United States Patent 7,745,391 (HUMAN THROMBOSPONDIN POLYPEPTIDE) - sequence listing, part 102

SEQ ID NO: 313866 - DNA, 3437 bp, Homo sapiens
cgagaggccggcgtctctcccccagtttgccgttcacccggagcgctcgggacttgccgatagtggtgacggcggcaacatgtctgtggctttcgcggccccgaggcagcgaggcaagggggagatcactcccgctgcgattcagaagatgttggatgacaataaccatcttattcagtgtataatggactctcagaataaaggaaagacctcagagtgttctcagtatcagcagatgttgcacacaaacttggtataccttgctacaatagcagattctaatcaaaatatgcagtctcttttaccagcaccacccacacagaatatgcctatgggtcctggagggatgaatcagagcggccctcccccacctccacgctctcacaacatgccttcagatggaatggtaggtgggggtcctcctgcaccgcacatgcagaaccagatgaacggccagatgcctgggcctaaccatatgcctatgcagggacctggacccaatcaactcaatatgacaaacagttccatgaatatgccttcaagtagccatggatccatgggaggttacaaccattctgtgccatcatcacagagcatgccagtacagaatcagatgacaatgagtcagggacaaccaatgggaaactatggtcccagaccaaatatgagtatgcagccaaaccaaggtccaatgatgcatcagcagcctccttctcagcaatacaatatgccacagggaggcggacagcattaccaaggacagcagccacctatgggaatgatgggtcaagttaaccaaggcaatcatatgatgggtcagagacagattcctccctatagacctcctcaacagggcccaccacagcagtactcaggccaggaagactattacggggaccaatacagtcatggtggacaaggtcctccagaaggcatgaaccagcaatattaccctgatggtcataatgattacggttatcagcaaccgtcgtatcctgaacaaggctacgataggccttatgaggattcctcacaacattactacgaaggaggaaattcacagtatggccaacagcaagatgcataccagggaccacctccacaacagggatatccaccccagcagcagcagtacccagggcagcaaggttacccaggacagcagcagggctacggtccttcacagggtggtccaggtcctcagtatcctaactacccacagggacaaggtcagcagtatggaggatatagaccaacacagcctggaccaccacagccaccccagcagaggccttatggatatgaccagggacagtatggaaattaccagcagtgaaaaagtacttacattccagtagccagtatctattagcagccatattgtcacctcagcactgtggacacctccctgtgaagagatccttccattccatctagtttttggaaaaaccttgtggataagtggctgtttcatcagtaagcagcctttgtggtttagttataaaaggctttagtagctcaaaaatactcttgatttcacatttctactctagatggcaacattggacagaaaatgcaatgacataaccaatttgtaatgattttggaactgtgtttcaaatggactgttacagactgaaaggtgtgaacagctttgtatgtttatgaagggtaagggaatttaatacttttccacagatttttttgtaaggggaagagggaaatgtacactttttacagcagcaatattttgtatattatgtttatttcatgtggtgaatatgcaaggcggtacactacgcactggacagcatcagaaatcctctgttaatgtggactggagcatggtagatgcttgattgttttggtctcaaaatggtgtgctataaagataaaggtgaggggaagacaaagcacaccatatgtccactgttctgttctcatagaggaaattcaaatcccttttatctattagataatcaagggcactgtgatacagttttgagtaaaaagacattttttaaaagccttccagttttgtggattaaacctttttataaagatcatttataatactgttttaaaatgtgaggcaataagaattactttgtgttggatctgaggaggctttggtaaaacagtttcatctaaatgaaagtggtaatcctcttctaaaatagcaataactgaaaatgaaagtgttaattttaccttgtttgagttatcagggaacttagtaagtaatatcaaagcattttataaatgatatcaaagaagagtcaacattgatccagtcattttattttgtaatattgagggataattggttattaaactgaatagttcaggagactttacaaacctttgtttcaactttcttatctggaaataatatcatttataaagggacacttttatgtttttcccttttttatgttggttgatataacacaaagagatatttaggaaaatgcttattgatgaggtttattctatctgtttttaaagcaccgaggttgcattctagataaccttgtttattagcatggcatattttaatcattatttgagactgtcctgtgcctgattattttagctaaattcagggagattgcgtggggcaggaaagcatgcattgaaaaatttctaaccacggttatttaagcataatctgaaaacatctagcccaaaggtaagttgctattttcatcacagttgcctatgcccagggaataagatgtattctttataattgaattggtttttcccacgtctaactggaaacaaaacagaaggggcgtcataaatttgaataagcagaacatactgttctcaacatactgtaatcaaaaggaggaatttcagtgggtctctgtgtgtgtatgagagagagagtgtgtgtttgtgtgtttcaaggtcagaacaggtttttttgtttttgttttttgttctttgtttttttttttgagatggagtcttgctcttgtcgcccaggctggagtgcagtggcgcaatctcagctcactgcaacctccgcctcccaggttcaagcagttctcctgcctcagcctcctgagtagctgggatgacaggcacccgccaccacacccagctaatttttgtacttttagtagagacgaggtttcgccatgttggccaggctggtctcgaactcctgacctcaggtgatccacccgcctcggccttccaaagtgctgggattacaggcgtgagccaccgtgcctggccagaataggttttttctttcaacttgatcagtagaaaatggacatcaagtttgaacagataaatcatggacagccttattgtgattgaaatgcttgtaggttctgtgccaattttccaccactgtgtactttgttgctatttaaaactgtatcaactctaacggaagaataaattatttgtgattttaa

SEQ ID NO: 313867 - DNA, 2763 bp, Homo sapiens
cgagaggccggcgtctctcccccagtttgccgttcacccggagcgctcgggacttgccgatagtggtgacggcggcaacatgtctgtggctttcgcggccccgaggcagcgaggcaagggggagatcactcccgctgcgattcagaagatgttggatgacaataaccatcttattcagtgtataatggactctcagaataaaggaaagacctcagagtgttctcagtatcagcagatgttgcacacaaacttggtataccttgctacaatagcagattctaatcaaaatatgcagtctcttttaccagcaccacccacacagaatatgcctatgggtcctggagggatgaatcagagcggccctcccccacctccacgctctcacaacatgccttcagatggaatggtaggtgggggtcctcctgcaccgcacatgcagaaccagatgaacggccagatgcctgggcctaaccatatgcctatgcagggacctggacccaatcaactcaatatgacaaacagttccatgaatatgccttcaagtagccatggatccatgggaggttacaaccattctgtgccatcatcacagagcatgccagtacagaatcagatgacaatgagtcagggacaaccaatgggaaactatggtcccagaccaaatatgagtatgcagccaaaccaaggtccaatgatgcatcagcagcctccttctcagcaatacaatatgccacagggaggcggacagcattaccaaggacagcagccacctatgggaatgatgggtcaagttaaccaaggcaatcatatgatgggtcagagacagattcctccctatagacctcctcaacagggcccaccacagcagtactcaggccaggaagactattacggggaccaatacagtcatggtggacaaggtcctccagaaggcatgaaccagcaatattaccctgatggtcataatgattacggttatcagcaaccgtcgtatcctgaacaaggctacgataggccttatgaggattcctcacaacattactacgaaggaggaaattcacagtatggccaacagcaagatgcataccagggaccacctccacaacagggatatccaccccagcagcagcagtacccagggcagcaaggttacccaggacagcagcagggctacggtccttcacagggtggtccaggtcctcagtatcctaactacccacagggacaaggtcagcagtatggaggatatagaccaacacagcctggaccaccacagccaccccagcagaggccttatggatatgaccagggacagtatggaaattaccagcagtgaaaaagtacttacattccagtagccagtatctattagcagccatattgtcacctcagcactgtggacacctccctgtgaagagatccttccattccatctagtttttggaaaaaccttgtggataagtggctgtttcatcagtaagcagcctttgtggtttagttataaaaggctttagtagctcaaaaatactcttgatttcacatttctactctagatggcaacattggacagaaaatgcaatgacataaccaatttgtaatgattttggaactgtgtttcaaatggactgttacagactgaaaggtgtgaacagctttgtatgtttatgaagggtaagggaatttaatacttttccacagatttttttgtaaggggaagagggaaatgtacactttttacagcagcaatattttgtatattatgtttatttcatgtggtgaatatgcaaggcggtacactacgcactggacagcatcagaaatcctctgttaatgtggactggagcatggtagatgcttgattgttttggtctcaaaatggtgtgctataaagataaaggtgaggggaagacaaagcacaccatatgtccactgttctgttctcatagaggaaattcaaatcccttttatctattagataatcaagggcactgtgatacagttttgagtaaaaagacattttttaaaagccttccagttttgtggattaaacctttttataaagatcatttataatactgttttaaaatgtgaggcaataagaattactttgtgttggatctgaggaggctttggtaaaacagtttcatctaaatgaaagtggtaatcctcttctaaaatagcaataactgaaaatgaaagtgttaattttaccttgtttgagttatcagggaacttagtaagtaatatcaaagcattttataaatgatatcaaagaagagtcaacattgatccagtcattttattttgtaatattgagggataattggttattaaactgaatagttcaggagactttacaaacctttgtttcaactttcttatctggaaataatatcatttataaagggacacttttatgtttttcccttttttatgttggttgatataacacaaagagatatttaggaaaatgcttattgatgaggtttattctatctgtttttaaagcaccgaggttgcattctagataaccttgtttattagcatggcatattttaatcattatttgagactgtcctgtgccttagataatcaagggcactgtgatacagttttgagtaaaaagacattttttaaaagccttccagttttgtggattaaacctttttataaagatcatttataatactgttttaaaatgtgaggcaataagaattactttgtgttggatctgaggaggctttggtaaaacagtttcatcta

SEQ ID NO: 313868 - DNA, 3050 bp, Homo sapiens
ccttctacaggaatgaaaattcttgcataagacaacttctacccatgcaaagctcttgtagaatactagttgctggctttcttgaaagttgcagggagcccaaaacaatcaaaataatttccttacaaatatttaaaatgtataaccatgacttgccatttctaacaataataaaaagactaaaacattaaagataattttttcctcagtggaaattttctatttgaacataaatccatcaaacttttttttctcgtgtgtgtttacatatgtataattttacatataagtatagtgcctttaggaaacagcttgctgatctcgtgtagctagtgtgtgctcttgtagctgtctttaattttgtcttttttattttatttagcatagtcatgatcttatgactgtgatgttccagtaaatgtaatgctcgtatggcagagacgctgaaaatgctgcagttcaaccttgcaaaattggctttaactgcagtttgtttggccgaaatccttctgtttggtttgagttttttctttgttttgttaacttctaaaaatcaatatggcatttcattttgttcttgtgttgttggctatgcatcttagagggaaaaaagttacttaagcagacttctcagttttttttcctcttctccaattatcctgtaggaaattcacagtatggccaacagcaagatgcataccagggaccacctccacaacagggatatccaccccagcagcagcagtacccagggcagcaaggttacccaggacagcagcagggctacggtccttcacagggtggtccaggtcctcagtatcctaactacccacagggacaaggtcagcagtatggaggatatagaccaacacagcctggaccaccacagccaccccagcagaggccttatggatatgaccagggacagtatggaaattaccagcagtgaaaaagtacttacattccagtagccagtatctattagcagccatattgtcacctcagcactgtggacacctccctgtgaagagatccttccattccatctagtttttggaaaaaccttgtggataagtggctgtttcatcagtaagcagcctttgtggtttagttataaaaggctttagtagctcaaaaatactcttgatttcacatttctactctagatggcaacattggacagaaaatgcaatgacataaccaatttgtaatgattttggaactgtgtttcaaatggactgttacagactgaaaggtgtgaacagctttgtatgtttatgaagggtaagggaatttaatacttttccacagatttttttgtaaggggaagagggaaatgtacactttttacagcagcaatattttgtatattatgtttatttcatgtggtgaatatgcaaggcggtacactacgcactggacagcatcagaaatcctctgttaatgtggactggagcatggtagatgcttgattgttttggtctcaaaatggtgtgctataaagataaaggtgaggggaagacaaagcacaccatatgtccactgttctgttctcatagaggaaattcaaatcccttttatctattagataatcaagggcactgtgatacagttttgagtaaaaagacattttttaaaagccttccagttttgtggattaaacctttttataaagatcatttataatactgttttaaaatgtgaggcaataagaattactttgtgttggatctgaggaggctttggtaaaacagtttcatctaaatgaaagtggtaatcctcttctaaaatagcaataactgaaaatgaaagtgttaattttaccttgtttgagttatcagggaacttagtaagtaatatcaaagcattttataaatgatatcaaagaagagtcaacattgatccagtcattttattttgtaatattgagggataattggttattaaactgaatagttcaggagactttacaaacctttgtttcaactttcttatctggaaataatatcatttataaagggacacttttatgtttttcccttttttatgttggttgatataacacaaagagatatttaggaaaatgcttattgatgaggtttattctatctgtttttaaagcaccgaggttgcattctagataaccttgtttattagcatggcatattttaatcattatttgagactgtcctgtgcctgattattttagctaaattcagggagattgcgtggggcaggaaagcatgcattgaaaaatttctaaccacggttatttaagcataatctgaaaacatctagcccaaaggtaagttgctattttcatcacagttgcctatgcccagggaataagatgtattctttataattgaattggtttttcccacgtctaactggaaacaaaacagaaggggcgtcataaatttgaataagcagaacatactgttctcaacatactgtaatcaaaaggaggaatttcagtgggtctctgtgtgtgtatgagagagagagtgtgtgtttgtgtgtttcaaggtcagaacaggtttttttgtttttgttttttgttctttgtttttttttttgagatggagtcttgctcttgtcgcccaggctggagtgcagtggcgcaatctcagctcactgcaacctccgcctcccaggttcaagcagttctcctgcctcagcctcctgagtagctgggatgacaggcacccgccaccacacccagctaatttttgtacttttagtagagacgaggtttcgccatgttggccaggctggtctcgaactcctgacctcaggtgatccacccgcctcggccttccaaagtgctgggattacaggcgtgagccaccgtgcctggccagaataggttttttctttcaacttgatcagtagaaaatggacatcaagtttgaacagataaatcatggacagccttattgtgattgaaatgcttgtaggttctgtgccaattttccaccactgtgtactttgttgctatttaaaactgtatcaactctaacggaagaataaattatttgtgattttaa

SEQ ID NO: 313869 - DNA, 488 bp, Homo sapiens
tacggggaccaatacagtcatggtggacaaggtcctccagaaggcatgaaccagcaatattaccctgatggtaatctctcctgatgttaactttcccattttctatccctgcctaatattaatgtagagagttatttaaaacatttcagtgaggacgaagaaactaacaatttgtttcctctaaattttgaaacacttcagtactctaaagtaccaatgatagcattagtttataatctaattcaaagtatattttaggtgttccattagtaccatcaggaatcacagtctgtcattggaatccttatgtaaaaggatctttttgtaatatgtttagggttgtttgatttcagccaaagcttatgtttattgatttacttttttttaataagagcttcattaagatataattcacctgccataaagttcacccattagttgacttgtattaattgtacaaatacatagagtatatagttctcaagtta

SEQ ID NO: 313870 - DNA, 397 bp, Homo sapiens
ctcatttgctaatccctagcatattttggactatgaaattcatttgcaattgaatataatatcagaagaaattacagggtgatactgtatacctaacgatataaaaaaattttgtttattgtaggtacggctgcttttttgtggtatgacagtgttagaaatgattcgtttgtaatcttctttgcctgttatggtcaaactattatctaattatatttttaaatttatcttttagggacagtatggaaattaccagcagtgaaaaagtacttacattccagtagccagtatctattagcagccatattgtcacctcagcactgtggacacctccctgtgaagagatccttccattccatctagtttttggaaaaaccttgtggataagtggctgttt

SEQ ID NO: 313871 - DNA, 2985 bp, Homo sapiens
  misc_feature (1411)..(1411): n is a, c, g, or t
  misc_feature (1416)..(1416): n is a, c, g, or t
  misc_feature (1422)..(1423): n is a, c, g, or t
  misc_feature (1433)..(1433): n is a, c, g, or t
  misc_feature (1436)..(1436): n is a, c, g, or t
  misc_feature (1440)..(1440): n is a, c, g, or t
cgagaggccggcgtctctcccccagtttgccgttcacccggagcgctcgggacttgccgatagtggtgacggcggcaacatgtctgtggctttcgcggccccgaggcagcgaggcaagggggagatcactcccgctgcgattcagaagatgttggatgacaataaccatcttattcagtgtataatggactctcagaataaaggaaagacctcagagtgttctcagtatcagcagatgttgcacacaaacttggtataccttgctacaatagcagattctaatcaaaatatgcagtctcttttaccagcaccacccacacagaatatgcctatgggtcctggagggatgaatcagagcggccctcccccacctccacgctctcacaacatgccttcagatggaatggtaggtgggggtcctcctgcaccgcacatgcagaaccagatgaacggccagatgcctgggcctaaccatatgcctatgcagggacctggacccaatcaactcaatatgacaaacagttccatgaatatgccttcaagtagccatggatccatgggaggttacaaccattctgtgccatcatcacagagcatgccagtacagaatcagatgacaatgagtcagggacaaccaatgggaaactatggtcccagaccaaatatgagtatgcagccaaaccaaggtccaatgatgcatcagcagcctccttctcagcaatacaatatgccacagggaggcggacagcattaccaaggacagcagccacctatgggaatgatgggtcaagttaaccaaggcaatcatatgatgggtcagagacagattcctccctatagacctcctcaacagggcccaccacagcagtactcaggccaggaagactattacggggaccaatacagtcatggtggacaaggtcctccagaaggcatgaaccagcaatattaccctgatggtcataatgattacggttatcagcaaccgtcgtatcctgaacaaggctacgataggccttatgaggattcctcacaacattactacgaaggaggaaattcacagtatggccaacagcaagatgcataccagggaccacctccacaacagggatatccaccccagcagcagcagtacccagggcagcaaggttacccaggacagcagcagggctacggtccttcacagggtggtccaggtcctcagtatcctaactacccacagggacaaggtcagcagtatggaggatatagaccaacacagcctggaccaccacagccaccccagcagaggccttatggatatgaccagatcatgcccaagaagccagcagaggaaggaaatgattcggaggaagtgccagaagcatctggcccacaaaatgatgggaaagagctgtgccccccgggaaanccaantacctnngagaagattnacnaganatctggacccaaaagggggaaacatgcctggacccacagactgcgtgagagaaagcagctggtggtttatgaagagatcagcgaccctgaggaagatgacgagtaactcccctcggggatatgacacatgcccatgatgagaagcagaacgtggtgacctttcacgaacatgggcatggctgcggacccctcgtcatcaggtgcatagcaagtgaaagcaagtgttcacaacagtgaaaagttgagcgtcatttttcttagtgtgccaagagttcgatgttggcgtttccgctgtattttcttgcagtgtgccattctgttagacattagcgtttttcgttgatgagcaagacatgcttaatgcatatttcggcttgtgtatccatgcacctacctcagaaaacaagtattgtcaggtattctctccatagaacagcactaccctcctctctccccagatgtgactactgaggggaggtctgagtgtttaatttccgatttttcctctgcatttacacacacaccacacacgcacacacacacaccaagtaccagtataagccatctcccatctgcttttctccattgccatgcgacctggtcaagcccccctcactctgtttcctgttcagcatgtactcccctcatccgattccgttgtatcagtcactgacagttaataaacctttgcaaacgttcaaaaaaaaaaaaaaaaaatcatgcccaagaagccagcagaggaagaaaatggtttgaaggaagtgccagaggcatctggcccacaaaatgatgggaaacagctgtgccccccgggaaatccaagtaccttggagaagattaacaagacatctggacccaaaagggggaaacatgcctggacccacagactgcgtgagagaaagcagctggtggtttatgaagagatcagcgaccctgaggaagatgacgagtaactcccctcggggatatgacacatgcccatgatgagaagcagaacgtggtgacctttcacgaacatgggcatggctgcggacccctcgtcatcaggtgcatagcaggtgaaagcaagtgttcacaacagtgaaaagttgagcgtcatttttcttagtgtgccaagagttcgatgttggcgtttccgctgtattttcttgcagtgtgccattctgttagacattagcgtttttcgttgatgagcaagacatgcttaatgcatatttcggcttgtgtatccatgcacctacctcagaaaacaagtattgtcaggtattctctccatagaacagcactaccctcctctctccccagatgtgactactgaggggaggtctgagtgtttaatttccgatttttcctctgcatttacacacacaccacacacgcacacacacacaccaagtaccagtataagccatctcccatctgcttttctccattgccatgcgacctggtcaagcccccctcactctgtttcctgttcagcatgtactcccctatccgattccgttgtatcagtcactgacagttaataaacctttgcaaacgttc

SEQ ID NO: 313872 - DNA, 3408 bp, Homo sapiens
cgagaggccggcgtctctcccccagtttgccgttcacccggagcgctcgggacttgccgatagtggtgacggcggcaacatgtctgtggctttcgcggccccgaggcagcgaggcaagggggagatcactcccgctgcgattcagaagatgttggatgacaataaccatcttattcagtgtataatggactctcagaataaaggaaagacctcagagtgttctcagtatcagcagatgttgcacacaaacttggtataccttgctacaatagcagattctaatcaaaatatgcagtctcttttaccagcagtgtgattcaagtaaggtgaaggaacacatgcttagagctgtggaacattttgaagattagcagccacccacacagaatatgcctatgggtcctggagggatgaatcagagcggccctcccccacctccacgctctcacaacatgccttcagatggaatggtaggtgggggtcctcctgcaccgcacatgcagaaccagatgaacggccagatgcctgggcctaaccatatgcctatgcagggacctggacccaatcaactcaatatgacaaacagttccatgaatatgccttcaagtagccatggatccatgggaggttacaaccattctgtgccatcatcacagagcatgccagtacagaatcagatgacaatgagtcagggacaaccaatgggaaactatggtcccagaccaaatatgagtatgcagccaaaccaaggtccaatgatgcatcagcagcctccttctcagcaatacaatatgccacagggaggcggacagcattaccaaggacagcagccacctatgggaatgatgggtcaagttaaccaaggcaatcatatgatgggtcagagacagattcctccctatagacctcctcaacagggcccaccacagcagtactcaggccaggaagactattacggggaccaatacagtcatggtggacaaggtcctccagaaggcatgaaccagcaatattaccctgatggaaattcacagtatggccaacagcaagatgcataccagggaccacctccacaacagggatatccaccccagcagcagcagtacccagggcagcaaggttacccaggacagcagcagggctacggtccttcacagggtggtccaggtcctcagtatcctaactacccacagggacaaggtcagcagtatggaggatatagaccaacacagcctggaccaccacagccaccccagcagaggccttatggatatgaccagggacagtatggaaattaccagcagtgaaaaagtacttacattccagtagccagtatctattagcagccatattgtcacctcagcactgtggacacctccctgtgaagagatccttccattccatctagtttttggaaaaaccttgtggataagtggctgtttcatcagtaagcagcctttgtggtttagttataaaaggctttagtagctcaaaaatactcttgatttcacatttctactctagatggcaacattggacagaaaatgcaatgacataaccaatttgtaatgattttggaactgtgtttcaaatggactgttacagactgaaaggtgtgaacagctttgtatgtttatgaagggtaagggaatttaatacttttccacagatttttttgtaaggggaagagggaaatgtacactttttacagcagcaatattttgtatattatgtttatttcatgtggtgaatatgcaaggcggtacactacgcactggacagcatcagaaatcctctgttaatgtggactggagcatggtagatgcttgattgttttggtctcaaaatggtgtgctataaagataaaggtgaggggaagacaaagcacaccatatgtccactgttctgttctcatagaggaaattcaaatcccttttatctattagataatcaagggcactgtgatacagttttgagtaaaaagacattttttaaaagccttccagttttgtggattaaacctttttataaagatcatttataatactgttttaaaatgtgaggcaataagaattactttgtgttggatctgaggaggctttggtaaaacagtttcatctaaatgaaagtggtaatcctcttctaaaatagcaataactgaaaatgaaagtgttaattttaccttgtttgagttatcagggaacttagtaagtaatatcaaagcattttataaatgatatcaaagaagagtcaacattgatccagtcattttattttgtaatattgagggataattggttattaaactgaatagttcaggagactttacaaacctttgtttcaactttcttatctggaaataatatcatttataaagggacacttttatgtttttcccttttttatgttggttgatataacacaaagagatatttaggaaaatgcttattgatgaggtttattctatctgtttttaaagcaccgaggttgcattctagataaccttgtttattagcatggcatattttaatcattatttgagactgtcctgtgcctgattattttagctaaattcagggagattgcgtggggcaggaaagcatgcattgaaaaatttctaaccacggttatttaagcataatctgaaaacatctagcccaaaggtaagttgctattttcatcacagttgcctatgcccagggaataagatgtattctttataattgaattggtttttcccacgtctaactggaaacaaaacagaaggggcgtcataaatttgaataagcagaacatactgttctcaacatactgtaatcaaaaggaggaatttcagtgggtctctgtgtgtgtatgagagagagagtgtgtgtttgtgtgtttcaaggtcagaacaggtttttttgtttttgttttttgttctttgtttttttttttgagatggagtcttgctcttgtcgcccaggctggagtgcagtggcgcaatctcagctcactgcaacctccgcctcccaggttcaagcagttctcctgcctcagcctcctgagtagctgggatgacaggcacccgccaccacacccagctaatttttgtacttttagtagagacgaggtttcgccatgttggccaggctggtctcgaactcctgacctcaggtgatccacccgcctcggccttccaaagtgctgggattacaggcgtgagccaccgtgcctggccagaataggttttttctttcaacttgatcagtagaaaatggacatcaagtttgaacagataaatcatggacagccttattgtgattgaaatgcttgtaggttctgtgccaattttccaccactgtgtactttgttgctatttaaaactgtatcaactctaacggaagaataaattatttgtgattttaa

SEQ ID NO: 313873 - DNA, 1451 bp, Homo sapiens
cgagaggccggcgtctctcccccagtttgccgttcacccggagcgctcgggacttgccgatagtggtgacggcggcaacatgtctgtggctttcgcggccccgaggcagcgaggcaagggggagatcactcccgctgcgattcagaagatgttggatgacaataaccatcttattcagtgtataatggactctcagaataaaggaaagacctcagagtgttctcagtatcagcagatgttgcacacaaacttggtataccttgctacaatagcagattctaatcaaaatatgcagtctcttttaccagcaccacccacacagaatatgcctatgggtcctggagggatgaatcagagcggccctcccccacctccacgctctcacaacatgccttcagatggaatggtaggtgggggtcctcctgcaccgcacatgcagaaccagatgaacggccagatgcctgggcctaaccatatgcctatgcagggacctggacccaatcaactcaatatgacaaacagttccatgaatatgccttcaagtagccatggatccatgggaggttacaaccattctgtgccatcatcacagagcatgccagtacagaatcagatgacaatgagtcagggacaaccaatgggaaactatggtcccagaccaaatatgagtatgcagccaaaccaaggtccaatgatgcatcagcagcctccttctcagcaatacaatatgccacagggaggcggacagcattaccaaggacagcagccacctatgggaatgatgggtcaagttaaccaaggcaatcatatgatgggtcagagacagattcctccctatagacctcctcaacagggcccaccacagcagtactcaggccaggaagactattacggggaccaatacagtcatggtggacaaggtcctccagaaggcatgaaccagcaatattaccctgatggaaattcacagtatggccaacagcaagatgcataccagggaccacctccacaacagggatatccaccccagcagcagcagtacccagggcagcaaggttacccaggacagcagcagggctacggtccttcacagggtggtccaggtcctcagtatcctaactacccacagggacaaggtcagcagtatggaggatatagaccaacacagcctggaccaccacagccaccccagcagaggccttatggatatgaccaggacccaaaagggggaaacatgcctggacccacagactgcgtgagagaaagcagctggtggtttatgaagagatcagcgaccctgaggaagatgacgagtaactcccctcggggatatgacacatgcccatgatgagaagcagaacgtggtgacctttcacgaacatgggcatggctgcggacccctcgtcatcaggtgcatagcaagtgaatctttcccgggggtaccgtcgact

SEQ ID NO: 313874 - DNA, 5497 bp, Homo sapiens
  misc_feature (1299)..(1299): n is a, c, g, or t
  misc_feature (5497)..(5497): n is a, c, g, or t
catgtgggcactagatctcattccccatcccctctctgctagaagtatccatacagagccgtaatcatcctttgctctctcctcatgagtatttcctgttctaatggaaactccatcaccatgtaaaaatgttaattcctatcacattgacctcatattgctctaggtgtctcatttttttttcttttctttacaggaagattccttgaaagaattgagtgtactggctttccttccactttcttcagcctaccccagttatgttttcacccacaccactcagctaaactagtcatgtcaagatcacccatgaccttcacattgctaaatccagggataaattttcagccctaatcttacttgaccatgagcagtagttgacatggtggattattccatcctctttgaaatactttgcttggtttctggaaccacacttttctggttttccttctatcacactgactgctcctttgtctcctttgctgatacttcctcatcaactggaaatcttggacagcccagggctaagctctatgatgtcttttacctacatttctttagtgatttcattcagcatcagatttttaaattccattcctttgccagtctttcctctaaattctagacccatgtatacaattgcctattcattatcactactaagatgtctaatggacttttcaaatgtaacctcccccaaaacttactcctcccatggtcttccctatctcaattaatagcttcttcgtctttcagtcccgagacccttcagcccagatcattttccttgactgttctttctctcttatatttcacatgcaaatgctgttgtctttatcttcaaaatatattcagaatcgaagcccttctcacacatcctctgccaccattttggtctgagacatcttcatctcttccctggattggtgcaacagcctcccaccttgtctccttgcttctgtggttgttcccttaaagcctgtgctcaggttagctgctgcatgaccctgttaagatgtgagctagtgcccaccactcctttactcaaaaccatccagtgacttctttttttcctctgaatggaaaccaaagtcctacagtggcctacatgacctcctatggtctattcttccacacgtccttacctagattttctcttgctgctcttccctcgctcattctcaccctgccgtacttactcccttgctgttctttgagtgttccagacagattacacaatcacctcagggctttggcactttgcagttccttctgctaggaacacttttccctcanatattctccttggtatacgtgtgtacatgtatgcacacatacacatgcacacatttgttctgtgtctctcctttccctctgttttctagtgctcttttatgtatttccagtactatttttgtttattgtcattctcccataattagacgataaactccatgagggcagggtttgagaatgttttgtgaactgttgtattctcagtgcctggagcagtactcaacatgagcagtggccagatgaattttgaatgaacgtctgctgcatactctctgctagagaaatgcggagatggtgaagccagtctctgcctatgaacagctctcatggaaaccataaattgaaacctgtagcagtaacactgcatataagtaaaagggcaacttggttatatgcatgcacaaggtgcaggtagcataaagggaggcgtaattaacaccaacttcaggacatccacacctggaagaatttttaaatggtgcctaacgtttgaccaaatggattacagggaagagaagggtatgttcagcagatggtatatagtgtgtgaaggctttgaggtatgacacagcattatgtgtaaggcaactcacacccacatcttaaaggacatgggcaaggagtgactggtaacaaatccaagggtcatatctagtgtgtcacgccaatgggcttggacttaatcctttctttctcctcctcttcccccggtcactattcaacttgcctcagtaagtatttattgagtatattctatgtgccaggcattgtgaggagcaaaaatagacaagggccttggctttgtggggcttaaagtctattgaaaggcagtcttgaatcaaataattaatgggtgccatcattgaatgttaagccagctcctgaagcatcaaagacatgactagagtccaaaatggaaacctcagagtttaagagtaggttattacaggggacctggaagatacagggctagtgtatatttctgtatttttaaccagataaatgcagtgcttctcttctccacattcctttcctcctcccatcctaacaatgcaactacaatagatcaggagtcccaaatccccgggtcacagatcagtactggtccatggcctgctaggggccacacagcagacggtgagtggcaggggagtgtgcaaagcttcatctgtatttacagtcactcctcatcactcacacattattgcctgagctcagcctcttgtcagatcagcagcggcattagattctcataggagcacaaactctactgtgaactctgcatgcgagggatctaggttacatgctccttaggacagtctaatgcctggtgttctttcactgtctcccatcaaccccataaaggaccatctagttgcaggaaaacaagctcagggatcccactgattctacattatggtgagttgtataatcacttcattatatattccagtgtaataataatagaaagaaagtacacaataaatgtaatgtgcctgaatcatctcaaaaccatctccccactcctaccaaaccggtccacggaaaagttgtctttaatgaaactggtccctggtgccaaaaaggttggggactgctgcaatagatagtatttgttggtttcaggattcttttagatttcttactatagtactttctttctagaccacacctactactacaaccatttctaatttatattgacttttggcaggggaggcaagggtaggaaggaaagttttataggaggacaagtctttttagtaagtgatcaagcaggctgggcttggtggctcctgcctgtaatcccagcactttgggaggccgaggcgggtggataatgaggtcaagtgttcgagaccggcttcgccaacatggtgaaacctcgtctctactaaagataagaaaattagctgggcatgttggcgggtgcctgcagtcccagctactcgaaaagctgaggcaggagaattgcttgaacccgggaggcagacgttgcagtgagccgagatcgtgccactgccctccagcctgggaaacagagtgagactctgtctcaaaaaaaaaaaaaaaaaaaaaaaagtgatcaggcaaagaactgaaaggagagagaatgaggaaaacaaaaactattataagtttcaaggtatgaaaagactttataatcaaggtcttctaaccaaatattcctaattagatttttttaattttccatatctttaagaaatatttttcagtttgtgacaggaaatagaccctttagcttggaccaaggctactaggcactggccaagtataaaaggcatagctctactctgctccatttagcttgtttctttatccttggctctgtcatttatcacaatttggaattgtcaacatgagcctgaacactaaaaaaaattctgctaacaaaggcactgtgttttccatgcctgagtcaacccactgccctttcctaaatgccaaagatggggaaatgggatggaatttcctggattactacttgtacttaaacctgagtaagttttgaatttggaagacacattccagccagagagggtggattttggacccatgttcgagtgtatcagccacccagattggttttatttaagaaacagataaacaaaatatcttaaagtatctgttatttctagccagaagtaacttccgtatggtttaattaatagacctgccttggctcatcttgacttacagagctggggttctatattctagccctgttctccccagttaacagtcctcagaggaagaaacgagtccataaggcagaatttaaaagctgtgtacaaatttaacatttttacccatggcaagacatctagagtaactgaattattgactgtctttgcttttggcaaggcaagacagcaatagaggatggaaattcaacaaaagtatcaggtgtgtatgtacatatgacattctaaaagggaaaaatgaattattccttaatcatctattaaataagctaagtttattttttaaaaacgtttaagcccaagaggagaaaatatgaaaggaaatgttagttatgcgaaaggttctaggtagtcaagaattcctttttcttttctgaaacccacttaaattcatttgcagcagccctagggggttgtcagaatcacattctggttaagtagtgtcagtgtgtcagatcaaagaagaaataaatcatcctcctcctcctcctgttgtgtgcaataaagtagcccattcaaaactggattcacagtaaccaactgtgtcatgtaaacaaagcaatcttcagattcaccttgtaggatggtgacaggtaaattaacaaggaagttgagaacaagaaggaaagctacctgggataaattcacggttttttttttttgtttttttgttttgttttgtttccttcagtgactttcaaaacgtcagcaatcagccctgaagtgtttggaatgcatactgaattgctacagggataaatataccattgccagaatcttctgtaggacagtcttactagaaatcagtaatcctgaggctgagcacagtggctgtcacctgtaatcccagcactttgggaggctgaggcaggcagatcacttgaggccaggagtttgagaccagcctggccaacatggtgatacctgtttctactaaaagtacaaaaattagctgggcacaatggtgggcacctgtaatcccagctactcaggaggctgaggcaggagaagcgcctgaacccaggaggcggagattgcagtaagccaagatcacaccattgcattctagcctgggtgacagagcaagactctatcttaaaaaaaaaaaaaaaaaaaaattgagcaaataaaaagttgtttatctcatggaaaccacgaggaaaatacacaagaaaaagtatagtaggctgggtgcagcagttcacacctgtaatcccagcactttaggaggctaagggaggaggactgcttgagctcagaagtttcagaccagcctgggcaacataatgaggccctgtttctactaaaaaaaaaaaaaaaaaattagctaggtgtggtggcatgcacctgtagtcccagctacttgggaggctgagccagggggatcacttgagcctgggaggttgaggctgcagtgagctatgattactacacccttgcactccagcctgggtgacagtgagatgctgtcn

SEQ ID NO: 313875 - DNA, 464 bp, Homo sapiens
atccaggcatttctacaaccccgcctgtggagttgcatgtttgcctgcatgctctgctttatctccaatgactatgttcccagcaagggccaacccaccatgtgggcactagatctcattccccatcccctctctgctagaagtatccatacagagccgtaatcatcctttgctctctcctcatgagtatttcctgttctaatggaaactccatcaccatgtaaaaatgttaattcctatcacattgacctcatattgctctaggtgtctcatttttttttcttttctttacaggaagattccttgaaagaattgagtgtactggctttccttccactttcttcagcctaccccagttatgttttcacccacaccactcagctaaactagtcatgtcaagatcacccatgaccttcacattgctaaatccagggataaattttcagccctaatcttacttgacc

SEQ ID NO: 313876 - DNA, 415 bp, Homo sapiens
gctgtcgctactactactaaattcgcggcccgtcgacgaccccacaagaatctatgatacagccttggctctctggatcccttctttgctcatgtctgcaggggaggctgctctatctggttactgctgtgtggctgcactcactctacgtggagttgggccctgcaggaaggacggacttcaggggcagctagaggaaatgacagagcttgaatctcctaaatgtaaaaggcaggaaaatgagcagctactggatcaaaatcaagaaatccgggcatcacagagaagttgggtttaggacagcaggtgctgttccgagactcagtcctaaagggttttttttcccactaagcaaggggccctgacctcgggatgagataacaaattgtaataaagtaacttctcttttcttcta

SEQ ID NO: 313877 - DNA, 671 bp, Homo sapiens
tggcgcggcggacgggatgaggcgctgcagtctctgcgctttcgagcgtttccgtgggacttgtggccctcctggcgtccaggaaccttcttcgccctccactgcactgggtcctgctggcactagctctggtgaacctgctcttgtccgttgcctgctccctgggcctccttcttgctgtgtcactcactgtggccaacggtggccgccgccttattgctgactgccacccaggactgctggatcctctggtaccactggatgaggggccgggacatactgactgcccctttgaccccacaagaatctatgatacagccttggctctctggatcccttctttgctcatgtctgcaggggaggctgctctatctggttactgctgtgtggctgcactcactctacgtggagttgggccctgcaggaaggacggacttcaggggcagctagaggaaatgacagagcttgaatctcctaaatgtaaaaggcaggaaaatgagcagctactggatcaaaatcaagaaatccgggcatcacagagaagttgggtttaggacagcaggtgctgttccgagactcagtcctaaagggttttttttcccactaagcaaggggccctgacctcgggatgagataacaaattgtaataaagtaacttctcttttcttcta

SEQ ID NO: 313878 - DNA, 1474 bp, Homo sapiens
ggcgtctcgtctccttaccctggggctacccttgccccgtcctactgcccgcggttaacccgccgcgagccgcctctcccctccccgcccgactcaaccctgccctcccccgtgctttgcagacgccgcccgggggcccaggcggctgatgcgtgtgggcctcgcgctgatcttggtgggccacgtgaacctgctgctgggggccgtgctgcatggcaccgtcctgcggcacgtggccaatccccgcggcgctgtcacgccggagtacaccgtagccaatgtcatctctgtcggctcggggctgctgagcgtttccgtgggacttgtggccctcctggcgtccaggaaccttcttcgccctccactgcactgggtcctgctggcactagctctggtgaacctgctcttgtccgttgcctgctccctgggcctccttcttgctgtgtcactcactgtggccaacggtggccgccgccttattgctgactgccacccaggactgctggatcctctggtaccactggatgaggggccgggacatactgactgcccctttgaccccacaagaatctatgatacagccttggctctctggatcccttctttgctcatgtctgcaggggaggctgctctatctggttactgctgtgtggctgcactcactctacgtggagttgggccctgcaggaaggacggacttcaggggcaggtaaggaaggcaaacaggaagggttcattccacagagactggctgtgttgaaaagatgctgaccggccgggtgcggaggctcacacctgtaatcccagcactttgggaggctgaggcaggcggatcacttgaggtcaggagtttgagaccagcttggacaacatggtgaaacctcgtctctactaaaaatacaaaaaattaggtggggtggtgggcgcctgtaatcccagctacttggaaggctgaggcaggagaatcgcttgaacccggaaggcggaggttgcagtgaaccgagatcacgccactgcactccagcctgggcaacagagtgaggctccgtcacaaaaaacaaaacaaaaaaaagatgctgacctatcattcagggcgagggtgtctaactctatcttcttctgcagctagaggaaatgacagagcttgaatctcctaaatgtaaaaggcaggaaaatgagcagctactggatcaaaatcaagaaatccgggcatcacagagaagttgggtttaggacaggtaatgggccttgaaggtggtggcccgggtaagagcggggacaaggaagtgctcttagaactgggtctaggtcttgccatgctgctttcccctctgacctgggttggttctcccctctgtccagcaggtgctgttccgagactcagtcctaaagggttttttttcccactaagcaaggggccctgacctcgggatgagataacaaattgtaataaagtaacttctcttttcttcta

SEQ ID NO: 313879 - DNA, 934 bp, Homo sapiens
ggcgtctcgtctccttaccctggggctacccttgccccgtcctactgcccgcggttaacccgccgcgagccgcctctcccctccccgcccgactcaaccctgccctcccccgtgctttgcagacgccgcccgggggcccaggcggctgatgcgtgtgggcctcgcgctgatcttggtgggccacgtgaacctgctgctgggggccgtgctgcatggcaccgtcctgcggcacgtggccaatccccgcggcgctgtcacgccggagtacaccgtagccaatgtcatctctgtcggctcggggctgctgagcgtttccgtgggacttgtggccctcctggcgtccaggaaccttcttcgccctccactgcactgggtcctgctggcactagctctggtgaacctgctcttgtccgttgcctgctccctgggcctccttcttgctgtgtcactcactgtggccaacggtggccgccgccttattgctgactgccacccaggactgctggatcctctggtaccactggatgaggggccgggacatactgactgcccctttgaccccacaagaatctatgatacagccttggctctctggatcccttctttgctcatgtctgcaggggaggctgctctatctggttactgctgtgtggctgcactcactctacgtggagttgggccctgcaggaaggacggacttcaggggcagctagaggaaatgacagagcttgaatctcctaaatgtaaaaggcaggaaaatgagcagctactggatcaaaatcaagaaatccgggcatcacagagaagttgggtttaggacagcaggtgctgttccgagactcagtcctaaagggttttttttcccactaagcaaggggccctgacctcgggatgagataacaaattgtaataaagtaacttctcttttcttcta

SEQ ID NO: 313880 - DNA, 1058 bp, Homo sapiens
ggcgtctcgtctccttaccctggggctacccttgccccgtcctactgcccgcggttaacccgccgcgagccgcctctcccctccccgcccgactcaaccctgccctcccccgtgctttgcagacgccgcccgggggcccaggcggctgatgcgtgtgggcctcgcgctgatcttggtgggccacgtgaacctgctgctgggggccgtgctgcatggcaccgtcctgcggcacgtggccaatccccgcggcgctgtcacgccggagtacaccgtagccaatgtcatctctgtcggctcggggctgctgagcgtttccgtgggacttgtggccctcctggcgtccaggaaccttcttcgccctccactgcactgggtcctgctggcactagctctggtgaacctgctcttgtccgttgcctgctccctgggcctccttcttgctgtgtcactcactgtggccaacggtggccgccgccttattgctgactgccacccaggactgctggatcctctggtaccactggatgaggggccgggacatactgactgcccctttgaccccacaagaatctatgatacagccttggctctctggatcccttctttgctcatgtctgcaggggaggctgctctatctggttactgctgtgtggctgcactcactctacgtggagttgggccctgcaggaaggacggacttcaggggcagctagaggaaatgacagagcttgaatctcctaaatgtaaaaggcaggaaaatgagcagctactggatcaaaatcaagaaatccgggcatcacagagaagttgggtttaggacaggtaatgggccttgaaggtggtggcccgggtaagagcggggacaaggaagtgctcttagaactgggtctaggtcttgccatgctgctttcccctctgacctgggttggttctcccctctgtccagcaggtgctgttccgagactcagtcctaaagggttttttttcccactaagcaaggggccctgacctcgggatgagataacaaattgtaataaagtaacttctcttttcttcta

SEQ ID NO: 313881 - DNA, 1151 bp, Homo sapiens
aacggcattccccaggagacaagaaaggaggatagaaaaacgacttaggaatctccttggagctcaagaccaggaacttccccaagccggaggtccctgaggcgctctagcgcgctggccgcactcgcagcccaggtcgccagtgcgcacgcgcaagattaggtggggcgccagagccggggcacctgcgcaggcttggctgcgccctctcgcgccgcacgctctgcgggttcctcccttcttccgagcctctcctctggccgccgcgcgggagagaggccgagatggcagatgagattgccaaggctcaggtcgctcggcctggtggcgacacgatctttgggaagatcatccgcaaggaaataccagccaaaatcatttttgaggatgaccggtgccttgctttccatgacatttcccctcaagcaccaacacattttctggtgatacccaagaaacatatatcccagatttctgtggcagaagatgatgatgaaagtcttcttggacacttaatgattgttggcaagaaatgtgctgctgatctgggcctgaataagggttatcgaatggtggtgaatgaaggttcagatggtggacagtctgtctatcacgttcatctccatgttcttggaggtcggcaaatgcattggcctcctggttaagcacgttttggggataattttctcttctttaggcaatgattaagttaggcaatttccagtatgttaagtaacacacttatttttgcctgtgtatggagagattcaagaaataattttaaaaccgcatacataataaaagacattgttgcatggcttatagtctctctgagtgttgcgtttgatttgttattttaaaaacatatttgttggaatatgtgaaggtgggtttataattttggatgtttcttgctttttcttcccaaggaggactcaacatatgaacatcgcattgttttaatggtgttactagtctttgaagacaaataatgagagtttataaatttagctttaacttcgaaatatctttccaggctaaaataggtccaacttagatttttaagctaattctcacattttctaagaacataggaaattgaccattttgggtttagaaacagtgctttatgttcagcccacattgcccct

SEQ ID NO: 313882 - DNA, 888 bp, Homo sapiens
  misc_feature (843)..(845): n is a, c, g, or t
  misc_feature (881)..(881): n is a, c, g, or t
aacggcattccccaggagacaagaaaggaggatagaaaaacgacttaggaatctccttggagctcaagaccaggaacttccccaagccggaggtccctgaggcgctctagcgcgctggccgcactcgcagcccaggtcgccagtgcgcacgcgcaagattaggtggggcgccagagccggggcacctgcgcaggcttggctgcgccctctcgcgccgcacgctctgcgggttcctcccttcttccgagcctctcctctggccgccgcgcgggagagaggccgagatggcagatgagattgccaaggctcaggtcgctcggcctggtggcgacacgatctttgggaagatcatccgcaaggaaataccagccaaaatcatttttgaggatgaccggtgccttgctttccatgacatttcccctcaagcaccaacacattttctggtgatacccaagaaacatatatcccagatttctgtggcagaagatgatgatgaaagtcttcttggacacttaatgattgttggcaagaaatgtgctgctgatctgggcctgaataagggttatcgaatggtggtgaatgaaggttcagatggtggacagtctgtctatcacgttcatctccatgttcttggaggtcggcaaatgcattggcctcctggttaagcacgttttggggataattttctcttctttaggcaatgattaagttaggcaatttccagtatgttaagtaacacacttatttttgcctgtgtatggagagattcaagaaataattttaaaaccgcatacataataaaagacattgttgcatggctatagtcaaaaaaaaaacacaccnnnaaaaaaaagcggccgctcgaattgtcgaacgcggcntcgaatt

SEQ ID NO: 313883 - DNA, 655 bp, Homo sapiens
gaattcccgtgatagacagactgtccaccatctgaaccttcattcaccaccattcgataatgcgggttcctcccttcttccgagcctctcctctggccgccgcgcgggagagaggccgagatggcagatgagattgccaaggctcaggtcgctcggcctggtggcgacacgatctttgggaagatcatccgcaaggaaataccagccaaaatcatttttgaggatgaccggtgccttgctttccatgacatttcccctcaagcaccaacacattttctggtgatacccaagaaacatatatcccagatttctgtggcagaagatgatgatgaaagtcttcttggacacttaatgattgttggcaagaaatgtgctgctgatctgggcctgaataagggttatcgaatggtggtgaatgaaggttcagatggtggacagtctgtctatcacgttcatctccatgttcttggaggtcggcaaatgcattggcctcctggttaagcacgttttggggataattttctcttctttaggcaatgattaagttaggcaatttccagtatgttaagtaacacacttatttttgcctgtgtatggagagattcaagaaataattttaaaaccgcatacataataaaagacattgttgcatggc

SEQ ID NO: 313884 - DNA, 447 bp, Homo sapiens
agattctgtttcttgggtatcaccagaaatctgggatatatgtttcttgggtatcaccaacacattttctggtgatacccaagaaacatatatcccagatttctgtggcagaagatgatgatgaaagtcttcttggacacttaatgattgttggcaagaaatgtgctgctgatctgggcctgaataagggttatcgaatggtggtgaatgaaggttcagatggtggacagtctgtctatcacgttcatctccatgttcttggaggtcggcaaatgcattggcctcctggttaagcacgttttggggataattttctcttctttaggcaatgattaagttaggcaatttccagtatgttaagtaacacacttatttttgcctgtgtatggagagattcaagaaataattttaaaaccgcatacataataaaagacattgttgcatggc

SEQ ID NO: 313885 - DNA, 641 bp, Homo sapiens
  misc_feature (52)..(52): n is a, c, g, or t
  misc_feature (78)..(78): n is a, c, g, or t
gagacagtcttgctgtattgcccaggctggagtgtggtggcacaatcacagntcattgcatcttcaatcacccaggcntaagcaatcctccccaccttgtagctgggactacagctcacagcacacctggctaaaattttttttttgttgagacggattctctatgttgcccaggctggtctcaggctcctgggctcagatggtcctcctgcctcagcttccaaaggcacaggccaagttgtagctttgtcccttgccatcatgcccaacaagaggttctataccttttaatgaattgactttcataaaaggtatagaacctcttcttggacacttaatgattgttggcaagaaatgtgctgctgatctgggcctgaataagggttatcgaatggtggtgaatgaaggttcagatggtggacagtctgtctatcacgttcatctccatgttcttggaggtcggcaaatgcattggcctcctggttaagcacgttttggggataattttctcttctttaggcaatgattaagttaggcaatttccagtatgttaagtaacacacttatttttgcctgtgtatggagagattcaagaaataattttaaaaccgcatacataataaaagacattgttgcatggc

SEQ ID NO: 313886 - DNA, 296 bp, Homo sapiens
cgcggccgcgcgactacgctgcgagagacgacagaagggttatcgaatggtggtgaatgaaggttcagatggtggacagtctgtctatcacgttcatctccatgttcttggaggtcggcaaatgcattggcctcctggttaagcacgttttggggataattttctcttctttaggcaatgattaagttaggcaatttccagtatgttaagtaacacacttatttttgcctgtgtatggagagattcaagaaataattttaaaaccgcatacataataaaagacattgttgcatggc

SEQ ID NO: 313887 - DNA, 1185 bp, Homo sapiens
aacggcattccccaggagacaagaaaggaggatagaaaaacgacttaggaatctccttggagctcaagaccaggaacttccccaagccggaggtccctgaggcgctctagcgcgctggccgcactcgcagcccaggtcgccagtgcgcacgcgcaagattaggtggggcgccagagccggggcacctgcgcaggcttggctgcgccctctcgcgccgcacgctctgcgggttcctcccttcttccgagcctctcctctggccgccgcgcgggagagaggccgagatggcagatgagattgccaaggctcaggtcgctcggcctggtggcgacacgatctttgggaagatcatccgcaaggaaataccagccaaaatcatttttgaggatgaccggtgccttgctttccatgacatttcccctcaagcaccaacacattttctggtgatacccaagaaacatatatcccagatttctgtggcagaagatgatgatgaaagtcttcttggacacttaatgattgttggcaagaaatgtgctgctgatctgggcctgaataagggttatcgaatggtggtgaatgaaggttcagatggtggacagtctgtctatcacgttcatctccatgttcttggaggtcggcaaatgcattggcctcctggttaagcacgttttggggataattttctcttctttaggcaatgattaagttaggcaatttccagtatgttaagtaacacacttatttttgcctgtgtatggagagattcaagaaataattttaaaaccgcatacataataaaagacattgttgcatggcaaaaaaaaaaaaaaaaaaaaaaaaaaaaaaaaaaaaaaaaaaaaaaaaaaaaagaaaaaaaaaacacacacacacagaagaaacgtgacggcacgaagaaagataaagacaccgcgcgcagagcaccgaggagcgaagcagagacaagaacttgaaccagacacgagtcgcgccacgcaacgggcgacactccacacgagcagagaggaggcgacgcgccagacgtatcacaagaaaccaagacgggcggagcaagaccacgagggaggaagaaaagagaaagaagacaacaaacacccgagtgggggagaacaaacgacaagggcgcgcaaacacacaaagaagatgaaaggcggcggcggcata

SEQ ID NO: 313888 - DNA, 1269 bp, Homo sapiens
aacggcattccccaggagacaagaaaggaggatagaaaaacgacttaggaatctccttggagctcaagaccaggaacttccccaagccggaggtccctgaggcgctctagcgcgctggccgcactcgcagcccaggtcgccagtgcgcacgcgcaagattaggtggggcgccagagccggggcacctgcgcaggcttggctgcgccctctcgcgccgcacgctctgcgggttcctcccttcttccgagcctctcctctggccgccgcgcgggagagaggccgagatggcagatgagattgccaaggctcaggtcgctcggcctggtggcgacacgatctttgggaagatcatccgcaaggaaataccagccaaaatcatttttgaggatgaccggtgccttgctttccatgacatttcccctcaagcaccaacacattttctggtgatacccaagaaacatatatcccagatttctgtggcagaagatgatgatgaaagtcttcttggacacttaatgattgttggcaagaaatgtgctgctgatctgggcctgaataagggttatcgaatggtggtgaatgaaggttcagatggtggacagtctgtctatcacgttcatctccatgttcttggaggtcggcaaatgcattggcctcctggttaagcacgttttggggataattttctcttctttaggcaatgattaagttaggcaatttccagtatgttaagtaacacacttatttttgcctgtgtatggagagattcaagaaataattttaaaaccgcatacataataaaagacattgttgcatggcaaaaaaaaaaaaaaaaaaaaaaaaaaaaaaaaaaaaaaaaaaaaaaaaaaaaaaaaaaaaaaaaagagaaagaaaagaaagagcaagaggaaaaaaagagaaaacaagagaggagggaaggaaacaaataaaaaacgaaacaaaagggccgcaaaccaagcagactgacgtggagagaggacaagtgagagtggaggaggcggtcagatagtaacacagggagttgcgagtggagaatagggggggtggaggggggacaacgtaggtgaaagaaacgtccaatagatgaaggtgggagaccatctgtgtgagggcgggacagacgaagcggcagtagcgaggattgagggagtatttacacagatgcggaggagaatcggggaggcggcacgggatatttgtaaagcggggaggtgtgaacgaggagacttgcgcacaagactaacggga

SEQ ID NO: 313889 - DNA, 983 bp, Homo sapiens
  misc_feature (836)..(836): n is a, c, g, or t
aacggcattccccaggagacaagaaaggaggatagaaaaacgacttaggaatctccttggagctcaagaccaggaacttccccaagccggaggtccctgaggcgctctagcgcgctggccgcactcgcagcccaggtcgccagtgcgcacgcgcaagattaggtggggcgccagagccggggcacctgcgcaggcttggctgcgccctctcgcgccgcacgctctgcgggttcctcccttcttccgagcctctcctctggccgccgcgcgggagagaggccgagatggcagatgagattgccaaggctcaggtcgctcggcctggtggcgacacgatctttgggaagatcatccgcaaggaaataccagccaaaatcatttttgaggatgaccggtgccttgctttccatgacatttcccctcaagcaccaacacattttctggtgatacccaagaaacatatatcccagatttctgtggcagaagatgatgatgaaagtcttcttggacacttaatgattgttggcaagaaatgtgctgctgatctgggcctgaataagggttatcgaatggtggtgaatgaaggttcagatggtggacagtctgtctatcacgttcatctccatgttcttggaggtcggcaaatgcattggcctcctggttaagcacgttttggggataattttctcttctttaggcaatgattaagttaggcaatttccagtatgttaagtaacacacttatttttgcctgtgtatggagagattcaagaaataattttaaaaccgcatacataataaaagacattgttgcatggcttatagctcaaaaaaanaaagaaaaaaagagaaaaaaaaaacaactgtgtggcgacggcatgtggcccaggaaaaaggttcggacaccctgcggagggccacggggcccacagagggcaggggacactgcgccaaagcggtgcccacaggagaccggggacagg

SEQ ID NO: 313890 - DNA, 1017 bp, Homo sapiens
aacggcattccccaggagacaagaaaggaggatagaaaaacgacttaggaatctccttggagctcaagaccaggaacttccccaagccggaggtccctgaggcgctctagcgcgctggccgcactcgcagcccaggtcgccagtgcgcacgcgcaagattaggtggggcgccagagccggggcacctgcgcaggcttggctgcgccctctcgcgccgcacgctctgcgggttcctcccttcttccgagcctctcctctggccgccgcgcgggagagaggccgagatggcagatgagattgccaaggctcaggtcgctcggcctggtggcgacacgatctttgggaagatcatccgcaaggaaataccagccaaaatcatttttgaggatgaccggtgccttgctttccatgacatttcccctcaagcaccaacacattttctggtgatacccaagaaacatatatcccagatttctgtggcagaagatgatgatgaaagtcttcttggacacttaatgattgttggcaagaaatgtgctgctgatctgggcctgaataagggttatcgaatggtggtgaatgaaggttcagatggtggacagtctgtctatcacgttcatctccatgttcttggaggtcggcaaatgcattggcctcctggttaagcacgttttggggataattttctcttctttaggcaatgattaagttaggcaatttccagtatgttaagtaacacacttatttttgcctgtgtatggagagattcaagaaataattttaaaaccgcatacataataaaagacattgttgcatggctaaaacaaaaaaaaaaaatcataatcgcgccaccgctattctctaacatcacactaataaatccaaaatataaataattttgggccctttttggccctcaacgggggacctttgccggccctttccctttatgggggggtgaaattatgacccctcgctaactgactccgctggccttcggcgatttcggttgggaaa

SEQ ID NO: 313891 - DNA, 839 bp, Homo sapiens
tgtaatgttatcccaacaccaatcatgcatagtacaatcttaaagaatgaaatatgaacttcagaacttagccttaccacctaagaactggtgcatgggtggggcgataacatcgcccaacacattttctggtgatacccaagaaacatatatcccagatttctgtggcagaagatgatgatgaaagtcttcttggacacttaatgattgttggcaagaaatgtgctgctgatctgggcctgaataagggttatcgaatggtggtgaatgaaggttcagatggtggacagtctgtctatcacgttcatctccatgttcttggaggtcggcaaatgcattggcctcctggttaagcacgttttggggataattttctcttctttaggcaatgattaagttaggcaatttccagtatgttaagtaacacacttatttttgcctgtgtatggagagattcaagaaataattttaaaaccgcatacataataaaagacattgttgcatggcttatagtctctctgagtgttgcgtttgatttgttattttaaaaacatatttgttggaatatgtgaaggtgggtttataattttggatgtttcttgctttttcttcccaaggaggactcaacatatgaacatcgcattgttttaatggtgttactagtctttgaagacaaataatgagagtttataaatttagctttaacttcgaaatatctttccaggctaaaataggtccaacttagatttttaagctaattctcacattttctaagaacataggaaattgaccattttgggtttagaaacagtgctttatgttcagcccacattgcccct

SEQ ID NO: 313892 - DNA, 1094 bp, Homo sapiens
aacggcattccccaggagacaagaaaggaggatagaaaaacgacttaggaatctccttggagctcaagaccaggaacttccccaagccggaggtccctgaggcgctctagcgcgctggccgcactcgcagcccaggtcgccagtgcgcacgcgcaagattaggtggggcgccagagccggggcacctgcgcaggcttggctgcgccctctcgcgccgcacgctctgcgggttcctcccttcttccgagcctctcctctggccgccgcgcgggagagaggccgagatggcagatgagattgccaaggctcaggtcgctcggcctggtggcgacacgatctttgggaagatcatccgcaaggaaataccagccccaacacattttctggtgatacccaagaaacatatatcccagatttctgtggcagaagatgatgatgaaagtcttcttggacacttaatgattgttggcaagaaatgtgctgctgatctgggcctgaataagggttatcgaatggtggtgaatgaaggttcagatggtggacagtctgtctatcacgttcatctccatgttcttggaggtcggcaaatgcattggcctcctggttaagcacgttttggggataattttctcttctttaggcaatgattaagttaggcaatttccagtatgttaagtaacacacttatttttgcctgtgtatggagagattcaagaaataattttaaaaccgcatacataataaaagacattgttgcatggcttatagtctctctgagtgttgcgtttgatttgttattttaaaaacatatttgttggaatatgtgaaggtgggtttataattttggatgtttcttgctttttcttcccaaggaggactcaacatatgaacatcgcattgttttaatggtgttactagtctttgaagacaaataatgagagtttataaatttagctttaacttcgaaatatctttccaggctaaaataggtccaacttagatttttaagctaattctcacattttctaagaacataggaaattgaccattttgggtttagaaacagtgctttatgttcagcccacattgcccct

SEQ ID NO: 313893 - DNA, 797 bp, Homo sapiens
  misc_feature (684)..(684): n is a, c, g, or t
aacggcattccccaggagacaagaaaggaggatagaaaaacgacttaggaatctccttggagctcaagaccaggaacttccccaagccggaggtccctgaggcgctctagcgcgctggccgcactcgcagcccaggtcgccagtgcgcacgcgcaagattaggtggggcgccagagccggggcacctgcgcaggcttggctgcgccctctcgcgccgcacgctctgcgggttcctcccttcttccgagcctctcctctggccgccgcgcgggagagaggccgagatggcagatgagattgccaaggctcaggtcgctcggcctggtggcgacacgatctttgggaagatcatccgcaaggaaataccagccaaaatcatttttgaggatgaccggtgccttgctttccatgacatttcccctcaagcaccaacacattttctggtgatacccaagaaacatatatcccagatttctgtggcagaagatgatgatgaaagtcttcttggacacttaatgattgttggcaagaaatgtgctgctgatctgggcctgaataagggttatcgaatggtggtgaatgaaggttcagatggtggacagtctgtctatcacgttcatctccatgttcttggaggtcggcaaatgcattggcctcctggttaagcacgttttgggaaattcnctcttagcaagatagtagcattccatagtaagtaacacactatttgccggtagggagatcagaataattaaacgcaacatataagcatgtgcagccaaaaaaaaaagcgcccg

SEQ ID NO: 313894 - DNA, 853 bp, Homo sapiens
aacggcattccccaggagacaagaaaggaggatagaaaaacgacttaggaatctccttggagctcaagaccaggaacttccccaagccggaggtccctgaggcgctctagcgcgctggccgcactcgcagcccaggtcgccagtgcgcacgcgcaagattaggtggggcgccagagccggggcacctgcgcaggcttggctgcgccctctcgcgccgcacgctctgcgggttcctcccttcttccgagcctctcctctggccgccgcgcgggagagaggccgagatggcagatgagattgccaaggctcaggtcgctcggcctggtggcgacacgatctttgggaagatcatccgcaaggaaataccagccaaaatcatttttgaggatgaccgggtaggtactgggcaccacctctctcgcctgctggtgccttgctttccatgacatttcccctcaagcaccaacacattttctggtgatacccaagaaacatatatcccagatttctgtggcagaagatgatgatgaaagtcttcttggacacttaatgattgttggcaagaaatgtgctgctgatctgggcctgaataagggttatcgaatggtggtgaatgaaggttcagatggtggacagtctgtctatcacgttcatctccatgttcttggaggtcggcaaatgcattggcctcctggttaagcacgttttggggataattttctcttctttaggcaatgattaagttaggcaatttccagtatgttaagtaacacacttatttttgcctgtgtatggagagattcaagaaataattttaaaaccgcatacataataaaagacattgttgcatggc

SEQ ID NO: 313895 - DNA, 4017 bp, Homo sapiens
aacggcattccccaggagacaagaaaggaggatagaaaaacgacttaggaatctccttggagctcaagaccaggaacttccccaagccggaggtccctgaggcgctctagcgcgctggccgcactcgcagcccaggtcgccagtgcgcacgcgcaagattaggtggggcgccagagccggggcacctgcgcaggcttggctgcgccctctcgcgccgcacgctctgcgggttcctcccttcttccgagcctctcctctggccgccgcgcgggagagaggccgagatggcagatgagattgccaaggctcaggtcgctcggcctggtggcgacacgatctttgggaagatcatccgcaaggaaataccagccaaaatcatttttgaggatgaccggtgccttgctttccatgacatttcccctcaagcaccaacacattttctggtgatacccaagaaacatatatcccagatttctgtggcagaagatgatgatgaaagtgtcattactaaggaaaaaccagaaaaaccattaggacttcaactgcccagctgttttccaaagttactgcatcattttgtatcccaccagcaatgaatgagcgttccagcttctccgtatccttatcaacacttgctattaccttttttttttttttttgagacagagtcttgctctgtcgcccaggctgcagtgcaggggcactcggttcactgcaagctccacctcccgtggttcacaccattctcctgcctcagcctcccgagtagtgggacaacaggcgcccgccaccaaggctggctaattttttgtatttttagtagagacggctttcaccatgttagtcaggatagtttcgatttcctgacctcgtgatccgcccgcctcggcctcccaaagtgctgggattacacgcgtgagccaccgttcctggcctattatattcttaaagtaagctagagaaaaggttattaagaaaatcataaggaagagaaaatatatttactatttattaagtcgagtgaatcataaaggtcttcatccctgtcatcttcatgttgagtaggctgaggaagacgaggggttggtctagctgtagctgtctcaggggtggcagaggcagaagaaaatttgcatatgagtagacctgcacgggtcaaacccatgttgtgcaagggtcagttgtatttacttggggatacctttttaaagtgagacattatttctgaaacttagaaacttcaaggcattaatttttaattcaatatatttgtacaaatcacagagttcaaagattagagcgagtacttaatggtaaaataccgtcttatatgcaataacattaaaccctcagaatacatttttttcttttttttttttttttgagacggagtttcgttcttgttgcccaggctggagtgcaatggcgcgatctcggctcaccgcagcctctgcctcctgggtacaagcgattcccctgccctcctgagtagctgggattacaggcatgccatcacgcctggcttatttgtatttttagtagagatggggtttctccatgttggtcaggttggtctcgagctcccaacctcacgtgatccacccgcctcagccttccaaagtgctgggattacaggtgtcagccaccacgcccagccccagaatacaaatttttaacatttagtataattagacagtcatggcattttaaggtcagagcttcttactcaaatgcagctcttttctgtaaggacaataaaatgttaatttttactcagttaacattctaaattagtgttttaaggtcatctcttttacttagaagacagttgttggccaggaaacgtttactgaaccagctttaaaaccgtgctaattcataattaaatgttgtgaccaatataggtatctgctgtacaaaattttatatagatgctcatcaacttaagatgggcttacatgctgataaacccatcataagttgaaaatattgtatgtctgttgaaaatgcgtgtaagacacctaacttactgaacattatagcctagcctagtctaacttaagcttgctcggaacacttaacgttaacctacagttgggcaaaatcatctaatacagagcctattctgtaacagagtgttgaatatctcatgtaagagtattttactgcatatcaccagtctggaaaaggatcagaattcgaagtatggtttctcctgaatgcatatcgccacaccattgtaaagttgaaaaatcataatttccccaacttacaatttttgtccattgtccatctgtacaatggaccttactgcatgagtaaggtaagcagagtccactgtcctggggcttaataaggtaatgggaatagaaatgtaagactctctcccttccctcttttcttgccaaaggaattaaaggagttccctttcctgagagctttttagaatgttgaagttaaccctcccaacttttttctctcataatgggaaagcataagcagtgaaatgggagttaaagttcttttctcttggcaaccttctcccctttaacttttattagggaagaaagctggcaacatacaaatagactccatgtgtaaatagagacaaattgactgtagatagaaccaaaaaacaaacaggatgacacagagcgagactaggtatttgccacaggatcctgcaagtcccgacaatgcaatagatctggtagtgttcaaaggaaaatccataatggtcataaggaagtcataaagaaagcaagatgtcttgctttattaagaaaacttaaacagcacttggaatataattaagttttttttttggttgggcatagtgccttgtgcctgtaatcccagcactttggaagttaaggtgggcagattgcccaagcgcaggagttcgagaccagcctggacaacattggagaagccccatctcaacaaaaaaatacaaaaattagccgggtgtggtggcatgtgcttgtggtcccagctccttgggtgggtgaggcaggaggatcacttcaacctgggaggtcgaggctgcagtgagctgagatcgtgccactgcactccagtctgagtgacagagcaagaccccatctcttaaaaaaaaaagtttaattgaacagcagattttatttctaatttgtttcttgaaattagtaatgataaatacctaatcttaatgagtctccagttgtagattatgctctgttgggattaagagtttccaaatatttgctcaaagggttgtgtttcaatgagagttttaagatttgatatttcagcttgacagtttgttatttaatggcaagaagtaataaattgcctgtgcctaagaaactttttttccttttccagcttcttggacacttaatgattgttggcaagaaatgtgctgctgatctgggcctgaataagggttatcgaatggtggtgaatgaaggttcagatggtggacagtctgtctatcacgttcatctccatgttcttggaggtcggcaaatgcattggcctcctggttaagcacgttttggggataattttctcttctttaggcaatgattaagttaggcaatttccagtatgttaagtaacacacttatttttgcctgtgtatggagagattcaagaaataattttaaaaccgcatacataataaaagacattgttgcatggcttatagtctctctgagtgttgcgtttgatttgttattttaaaaacatatttgttggaatatgtgaaggtgggtttataattttggatgtttcttgctttttcttcccaaggaggactcaacatatgaacatcgcattgttttaatggtgttactagtctttgaagacaaataatgagagtttataaatttagctttaacttcgaaatatctttccaggctaaaataggtccaacttagatttttaagctaattctcacattttctaagaacataggaaattgaccattttgggtttagaaacagtgctttatgttcagcccacattgcccct

SEQ ID NO: 313896 - DNA, 4111 bp, Homo sapiens
aacggcattccccaggagacaagaaaggaggatagaaaaacgacttaggaatctccttggagctcaagaccaggaacttccccaagccggaggtccctgaggcgctctagcgcgctggccgcactcgcagcccaggtcgccagtgcgcacgcgcaagattaggtggggcgccagagccggggcacctgcgcaggcttggctgcgccctctcgcgccgcacgctctgcgggttcctcccttcttccgagcctctcctctggccgccgcgcgggagagaggccgagatggcagatgagattgccaaggctcaggtcgctcggcctggtggcgacacgatctttgggaagatcatccgcaaggaaataccagccaaaatcatttttgaggatgaccggtgccttgctttccatgacatttcccctcaagcaccaacacattttctggtgatacccaagaaacatatatcccagatttctgtggcagaagatgatgatgaaagtgtaagtacatttctaacatgatttattttcttgctttttaaattgtgagattaattttgtccttaaagtgctgtcacattttcatcttcctaaggtcattactaaggaaaaaccagaaaaaccattaggacttcaactgcccagctgttttccaaagttactgcatcattttgtatcccaccagcaatgaatgagcgttccagcttctccgtatccttatcaacacttgctattaccttttttttttttttttgagacagagtcttgctctgtcgcccaggctgcagtgcaggggcactcggttcactgcaagctccacctcccgtggttcacaccattctcctgcctcagcctcccgagtagtgggacaacaggcgcccgccaccaaggctggctaattttttgtatttttagtagagacggctttcaccatgttagtcaggatagtttcgatttcctgacctcgtgatccgcccgcctcggcctcccaaagtgctgggattacacgcgtgagccaccgttcctggcctattatattcttaaagtaagctagagaaaaggttattaagaaaatcataaggaagagaaaatatatttactatttattaagtcgagtgaatcataaaggtcttcatccctgtcatcttcatgttgagtaggctgaggaagacgaggggttggtctagctgtagctgtctcaggggtggcagaggcagaagaaaatttgcatatgagtagacctgcacgggtcaaacccatgttgtgcaagggtcagttgtatttacttggggatacctttttaaagtgagacattatttctgaaacttagaaacttcaaggcattaatttttaattcaatatatttgtacaaatcacagagttcaaagattagagcgagtacttaatggtaaaataccgtcttatatgcaataacattaaaccctcagaatacatttttttcttttttttttttttttgagacggagtttcgttcttgttgcccaggctggagtgcaatggcgcgatctcggctcaccgcagcctctgcctcctgggtacaagcgattcccctgccctcctgagtagctgggattacaggcatgccatcacgcctggcttatttgtatttttagtagagatggggtttctccatgttggtcaggttggtctcgagctcccaacctcacgtgatccacccgcctcagccttccaaagtgctgggattacaggtgtcagccaccacgcccagccccagaatacaaatttttaacatttagtataattagacagtcatggcattttaaggtcagagcttcttactcaaatgcagctcttttctgtaaggacaataaaatgttaatttttactcagttaacattctaaattagtgttttaaggtcatctcttttacttagaagacagttgttggccaggaaacgtttactgaaccagctttaaaaccgtgctaattcataattaaatgttgtgaccaatataggtatctgctgtacaaaattttatatagatgctcatcaacttaagatgggcttacatgctgataaacccatcataagttgaaaatattgtatgtctgttgaaaatgcgtgtaagacacctaacttactgaacattatagcctagcctagtctaacttaagcttgctcggaacacttaacgttaacctacagttgggcaaaatcatctaatacagagcctattctgtaacagagtgttgaatatctcatgtaagagtattttactgcatatcaccagtctggaaaaggatcagaattcgaagtatggtttctcctgaatgcatatcgccacaccattgtaaagttgaaaaatcataatttccccaacttacaatttttgtccattgtccatctgtacaatggaccttactgcatgagtaaggtaagcagagtccactgtcctggggcttaataaggtaatgggaatagaaatgtaagactctctcccttccctcttttcttgccaaaggaattaaaggagttccctttcctgagagctttttagaatgttgaagttaaccctcccaacttttttctctcataatgggaaagcataagcagtgaaatgggagttaaagttcttttctcttggcaaccttctcccctttaacttttattagggaagaaagctggcaacatacaaatagactccatgtgtaaatagagacaaattgactgtagatagaaccaaaaaacaaacaggatgacacagagcgagactaggtatttgccacaggatcctgcaagtcccgacaatgcaatagatctggtagtgttcaaaggaaaatccataatggtcataaggaagtcataaagaaagcaagatgtcttgctttattaagaaaacttaaacagcacttggaatataattaagttttttttttggttgggcatagtgccttgtgcctgtaatcccagcactttggaagttaaggtgggcagattgcccaagcgcaggagttcgagaccagcctggacaacattggagaagccccatctcaacaaaaaaatacaaaaattagccgggtgtggtggcatgtgcttgtggtcccagctccttgggtgggtgaggcaggaggatcacttcaacctgggaggtcgaggctgcagtgagctgagatcgtgccactgcactccagtctgagtgacagagcaagaccccatctcttaaaaaaaaaagtttaattgaacagcagattttatttctaatttgtttcttgaaattagtaatgataaatacctaatcttaatgagtctccagttgtagattatgctctgttgggattaagagtttccaaatatttgctcaaagggttgtgtttcaatgagagttttaagatttgatatttcagcttgacagtttgttatttaatggcaagaagtaataaattgcctgtgcctaagaaactttttttccttttccagcttcttggacacttaatgattgttggcaagaaatgtgctgctgatctgggcctgaataagggttatcgaatggtggtgaatgaaggttcagatggtggacagtctgtctatcacgttcatctccatgttcttggaggtcggcaaatgcattggcctcctggttaagcacgttttggggataattttctcttctttaggcaatgattaagttaggcaatttccagtatgttaagtaacacacttatttttgcctgtgtatggagagattcaagaaataattttaaaaccgcatacataataaaagacattgttgcatggcttatagtctctctgagtgttgcgtttgatttgttattttaaaaacatatttgttggaatatgtgaaggtgggtttataattttggatgtttcttgctttttcttcccaaggaggactcaacatatgaacatcgcattgttttaatggtgttactagtctttgaagacaaataatgagagtttataaatttagctttaacttcgaaatatctttccaggctaaaataggtccaacttagatttttaagctaattctcacattttctaagaacataggaaattgaccattttgggtttagaaacagtgctttatgttcagcccacattgcccct

SEQ ID NO: 313897 - DNA, 3685 bp, Homo sapiens
aacggcattccccaggagacaagaaaggaggatagaaaaacgacttaggaatctccttggagctcaagaccaggaacttccccaagccggaggtccctgaggcgctctagcgcgctggccgcactcgcagcccaggtcgccagtgcgcacgcgcaagattaggtggggcgccagagccggggcacctgcgcaggcttggctgcgccctctcgcgccgcacgctctgcgggttcctcccttcttccgagcctctcctctggccgccgcgcgggagagaggccgagatggcagatgagattgccaaggctcaggtcgctcggcctggtggcgacacgatctttgggaagatcatccgcaaggaaataccagccaaaatcatttttgaggatgaccggtgccttgctttccatgacatttcccctcaagcaccaacacattttctggtgatacccaagaaacatatatcccagatttctgtggcagaagatgatgatgaaagtgtcattactaaggaaaaaccagaaaaaccattaggacttcaactgcccagctgttttccaaagttactgcatcattttgtatcccaccagcaatgaatgagcgttccagcttctccgtatccttatcaacacttgctattaccttttttttttttttttgagacagagtcttgctctgtcgcccaggctgcagtgcaggggcactcggttcactgcaagctccacctcccgtggttcacaccattctcctgcctcagcctcccgagtagtgggacaacaggcgcccgccaccaaggctggctaattttttgtatttttagtagagacggctttcaccatgttagtcaggatagtttcgatttcctgacctcgtgatccgcccgcctcggcctcccaaagtgctgggattacacgcgtgagccaccgttcctggcctattatattcttaaagtaagctagagaaaaggttattaagaaaatcataaggaagagaaaatatatttactatttattaagtcgagtgaatcataaaggtcttcatccctgtcatcttcatgttgagtaggctgaggaagacgaggggttggtctagctgtagctgtctcaggggtggcagaggcagaagaaaatttgcatatgagtagacctgcacgggtcaaacccatgttgtgcaagggtcagttgtatttacttggggatacctttttaaagtgagacattatttctgaaacttagaaacttcaaggcattaatttttaattcaatatatttgtacaaatcacagagttcaaagattagagcgagtacttaatggtaaaataccgtcttatatgcaataacattaaaccctcagaatacatttttttcttttttttttttttttgagacggagtttcgttcttgttgcccaggctggagtgcaatggcgcgatctcggctcaccgcagcctctgcctcctgggtacaagcgattcccctgccctcctgagtagctgggattacaggcatgccatcacgcctggcttatttgtatttttagtagagatggggtttctccatgttggtcaggttggtctcgagctcccaacctcacgtgatccacccgcctcagccttccaaagtgctgggattacaggtgtcagccaccacgcccagccccagaatacaaatttttaacatttagtataattagacagtcatggcattttaaggtcagagcttcttactcaaatgcagctcttttctgtaaggacaataaaatgttaatttttactcagttaacattctaaattagtgttttaaggtcatctcttttacttagaagacagttgttggccaggaaacgtttactgaaccagctttaaaaccgtgctaattcataattaaatgttgtgaccaatataggtatctgctgtacaaaattttatatagatgctcatcaacttaagatgggcttacatgctgataaacccatcataagttgaaaatattgtatgtctgttgaaaatgcgtgtaagacacctaacttactgaacattatagcctagcctagtctaacttaagcttgctcggaacacttaacgttaacctacagttgggcaaaatcatctaatacagagcctattctgtaacagagtgttgaatatctcatgtaagagtattttactgcatatcaccagtctggaaaaggatcagaattcgaagtatggtttctcctgaatgcatatcgccacaccattgtaaagttgaaaaatcataatttccccaacttacaatttttgtccattgtccatctgtacaatggaccttactgcatgagtaaggtaagcagagtccactgtcctggggcttaataaggtaatgggaatagaaatgtaagactctctcccttccctcttttcttgccaaaggaattaaaggagttccctttcctgagagctttttagaatgttgaagttaaccctcccaacttttttctctcataatgggaaagcataagcagtgaaatgggagttaaagttcttttctcttggcaaccttctcccctttaacttttattagggaagaaagctggcaacatacaaatagactccatgtgtaaatagagacaaattgactgtagatagaaccaaaaaacaaacaggatgacacagagcgagactaggtatttgccacaggatcctgcaagtcccgacaatgcaatagatctggtagtgttcaaaggaaaatccataatggtcataaggaagtcataaagaaagcaagatgtcttgctttattaagaaaacttaaacagcacttggaatataattaagttttttttttggttgggcatagtgccttgtgcctgtaatcccagcactttggaagttaaggtgggcagattgcccaagcgcaggagttcgagaccagcctggacaacattggagaagccccatctcaacaaaaaaatacaaaaattagccgggtgtggtggcatgtgcttgtggtcccagctccttgggtgggtgaggcaggaggatcacttcaacctgggaggtcgaggctgcagtgagctgagatcgtgccactgcactccagtctgagtgacagagcaagaccccatctcttaaaaaaaaaagtttaattgaacagcagattttatttctaatttgtttcttgaaattagtaatgataaatacctaatcttaatgagtctccagttgtagattatgctctgttgggattaagagtttccaaatatttgctcaaagggttgtgtttcaatgagagttttaagatttgatatttcagcttgacagtttgttatttaatggcaagaagtaataaattgcctgtgcctaagaaactttttttccttttccagcttcttggacacttaatgattgttggcaagaaatgtgctgctgatctgggcctgaataagggttatcgaatggtggtgaatgaaggttcagatggtggacagtctgtctatcacgttcatctccatgttcttggaggtcggcaaatgcattggcctcctggttaagcacgttttggggataattttctcttctttaggcaatgattaagttaggcaatttccagtatgttaagtaacacacttatttttgcctgtgtatggagagattcaagaaataattttaaaaccgcatacataataaaagacattgttgcatggc

SEQ ID NO: 313898 - DNA, 1340 bp, Homo sapiens
aacggcattccccaggagacaagaaaggaggatagaaaaacgacttaggaatctccttggagctcaagaccaggaacttccccaagccggaggtccctgaggcgctctagcgcgctggccgcactcgcagcccaggtcgccagtgcgcacgcgcaagattaggtggggcgccagagccggggcacctgcgcaggcttggctgcgccctctcgcgccgcacgctctgcgggttcctcccttcttccgagcctctcctctggccgccgcgcgggagagaggccgagatggcagatgagattgccaaggctcaggtcgctcggcctggtggcgacacgatctttgggaagatcatccgcaaggaaataccagccaaaatcatttttgaggatgaccggtgccttgctttccatgacatttcccctcaagcaccaacacattttctggtgatacccaagaaacatatatcccagatttctgtggcagaagatgatgatgaaagtagtgttgaatatctcatgtaagagtattttactgcatatcaccagtctggaaaaggatcagaattcgaagtatggtttctcctgaatgcatatcgccacaccattgtaaagttgaaaaatcataatttccccaacttacaatttttgtccattgtccatctgtacaatggaccttactgcatgagtaagcttcttggacacttaatgattgttggcaagaaatgtgctgctgatctgggcctgaataagggttatcgaatggtggtgaatgaaggttcagatggtggacagtctgtctatcacgttcatctccatgttcttggaggtcggcaaatgcattggcctcctggttaagcacgttttggggataattttctcttctttaggcaatgattaagttaggcaatttccagtatgttaagtaacacacttatttttgcctgtgtatggagagattcaagaaataattttaaaaccgcatacataataaaagacattgttgcatggcttatagtctctctgagtgttgcgtttgatttgttattttaaaaacatatttgttggaatatgtgaaggtgggtttataattttggatgtttcttgctttttcttcccaaggaggactcaacatatgaacatcgcattgttttaatggtgttactagtctttgaagacaaataatgagagtttataaatttagctttaacttcgaaatatctttccaggctaaaataggtccaacttagatttttaagctaattctcacattttctaagaacataggaaattgaccattttgggtttagaaacagtgctttatgttcagcccacattgcccct

SEQ ID NO: 313899 - DNA, 762 bp, Homo sapiens
aacggcattccccaggagacaagaaaggaggatagaaaaacgacttaggaatctccttggagctcaagaccaggaacttccccaagccggaggtccctgaggcgctctagcgcgctggccgcactcgcagcccaggtcgccagtgcgcacgcgcaagattaggtggggcgccagagccggggcacctgcgcaggcttggctgcgccctctcgcgccgcacgctctgcgggttcctcccttcttccgagcctctcctctggccgccgcgcgggagagaggccgagatggcagatgagattgccaaggctcaggtcgctcggcctggtggcgacacgatctttgggaagatcatccgcaaggaaataccagccccaacacattttctggtgatacccaagaaacatatatcccagatttctgtggcagaagatgatgatgaaagtcttcttggacacttaatgattgttggcaagaaatgtgctgctgatctgggcctgaataagggttatcgaatggtggtgaatgaaggttcagatggtggacagtctgtctatcacgttcatctccatgttcttggaggtcggcaaatgcattggcctcctggttaagcacgttttggggataattttctcttctttaggcaatgattaagttaggcaatttccagtatgttaagtaacacacttatttttgcctgtgtatggagagattcaagaaataattttaaaaccgcatacataataaaagacattgttgcatggc

SEQ ID NO: 313900 - DNA, 1458 bp, Homo sapiens
aacggcattccccaggagacaagaaaggaggatagaaaaacgacttaggaatctccttggagctcaagaccaggaacttccccaagccggaggtccctgaggcgctctagcgcgctggccgcactcgcagcccaggtcgccagtgcgcacgcgcaagattaggtggggcgccagagccggggcacctgcgcaggcttggctgcgccctctcgcgccgcacgctctgcgggttcctcccttcttccgagcctctcctctggccgccgcgcgggagagaggccgagatggcagatgagattgccaaggctcaggtcgctcggcctggtggcgacacgatctttgggaagatcatccgcaaggaaataccagccaaaatcatttttgaggatgaccggtgccttgctttccatgacatttcccctcaagcaccaacacattttctggtgatacccaagaaacatatatcccagatttctgtggcagaagatgatgatgaaagtgtcattactaaggaaaaaccagaaaaaccattaggacttcaactgcccagctgttttccaaagttactgcatcattttgtgggcaaaatcatctaatacagagcctattctgtaacagagtgttgaatatctcatgtaagagtattttactgcatatcaccagtctggaaaaggatcagaattcgaagtatggtttctcctgaatgcatatcgccacaccattgtaaagttgaaaaatcataatttccccaacttacaatttttgtccattgtccatctgtacaatggaccttactgcatgagtaagcttcttggacacttaatgattgttggcaagaaatgtgctgctgatctgggcctgaataagggttatcgaatggtggtgaatgaaggttcagatggtggacagtctgtctatcacgttcatctccatgttcttggaggtcggcaaatgcattggcctcctggttaagcacgttttggggataattttctcttctttaggcaatgattaagttaggcaatttccagtatgttaagtaacacacttatttttgcctgtgtatggagagattcaagaaataattttaaaaccgcatacataataaaagacattgttgcatggcttatagtctctctgagtgttgcgtttgatttgttattttaaaaacatatttgttggaatatgtgaaggtgggtttataattttggatgtttcttgctttttcttcccaaggaggactcaacatatgaacatcgcattgttttaatggtgttactagtctttgaagacaaataatgagagtttataaatttagctttaacttcgaaatatctttccaggctaaaataggtccaacttagatttttaagctaattctcacattttctaagaacataggaaattgaccattttgggtttagaaacagtgctttatgttcagcccacattgcccct

SEQ ID NO: 313901 - DNA, 1601 bp, Homo sapiens
aacggcattccccaggagacaagaaaggaggatagaaaaacgacttaggaatctccttggagctcaagaccaggaacttccccaagccggaggtccctgaggcgctctagcgcgctggccgcactcgcagcccaggtcgccagtgcgcacgcgcaagattaggtggggcgccagagccggggcacctgcgcaggcttggctgcgccctctcgcgccgcacgctctgcgggttcctcccttcttccgagcctctcctctggccgccgcgcgggagagaggccgagatggcagatgagattgccaaggctcaggtcgctcggcctggtggcgacacgatctttgggaagatcatccgcaaggaaataccagccaaaatcatttttgaggatgaccggtgccttgctttccatgacatttcccctcaagcaccaacacattttctggtgatacccaagaaacatatatcccagatttctgtggcagaagatgatgatgaaagtgtcattactaaggaaaaaccagaaaaaccattaggacttcaactgcccagctgttttccaaagttactgcatcattttgtatcccaccagcaatgaatgagcgttccagcttctccgtatccttatcaacacttgctattaccttttttttttttttttgagacagagtcttgctctgtcgcccaggctgcagtgcaggggcactcggttcactgcaagctccacctcccgtggttcacaccattctcctgcctcagcctcccgagtagtgggacaacaggcgcccgccaccaaggctggctaattttttgtatttttagtagagacggctttcaccatgttagtcaggatagtttcgatttcctgacctcgtgatccgcccgcctcggcctcccaaagtgctgggattacacgcgtgagccaccgttcctggcctattatattcttaaacttcttggacacttaatgattgttggcaagaaatgtgctgctgatctgggcctgaataagggttatcgaatggtggtgaatgaaggttcagatggtggacagtctgtctatcacgttcatctccatgttcttggaggtcggcaaatgcattggcctcctggttaagcacgttttggggataattttctcttctttaggcaatgattaagttaggcaatttccagtatgttaagtaacacacttatttttgcctgtgtatggagagattcaagaaataattttaaaaccgcatacataataaaagacattgttgcatggcttatagtctctctgagtgttgcgtttgatttgttattttaaaaacatatttgttggaatatgtgaaggtgggtttataattttggatgtttcttgctttttcttcccaaggaggactcaacatatgaacatcgcattgttttaatggtgttactagtctttgaagacaaataatgagagtttataaatttagctttaacttcgaaatatctttccaggctaaaataggtccaacttagatttttaagctaattctcacattttctaagaacataggaaattgaccattttgggtttagaaacagtgctttatgttcagcccacattgcccct

SEQ ID NO: 313902 - DNA, 765 bp, Homo sapiens
aacggcattccccaggagacaagaaaggaggatagaaaaacgacttaggaatctccttggagctcaagaccaggaacttccccaagccggaggtccctgaggcgctctagcgcgctggccgcactcgcagcccaggtcgccagtgcgcacgcgcaagattaggtggggcgccagagccggggcacctgcgcaggcttggctgcgccctctcgcgccgcacgctctgcgggttcctcccttcttccgagcctctcctctggccgccgcgcgggagagaggccgagatggcagatgagattgccaaggctcaggtcgctcggcctggtggcgacacgatctttgggaagatcatccgcaaggaaataccagccaaaatcatttttgaggatgaccggtgccttgctttccatgacatttcccctcaagcaccaacacattttctggtgatacccaagaaacatatatcccagatttctgtggcagaagatgatgatgaaagtcttcttggacacttaatgattgttggcaagaaatgtgctgctgatctgggcctgaataagggttatcgaatggtggtgaatgaaggttcagatggtggacagtctgtctatcacgttcatggggataattttctcttctttaggcaatgattaagttaggcaatttccagtatgttaagtaacacacttatttttgcctgtgtatggagagattcaagaaataattttaaaaccgcatacataataaaagacattgttgcatggc

SEQ ID NO: 313903 - DNA, 1008 bp, Homo sapiens
aacggcattccccaggagacaagaaaggaggatagaaaaacgacttaggaatctccttggagctcaagaccaggaacttccccaagccggaggtccctgaggcgctctagcgcgctggccgcactcgcagcccaggtcgccagtgcgcacgcgcaagattaggtggggcgccagagccggggcacctgcgcaggcttggctgcgccctctcgcgccgcacgctctgcgggttcctcccttcttccgagcctctcctctggccgccgcgcgggagagaggccgagatggcagatgagattgccaaggctcaggtcgctcggcctggtggcgacacgatctttgggaagatcatccgcaaggaaataccagccaaaatcatttttgaggatgaccggtgccttgctttccatgacatttcccctcaagcaccaacacattttctggtgatacccaagaaacatatatcccagatttctgtggcagaagatgatgatgaaagtagtgttgaatatctcatgtaagagtattttactgcatatcaccagtctggaaaaggatcagaattcgaagtatggtttctcctgaatgcatatcgccacaccattgtaaagttgaaaaatcataatttccccaacttacaatttttgtccattgtccatctgtacaatggaccttactgcatgagtaagcttcttggacacttaatgattgttggcaagaaatgtgctgctgatctgggcctgaataagggttatcgaatggtggtgaatgaaggttcagatggtggacagtctgtctatcacgttcatctccatgttcttggaggtcggcaaatgcattggcctcctggttaagcacgttttggggataattttctcttctttaggcaatgattaagttaggcaatttccagtatgttaagtaacacacttatttttgcctgtgtatggagagattcaagaaataattttaaaaccgcatacataataaaagacattgttgcatggc

SEQ ID NO: 313904 - DNA, 692 bp, Homo sapiens
taaggcgacgtctagaggatccttttaggttatccccaacacttcttggacacttaatgattgttggcaagaaatgtgctgctgatctgggcctgaataagggttatcgaatggtggtgaatgaaggttcagatggtggacagtctgtctatcacgttcatctccatgttcttggaggtcggcaaatgcattggcctcctggttaagcacgttttggggataattttctcttctttaggcaatgattaagttaggcaatttccagtatgttaagtaacacacttatttttgcctgtgtatggagagattcaagaaataattttaaaaccgcatacataataaaagacattgttgcatggcttatagtctctctgagtgttgcgtttgatttgttattttaaaaacatatttgttggaatatgtgaaggtgggtttataattttggatgtttcttgctttttcttcccaaggaggactcaacatatgaacatcgcattgttttaatggtgttactagtctttgaagacaaataatgagagtttataaatttagctttaacttcgaaatatctttccaggctaaaataggtccaacttagatttttaagctaattctcacattttctaagaacataggaaattgaccattttgggtttagaaacagtgctttatgttcagcccacattgcccct

SEQ ID NO: 313905 - DNA, 1263 bp, Homo sapiens
aacggcattccccaggagacaagaaaggaggatagaaaaacgacttaggaatctccttggagctcaagaccaggaacttccccaagccggaggtccctgaggcgctctagcgcgctggccgcactcgcagcccaggtcgccagtgcgcacgcgcaagattaggtggggcgccagagccggggcacctgcgcaggcttggctgcgccctctcgcgccgcacgctctgcgggttcctcccttcttccgagcctctcctctggccgccgcgcgggagagaggccgagatggcagatgagattgccaaggctcaggtcgctcggcctggtggcgacacgatctttgggaagatcatccgcaaggaaataccagccaaaatcatttttgaggatgaccggtgccttgctttccatgacatttcccctcaagcaccaacacattttctggtgatacccaagaaacatatatcccagatttctgtggcagaagatgatgatgaaagtagtgttgaatatctcatgtaagagtattttactgcatatcaccagtctggaaaaggatcagaattcgaagtatggtttctcctgaatgcatatcgccacaccattgtaaagttgaaaaatcataatttccccaacttacaatttttgtccattgtccatctgtacaatggaccttactgcatgagtaagcttcttggacacttaatgattgttggcaagaaatgtgctgctgatctgggcctgaataagggttatcgaatggtggtgaatgaaggttcagatggtggacagtctgtctatcacgttcatctccatgttcttggaggtcggcaaatgcattggcctcctggttaagcacgttttggggataattttctcttctttaggcaatgattaagttaggcaatttccagtatgttaagtaacacacttatttttgcctgtgtatggagagattcaagaaataattttaaaaccgcatacataataaaagacattgttgcatggcaaaaaaaaaaaaaaaaaaaaaaaaaaaaaaaaaaaaaaaaaaaaaacctaaaaaaaacacataataattcaaaaactaaccccccaataaaaaaaaaaaatataatcaaaaaaacctttggggtcctttggcccactttcctttttaccttggcactttttttttttgggcccaaatttgggcccactgtgccataatccccttttgggggccgtttaaaaataatggtgcccttttatacaccgtggtactggg

SEQ ID NO: 313906 - DNA, 663 bp, Homo sapiens
tatatgtcgtgcttactattgttcctttttagggtttgctgaagatggcggtatataggctgaattggcaagggttatcgaatggtggtgaatgaaggttcagatggtggacagtctgtctatcacgttcatctccatgttcttggaggtcggcaaatgcattggcctcctggttaagcacgttttggggataattttctcttctttaggcaatgattaagttaggcaatttccagtatgttaagtaacacacttatttttgcctgtgtatggagagattcaagaaataattttaaaaccgcatacataataaaagacattgttgcatggcttatagtctctctgagtgttgcgtttgatttgttattttaaaaacatatttgttggaatatgtgaaggtgggtttataattttggatgtttcttgctttttcttcccaaggaggactcaacatatgaacatcgcattgttttaatggtgttactagtctttgaagacaaataatgagagtttataaatttagctttaacttcgaaatatctttccaggctaaaataggtccaacttagatttttaagctaattctcacattttctaagaacataggaaattgaccattttgggtttagaaacagtgctttatgttcagcccacattgcccct

SEQ ID NO: 313907 - DNA, 651 bp, Homo sapiens
aaaatacgccacaaggccactccaaaggttggttgggtctttttgagccgaaaatttgcgggttcctcccttcttccgagcctctcctctggccgccgcgcgggagagaggccgagatggcagatgagattgccaaggctcaggtcgctcggcctggtggcgacacgatctttgggaagatcatccgcaaggaaataccagccaaaatcatttttgaggatgaccggtgccttgctttccatgacatttcccctcaagcaccaacacattttctggtgatacccaagaaacatatatcccagatttctgtggcagaagatgatgatgaaagtcttcttggacacttaatgattgttggcaagaaatgtgctgctgatctgggcctgaataagggttatcgaatggtggtgaatgaaggttcagatggtggacagtctgtctatcacgttcatctccatgttcttggaggtcggcaaatgcattggcctcctggttaagcacgttttggggataattttctcttctttaggcaatgattaagttaggcaatttccagtatgttaagtaacacacttatttttgcctgtgtatggagagattcaagaaataattttaaaaccgcatacataataaaagacattgttgcatggc

SEQ ID NO: 313908 - DNA, 682 bp, Homo sapiens
  misc_feature (55)..(55): n is a, c, g, or t
acacagcatatgacagatgtactataaccaccaacatcacaaacacaaaaaaaanttttgtgccttgctttccatgacatttcccctcaagcaccaacacattttctggtgatacccaagaaacatatatcccagatttctgtggcagaagatgatgatgaaagtcttcttggacacttaatgattgttggcaagaaatgtgctgctgatctgggcctgaataagggttatcgaatggtggtgaatgaaggttcagatggtggacagtctgtctatcacgttcatctccatgttcttggaggtcggcaaatgcattggcctcctggttaagcacgttttggggataattttctcttctttaggcaatgattaagttaggcaatttccagtatgttaagtaacacacttatttttgcctgtgtatggagagattcaagaaataattttaaaaccgcatacataataaaagacattgttgcatggctaaaacaaaaaaaaaaaatcataatcgcgccaccgctattctctaacatcacactaataaatccaaaatataaataattttgggccctttttggccctcaacgggggacctttgccggccctttccctttatgggggggtgaaattatgacccctcgctaactgactccgctggccttcggcgatttcggttgggaaa

SEQ ID NO: 313909 - DNA, 986 bp, Homo sapiens
aacggcattccccaggagacaagaaaggaggatagaaaaacgacttaggaatctccttggagctcaagaccaggaacttccccaagccggaggtccctgaggcgctctagcgcgctggccgcactcgcagcccaggtcgccagtgcgcacgcgcaagattaggtggggcgccagagccggggcacctgcgcaggcttggctgcgccctctcgcgccgcacgctctgcgggttcctcccttcttccgagcctctcctctggccgccgcgcgggagagaggccgagatggcagatgagattgccaaggctcaggtcgctcggcctggtggcgacacgatctttgggaagatcatccgcaaggaaataccagccaaaatcatttttgaggatgaccggtgccttgctttccatgacatttcccctcaagcaccaacacattttctggtgatacccaagaaacatatatcccagatttctgtggcagaagatgatgatgaaagtcttcttggacacttaatgattgttggcaagaaatgtgctgctgatctgggcctgaataagggttatcgaatggtggtgaatgaaggttcagatggtggacagtctgtctatcacgttcatctccatgttcttggaggtcggcaaatgcattggcctcctggttaagcacgttttggggataattttctcttctttaggcaatgattaagttaggcaatttccagtatgttaagtaacacacttatttttgcctgtgtatggagagattcaagaaataattttaaaaccgcatacataataaaagacattgttgcatggctaaaaaaaaacaactcttagctcaaaccaatttaccccaggataaaggtataaggccaattggaaaaattgaaactctgggcgcaaataagatatagtacccgtaaaggtagtatgaattttttaccccaggccttaatataatcaagggacctatcctcctttcct

SEQ ID NO: 313910 - DNA, 1119 bp, Homo sapiens
aacggcattccccaggagacaagaaaggaggatagaaaaacgacttaggaatctccttggagctcaagaccaggaacttccccaagccggaggtccctgaggcgctctagcgcgctggccgcactcgcagcccaggtcgccagtgcgcacgcgcaagattaggtggggcgccagagccggggcacctgcgcaggcttggctgcgccctctcgcgccgcacgctctgcgggttcctcccttcttccgagcctctcctctggccgccgcgcgggagagaggccgagatggcagatgagattgccaaggctcaggtcgctcggcctggtggcgacacgatctttgggaagatcatccgcaaggaaataccagccaaaatcatttttgaggatgaccggtgccttgctttccatgacatttcccctcaagcaccaacacattttctggtgatacccaagaaacatatatcccagatttctgtggcagaagatgatgatgaaagtcttcttggacacttaatgattgttggcaagaaatgtgctgctgatctgggcctgaataagggttatcgaatggtggtgaatgaaggttcagatggtggacagtctgtctatcacgttcatctccatgttcttggaggtcggcaaatgcattggcctcctggttaagcacgttttggggataattttctcttctttaggcaatgattaagttaggcaatttccagtatgttaagtaacacacttatttttgcctgtgtatggagagattcaagaaataattttaaaaccgcatacataataaaagacattgttgcatggctaaaaaaaaaaaaaaaaaatcgagatagttctctctctctcgtgcgtggaccgggtcatcctggagggtgcgactcccgcggagatgtgtgacccggttccctgggcccagctacgcgggaggtggttcaagaactggttccgaggcttaacttgggggcgctttgggccccgtggggttggttttggccccgattggcgtgatcctggacggtactccttcagggcgttacaaggtttttattaccacttaagaaggcttggtgcctgggtgtgtctcccctaacttgttggtacactg

SEQ ID NO: 313911 - DNA, 1074 bp, Homo sapiens
aacggcattccccaggagacaagaaaggaggatagaaaaacgacttaggaatctccttggagctcaagaccaggaacttccccaagccggaggtccctgaggcgctctagcgcgctggccgcactcgcagcccaggtcgccagtgcgcacgcgcaagattaggtggggcgccagagccggggcacctgcgcaggcttggctgcgccctctcgcgccgcacgctctgcgggttcctcccttcttccgagcctctcctctggccgccgcgcgggagagaggccgagatggcagatgagattgccaaggctcaggtcgctcggcctggtggcgacacgatctttgggaagatcatccgcaaggaaataccagccaaaatcatttttgaggatgaccggtgccttgctttccatgacatttcccctcaagcaccaacacattttctggtgatacccaagaaacatatatcccagatttctgtggcagaagatgatgatgaaagtcttcttggacacttaatgattgttggcaagaaatgtgctgctgatctgggcctgaataagggttatcgaatggtggtgaatgaaggttcagatggtggacagtctgtctatcacgttcatctccatgttcttggaggtcggcaaatgcattggcctcctggttaagcacgttttggggataattttctcttctttaggcaatgattaagttaggcaatttccagtatgttaagtaacacacttatttttgcctgtgtatggagagattcaagaaataattttaaaaccgcatacataataaaagacattgttgcatggcaaaaaaaaaaaaaaaaaaaaaaaaaaaaaaaaaaaaaaaaaaaaaacctaaaaaaaacacataataattcaaaaactaaccccccaataaaaaaaaaaaatataatcaaaaaaacctttggggtcctttggcccactttcctttttaccttggcactttttttttttgggcccaaatttgggcccactgtgccataatccccttttgggggccgtttaaaaataatggtgcccttttatacaccgtggtactggg

SEQ ID NO: 313912 - DNA, 819 bp, Homo sapiens
aacggcattccccaggagacaagaaaggaggatagaaaaacgacttaggaatctccttggagctcaagaccaggaacttccccaagccggaggtccctgaggcgctctagcgcgctggccgcactcgcagcccaggtcgccagtgcgcacgcgcaagattaggtggggcgccagagccggggcacctgcgcaggcttggctgcgccctctcgcgccgcacgctctgcgggttcctcccttcttccgagcctctcctctggccgccgcgcgggagagaggccgagatggcagatgagattgccaaggctcaggtcgctcggcctggtggcgacacgatctttgggaagatcatccgcaaggaaataccagccaaaatcatttttgaggatgaccggtgccttgctttccatgacatttcccctcaagcaccaacacattttctggtgatacccaagaaacatatatcccagatttctgtggcagaagatgatgatgaaagtcttcttggacacttaatgattgttggcaagaaatgtgctgctgatctgggcctgaataagggttatcgaatggtggtgaatgaaggttcagatggtggacagtctgtctatcacgttcatctccatgttcttggaggtcggcaaatgcattggcctcctggttaagcacgttttggggataattttctcttctttaggcaatgattaagttaggcaatttccagtatgttaagtaacacacttatttttgcctgtgtatggagagattcaagaaataattttaaaaccgcatacataataaaagacattgttgcatggc

SEQ ID NO: 313913 - DNA, 363 bp, Homo sapiens
tggaaacgcccctgtaccccagaaacttcctgatcagtccctggtcagtgtatatcatgcttcctgtgacatgacatcaacttttcagtgacttccactggttttggcccagctcgaagagcctgacacctctgcagggaattctaccagggagaagagaaagtagtcactgcttccagtttttttaaggagttggccaagagccagcaccaggcatcagaggaaggcagctgactgcactcggccacatcccaaaagtgcctggaaggggagggaggaagcaggcgcttcagaaggcactactgtgtgtcaggactcatgctaggaacgctgtaacagggagcagtgatggagtccttgagg

SEQ ID NO: 313914 - DNA, 1770 bp, Homo sapiens
gacaacccagaatctgatcaccaggacataggaatggccccatcagatttcttgagccattttgtcacttggaagaaaatagtgtacctttgtatttatttaagagtgctcaaggcctaatagcaataaacaggtctagccaagaaattacaagctattctgttagctgggagtgctctctataagctgattaaggtactgataggaactctttgttattcatgttggttggggattagaaatttgtttttgtacatttatttcaaatgaggaggaggtcattttttctctcaaaaaatgagtatttattattgtcttactgatttctttgattatatacctctcctcctcagttcactcttgttttttttctttctctttggcttttgcttttgctctctctcacttctttcttattttgttgcattggtagagtgttgtatggctagcattgtattgtatgtaattaattttgcacaaaagcaaacatttagcatagtaggttaattttgtttgtttttatgaccatgccaaaataatattctgggctggtggagaacaaaggactgttctttaggactgaaacttgattttgctcatagtaagtaaaaaaaaacaaaaaacacacacactcacagatgttgtttcgtaagtgttataagcactggatataaatgggtattttttatcacttctgactaatgtgaaactgttgtacgaaaactacatgaacaaaagtcatctgtttcgactcgtgtgggcttgcctcacagttgccggatttgagtcatttttatgtcttgttatttcatttatttatgcaaaatacatgtgtgtatgaacactttgttttagctccagctctgcctcagtactggggttcatttacttttagccatgttcttaaaaatgaaaggctattcaggaatgatctgattgtaaacgtctttttcattggatcaaacagtaatgctgtatttgaatctaaattttgtgtataagcagtttatttattagccaagtttggctctaaatatccatggaaattaagaatgacaatcatagggatcaattcattttattttcagtggggcttaaacaaagtttatatgactttaccatctcattttagatttttctaattgtgtaaatataacatagaaatagaatttatttttggttcatgaatacttagtgagatataagttatgtatttcctttttgttctctatccatagatgttggtccaaactgaaagttgatgagtcactgtgcctctcggggtagtgagttatcagctacagtgagagagcagtgtttggcctgcagctgggacagcaaaacgtttcaccagggttctcatgcagttcagaacccactgtccacagatccagacatttcccttttttcttacagaaagttgatgattggacatactaaatttccactacagttaggagacagtcagtttgctttgggagtctacataaatcttctaagatagttctgtgaccatttaatagcaagaagcatgaatgccactacaaaggcaaaaatccacctctgagatcggccgttaataaacgtcccgtcatgtcagtttagattcaagaatgttaagcaactttgtttttgcggtgctccctatttcatagtatcttcaaatcaaaaataaaaattatctccattttgttaaagaacttacagggtcagggttctccttgtcacttagaattgggacactgccaggcaatcctctcccaaaaaaaa

SEQ ID NO: 313915 - DNA, 477 bp, Homo sapiens
tgaatttatttgattcttctgtatttgatacagaaatctcatcagatcagtttaatgaacattattctgcaagaaatctaaatcctctgtcatcagagcaagagattgaaaagaccaagtgttttcggaatgaggggaaaaaaggtcatcatgagctagaaaacctgggaaggattcaccgaagaggtaaaattgaattaggactttacagtttgtgaatgctctcgtccccatcctcatccatggcgaaatcttcgcccccagcctcgtgaagatctagcacgtccgccatctcgccttcgatcgagatctcgtctgtgccgctcagacactagatactcaacatatactatatgctaggccatgcaagatgtagagaataccagaataagaaaataaaaattgatttctacatgatacattaagtgcaagaaatatccctctggcaaattaaagaaagtaaaggtatagtgaata

SEQ ID NO: 313916 - DNA, 487 bp, Homo sapiens
agggggcggaatctctaacccacccaagacccggttcctcgattcccatcctaacgaccgaggaaaaaagagtaaattttcctattatagcattctctagcaccttccccgcttcccaccagccgtctccactgtcctcaccgtccccagcctcgtgaagatctagcacgtccgccatctcgccttcgatcgagatctcgtctgtgccgctcagacactaggggaaactgtcgcagaggggaaaggtcgccagtcaagctggccaatcaaaggctaactgtgaatccctccctctgcacggtaaaaacacgcaaattggggcgggcctagtgcggacccacaccgaaagtgtttctgtggccaaaaaaaacagatcgcaagctaaatcatccatcttaggagatgctgttgaactgggcaaagaataatgggagaaaaacagctgggtcctaaataacagagggaaaccaactttcaataaagtatt

SEQ ID NO: 313917 - DNA, 419 bp, Homo sapiens
aacacgatgttgcaggtagaagagtacaagttaagacaggatgccttaattaaagaagaggcctttactcctgttttcttccattctcacccctctgtttctgccagaattgtgacagcagggcagaaaatgggcttttcgtgcagagttgacaagatacagggtagtgaagacaagaatcttctttcacatgctaagaaactcctgactatacttctgaagtagtaattggaatgacagcttttctggctgaagtacaatttttttgttttaaaaatacaaatggtccctctcattttctattcccagttctttcactcacatgctcacacttacagttatacagtgttcacacatacatttttcattgttttctcatttgaaataaaatgttatgagaaattttcaccataagcaaa

SEQ ID NO: 313918 - DNA, 834 bp, Homo sapiens
  misc_feature (558)..(558): n is a, c, g, or t
gacagccagagggacgagctagcccgacgatggcccaggggacattgatccgtgtgaccccagagcagcccacccatgccgtgtgtgtgctgggcaccttgactcagcttgacatctgcagctctgcccctgaggactgcacgtccttcagcatcaacgcctccccaggggtggtcgtggatattgcccacagccctccagccaagaagaaatccacaggttcctccacatggcccctggaccctggggtagaggtgaccctgacgatgaaagcggccagtggtagcacaggcgaccagaaggttcagatttcatactacggacccaagactccaccagtcaaagctctactctacctcaccgcggtggatggagtctcaccctgtcacccaggctggagtgcaatggcatgatctcgctcactgcaacctgcgtctccaggttcaagcgatcctctgcttcagcgtccctagtagctgggactacaggcgcttgccaccacgcctggctaatttttgtatttttagtagagatggagtttcaccatgttggccaggntggtctcgaacttctgacctcaggtgatctgcctgcctcaggctcccaaagtgctcggattactggcatgaaccactgcgccaggccctctatctttttgatcctcaaatatctctaacaaaaagtagataatgacactgtttatacaagaatatagatagtgttcctcaaattccattatttatatctcatcttcaccattttgccatatcaatgatccacctatactcatatttatgtaatgttcttctttaaataaaatccattcttaaactt

SEQ ID NO: 313919 - DNA, 1377 bp, Homo sapiens
gacagccagagggacgagctagcccgacgatggcccaggggacattgatccgtgtgaccccagagcagcccacccatgccgtgtgtgtgctgggcaccttgactcagcttgacatctgcagctctgcccctgaggactgcacgtccttcagcatcaacgcctccccaggggtggtcgtggatattgcccacagccctccagccaagaagaaatccacaggttcctccacatggcccctggaccctggggtagaggtgaccctgacgatgaaagcggccagtggtagcacaggcgaccagaaggttcagatttcatactacggacccaagactccaccagtcaaagctctactctacctcaccgcggtggaaatctccctgtgcgcagacatcacccgcaccggcaaagtgaagccaaccagagctgtgaaagatcagaggacctggacctggggcccttgtggacagggtgccatcctgctggtgaactgtgacagagacaatctcgaatcttctgccatggactgcgaggatgatgaagtgcttgacagcgaagacctgcaggacatgtcgctgatgaccctgagcacgaagacccccaaggacttcttcacaaaccatacactggtgctccacgtggccaggtctgagatggacaaagtgagggtgtttcaggccacacggggcaaactgtcctccaagtgcagcgtagtcttgggtcccaagtggccctctcactacctgatggtccccggtggaaagcacaacatggacttctacgtggaggccctcgctttcccggacaccgacttcccggggctcattaccctcaccatctccctgctggacacgtccaacctggagctccccgaggctgtggtgttccaagacagcgtggtcttccgcgtggcgccctggatcatgacccccaacacccagcccccgcaggaggtgtacgcgtgcagtatttttgaaaatgaggacttcctgaagtcagtgactactctggccatgaaagccaagtgcaagctgaccatctgccctgaggaggagaacatggatgaccagtggatgcaggatgaaatggagatcggctacatccaagccccacacaaaacgctgcccgtggtcttcgactctccaaggaacagaggcctgaaggagtttcccatcaaacgagtgatggtacctgcatggggtggggagggggcacagctgccgaaaccctcttgtcttgagactccctccttttagcctgccttccccgcccgcgcctgtagctgagtagcccagtgcaaggaggtggaattcctaccaaagtgggagcatgtaggcggggccttgtacgcgtatcaagccccgctgtccacgttagtgt

SEQ ID NO: 313920 - DNA, 1692 bp, Homo sapiens
gacagccagagggacgagctagcccgacgatggcccaggggacattgatccgtgtgaccccagagcagcccacccatgccgtgtgtgtgctgggcaccttgactcagcttgacatctgcagctctgcccctgaggactgcacgtccttcagcatcaacgcctccccaggggtggtcgtggatattgcccacagccctccagccaagaagaaatccacaggttcctccacatggcccctggaccctggggtagaggtgaccctgacgatgaaagcggccagtggtagcacaggcgaccagaaggttcagatttcatactacggacccaagactccaccagtcaaagctctactctacctcaccgcggtggaaatctccctgtgcgcagacatcacccgcaccggcaaagtgaagccaaccagagctgtgaaagatcagaggacctggacctggggcccttgtggacagggtgccatcctgctggtgaactgtgacagagacaatctcgaatcttctgccatggactgcgaggatgatgaagtgcttgacagcgaagacctgcaggacatgtcgctgatgaccctgagcacgaagacccccaaggacttcttcacaaaccatacactggtgctccacgtggccaggtctgagatggacaaagtgagggtgtttcaggccacacggggcaaactgtcctccaagtgcagcgtagtcttgggtcccaagtggccctctcactacctgatggtccccggtggaaagcacaacatggacttctacgtggaggccctcgctttcccggacaccgacttcccggggctcattaccctcaccatctccctgctggacacgtccaacctggagctccccgaggctgtggtgttccaagacagcgtggtcttccgcgtggcgccctggatcatgacccccaacacccagcccccgcaggaggtgtacgcgtgcagtatttttgaaaatgaggacttcctgaagtcagtgactactctggccatgaaagccaagtgcaagctgaccatctgccctgaggaggagaacatggatgaccagtggatgcaggatgaaatggagatcggctacatccaagccccacacaaaacgctgcccgtggtcttcgactctccaaggaacagaggcctgaaggagtttcccatcaaacgagtgatggtacctgcatggggtggggagggggcacagctgccgaaaccctcttgtcttgagactccctccttttagcctgccttccccgcccgcgcctgtagctgagtagcccagtgcaaggaggtggaattcctaccaaagtgggagcatgtaggcggggccttgttatttttttattaccaagataagatctggctcttcatttcccaaaacccttgtcacccgtgagctcagcttgatctccaggtaaccctgccgaggaggtggctcaggcttggacctccctgtgctcttgaagaagctcttgctgcaaggcggaggtggggccggggctggaatctttcccaatgcccagctggaggctctgtcttatgggtggtgtttggtcttcaggggctccatctgggatatgggggattttgggatcagtggatcagtggtcatttcctgggtgtgactttatcagccacaggctgtccatgtggaggtgggaagtgacgtattgctgactcat

SEQ ID NO: 313921 - DNA, 1273 bp, Homo sapiens
cacatggctaacaagagatcaccgacttaggtcagactggctctaagccccatgtgtacccagaataccagcatctcatctaactcaagaggcagtgctttctgaggctaagctctgttctacttaccttagtgactctgtgcctcagtttcccccaataaaactagaatgacaattccttgatttctcaaatgttaggggataaaataaaggcattctagactcctgcatccctttctcagctgaaggagaaccctgacctttttgccaagccccttgtccttcagggacttccctgtagcccttgctgccgataacacccctttaaccctgccatgacagcaatgacagccggcagatgcaccaggccctgcaggacttcctcagtgcccagcaggtgcaggcccctgtgaagctctattctgactggctgtccgtgggccacgtggacgagttcctgagctttgtgccagcacccgacaggaagggcttccggctgctcctggccagccccaggtcctgctacaaactgttccaggagcagcagaatgagggccacggggaggccctgctgttcgaagggatcaagaaaaaaaaacagcagaaaataaagaacattctgtcaaacaagacattgagagaacataattcatttgtggagagatgcatcgactggaaccgcgagctgctgaagcgggagctgggcctggccgagagtgacatcattgacatcccgcagctcttcaagctcaaagagttctctaaggcggaagcttttttccccaacatggtgaacatgctggtgctagggaagcacctgggcatccccaagcccttcgggcccgtcatcaacggccgctgctgcctggaggagaaggtgtgttccctgctggagccactgggcctccagtgcaccttcatcaacgacttcttcacctaccacatcaggcatggggaggtgcactgcggcaccaacgtgcgcagaaagcccttctccttcaagtggtggaacatggtgccctgagcccatcttccctggcgtcctctccctcctggccagatgtcgctgggtcctctgcagtgtggcaagcaagagctcttgtgaatattgtggctccctgggggcggccagccctcccagcagtggcttgctttcttctcctgtgatgtcccagtttcccactctgaagatcccaacatggtcctagcactgcacactcagttctgctctaagaagctgcaataaagtttttttaagtcactttgtacatga

SEQ ID NO: 313922 - DNA, 827 bp, Homo sapiens
gacagccagagggacgagctagcccgacgatggcccaggggacattgatccgtgtgaccccagagcagcccacccatgccgtgtgtgtgctgggcaccttgactcagcttgacatctgcagctctgcccctgaggactgcacgtccttcagcatcaacgcctccccaggggtggtcgtggatattgcccacagccctccagccaagaagaaatccacaggttcctccacatggcccctggaccctggggtagaggtgaccctgacgatgaaagcggccagtggtagcacaggcgaccagaaggttcagatttcatactacggacccaagactccaccagtcaaagctctactctacctcaccgcggtggaaatctccctgtgcgcagacatcacccgcaccggcaaagtgaagccaaccagagctgtgaaagatcagaggacctggacctggggcccttgtggacagggtgccatcctgctggtgaactgtgacagagacaatctcgaatcttctgccatggactgcgaggatgatgaagtgcttgacagcgaagacctgcaggacatgtcgctgatgaccctgagcacgaagacccccaaggacttcttcacaaaccatacactggtgctccacgtggccaggtctgagatggacaaagtgagggtgtttcaggccacacaatgagccccgggaagtcggtgtccgggaaagcgagggcctccacgtagaagtccatgttgtgctttccaccggggaccatcaggtagtgagagggccacttggacccaagactacgctgcacttggagacagttcccctttggca

SEQ ID NO: 313923 - DNA, 256 bp, Homo sapiens
acgggtggaaggggtacccactagttcctgcctcataacttgttagatggattccatgagctaatgcctgctaagagcagatggaccggacgtgccaggagcctctgttcaggccacaggtgacccctgagccacctgtgtgtccctcccaatccttccaggctgagcttcaaattccagagcactaaggagctgcttttctgctctctctagtatttttgaaaatgaggacttcctgaagtcagtgactactctg

SEQ ID NO: 313924 - DNA, 160 bp, Homo sapiens
gaccatctgccctgaggaggagaacatggatgaccagtggatgcaggtatgtgccctgcggggcaggcagggtgactgtccctgagggccaagagacacttgggggacccgggctcctggggttcagcctggtgcctcactggccactcttccttagatg

SEQ ID NO: 313925 - DNA, 2270 bp, Homo sapiens
gacagccagagggacgagctagcccgacgatggcccaggggacattgatccgtgtgaccccagagcagcccacccatgccgtgtgtgtgctgggcaccttgactcagcttgacatctgcagctctgcccctgaggactgcacgtccttcagcatcaacgcctccccaggggtggtcgtggatattgcccacagccctccagccaagaagaaatccacaggttcctccacatggcccctggaccctggggtagaggtgaccctgacgatgaaagcggccagtggtagcacaggcgaccagaaggttcagatttcatactacggacccaagactccaccagtcaaagctctactctacctcaccgcggtggaaatctccctgtgcgcagacatcacccgcaccggcaaagtgaagccaaccagagctgtgaaagatcagaggacctggacctggggcccttgtggacagggtgccatcctgctggtgaactgtgacagagacaatctcgaatcttctgccatggactgcgaggatgatgaagtgcttgacagcgaagacctgcaggacatgtcgctgatgaccctgagcacgaagacccccaaggacttcttcacaaaccatacactggtgctccacgtggccaggtctgagatggacaaagtgagggtgtttcaggccacacggggcaaactgtcctccaagtgcagcgtagtcttgggtcccaagtggccctctcactacctgatggtccccggtggaaagcacaacatggacttctacgtggaggccctcgctttcccggacaccgacttcccggggctcattaccctcaccatctccctgctggacacgtccaacctggagctccccgaggctgtggtgttccaagacagcgtggtcttccgcgtggcgccctggatcatgacccccaacacccagcccccgcaggaggtgtacgcgtgcagtatttttgaaaatgaggacttcctgaagtcagtgactactctggccatgaaagccaagtgcaagctgaccatctgccctgaggaggagaacatggatgaccagtggatgcaggatgaaatggagatcggctacatccaagccccacacaaaacgctgcccgtggtcttcgactctccaaggaacagaggcctgaaggagtttcccatcaaacgagtgatgggtccagattttggctatgtaactcgagggccccaaacagggggtatcagtggactggactcctttgggaacctggaagtgagccccccagtcacagtcaggggcaaggaatacccgctgggcaggattctcttcggggacagctgttatcccagcaatgacagccggcagatgcaccaggccctgcaggacttcctcagtgcccagcaggtgcaggcccctgtgaagctctattctgactggctgtccgtgggccacgtggacgagttcctgagctttgtgccagcacccgacaggaagggcttccggctgctcctggccagccccaggtcctgctacaaactgttccaggagcagcagaatgagggccacggggaggccctgctgttcgaagggatcaagaaaaaaaaacagcagaaaataaagaacattctgtcaaacaagacattgagagaacataattcatttgtggagagatgcatcgactggaaccgcgagctgctgaagcgggagctgggcctggccgagagtgacatcattgacatcccgcagctcttcaagctcaaagagttctctaaggcggaagcttttttccccaacatggtgaacatgctggtgctagggaagcacctgggcatccccaagcccttcgggcccgtcatcaacggccgctgctgcctggaggagaaggtgtgttccctgctggagccactgggcctccagtgcaccttcatcaacgacttcttcacctaccacatcaggcatggggaggtgcactgcggcaccaacgtgcgcagaaagcccttctccttcaagtggtggaacatggtgccctgagcccatcttccctggcgtcctctccctcctggccagatgtcgctgggtcctctgcagtgtggcaagcaagagctcttgtgaatattgtggctccctgggggcggccagccctcccagcagtggcttgctttcttctcctgtgatgtcccagtttcccactctgaagatcccaacatggtcctagcactgcacactcagttctgctctaagaagctgcaataaagtttttttaagtcactttgtacatga

SEQ ID NO: 313926 - DNA, 558 bp, Homo sapiens
  misc_feature (533)..(533): n is a, c, g, or t
  misc_feature (543)..(543): n is a, c, g, or t
gacagccagagggacgagctagcccgacgatggcccaggggacattgatccgtgtgaccccagagcagcccacccatgccgtgtgtgtgctgggcaccttgactcagcttgacatctgcagctctgcccctgaggactgcacgtccttcagcatcaacgcctccccaggggtggtcgtggatattgcccacagccctccagccaagaagaaatccacaggttcctccacatggcccctggaccctggggtagaggtgaccctgacgatgaaagcggccagtggtagcacaggcgaccagaaggttcagatttcatactacggacccaagactccaccagtcaaagctctactctacctcaccgcggtggatggagtctcaccctgtcacccaggctggagtgcaatggcatgatctcgctcactgcaacctgcgtctccaggttcaagcgatcctctgcttcagcgtccctagtagctgggactacaggcgcttgccaccacgctgcttttgatttataggatgattacagtngcagtgctcnatctactcaggtctc

SEQ ID NO: 313927 - DNA, 2091 bp, Homo sapiens
gacagccagagggacgagctagcccgacgatggcccaggggacattgatccgtgtgaccccagagcagcccacccatgccgtgtgtgtgctgggcaccttgactcagcttgacatctgcagctctgcccctgaggactgcacgtccttcagcatcaacgcctccccaggggtggtcgtggatattgcccacagccctccagccaagaagaaatccacaggttcctccacatggcccctggaccctggggtagaggtgaccctgacgatgaaagcggccagtggtagcacaggcgaccagaaggttcagatttcatactacggacccaagactccaccagtcaaagctctactctacctcaccgcggtggaaatctccctgtgcgcagacatcacccgcaccggcaaagtgaagccaaccagagctgtgaaagatcagaggacctggacctggggcccttgtggacagggtgccatcctgctggtgaactgtgacagagacaatctcgaatcttctgccatggactgcgaggatgatgaagtgcttgacagcgaagacctgcaggacatgtcgctgatgaccctgagcacgaagacccccaaggacttcttcacaaaccatacactggtgctccacgtggccaggtctgagatggacaaagtgagggtgtttcaggccacacgagctccccgaggctgtggtgttccaagacagcgtggtcttccgcgtggcgccctggatcatgacccccaacacccagcccccgcaggaggtgtacgcgtgcagtatttttgaaaatgaggacttcctgaagtcagtgactactctggccatgaaagccaagtgcaagctgaccatctgccctgaggaggagaacatggatgaccagtggatgcaggatgaaatggagatcggctacatccaagccccacacaaaacgctgcccgtggtcttcgactctccaaggaacagaggcctgaaggagtttcccatcaaacgagtgatgggtccagattttggctatgtaactcgagggccccaaacagggggtatcagtggactggactcctttgggaacctggaagtgagccccccagtcacagtcaggggcaaggaatacccgctgggcaggattctcttcggggacagctgttatcccagcaatgacagccggcagatgcaccaggccctgcaggacttcctcagtgcccagcaggtgcaggcccctgtgaagctctattctgactggctgtccgtgggccacgtggacgagttcctgagctttgtgccagcacccgacaggaagggcttccggctgctcctggccagccccaggtcctgctacaaactgttccaggagcagcagaatgagggccacggggaggccctgctgttcgaagggatcaagaaaaaaaaacagcagaaaataaagaacattctgtcaaacaagacattgagagaacataattcatttgtggagagatgcatcgactggaaccgcgagctgctgaagcgggagctgggcctggccgagagtgacatcattgacatcccgcagctcttcaagctcaaagagttctctaaggcggaagcttttttccccaacatggtgaacatgctggtgctagggaagcacctgggcatccccaagcccttcgggcccgtcatcaacggccgctgctgcctggaggagaaggtgtgttccctgctggagccactgggcctccagtgcaccttcatcaacgacttcttcacctaccacatcaggcatggggaggtgcactgcggcaccaacgtgcgcagaaagcccttctccttcaagtggtggaacatggtgccctgagcccatcttccctggcgtcctctccctcctggccagatgtcgctgggtcctctgcagtgtggcaagcaagagctcttgtgaatattgtggctccctgggggcggccagccctcccagcagtggcttgctttcttctcctgtgatgtcccagtttcccactctgaagatcccaacatggtcctagcactgcacactcagttctgctctaagaagctgcaataaagtttttttaagtcactttgtacatga

SEQ ID NO: 313928 - DNA, 1225 bp, Homo sapiens
gacagccagagggacgagctagcccgacgatggcccaggggacattgatccgtgtgaccccagagcagcccacccatgccgtgtgtgtgctgggcaccttgactcagcttgacatctgcagctctgcccctgaggactgcacgtccttcagcatcaacgcctccccaggggtggtcgtggatattgcccacagccctccagccaagaagaaatccacaggttcctccacatggcccctggaccctggggtagaggtgaccctgacgatgaaagcggccagtggtagcacaggcgaccagaaggttcagatttcatactacggacccaagactccaccagtcaaagctctactctacctcaccgcggtggaaatctccctgtgcgcagacatcacccgcaccggcaaagtgaagccaaccagagctgtgaaagatcagaggacctggacctggggcccttgtggacagggtgccatcctgctggtgaactgtgacagagacaatctcgaatcttctgccatggactgcgaggatgatgaagtgcttgacagcgaagacctgcaggacatgtcgctgatgaccctgagcacgaagacccccaaggacttcttcacaaaccatacactggtgctccacgtggccaggtctgagatggacaaagtgagggtgtttcaggccacacatggacaaagtgagggtgtttcaggccacacgtaagtcatccccatctttgttcccctcctgccctggccaacggggcacaatcctgtcacacagctgtgtggcagataaatcctgagcacctactatgtgccaagttctaagaacagcagacgcagcagtgggcaagacagacgacatctcgtctactaccttccagttggaggacacagacaaaatgactcgttattgctccctgcttttctttctctctctctcacacacgcgcgcacacacacacacacacacacacacacacctcctggttatagactttgagtgcaagctgacagcatgtggcatgtaatcatttgttctgcaacatcctgctaatcagagacatcaggaacttctcagtgacccacgagcacctgcaactaagtaggtgccaggttgatcccaggcacggggcacagagccatgactgtgaccgagtccctgccctcgtgttgctttcatcttagtggctgggagaactataggtaaaataattacataaaacacct

SEQ ID NO: 313929 - DNA, 610 bp, Homo sapiens
tctgtgcctcagtttcccccaataaaactagaatgacaattccttgatttctcaaatgttaggggataaaataaaggcattctagactcctgcatccctttctcagctgaaggagaaccctgacctttttgccaagccccttgtccttcagggacttccctgtagcccttgctgccgataacacccctttaaccctgccatgacagcaatgacagccggcagatgcaccaggccctgcaggacttcctcagtgcccagcaggtgcaggcccctgtgaagctctattctgactggctgtccgtgggccacgtggacgagttcctgagctttgtgccagcacccgacaggaaggtacagtcttgggggctgcctcaggaagccatgcctccttcctgggtagaccctctgcctggggtgggagcaactttacttgtctatttctccttcacccttaggatggcagtagaggaggtggccagcttgggtccaagtccacactactcccaccctcagcagatccaccctcgttgggagctccaggggcaaagctgacttctaaccccagtgtttctgcctccagggcttccggctgctcctggccagccccagg

SEQ ID NO: 313930 - DNA, 271 bp, Homo sapiens
ttttttaattcttcagctaaaacagcggaagaggtgatttattatatggttgttacactcggccacaaataaacacagaaatagtccagaatgtcacaggtccagggcagaggaccaacatgatagaataagaagcagaaaccccccagcagtggggtaagattgcgcgcttcatcccctcaaaatgcagttcagccccactccctctccatgtccccgtacatcgttagaagcttgaattcgagcagtagtagtagtagtaggcggccgc

SEQ ID NO: 313931 - DNA, 6179 bp, Homo sapiens
ccacgcgtccggagctggaggaggcggcgggcgcgagacccggaatgcgcagggcccccgcctcgccccccccagcccgggccgcggcccccgccttccccgcagtcgtcccgcactcggtgcccgccccccgaggccggcggctgctcccactcggggccgttgctgcttgtgccgtgagcgccgcccagccattgtccccgtcgctccgtcagccgcgccggaccgcgcaccaggaggcgagagcgcgcatggggagcctctgttgatgccgccgccgcgccgccctccgaggctgcgtcccgggaagcccggctccccgagcgctccggcctggcccggtgccccggacctgagtgcgtccccatggaggcgcccgggctggcccaggcggccgcggcggagagcgactcccgcaaggtggcggaggagacccccgacggggcgcccgcgctctgccccagccctgaggcgctgtcgccggagccgcctgtgtacagcctgcaggactttgacacgctggccaccgtgggcactgggacgttcgggcgggtgcacctggtgaaggagaagacagccaagcatttcttcgccctcaaggtgatgagcattcccgacgtcatccgcctaaagcaggagcaacacgtacacaatgagaagtctgtcctgaaggaagtcagccacccgttcctcatcaggctgttctggacgtggcatgacgagcgcttcctctacatgctcatggagtacgtgccgggcggcgagctcttcagctacctgcgcaaccgggggcgcttctccagcaccacggggctcttctactctgcagagatcatctgtgccatcgagtacctgcactccaaagagatcgtctacagggacttgaagccagagaacatcctgctggatagggatggccacattaagctcacggactttgggttcgccaagaagctggtagacaggacttggaccctctgtggaacacccgagtacctagcccccgaagtcattcagagcaagggccacggaagggccgtggactggtgggccctcggcatcctgatattcgagatgctttcggggtttcctccgttttttgatgacaacccgtttggcatttatcagaaaattcttgcaggcaaaatagatttccccagacatttggatttccatgtaaaagacctcattaagaaactgctcgtggttgacagaacaaggcgattaggaaacatgaagaacggggcgaatgatgtgaagcatcatcggtggttccgctccgtggactgggaagctgttccgcagagaaaactgaagcctcccatcgtgcccaagatagctggtgacggcgacacttccaacttcgaaacttaccctgagaatgactgggacacagccgcgcccgtgccgcagaaggatttagaaatcttcaagaatttctgaggacaggagctcacatctggaagtcttcccagttatgtgaagtggaaagccaattggctaaccaacaccattcgaaacagacaccaaatgtcacaattgctgactggggagaggaaccaacctgctgaaagacgtgaaacaggaagattggaatctgcctggaacaaagaactgcacctaagcagaccagaagcaaaatgtcttcttcacggcataaggacatctccacttttctctgtacctgtgtgtatagaaatagattagagcacagttgaaattcatggaactggcattatttaagcaactggaattccacactgtaggaaggttttgaaaattgtttggttgtagattttatcttatcctttagtgttgtgttcctactgtgatgtcttggtttttgtcatagacttaagtttataagtttgaactggacttgttcgattataaccacaaattgtgtgtgtgtgtgtgtgtgtgtgtgtgtgtgtgtgtgtgtgtgtatgcctgtgtgtatatatagaagtcattatggcagatgcacagaaattgtgcagtgatgtaaatgttcatactttacagagcctataatttttatttttcaatttgttttttcaaaaatctcttctcggggacaacatctgaagggtatgttgcatgcattaaaaaaaatcatctcacatgcattttatagttttggggaagaaaatatcatggggaggtctaccttcagtatctttagtgcttcttacctggtaacttgagactttaaaagaagaaacaaagaggggaagatatgggagcgaatttattccaagaatctacaatgacattgaagttgttggaggaatgtactgtatttaaaaaaaccttctgtgacacattcaaaaatttcatctgagctggatgcagtggcttgttcctatagtcccagcactttgggaggctgaggtgggtggattgcttgagcccaggagttggagaccagtctgggaaacgtggtgagacctcatctctacaaaatacaaaaaaattagccgggcatggtggcacgtgagtgtagtctcagctactcaggaggctgagatgagaggatcacttgagcctggggaggtccaggccgcagtgatccgagatcacaccactgcattccagcctgggtgacagagtgagaccctgtccaaaaaaaaaaaaaaaaaaaagaaggcaatggctttgtgcttttgaagatggattgaagagaacgtccaccttaaggctttaaaagacagtgaagctgggtgcggtggtgcactcctgtaaccctgggactttgggaagctgaggcaggaagattgagcctaggagttcgagaccgacctgggcagcatagcgagaccccatctctatataaaaaaaaagatgttaaaacagtgaaattacagaaacagaacatagccaccctttttcatcagtgaccttttcttcacgtggaggtcaactcagtaggtgagaataattagtaggttcagcagaataaactctttacaattaataactcagtggaaaatgatgttcagatggtgaaatgtggaaatgttttagacaactctattttcagcctgtgcttctcactcaccatcctgttgggattaacagttgagggccatcgctgcctaaacatttagcgtgcggtttcccatcagttttaccgtgaatgtgaaaaggtgaaactggtgctgacttcggcagcaggtatactaaaattggaatgacacagaggagattagcatggccccctgcgcgaggaagatctgcagattcatgcagcattccatatttttttaagaaaaggttacactgtgcaccgacatgtggagctagaaggaaaagcttttaagtctcatgtttgctgactataaaaataaatcatagtaataatattgaacattctactttaaaaattattaataaaaccataaatgaaacacttgagcacactttaaaaagtacataaatccatgagtccatatgcctatttttaggttgtctgttttattatccaggatttcatactcagatgagaattagcatcaggaaagcctgaaatgccttaattgtgaactgatatgcaggaaaatgaaatatgcaagcacattggtgaccttgttctttacagacgtcgtgatcagcctccagccatacagaacaaatgagaaattagaagcgattccaagaacgtgtgatggtgtgaaacccactttggaccatcacacacatttcagcatttgaagtgacacaagctacctggtaactgcccatggcggggtcatagtttaaatggcccaatgtcatgtagaggttaatttaatcaaaatgagctataaacatggagcaatcactgtataattttaaaatagtttacctggccaggcatggtcgctcacgcctgtaatcccagcactttgggaggccgaggcaggtggatcacctgaggtcaggagttcgagaccagcctggccaacatggcaaaacccccgtctctactaaaatacaaaaattaggtgtggtggcgggcacctgtaatcctggctactcgggaggctgaggcaggagaatcgcttgaacccgggaggcagaggctgcagtgagccgagatcgtgccactgcactccagcctgggccacagagcaagactccgtctcaaaacataaaaataaaaaaaatacaaatagctgacccgggtgggcattccaaaatgtccgcatggacgatcacgaaacaatcacggtgcgaaatgtccgcatggatgatcacgaaacaatcacggtgcggaatgtccgtatggatgatcatgacaaacaatcactgcgcaaaatgtggaggaaaattcattaccataatcacaacatttgtatcagaaaaacattacaaatttactttgcttcatgtaattttacgagttggcaatattttcttaaattggaatactctaagagaataggacatggatatgttacaagaagaagtgtattggggcaagtcttgtttttctgaagggaaatgccaccggcctgctttcataggcattgataaagccaggaaggaaataaagtcacaaccaaatagtatacactgtctctactgaattcttctaattccttcgcaacagaagtctaaatcctgcttagcctaaacatatctatagccagcgatgggcaaattatatttgctgtcagcatgatagaataagaagcagaaaccccccagcagtggggtaagattgcgcgcttcatcccctcaaaatgcagttcagccccactccctctccatgcccatcaaacaactgcacaatcacttgttactgaatttcccattcagcgttttgtttctttctgtccatacttaaagaccaaatcatttgtttgctttgaagaaaaagcaaaaacaagaacaaaaacaccaaatcatttgaaatcactgtccattaaaaaaaatcaccagtggaactaaacagttgagtggtttgggatgtgttcgccatttctgtgtttgacctacatggcctctaattctttggaccattgtaactgtgaaactatggcttaatactgttaaagaccccaaggctccactctgtagccaggtgcacctcaggctgcacaaataccccaccagaatgtcacaatcattcattgctccagctactgagtgaacagggtgcaagacagcactggcttgggttgtatttttgcagccagttaactttgcatcaggtctacacagtccttgcagcctttgatttctccagttgtagagatttgaaatggggtgcccgggttcctctcgtttttccttcaatctacctagcatgcattttacacacattggaggagtcgtatgcactgtttttctgttgctgatggaggcaagcaggccttctaattagtctaacttaaacggatgggattcacttaacaaaagcaagaagaaaagcacacgaacaggtgtcttaatgcatttggatagtttctttgcggggtgtgtgtgtgtgtgtgtgtgtgtgtgtgtgtgtgtgtgtgtgtgtcttggtgaaggtgaggggctgtattttcaccaagccttttcataatcaagtttgctttgcaaaccttatggccttgcaccccgcagaacagtcccttcctaatagcagggatgctctgtcatggttttctgtaaattatcgtgtgttgggaagttctgttgaggcttagtttgatcttccatggtggacacgtctgttctgtatgtaaaaggcattacaattgtgttttagcagatgagacttgaagcctttccacagtccttgtgctctgagatggctgttgagctctgctcaactgtcgtagctgaattctttctttgcgctgaacactgggcagcctcaccatgttgccaacgtgcttctggggcccctgtcactgccgccggatgccgcgcacacaggcagagtgccttggcaggtttgtgcaccccttggcgagccagaactgggaaccccgcggggtgaccccttctcatggggggtcggggaggggagtgcctatttttaatcctgtctgtttgttgcacaatggaaatcactgtgatttgtacatatgccctaggaaaattttactgctgtctaatttatgtaataatactgttgattccaggtttgtttaataaaactttgtatcttttcagaagtctgagtttcatctgcttctgtctcc

SEQ ID NO: 313932 - DNA, 6000 bp, Homo sapiens
ccacgcgtccggagctggaggaggcggcgggcgcgagacccggaatgcgcagggcccccgcctcgccccccccagcccgggccgcggcccccgccttccccgcagtcgtcccgcactcggtgcccgccccccgaggccggcggctgctcccactcggggccgttgctgcttgtgccgtgagcgccgcccagccattgtccccgtcgctccgtcagccgcgccggaccgcgcaccaggaggcgagagcgcgcatggggagcctctgttgatgccgccgccgcgccgccctccgaggctgcgtcccgggaagcccggctccccgagcgctccggcctggcccggtgccccggacctgagtgcgtccccatggaggcgcccgggctggcccaggcggccgcggcggagagcgactcccgcaaggtggcggaggagacccccgacggggcgcccgcgctctgccccagccctgaggcgctgtcgccggagccgcctgtgtacagcctgcaggactttgacacgctggccaccgtgggcactgggacgttcgggcgggtgcacctggtgaaggagaagacagccaagcatttcttcgccctcaaggtgatgagcattcccgacgtcatccgcctaaagcaggagcaacacgtacacaatgagaagtctgtcctgaaggaagtcagccacccgttcctcatcaggctgttctggacgtggcatgacgagcgcttcctctacatgctcatggagtacgtgccgggcggcgagctcttcagctacctgcgcaaccgggggcgcttctccagcaccacggggctcttctactctgcagagatcatctgtgccatcgagtacctgcactccaaagagatcgtctacagggacttgaagccagagaacatcctgctggatagggatggccacattaagctcacggactttgggttcgccaagaagctggtagacaggacttggaccctctgtggaacacccgagtacctagcccccgaagtcattcagagcaagggccacggaagggccgtggactggtgggccctcggcatcctgatattcgagatgctttcggggtttcctccgttttttgatgacaacccgtttggcatttatcagaaaattcttgcaggcaaaatagatttccccagacatttggatttccatgtaaaagacctcattaagaaactgctcgtggttgacagaacaaggcgattaggaaacatgaagaacggggcgaatgatgtgaagcatcatcggtggttccgctccgtggactgggaagctgttccgcagagaaaactgaagcctcccatcgtgcccaagatagctggtgacggcgacacttccaacttcgaaacttaccctgagaatgactgggacacagccgcgcccgtgccgcagaaggatttagaaatcttcaagaatttctgaggacaggagctcacatctggaagaaacaggaagattggaatctgcctggaacaaagaactgcacctaagcagaccagaagcaaaatgtcttcttcacggcataaggacatctccacttttctctgtacctgtgtgtatagaaatagattagagcacagttgaaattcatggaactggcattatttaagcaactggaattccacactgtaggaaggttttgaaaattgtttggttgtagattttatcttatcctttagtgttgtgttcctactgtgatgtcttggtttttgtcatagacttaagtttataagtttgaactggacttgttcgattataaccacaaattgtgtgtgtgtgtgtgtgtgtgtgtgtgtgtgtgtgtgtgtgtgtatgcctgtgtgtatatatagaagtcattatggcagatgcacagaaattgtgcagtgatgtaaatgttcatactttacagagcctataatttttatttttcaatttgttttttcaaaaatctcttctcggggacaacatctgaagggtatgttgcatgcattaaaaaaaatcatctcacatgcattttatagttttggggaagaaaatatcatggggaggtctaccttcagtatctttagtgcttcttacctggtaacttgagactttaaaagaagaaacaaagaggggaagatatgggagcgaatttattccaagaatctacaatgacattgaagttgttggaggaatgtactgtatttaaaaaaaccttctgtgacacattcaaaaatttcatctgagctggatgcagtggcttgttcctatagtcccagcactttgggaggctgaggtgggtggattgcttgagcccaggagttggagaccagtctgggaaacgtggtgagacctcatctctacaaaatacaaaaaaattagccgggcatggtggcacgtgagtgtagtctcagctactcaggaggctgagatgagaggatcacttgagcctggggaggtccaggccgcagtgatccgagatcacaccactgcattccagcctgggtgacagagtgagaccctgtccaaaaaaaaaaaaaaaaaaaagaaggcaatggctttgtgcttttgaagatggattgaagagaacgtccaccttaaggctttaaaagacagtgaagctgggtgcggtggtgcactcctgtaaccctgggactttgggaagctgaggcaggaagattgagcctaggagttcgagaccgacctgggcagcatagcgagaccccatctctatataaaaaaaaagatgttaaaacagtgaaattacagaaacagaacatagccaccctttttcatcagtgaccttttcttcacgtggaggtcaactcagtaggtgagaataattagtaggttcagcagaataaactctttacaattaataactcagtggaaaatgatgttcagatggtgaaatgtggaaatgttttagacaactctattttcagcctgtgcttctcactcaccatcctgttgggattaacagttgagggccatcgctgcctaaacatttagcgtgcggtttcccatcagttttaccgtgaatgtgaaaaggtgaaactggtgctgacttcggcagcaggtatactaaaattggaatgacacagaggagattagcatggccccctgcgcgaggaagatctgcagattcatgcagcattccatatttttttaagaaaaggttacactgtgcaccgacatgtggagctagaaggaaaagcttttaagtctcatgtttgctgactataaaaataaatcatagtaataatattgaacattctactttaaaaattattaataaaaccataaatgaaacacttgagcacactttaaaaagtacataaatccatgagtccatatgcctatttttaggttgtctgttttattatccaggatttcatactcagatgagaattagcatcaggaaagcctgaaatgccttaattgtgaactgatatgcaggaaaatgaaatatgcaagcacattggtgaccttgttctttacagacgtcgtgatcagcctccagccatacagaacaaatgagaaattagaagcgattccaagaacgtgtgatggtgtgaaacccactttggaccatcacacacatttcagcatttgaagtgacacaagctacctggtaactgcccatggcggggtcatagtttaaatggcccaatgtcatgtagaggttaatttaatcaaaatgagctataaacatggagcaatcactgtataattttaaaatagtttacctggccaggcatggtcgctcacgcctgtaatcccagcactttgggaggccgaggcaggtggatcacctgaggtcaggagttcgagaccagcctggccaacatggcaaaacccccgtctctactaaaatacaaaaattaggtgtggtggcgggcacctgtaatcctggctactcgggaggctgaggcaggagaatcgcttgaacccgggaggcagaggctgcagtgagccgagatcgtgccactgcactccagcctgggccacagagcaagactccgtctcaaaacataaaaataaaaaaaatacaaatagctgacccgggtgggcattccaaaatgtccgcatggacgatcacgaaacaatcacggtgcgaaatgtccgcatggatgatcacgaaacaatcacggtgcggaatgtccgtatggatgatcatgacaaacaatcactgcgcaaaatgtggaggaaaattcattaccataatcacaacatttgtatcagaaaaacattacaaatttactttgcttcatgtaattttacgagttggcaatattttcttaaattggaatactctaagagaataggacatggatatgttacaagaagaagtgtattggggcaagtcttgtttttctgaagggaaatgccaccggcctgctttcataggcattgataaagccaggaaggaaataaagtcacaaccaaatagtatacactgtctctactgaattcttctaattccttcgcaacagaagtctaaatcctgcttagcctaaacatatctatagccagcgatgggcaaattatatttgctgtcagcatgatagaataagaagcagaaaccccccagcagtggggtaagattgcgcgcttcatcccctcaaaatgcagttcagccccactccctctccatgcccatcaaacaactgcacaatcacttgttactgaatttcccattcagcgttttgtttctttctgtccatacttaaagaccaaatcatttgtttgctttgaagaaaaagcaaaaacaagaacaaaaacaccaaatcatttgaaatcactgtgtttgacctacatggcctctaattctttggaccattgtaactgtgaaactatggcttaatactgttaaagaccccaaggctccactctgtagccaggtgcacctcaggctgcacaaataccccaccagaatgtcacaatcattcattgctccagctactgagtgaacagggtgcaagacagcactggcttgggttgtatttttgcagccagttaactttgcatcaggtctacacagtccttgcagcctttgatttctccagttgtagagatttgaaatggggtgcccgggttcctctcgtttttccttcaatctacctagcatgcattttacacacattggaggagtcgtatgcactgtttttctgttgctgatggaggcaagcaggccttctaattagtctaacttaaacggatgggattcacttaacaaaagcaagaagaaaagcacacgaacaggtgtcttaatgcatttggatagtttctttgcggggtgtgtgtgtgtgtgtgtgtgtgtgtgtgtgtgtgtgtgtgtgtgtcttggtgaaggtgaggggctgtattttcaccaagccttttcataatcaagtttgctttgcaaaccttatggccttgcaccccgcagaacagtcccttcctaatagcagggatgctctgtcatggttttctgtaaattatcgtgtgttgggaagttctgttgaggcttagtttgatcttccatggtggacacgtctgttctgtatgtaaaaggcattacaattgtgttttagcagatgagacttgaagcctttccacagtccttgtgctctgagatggctgttgagctctgctcaactgtcgtagctgaattctttctttgcgctgaacactgggcagcctcaccatgttgccaacgtgcttctggggcccctgtcactgccgccggatgccgcgcacacaggcagagtgccttggcaggtttgtgcaccccttggcgagccagaactgggaaccccgcggggtgaccccttctcatggggggtcggggaggggagtgcctatttttaatcctgtctgtttgttgcacaatggaaatcactgtgatttgtacatatgccctaggaaaattttactgctgtctaatttatgtaataatactgttgattccaggtttgtttaataaaactttgtatcttttcagaagtctgagtttcatctgcttctgtctcc

SEQ ID NO: 313933 - DNA, 1864 bp, Homo sapiens
ccacgcgtccggagctggaggaggcggcgggcgcgagacccggaatgcgcagggcccccgcctcgccccccccagcccgggccgcggcccccgccttccccgcagtcgtcccgcactcggtgcccgccccccgaggccggcggctgctcccactcggggccgttgctgcttgtgccgtgagcgccgcccagccattgtccccgtcgctccgtcagccgcgccggaccgcgcaccaggaggcgagagcgcgcatggggagcctctgttgatgccgccgccgcgccgccctccgaggctgcgtcccgggaagcccggctccccgagcgctccggcctggcccggtgccccggacctgagtgcgtccccatggaggcgcccgggctggcccaggcggccgcggcggagagcgactcccgcaaggtggcggaggagacccccgacggggcgcccgcgctctgccccagccctgaggcgctgtcgccggagccgcctgtgtacagcctgcaggactttgacacgctggccaccgtgggcactgggacgttcgggcgggtgcacctggtgaaggagaagacagccaagcatttcttcgccctcaaggtgatgagcattcccgacgtcatccgcctaaagcaggagcaacacgtacacaatgagaagtctgtcctgaaggaagtcagccacccgttcctcatcaggctgttctggacgtggcatgacgagcgcttcctctacatgctcatggagtacgtgccgggcggcgagctcttcagctacctgcgcaaccgggggcgcttctccagcaccacggggctcttctactctgcagagatcatctgtgccatcgagtacctgcactccaaagagatcgtctacagggacttgaagccagagaacatcctgctggatagggatggccacattaagctcacggactttgggttcgccaagaagctggtagacaggacttggaccctctgtggaacacccgagtacctagcccccgaagtcattcagagcaagggccacggaagggccgtggactggtgggccctcggcatcctgatattcgagatgctttcggggtttcctccgttttttgatgacaacccgtttggcatttatcagaaaattcttgcaggcaaaatagatttccccagacatttggatttccatgtaaaagacctcattaagaaactgctcgtggttgacagaacaaggcgattaggaaacatgaagaacggggcgaatgatgtgaagcatcatcggtggttccgctccgtggactgggaagctgttccgcagagaaaactgaagcctcccatcgtgcccaagatagctggtgacggcgacacttccaacttcgaaacttaccctgagaatgactgggacacagccgcgcccgtgccgcagaaggatttagaaatcttcaagaatttctgaggacaggagctcacatctggaagtcttcccagttatgtgaagtggaaagccaattggctaaccaacaccattcgaaacagacaccaaatgtcacaattgctgactggggagaggaaccaacctgctgaaagacgtggtgaatgagagccctccatcctgggcaggtgtttacatggatgtaccaagaggaaagctggatacaaattgaaataatagacaacaaaatgatagaggaataggtggctatgacctcgagaagataacctgtctccatggcatggcttcacctctcagtgtgtgatgaacgctttcacagtggtgactggtttgtattaacatgagagcgtgtaactttaccaacttcataaacgctcatgaaatccagttgcgggttttaaaaatcataagatgttcctgaatg

SEQ ID NO: 313934 - DNA, 6066 bp, Homo sapiens
ccacgcgtccggagctggaggaggcggcgggcgcgagacccggaatgcgcagggcccccgcctcgccccccccagcccgggccgcggcccccgccttccccgcagtcgtcccgcactcggtgcccgccccccgaggccggcggctgctcccactcggggccgttgctgcttgtgccgtgagcgccgcccagccattgtccccgtcgctccgtcagccgcgccggaccgcgcaccaggaggcgagagcgcgcatggggagcctctgttgatgccgccgccgcgccgccctccgaggctgcgtcccgggaagcccggctccccgagcgctccggcctggcccggtgccccggacctgagtgcgtccccatggaggcgcccgggctggcccaggcggccgcggcggagagcgactcccgcaaggtggcggaggagacccccgacggggcgcccgcgctctgccccagccctgaggcgctgtcgccggagccgcctgtgtacagcctgcaggactttgacacgctggccaccgtgggcactgggacgttcgggcgggtgcacctggtgaaggagaagacagccaagcatttcttcgccctcaaggtgatgagcattcccgacgtcatccgcctaaagcaggagcaacacgtacacaatgagaagtctgtcctgaaggaagtcagccacccgttcctcatcaggctgttctggacgtggcatgacgagcgcttcctctacatgctcatggagtacgtgccgggcggcgagctcttcagctacctgcgcaaccgggggcgcttctccagcaccacggggctcttctactctgcagagatcatctgtgccatcgagtacctgcactccaaagagatcgtctacagggacttgaagccagagaacatcctgctggatagggatggccacattaagctcacggactttgggttcgccaagaagctggtagacaggacttggaccctctgtggaacacccgagtacctagcccccgaagtcattcagagcaagggccacggaagggccgtggactggtgggccctcggcatcctgatattcgagatgctttcggggtttcctccgttttttgatgacaacccgtttggcatttatcagaaaattcttgcaggcaaaatagatttccccagacatttggatttccatgtaaaagacctcattaagaaactgctcgtggttgacagaacaaggcgattaggaaacatgaagaacggggcgaatgatgtgaagcatcatcggtggttccgctccgtggactgggaagctgttccgcagagaaaactgaagcctcccatcgtgcccaagatagctggtgacggcgacacttccaacttcgaaacttaccctgagaatgactgggacacagccgcgcccgtgccgcagaaggatttagaaatcttcaagaatttctgaggacaggagctcacatctggaagaaacaggaagattggaatctgcctggaacaaagaactgcacctaagcagaccagaagcaaaatgtcttcttcacggcataaggacatctccacttttctctgtacctgtgtgtatagaaatagattagagcacagttgaaattcatggaactggcattatttaagcaactggaattccacactgtaggaaggttttgaaaattgtttggttgtagattttatcttatcctttagtgttgtgttcctactgtgatgtcttggtttttgtcatagacttaagtttataagtttgaactggacttgttcgattataaccacaaattgtgtgtgtgtgtgtgtgtgtgtgtgtgtgtgtgtgtgtgtgtgtatgcctgtgtgtatatatagaagtcattatggcagatgcacagaaattgtgcagtgatgtaaatgttcatactttacagagcctataatttttatttttcaatttgttttttcaaaaatctcttctcggggacaacatctgaagggtatgttgcatgcattaaaaaaaatcatctcacatgcattttatagttttggggaagaaaatatcatggggaggtctaccttcagtatctttagtgcttcttacctggtaacttgagactttaaaagaagaaacaaagaggggaagatatgggagcgaatttattccaagaatctacaatgacattgaagttgttggaggaatgtactgtatttaaaaaaaccttctgtgacacattcaaaaatttcatctgagctggatgcagtggcttgttcctatagtcccagcactttgggaggctgaggtgggtggattgcttgagcccaggagttggagaccagtctgggaaacgtggtgagacctcatctctacaaaatacaaaaaaattagccgggcatggtggcacgtgagtgtagtctcagctactcaggaggctgagatgagaggatcacttgagcctggggaggtccaggccgcagtgatccgagatcacaccactgcattccagcctgggtgacagagtgagaccctgtccaaaaaaaaaaaaaaaaaaaagaaggcaatggctttgtgcttttgaagatggattgaagagaacgtccaccttaaggctttaaaagacagtgaagctgggtgcggtggtgcactcctgtaaccctgggactttgggaagctgaggcaggaagattgagcctaggagttcgagaccgacctgggcagcatagcgagaccccatctctatataaaaaaaaagatgttaaaacagtgaaattacagaaacagaacatagccaccctttttcatcagtgaccttttcttcacgtggaggtcaactcagtaggtgagaataattagtaggttcagcagaataaactctttacaattaataactcagtggaaaatgatgttcagatggtgaaatgtggaaatgttttagacaactctattttcagcctgtgcttctcactcaccatcctgttgggattaacagttgagggccatcgctgcctaaacatttagcgtgcggtttcccatcagttttaccgtgaatgtgaaaaggtgaaactggtgctgacttcggcagcaggtatactaaaattggaatgacacagaggagattagcatggccccctgcgcgaggaagatctgcagattcatgcagcattccatatttttttaagaaaaggttacactgtgcaccgacatgtggagctagaaggaaaagcttttaagtctcatgtttgctgactataaaaataaatcatagtaataatattgaacattctactttaaaaattattaataaaaccataaatgaaacacttgagcacactttaaaaagtacataaatccatgagtccatatgcctatttttaggttgtctgttttattatccaggatttcatactcagatgagaattagcatcaggaaagcctgaaatgccttaattgtgaactgatatgcaggaaaatgaaatatgcaagcacattggtgaccttgttctttacagacgtcgtgatcagcctccagccatacagaacaaatgagaaattagaagcgattccaagaacgtgtgatggtgtgaaacccactttggaccatcacacacatttcagcatttgaagtgacacaagctacctggtaactgcccatggcggggtcatagtttaaatggcccaatgtcatgtagaggttaatttaatcaaaatgagctataaacatggagcaatcactgtataattttaaaatagtttacctggccaggcatggtcgctcacgcctgtaatcccagcactttgggaggccgaggcaggtggatcacctgaggtcaggagttcgagaccagcctggccaacatggcaaaacccccgtctctactaaaatacaaaaattaggtgtggtggcgggcacctgtaatcctggctactcgggaggctgaggcaggagaatcgcttgaacccgggaggcagaggctgcagtgagccgagatcgtgccactgcactccagcctgggccacagagcaagactccgtctcaaaacataaaaataaaaaaaatacaaatagctgacccgggtgggcattccaaaatgtccgcatggacgatcacgaaacaatcacggtgcgaaatgtccgcatggatgatcacgaaacaatcacggtgcggaatgtccgtatggatgatcatgacaaacaatcactgcgcaaaatgtggaggaaaattcattaccataatcacaacatttgtatcagaaaaacattacaaatttactttgcttcatgtaattttacgagttggcaatattttcttaaattggaatactctaagagaataggacatggatatgttacaagaagaagtgtattggggcaagtcttgtttttctgaagggaaatgccaccggcctgctttcataggcattgataaagccaggaaggaaataaagtcacaaccaaatagtatacactgtctctactgaattcttctaattccttcgcaacagaagtctaaatcctgcttagcctaaacatatctatagccagcgatgggcaaattatatttgctgtcagcatgatagaataagaagcagaaaccccccagcagtggggtaagattgcgcgcttcatcccctcaaaatgcagttcagccccactccctctccatgcccatcaaacaactgcacaatcacttgttactgaatttcccattcagcgttttgtttctttctgtccatacttaaagaccaaatcatttgtttgctttgaagaaaaagcaaaaacaagaacaaaaacaccaaatcatttgaaatcactgtccattaaaaaaaatcaccagtggaactaaacagttgagtggtttgggatgtgttcgccatttctgtgtttgacctacatggcctctaattctttggaccattgtaactgtgaaactatggcttaatactgttaaagaccccaaggctccactctgtagccaggtgcacctcaggctgcacaaataccccaccagaatgtcacaatcattcattgctccagctactgagtgaacagggtgcaagacagcactggcttgggttgtatttttgcagccagttaactttgcatcaggtctacacagtccttgcagcctttgatttctccagttgtagagatttgaaatggggtgcccgggttcctctcgtttttccttcaatctacctagcatgcattttacacacattggaggagtcgtatgcactgtttttctgttgctgatggaggcaagcaggccttctaattagtctaacttaaacggatgggattcacttaacaaaagcaagaagaaaagcacacgaacaggtgtcttaatgcatttggatagtttctttgcggggtgtgtgtgtgtgtgtgtgtgtgtgtgtgtgtgtgtgtgtgtgtgtcttggtgaaggtgaggggctgtattttcaccaagccttttcataatcaagtttgctttgcaaaccttatggccttgcaccccgcagaacagtcccttcctaatagcagggatgctctgtcatggttttctgtaaattatcgtgtgttgggaagttctgttgaggcttagtttgatcttccatggtggacacgtctgttctgtatgtaaaaggcattacaattgtgttttagcagatgagacttgaagcctttccacagtccttgtgctctgagatggctgttgagctctgctcaactgtcgtagctgaattctttctttgcgctgaacactgggcagcctcaccatgttgccaacgtgcttctggggcccctgtcactgccgccggatgccgcgcacacaggcagagtgccttggcaggtttgtgcaccccttggcgagccagaactgggaaccccgcggggtgaccccttctcatggggggtcggggaggggagtgcctatttttaatcctgtctgtttgttgcacaatggaaatcactgtgatttgtacatatgccctaggaaaattttactgctgtctaatttatgtaataatactgttgattccaggtttgtttaataaaactttgtatcttttcagaagtctgagtttcatctgcttctgtctcc

SEQ ID NO: 313935 - DNA, 6008 bp, Homo sapiens
ccacgcgtccggagctggaggaggcggcgggcgcgagacccggaatgcgcagggcccccgcctcgccccccccagcccgggccgcggcccccgccttccccgcagtcgtcccgcactcggtgcccgccccccgaggccggcggctgctcccactcggggccgttgctgcttgtgccgtgagcgccgcccagccattgtccccgtcgctccgtcagccgcgccggaccgcgcaccaggaggcgagagcgcgcatggggagcctctgttgatgccgccgccgcgccgccctccgaggctgcgtcccgggaagcccggctccccgagcgctccggcctggcccggtgccccggacctgagtgcgtccccatggaggcgcccgggctggcccaggcggccgcggcggagagcgactcccgcaaggtggcggaggagacccccgacggggcgcccgcgctctgccccagccctgaggcgctgtcgccggagccgcctgtgtacagcctgcaggactttgacacgctggccaccgtgggcactgggacgttcgggcgggtgcacctggtgaaggagaagacagccaagcatttcttcgccctcaaggtgatgagcattcccgacgtcatccgcctaaagcaggagcaacacgtacacaatgagaagtctgtcctgaaggaagtcagccacccgttcctcatcaggctgttctggacgtggcatgacgagcgcttcctctacatgctcatggagtacgtgccgggcggcgagctcttcagctacctgcgcaaccgggggcgcttctccagcaccacggggctcttctactctgcagagatcatctgtgccatcgagtacctgcactccaaagagatcgtctacagggacttgaagccagagaacatcctgctggatagggatggccacattaagctcacggactttgggttcgccaagaagctggtagacaggacttggaccctctgtggaacacccgagtacctagcccccgaagtcattcagagcaagggccacggaagggccgtggactggtgggccctcggcatcctgatattcgagatgctttcggggtttcctccgttttttgatgacaacccgtttggcatttatcagaaaattcttgcaggcaaaatagatttccccagacatttggatttccatgtaaaagacctcattaagaaactgctcgtggttgacagaacaaggcgattaggaaacatgaagaacggggcgaatgatgtgaagcatcatcggtggttccgctccgtggactgggaagctgttccgcagagaaaactgaagcctcccatcgtgcccaagatagctggtgacggcgacacttccaacttcgaaacttaccctgagaatgactgggacacagccgcgcccgtgccgcagaaggatttagaaatcttcaagaatttctgaggacaggagctcacatctggaagaaacaggaagattggaatctgcctggaacaaagaactgcacctaagcagaccagaagcaaaatgtcttcttcacggcataaggacatctccacttttctctgtacctgtgtgtatagaaatagattagagcacagttgaaattcatggaactggcattatttaagcaactggaattccacactgtaggaaggttttgaaaattgtttggttgtagattttatcttatcctttagtgttgtgttcctactgtgatgtcttggtttttgtcatagacttaagtttataagtttgaactggacttgttcgattataaccacaaattgtgtgtgtgtgtgtgtgtgtgtgtgtgtgtgtgtgtgtgtgtgtatgcctgtgtgtatatatagaagtcattatggcagatgcacagaaattgtgcagtgatgtaaatgttcatactttacagagcctataatttttatttttcaatttgttttttcaaaaatctcttctcggggacaacatctgaagggtatgttgcatgcattaaaaaaaatcatctcacatgcattttatagttttggggaagaaaatatcatggggaggtctaccttcagtatctttagtgcttcttacctggtaacttgagactttaaaagaagaaacaaagaggggaagatatgggagcgaatttattccaagaatctacaatgacattgaagttgttggaggaatgtactgtatttaaaaaaaccttctgtgacacattcaaaaatttcatctgagctggatgcagtggcttgttcctatagtcccagcactttgggaggctgaggtgggtggattgcttgagcccaggagttggagaccagtctgggaaacgtggtgagacctcatctctacaaaatacaaaaaaattagccgggcatggtggcacgtgagtgtagtctcagctactcaggaggctgagatgagaggatcacttgagcctggggaggtccaggccgcagtgatccgagatcacaccactgcattccagcctgggtgacagagtgagaccctgtccaaaaaaaaaaaaaaaaaaaagaaggcaatggctttgtgcttttgaagatggattgaagagaacgtccaccttaaggctttaaaagacagtgaagctgggtgcggtggtgcactcctgtaaccctgggactttgggaagctgaggcaggaagattgagcctaggagttcgagaccgacctgggcagcatagcgagaccccatctctatataaaaaaaaagatgttaaaacagtgaaattacagaaacagaacatagccaccctttttcatcagtgaccttttcttcacgtggaggtcaactcagtaggtgagaataattagtaggttcagcagaataaactctttacaattaataactcagtggaaaatgatgttcagatggtgaaatgtggaaatgttttagacaactctattttcagcctgtgcttctcactcaccatcctgttgggattaacagttgagggccatcgctgcctaaacatttagcgtgcggtttcccatcagttttaccgtgaatgtgaaaaggtgaaactggtgctgacttcggcagcaggtatactaaaattggaatgacacagaggagattagcatggccccctgcgcgaggaagatctgcagattcatgcagcattccatatttttttaagaaaaggttacactgtgcaccgacatgtggagctagaaggaaaagcttttaagtctcatgtttgctgactataaaaataaatcatagtaataatattgaacattctactttaaaaattattaataaaaccataaatgaaacacttgagcacactttaaaaagtacataaatccatgagtccatatgcctatttttaggttgtctgttttattatccaggatttcatactcagatgagaattagcatcaggaaagcctgaaatgccttaattgtgaactgatatgcaggaaaatgaaatatgcaagcacattggtgaccttgttctttacagacgtcgtgatcagcctccagccatacagaacaaatgagaaattagaagcgattccaagaacgtgtgatggtgtgaaacccactttggaccatcacacacatttcagcatttgaagtgacacaagctacctggtaactgcccatggcggggtcatagtttaaatggcccaatgtcatgtagaggttaatttaatcaaaatgagctataaacatggagcaatcactgtataattttaaaatagtttacctggccaggcatggtcgctcacgcctgtaatcccagcactttgggaggccgaggcaggtggatcacctgaggtcaggagttcgagaccagcctggccaacatggcaaaacccccgtctctactaaaatacaaaaattaggtgtggtggcgggcacctgtaatcctggctactcgggaggctgaggcaggagaatcgcttgaacccgggaggcagaggctgcagtgagccgagatcgtgccactgcactccagcctgggccacagagcaagactccgtctcaaaacataaaaataaaaaaaatacaaatagctgacccgggtgggcattccaaaatgtccgcatggacgatcacgaaacaatcacggtgcgaaatgtccgcatggatgatcacgaaacaatcacggtgcggaatgtccgtatggatgatcatgacaaacaatcactgcgcaaaatgtggaggaaaattcattaccataatcacaacatttgtatcagaaaaacattacaaatttactttgcttcatgtaattttacgagttggcaatattttcttaaattggaatactctaagagaataggacatggatatgttacaagaagaagtgtattggggcaagtcttgtttttctgaagggaaatgccaccggcctgctttcataggcattgataaagccaggaaggaaataaagtcacaaccaaatagtatacactgtctctactgaattcttctaattccttcgcaacagaagtctaaatcctgcttagcctaaacatatctatagccagcgatgggcaaattatatttgctgtcagcatgatagaataagaagcagaaaccccccagcagtggggtaagattgcgcgcttcatcccctcaaaatgcagttcagccccactccctctccatgcccatcaaacaactgcacaatcacttgttactgaatttcccattcagcgttttgtttctttctgtccatacttaaagaccaaatcattttgtccattaaaaaaaatcaccagtggaactaaacagttgagtggtttgggatgtgttcgccatttctgtgtttgacctacatggcctctaattctttggaccattgtaactgtgaaactatggcttaatactgttaaagaccccaaggctccactctgtagccaggtgcacctcaggctgcacaaataccccaccagaatgtcacaatcattcattgctccagctactgagtgaacagggtgcaagacagcactggcttgggttgtatttttgcagccagttaactttgcatcaggtctacacagtccttgcagcctttgatttctccagttgtagagatttgaaatggggtgcccgggttcctctcgtttttccttcaatctacctagcatgcattttacacacattggaggagtcgtatgcactgtttttctgttgctgatggaggcaagcaggccttctaattagtctaacttaaacggatgggattcacttaacaaaagcaagaagaaaagcacacgaacaggtgtcttaatgcatttggatagtttctttgcggggtgtgtgtgtgtgtgtgtgtgtgtgtgtgtgtgtgtgtgtgtgtgtcttggtgaaggtgaggggctgtattttcaccaagccttttcataatcaagtttgctttgcaaaccttatggccttgcaccccgcagaacagtcccttcctaatagcagggatgctctgtcatggttttctgtaaattatcgtgtgttgggaagttctgttgaggcttagtttgatcttccatggtggacacgtctgttctgtatgtaaaaggcattacaattgtgttttagcagatgagacttgaagcctttccacagtccttgtgctctgagatggctgttgagctctgctcaactgtcgtagctgaattctttctttgcgctgaacactgggcagcctcaccatgttgccaacgtgcttctggggcccctgtcactgccgccggatgccgcgcacacaggcagagtgccttggcaggtttgtgcaccccttggcgagccagaactgggaaccccgcggggtgaccccttctcatggggggtcggggaggggagtgcctatttttaatcctgtctgtttgttgcacaatggaaatcactgtgatttgtacatatgccctaggaaaattttactgctgtctaatttatgtaataatactgttgattccaggtttgtttaataaaactttgtatcttttcagaagtctgagtttcatctgcttctgtctcc

SEQ ID NO: 313936 - DNA, 5486 bp, Homo sapiens
ccacgcgtccggagctggaggaggcggcgggcgcgagacccggaatgcgcagggcccccgcctcgccccccccagcccgggccgcggcccccgccttccccgcagtcgtcccgcactcggtgcccgccccccgaggccggcggctgctcccactcggggccgttgctgcttgtgccgtgagcgccgcccagccattgtccccgtcgctccgtcagccgcgccggaccgcgcaccaggaggcgagagcgcgcatggggagcctctgttgatgccgccgccgcgccgccctccgaggctgcgtcccgggaagcccggctccccgagcgctccggcctggcccggtgccccggacctgagtgcgtccccatggaggcgcccgggctggcccaggcggccgcggcggagagcgactcccgcaaggtggcggaggagacccccgacggggcgcccgcgctctgccccagccctgaggcgctgtcgccggagccgcctgtgtacagcctgcaggactttgacacgctggccaccgtgggcactgggacgttcgggcgggtgcacctggtgaaggagaagacagccaagcatttcttcgccctcaaggtgatgagcattcccgacgtcatccgcctaaagcaggagcaacacgtacacaatgagaagtctgtcctgaaggaagtcagccacccgttcctcatcaggctgttctggacgtggcatgacgagcgcttcctctacatgctcatggagtacgtgccgggcggcgagctcttcagctacctgcgcaaccgggggcgcttctccagcaccacggggctcttctactctgcagagatcatctgtgccatcgagtacctgcactccaaagagatcgtctacagggacttgaagccagagaacatcctgctggatagggatggccacattaagctcacggactttgggttcgccaagaagctggtagacaggacttggaccctctgtggaacacccgagtacctagcccccgaagtcattcagagcaagggccacggaagggccgtggactggtgggccctcggcatcctgatattcgagatgctttcggggtttcctccgttttttgatgacaacccgtttggcatttatcagaaaattcttgcaggcaaaatagatttccccagacatttggatttccatgtaaaagacctcattaagaaactgctcgtggttgacagaacaaggcgattaggaaacatgaagaacggggcgaatgatgtgaagcatcatcggtggttccgctccgtggactgggaagctgttccgcagagaaaactgaagcctcccatcgtgcccaagatagctggtgacggcgacacttccaacttcgaaacttaccctgagaatgactgggacacagccgcgcccgtgccgcagaaggatttagaaatcttcaagaatttctgaggacaggagctcacatctggaagaaacaggaagattggaatctgcctggaacaaagaactgcacctaagcagaccagaagcaaaatgtcttcttcacggcataaggacatctccacttttctctgtacctgtgtgtatagaaatagattagagcacagttgaaattcatggaactggcattatttaagcaactggaattccacactgtaggaaggttttgaaaattgtttggttgtagattttatcttatcctttagtgttgtgttcctactgtgatgtcttggtttttgtcatagacttaagtttataagtttgaactggacttgttcgattataaccacaaattgtgtgtgtgtgtgtgtgtgtgtgtgtgtgtgtgtgtgtgtgtgtatgcctgtgtgtatatatagaagtcattatggcagatgcacagaaattgtgcagtgatgtaaatgttcatactttacagagcctataatttttatttttcaatttgttttttcaaaaatctcttctcggggacaacatctgaagggtatgttgcatgcattaaaaaaaatcatctcacatgcattttatagttttggggaagaaaatatcatggggaggtctaccttcagtatctttagtgcttcttacctggtaacttgagactttaaaagaagaaacaaagaggggaagatatgggagcgaatttattccaagaatctacaatgacattgaagttgttggaggaatgtactgtatttaaaaaaaccttctgtgacacattcaaaaatttcatctgagctggatgcagtggcttgttcctatagtcccagcactttgggaggctgaggtgggtggattgcttgagcccaggagttggagaccagtctgggaaacgtggtgagacctcatctctacaaaatacaaaaaaattagccgggcatggtggcacgtgagtgtagtctcagctactcaggaggctgagatgagaggatcacttgagcctggggaggtccaggccgcagtgatccgagatcacaccactgcattccagcctgggtgacagagtgagaccctgtccaaaaaaaaaaaaaaaaaaaagaaggcaatggctttgtgcttttgaagatggattgaagagaacgtccaccttaaggctttaaaagacagtgaagctgggtgcggtggtgcactcctgtaaccctgggactttgggaagctgaggcaggaagattgagcctaggagttcgagaccgacctgggcagcatagcgagaccccatctctatataaaaaaaaagatgttaaaacagtgaaattacagaaacagaacatagccaccctttttcatcagtgaccttttcttcacgtggaggtcaactcagtaggtgagaataattagtaggttcagcagaataaactctttacaattaataactcagtggaaaatgatgttcagatggtgaaatgtggaaatgttttagacaactctattttcagcctgtgcttctcactcaccatcctgttgggattaacagttgagggccatcgctgcctaaacatttagcgtgcggtttcccatcagttttaccgtgaatgtgaaaaggtgaaactggtgctgacttcggcagcaggtatactaaaattggaatgacacagaggagattagcatggccccctgcgcgaggaagatctgcagattcatgcagcattccatatttttttaagaaaaggttacactgtgcaccgacatgtggagctagaaggaaaagcttttaagtctcatgtttgctgactataaaaataaatcatagtaataatattgaacattctactttaaaaattattaataaaaccataaatgaaacacttgagcacactttaaaaagtacataaatccatgagtccatatgcctatttttaggttgtctgttttattatccaggatttcatactcagatgagaattagcatcaggaaagcctgaaatgccttaattgtgaactgatatgcaggaaaatgaaatatgcaagcacattggtgaccttgttctttacagacgtcgtgatcagcctccagccatacagaacaaatgagaaattagaagcgattccaagaacgtgtgatggtgtgaaacccactttggaccatcacacacatttcagcatttgaagtgacacaagctacctggtaactgcccatggcggggtcatagtttaaatggcccaatgtcatgtagaggttaatttaatcaaaatgagctataaacatggagcaatcactgtataattttaaaatagtttacctggccaggcatggtcgctcacgcctgtaatcccagcactttgggaggccgaggcaggtggatcacctgaggtcaggagttcgagaccagcctggccaacatggcaaaacccccgtctctactaaaatacaaaaattaggtgtggtggcgggcacctgtaatcctggctactcgggaggctgaggcaggagaatcgcttgaacccgggaggcagaggctgcagtgagccgagatcgtgccactgcactccagcctgggccacagagcaagactccgtctcaaaacataaaaataaaaaaaatacaaatagctgacccgggtgggcattccaaaatgtccgcatggacgatcacgaaacaatcacggtgcgaaatgtccgcatggatgatcacgaaacaatcacggtgcggaatgtccgtatggatgatcatgacaaacaatcactgcgcaaaatgtggaggaaaattcattaccataatcacaacatttgtatcagaaaaacattacaaatttactttgcttcatgtaattttacgagttggcaatattttcttaaattggaatactctaagagaataggacatggatatgttacaagaagaagtgtattggggcaagtcttgtttttctgaagggaaatgccaccggcctgctttcataggcattgataaagccaggaaggaaataaagtcacaaccaaatagtatacactgtctctactgaattcttctaattccttcgcaacagaagtctaaatcctgcttagcctaaacatatctatagccagcgatgggcaaattatatttgctgtcagcatgatagaataagaagcagaaaccccccagcagtggggtaagattgcgcgcttcatcccctcaaaatgcagttcagccccactccctctccatgcccatcaaacaactgcacaatcacttgttactgaatttcccattcagcgttttgtttctttctgtccatacttaaagaccaaatcatttgtttgctttgaagaaaaagcaaaaacaagaacaaaaacaccaaatcatttgaaatcactgtccattaaaaaaaatcaccagtggaactaaacagttgagtggtttgggatgtgttcgccatttctgtgtttgacctacatggcctctaattctttggaccattgtaactgtgaaactatggcttaatactgttaaagaccccaaggctccactctgtagccaggtgcacctcaggctgcacaaataccccaccagaatgtcacaatcattcattgctccagctactgagtgaacagggtgcaagacagcactggcttgggttgtatttttgcagccagttaactttgcatcaggtctacacagtccttgcagcctttgatttctccagttgtagagatttgaaatggggtgcccgggttcctctcgtttttccttcaatctacctagcatgcattttacacacattggaggagtcgtatgcactgtttttctgttgctgatggaggcaagcaggccttctaattagtctaacttaaacggatgggattcacttaacaaaagcaagaagaaaagcacacgaacaggtgtcttaatgcatttggatagtttctttgcggggtgtgtgtgtgtgtgtgtgtgtgtgtgtgtgtgtgctgggagaaggcagagtacagtgcgcactgctctgtgtgtgtgtgtgtgtgtgtgtgtgtgtgtgtgtgtggagaatacagagagaaaggagagacgcgcg

SEQ ID NO: 313937 - DNA, 669 bp, Homo sapiens
atcagactggatgtcccgctcgtttgacacgagcgggatggagatctggacgggagcggtcagtgtcttccttcttcttcttcttgctgctgcccgcttggtgtctcgcttgctgcatcggtttctgctcctctcactcttgctgcggctgcgactgcgactgcggctctcctctagctttcttcctaccccattcccggcttccctcctcctcccctgcagcctggttaggtggatacctgccctgacatgtgaggcaagctaaggcctggagggtcagatgggagaccaggtcccaagggagcaagacctcgcgaagcgcagcagccccggcccttcccccgttttgaacatgtgtaaccgacagtctgcctgggccacagccctctcaccctggtactgcatgcacgcaatgctagctgcccctttcccgtcctgggcaccccgagtctcccccgaccccgggtcccaggtatgctcccacctccacctgccccactcaccacctctgctagttccagacacctccacgcccacctggtcctctcccatcgcccacaaaagggggggcacgagggacgagcttagctgagctgggaggagcagggtgagggtgggcgacccaggattccccctccccttcccaaataaagatgagggtactaaagt

SEQ ID NO: 313938 - DNA, 336 bp, Homo sapiens
gagacggcgcctgcctttgggcctcaggcctcgtcttttttgctgcttctgcatgaccttccctctcttctcatctctcttcctcctttcaccctcttgagacatcctcctccaggccatgcgggctgcacaggaccaaggactagagggtgttaggggattgtgggggaaggggtagcacagggtggtcacacatggacacagccacacagataggcacgagcacatcaacacacgggagatacacagatgcagacacggatacacgtgtgtgcagacagcacagggacacgcatgcaggaatgtgcagctacacgtgggcacacgtgatcctga

SEQ ID NO: 313939 - DNA, 453 bp, Homo sapiens
ggggtcgcgccaggggccgtaaacacgggcccaggaagtggggcaggagggggggcgccgcagctgcgcggccgctccctcctagccggcccttgaggggggtccagcccacgcctgggcctgacccgggccgccccatccctacagggctcctcgcacctaccccagcaactcaaattcaccacctcggactcctgcgaccgcatcaaagacgaatttcagctactgcaagctcagtaccacaggtgagctgggggactgggggtccctgcgtcccgagaatgtgagtccccccatttcttctgcgcagatggcaaggctgaggcctggagattgggaaaataatatatgctagactctgacctaatcacttgacaaatactgaattcatttattttaaacagccccattttgtagaggagaaaaccgaggcacaaaaatagttaaataatt

SEQ ID NO: 313940 - DNA, 1416 bp, Homo sapiens
aatcggaacaaacttaggctaggtacgaggctggggtgcggcggcggccccgggagctgccgatcggcgccgggacaaaggcgcggccgcccggcgcccccagcagcccgagccggggcgcacagccggggcgcagcccgcgccccccgccgcgattgacatgatgtttccacaaagcaggcattcgggctcctcgcacctaccccagcaactcaaattcaccacctcggactcctgcgaccgcatcaaagacgaatttcagctactgcaagctcagtaccacagcctcaagctcgaatgtgacaagttggccagtgagaagtcagagatgcagcgtcactatgtgatgtactacgagatgtcctacggcttgaacatcgagatgcacaaacaggctgagatcgtcaaaaggctgaacgggatttgtgcccaggtcctgccctacctctcccaagagcaccagcagcaggtcttgggagccattgagagggccaagcaggtcaccgctcccgagctgaactctatcatccgacagcagctccaagcccaccagctgtcccagctgcaggccctggccctgcccttgaccccactacccgtggggctgcagccgccttcgctgccggcggtcagcgcaggcaccggcctcctctcgctgtccgcgctgggttcccaggcccacctctccaaggaagacaagaacgggcacgatggtgacacccaccaggaggatgatggcgagaagtcggattagcagggggccgggacggggaggttgggaggggggacagaggggagacagaggcacggagagaaaggaatgtttagcacaagacacagcggagctcgggattggctaaactcccatagtatttatggtggccgccggcgggggccccagcccagcttgcaggccacctctagctttcttcctaccccattcccggcttccctcctcctcccctgcagcctggttaggtggatacctgccctgacatgtgaggcaagctaaggcctggagggtcagatgggagaccaggtcccaagggagcaagacctcgcgaagcgcagcagccccggcccttcccccgttttgaacatgtgtaaccgacagtctgcctgggccacagccctctcaccctggtactgcatgcacgcaatgctagctgcccctttcccgtcctgggcaccccgagtctcccccgaccccgggtcccaggtatgctcccacctccacctgccccactcaccacctctgctagttccagacacctccacgcccacctggtcctctcccatcgcccacaaaagggggggcacgagggacgagcttagctgagctgggaggagcagggtgagggtgggcgacccaggattccccctccccttcccaaataaagatgagggtactaaagt

SEQ ID NO: 313941 - DNA, 1698 bp, Homo sapiens
aatcggaacaaacttaggctaggtacgaggctggggtgcggcggcggccccgggagctgccgatcggcgccgggacaaaggcgcggccgcccggcgcccccagcagcccgagccggggcgcacagccggggcgcagcccgcgccccccgccgcgattgacatgatgtttccacaaagcaggcattcgggctcctcgcacctaccccagcaactcaaattcaccacctcggactcctgcgaccgcatcaaagacgaatttcagctactgcaagctcagtaccacagcctcaagctcgaatgtgacaagttggccagtgagaagtcagagatgcagcgtcactatgtgatgtactacgagatgtcctacggcttgaacatcgagatgcacaaacaggctgagatcgtcaaaaggctgaacgggatttgtgcccaggtcctgccctacctctcccaagagcaccagcagcaggtcttgggagccattgagagggccaagcaggtcaccgctcccgagctgaactctatcatccgacagcagctccaagcccaccagctgtcccagctgcaggccctggccctgcccttgaccccactacccgtggggctgcagccgccttcgctgccggcggtcagcgcaggcaccggcctcctctcgctgtccgcgctgggttcccaggcccacctctccaaggaagacaagaacgggcacgatggtgacacccaccaggaggatgatggcgagaagtcggattagcagggggccgggacggggaggttgggaggggggacagaggggagacagaggcacggagagaaaggaatgtttagcacaagacacagcggagctcgggattggctaaactcccatagtatttatggtggccgccggcgggggccccagcccagcttgcaggccacctctagctttcttcctaccccattcccggcttccctcctcctcccctgcagcctggttaggtggatacctgccctgacatgtgaggcaagctaaggcctggagggtcagatgggagaccaggtcccaagggagcaagacctcgcgaagcgcagcagccccggcccttcccccgttttgaacatgtgtaaccgacagtctgcctgggccacagccctctcaccctggtactgcatgcacgcaatgctagctgcccctttcccgtcctgggcaccccgagtctcccccgaccccgggtcccaggtatgctcccacctccacctgccccactcaccacctctgctagttccagacacctccacgcccacctggtcctctcccatcgcccacaaaagggggggcacgagggacgagcttagctgagctgggaggagcagggtgagggtgggcgacccaggattccccctccccttcccaaataaagatgagggtactaaagttgtcttggtttttattttattattatttttttctttttccagtatactagcttgtcttttaagaaaggggatattaaaaaaaaaaaaagacaaaagtgtttttaaaaaaaagcaacacccacacctgtgtctgtatatagtcagcttatctcgtgttcaatcgtctgatctctacagagagaagtggaaaatgctgtatcaagggtgggcttagctgtgcctttccaataaagatgtgagaagcttcaaaaaaaaaaggcgccgctcgcgatctagaactag

SEQ ID NO: 313942 - DNA, 1401 bp, Homo sapiens
ccagaagctatgtatagtacgagctcggtgtaacatcggcagagggcgatcttcgctgtacaaaggcgcggccgcccggcgcccccagcagcccgagccggggcgcacagccggggcgcagcccgcgccccccgccgcgattgacatgatgtttccacaaagcaggcattcgggctcctcgcacctaccccagcaactcaaattcaccacctcggactcctgcgaccgcatcaaagacgaatttcagctactgcaagctcagtaccacagcctcaagctcgaatgtgacaagttggccagtgagaagtcagagatgcagcgtcactatgtgatgtactacgagatgtcctacggcttgaacatcgagatgcacaaacaggctgagatcgtcaaaaggctgaacgggatttgtgcccaggtcctgccctacctctcccaagagcaccagcagcaggtcttgggagccattgagagggccaagcaggtcaccgctcccgagctgaactctatcatccgacagcagctccaagcccaccagctgtcccagctgcaggccctggccctgcccttgaccccactacccgtggggctgcagccgccttcgctgccggcggtcagcgcaggcaccggcctcctctcgctgtccgcgctgggttcccaggcccacctctccaaggaagacaagaacgggcacgatggtgacacccaccaggaggatgatggcgagaagtcggattagcagggggccgggacggggaggttgggaggggggacagaggggagacagaggcacggagagaaaggaatgtttagcacaagacacagcggagctcgggattggctaaactcccatagtatttatggtggccgccggcgggggccccagcccagcttgcaggccacctctagctttcttcctaccccattcccggcttccctcctcctcccctgcagcctggttaggtggatacctgccctgacatgtgaggcaagctaaggcctggagggtcagatgggagaccaggtcccaagggagcaagacctcgcgaagcgcagcagccccggcccttcccccgttttgaacatgtgtaaccgacagtctgcctgggccacagccctctcaccctggtactgcatgcacgcaatgctagctgcccctttcccgtcctgggcaccccgagtctcccccgaccccgggtcccaggtatgctcccacctccacctgccccactcaccacctctgctagttccagacacctccacgcccacctggtcctctcccatcgcccacaaaagggggggcacgagggacgagcttagctgagctgggaggagcagggtgagggtgggcgacccaggattccccctccccttcccaaataaagatgagggtactaaagt

SEQ ID NO: 313943 - DNA, 2195 bp, Homo sapiens
aatcggaacaaacttaggctaggtacgaggctggggtgcggcggcggccccgggagctgccgatcggcgccgggacaaaggcgcggccgcccggcgcccccagcagcccgagccggggcgcacagccggggcgcagcccgcgccccccgccgcgattgacatgatgtttccacaaagcaggcattcgggctcctcgcacctaccccagcaactcaaattcaccacctcggactcctgcgaccgcatcaaagacgaatttcagctactgcaagctcagtaccacagcctcaagctcgaatgtgacaagttggccagtgagaagtcagagatgcagcgtcactatgtgatgtactacgagatgtcctacggcttgaacatcgagatgcacaaacaggctgagatcgtcaaaaggctgaacgggatttgtgcccaggtcctgccctacctctcccaagagcaccagcagcaggtcttgggagccattgagagggccaagcaggtcaccgctcccgagctgaactctatcatccgacagcagctccaagcccaccagctgtcccagctgcaggccctggccctgcccttgaccccactacccgtggggctgcagccgccttcgctgccggcggtcagcgcaggcaccggcctcctctcgctgtccgcgctgggttcccaggcccacctctccaaggaagacaagaacgggcacgatggtgacacccaccaggaggatgatggcgagaagtcggattagcagggggccgggacggggaggttgggaggggggacagaggggagacagaggcacggagagaaaggaatgtttagcacaagacacagcggagctcgggattggctaaactcccatagtatttatggtggccgccggcgggggccccagcccagcttgcaggccacctctagctttcttcctaccccattcccggcttccctcctcctcccctgcagcctggttaggtggatacctgccctgacatgtgaggcaagctaaggcctggagggtcagatgggagaccaggtcccaagggagcaagacctcgcgaagcgcagcagccccggcccttcccccgttttgaacatgtgtaaccgacagtctgcctgggccacagccctctcaccctggtactgcatgcacgcaatgctagctgcccctttcccgtcctgggcaccccgagtctcccccgaccccgggtcccaggtatgctcccacctccacctgccccactcaccacctctgctagttccagacacctccacgcccacctggtcctctcccatcgcccacaaaagggggggcacgagggacgagcttagctgagctgggaggagcagggtgagggtgggcgacccaggattccccctccccttcccaaataaagatgagggtactaaagttgtcttggtttttattttattattatttttttctttttccagtatactagcttgtcttttaagaaaggggatattaaaaaaaaaaaaagacaaaagtgtttttaaaaaaaagcaacacccacacctgtgtctgtatatagtcagcttatctcgtgttcaatcgtctgatctctacagagagaagtggaaaatgctgtatcaagggtgggcttagctgtgcctttccaataaagatgtgagaagcttcaaaaaaaaaaaaaaaaaaaaaaaaaaaaaaaaaaaaaaaaaaaaaaaaaaaaaaaaaaaaaaaaaacaaaaaaaaaaaaaaaaaaaaaaaaaaaaaaaaaaaaaaaaaaaaaaaaaaaaaaaaaaaaaaaaaaaaaaaaaaaaataaaaataagagcgcaaacgaaaaaaaaatcaccacagagagaaggcacagacaggaattaaagagaaaagccaggcgggcggcgtgctggacacaaaaataagcggtcaccaccgactgatggcgacaggcatatcatatatacaacacaacaacaagacgatgtgtgtgtcgcaacaggtaacaaacagtacacggcccatacgaagaatgaggaacaaaaaacattctgaaaacaacgagagaacactagtgtgacgggaggcagagacacacacacactcagctgtggggagggaggaagcaacacaactatgtggaggaacagaccacagccagcaagagaagaagaaacacccagcatgcggggggaggaagactgacgaaa

SEQ ID NO: 313944 - DNA, 1694 bp, Homo sapiens
aatcggaacaaacttaggctaggtacgaggctggggtgcggcggcggccccgggagctgccgatcggcgccgggacaaaggcgcggccgcccggcgcccccagcagcccgagccggggcgcacagccggggcgcagcccgcgccccccgccgcgattgacatgatgtttccacaaagcaggcattcgggctcctcgcacctaccccagcaactcaaattcaccacctcggactcctgcgaccgcatcaaagacgaatttcagctactgcaagctcagtaccacagcctcaagctcgaatgtgacaagttggccagtgagaagtcagagatgcagcgtcactatgtgatgtactacgagatgtcctacggcttgaacatcgagatgcacaaacaggctgagatcgtcaaaaggctgaacgggatttgtgcccaggtcctgccctacctctcccaagagcaccagcagcaggtcttgggagccattgagagggccaagcaggtcaccgctcccgagctgaactctatcatccgacagcagctccaagcccaccagctgtcccagctgcaggccctggccctgcccttgaccccactacccgtggggctgcagccgccttcgctgccggcggtcagcgcaggcaccggcctcctctcgctgtccgcgctgggttcccaggcccacctctccaaggaagacaagaacgggcacgatggtgacacccaccaggaggatgatggcgagaagtcggattagcagggggccgggacggggaggttgggaggggggacagaggggagacagaggcacggagagaaaggaatgtttagcacaagacacagcggagctcgggattggctaaactcccatagtatttatggtggccgccggcgggggccccagcccagcttgcaggccacctctagctttcttcctaccccattcccggcttccctcctcctcccctgcagcctggttaggtggatacctgccctgacatgtgaggcaagctaaggcctggagggtcagatgggagaccaggtcccaagggagcaagacctcgcgaagcgcagcagccccggcccttcccccgttttgaacatgtgtaaccgacagtctgcctgggccacagccctctcaccctggtactgcatgcacgcaatgctagctgcccctttcccgtcctgggcaccccgagtctcccccgaccccgggtcccaggtatgctcccacctccacctgccccactcaccacctctgctagttccagacacctccacgcccacctggtcctctcccatcgcccacaaaagggggggcacgagggacgagcttagctgagctgggaggagcagggtgagggtgggcgacccaggattccccctccccttcccaaataaagatgagggtactaaagtaaaaaaaaaaacaaaaaaaaaaaaaccggggggacaaaggggggggggggaaaaaaggggaacagaatggggcacggggccaacacgggtccgaggaccccaagtttcctggcacacggggggaaaccgggggacccaaaagggcgcgaaaactcgaaacccgggactgagaacctccacacacaagagaaaaaaacaaaaaggagaagggaacaacaaagacacacaaaactcgagaaaaacacacgaagagaaaacacacaaaaccaaagaaggag

SEQ ID NO: 313945 - DNA, 1595 bp, Homo sapiens
ctgatggcatcttcaaagctgaactgaatgagtttcttactcgggagctggctgaagatggctactctggagttgaggcattcgggctcctcgcacctaccccagcaactcaaattcaccacctcggactcctgcgaccgcatcaaagacgaatttcagctactgcaagctcagtaccacagcctcaagctcgaatgtgacaagttggccagtgagaagtcagagatgcagcgtcactatgtgatgtactacgagatgtcctacggcttgaacatcgagatgcacaaacaggctgagatcgtcaaaaggctgaacgggatttgtgcccaggtcctgccctacctctcccaagagcaccagcagcaggtcttgggagccattgagagggccaagcaggtcaccgctcccgagctgaactctatcatccgacagcagctccaagcccaccagctgtcccagctgcaggccctggccctgcccttgaccccactacccgtggggctgcagccgccttcgctgccggcggtcagcgcaggcaccggcctcctctcgctgtccgcgctgggttcccaggcccacctctccaaggaagacaagaacgggcacgatggtgacacccaccaggaggatgatggcgagaagtcggattagcagggggccgggacggggaggttgggaggggggacagaggggagacagaggcacggagagaaaggaatgtttagcacaagacacagcggagctcgggattggctaaactcccatagtatttatggtggccgccggcgggggccccagcccagcttgcaggccacctctagctttcttcctaccccattcccggcttccctcctcctcccctgcagcctggttaggtggatacctgccctgacatgtgaggcaagctaaggcctggagggtcagatgggagaccaggtcccaagggagcaagacctcgcgaagcgcagcagccccggcccttcccccgttttgaacatgtgtaaccgacagtctgcctgggccacagccctctcaccctggtactgcatgcacgcaatgctagctgcccctttcccgtcctgggcaccccgagtctcccccgaccccgggtcccaggtatgctcccacctccacctgccccactcaccacctctgctagttccagacacctccacgcccacctggtcctctcccatcgcccacaaaagggggggcacgagggacgagcttagctgagctgggaggagcagggtgagggtgggcgacccaggattccccctccccttcccaaataaagatgagggtactaaagttgtcttggtttttattttattattatttttttctttttccagtatactagcttgtcttttaagaaaggggatattaaaaaaaaaaaaagacaaaagtgtttttaaaaaaaagcaacacccacacctgtgtctgtatatagtcagcttatctcgtgttcaatcgtctgatctctacagagagaagtggaaaatgctgtatcaagggtgggcttagctgtgcctttccaataaagatgtgagaagcttcaaaaaaaaaaggcgccgctcgcgatctagaactag

SEQ ID NO: 313946 - DNA, 1560 bp, Homo sapiens
tcttctcctggattgttaaggattccaagtaactcttatttggcattcgggctcctcgcacctaccccagcaactcaaattcaccacctcggactcctgcgaccgcatcaaagacgaatttcagctactgcaagctcagtaccacagcctcaagctcgaatgtgacaagttggccagtgagaagtcagagatgcagcgtcactatgtgatgtactacgagatgtcctacggcttgaacatcgagatgcacaaacaggctgagatcgtcaaaaggctgaacgggatttgtgcccaggtcctgccctacctctcccaagagcaccagcagcaggtcttgggagccattgagagggccaagcaggtcaccgctcccgagctgaactctatcatccgacagcagctccaagcccaccagctgtcccagctgcaggccctggccctgcccttgaccccactacccgtggggctgcagccgccttcgctgccggcggtcagcgcaggcaccggcctcctctcgctgtccgcgctgggttcccaggcccacctctccaaggaagacaagaacgggcacgatggtgacacccaccaggaggatgatggcgagaagtcggattagcagggggccgggacggggaggttgggaggggggacagaggggagacagaggcacggagagaaaggaatgtttagcacaagacacagcggagctcgggattggctaaactcccatagtatttatggtggccgccggcgggggccccagcccagcttgcaggccacctctagctttcttcctaccccattcccggcttccctcctcctcccctgcagcctggttaggtggatacctgccctgacatgtgaggcaagctaaggcctggagggtcagatgggagaccaggtcccaagggagcaagacctcgcgaagcgcagcagccccggcccttcccccgttttgaacatgtgtaaccgacagtctgcctgggccacagccctctcaccctggtactgcatgcacgcaatgctagctgcccctttcccgtcctgggcaccccgagtctcccccgaccccgggtcccaggtatgctcccacctccacctgccccactcaccacctctgctagttccagacacctccacgcccacctggtcctctcccatcgcccacaaaagggggggcacgagggacgagcttagctgagctgggaggagcagggtgagggtgggcgacccaggattccccctccccttcccaaataaagatgagggtactaaagttgtcttggtttttattttattattatttttttctttttccagtatactagcttgtcttttaagaaaggggatattaaaaaaaaaaaaagacaaaagtgtttttaaaaaaaagcaacacccacacctgtgtctgtatatagtcagcttatctcgtgttcaatcgtctgatctctacagagagaagtggaaaatgctgtatcaagggtgggcttagctgtgcctttccaataaagatgtgagaagcttcaaaaaaaaaaggcgccgctcgcgatctagaactag

SEQ ID NO: 313947 - DNA, 2092 bp, Homo sapiens
aatcggaacaaacttaggctaggtacgaggctggggtgcggcggcggccccgggagctgccgatcggcgccgggacaaaggcgcggccgcccggcgcccccagcagcccgagccggggcgcacagccggggcgcagcccgcgccccccgccgcgattgacatgatgtttccacaaagcaggcattcgggctcctcgcacctaccccagcaactcaaattcaccacctcggactcctgcgaccgcatcaaagacgaatttcagctactgcaagctcagtaccacagcctcaagctcgaatgtgacaagttggccagtgagaagtcagagatgcagcgtcactatgtgatgtactacgagatgtcctacggcttgaacatcgagatgcacaaacaggctgagatcgtcaaaaggctgaacgggatttgtgcccaggtcctgccctacctctcccaagagcaccagcagcaggtcttgggagccattgagagggccaagcaggtcaccgctcccgagctgaactctatcatccgacagcagctccaagcccaccagctgtcccagctgcaggccctggccctgcccttgaccccactacccgtggggctgcagccgccttcgctgccggcggtcagcgcaggcaccggcctcctctcgctgtccgcgctgggttcccaggcccacctctccaaggaagacaagaacgggcacgatggtgacacccaccaggaggatgatggcgagaagtcggattagcagggggccgggacggggaggttgggaggggggacagaggggagacagaggcacggagagaaaggaatgtttagcacaagacacagcggagctcgggattggctaaactcccatagtatttatggtggccgccggcgggggccccagcccagcttgcaggccacctctagctttcttcctaccccattcccggcttccctcctcctcccctgcagcctggttaggtggatacctgccctgacatgtgaggcaagctaaggcctggagggtcagatgggagaccaggtcccaagggagcaagacctcgcgaagcgcagcagccccggcccttcccccgttttgaacatgtgtaaccgacagtctgcctgggccacagccctctcaccctggtactgcatgcacgcaatgctagctgcccctttcccgtcctgggcaccccgagtctcccccgaccccgggtcccaggtatgctcccacctccacctgccccactcaccacctctgctagttccagacaattccccctccccttcccaaataaagatgagggtactaaagttgtcttggtttttattttattattatttttttctttttccagtatactagcttgtcttttaagaaaggggatattaaaaaaaaaaaaagacaaaagtgtttttaaaaaaaagcaacacccacacctgtgtctgtatatagtcagcttatctcgtgttcaatcgtctgatctctacagagagaagtggaaaatgctgtatcaagggtgggcttagctgtgcctttccaataaagatgtgagaagcttcaaaaaaaaaaaaaaaaaaaaaaaaaaaaaaaaaaaaaaaaaaaaaaaaaaaaaaaaaaaaaaaaaacaaaaaaaaaaaaaaaaaaaaaaaaaaaaaaaaaaaaaaaaaaaaaaaaaaaaaaaaaaaaaaaaaaaaaaaaaaaaataaaaataagagcgcaaacgaaaaaaaaatcaccacagagagaaggcacagacaggaattaaagagaaaagccaggcgggcggcgtgctggacacaaaaataagcggtcaccaccgactgatggcgacaggcatatcatatatacaacacaacaacaagacgatgtgtgtgtcgcaacaggtaacaaacagtacacggcccatacgaagaatgaggaacaaaaaacattctgaaaacaacgagagaacactagtgtgacgggaggcagagacacacacacactcagctgtggggagggaggaagcaacacaactatgtggaggaacagaccacagccagcaagagaagaagaaacacccagcatgcggggggaggaagactgacgaaa

SEQ ID NO: 313948 - DNA, 1309 bp, Homo sapiens
aatcggaacaaacttaggctaggtacgaggctggggtgcggcggcggccccgggagctgccgatcggcgccgggacaaaggcgcggccgcccggcgcccccagcagcccgagccggggcgcacagccggggcgcagcccgcgccccccgccgcgattgacatgatgtttccacaaagcaggcattcgggctcctcgcacctaccccagcaactcaaattcaccacctcggactcctgcgaccgcatcaaagacgaatttcagctactgcaagctcagtaccacagcctcaagctcgaatgtgacaagttggccagtgagaagtcagagatgcagcgtcactatgtgatgtactacgagatgtcctacggcttgaacatcgagatgcacaaacaggctgagatcgtcaaaaggctgaacgggatttgtgcccaggtcctgccctacctctcccaagagcaccagcagcaggtcttgggagccattgagagggccaagcaggtcaccgctcccgagctgaactctatcatccgacagcagctccaagcccaccagctgtcccagctgcaggccctggccctgcccttgaccccactacccgtggggctgcagccgccttcgctgccggcggtcagcgcaggcaccggcctcctctcgctgtccgcgctgggttcccaggcccacctctccaaggaagacaagaacgggcacgatggtgacacccaccaggaggatgatggcgagaagtcggattagcagggggccgggacggggaggttgggaggggggacagaggggagacagaggcacggagagaaaggaatgtttagcacaagacacagcggagctcgggattggctaaactcccatagtatttatggtggccgccggcgggggccccagcccagcttgcaggccacctctagctttcttcctaccccattcccggcttccctcctcctcccctgcagcctggttaggtggatacctgccctgacatgtgaggcaagctaaggcctggagggtcagatgggagaccaggtcccaagggagcaagacctcgcgaagcgcagcagccccggcccttcccccgttttgaacatgtgtaaccgacagtctgcctgggccacagccctctcaccctggtactgcatgcacgcaatgctagctgcccctttcccgtcctgggcaccccgagtctcccccgaccccgggtcccaggtatgctcccacctccactactctgcatgccatgcactccacactactgcctccacaccatcctctgcctgtgatcctcaagaacgctac

SEQ ID NO: 313949 - DNA, 2145 bp, Homo sapiens
  misc_feature (140)..(140): n is a, c, g, or t
  misc_feature (201)..(201): n is a, c, g, or t
  misc_feature (411)..(411): n is a, c, g, or t
  misc_feature (413)..(413): n is a, c, g, or t
aggatcacgatgtccgtgctccagcgcggggcgggggggggacaagtgagccaggcaagaagaatggattggccctagagtacgggttctccaaatgtaacctcggccctacagatctctgagactatgtcagggggttngtgagattttataacaaaattaagatgttagtacaatatcgtgtttcgccgccgggcgcgnttgacatgatgtttccacaaagcaggcattcgggctcctcgcacctaccccagcaactcaaattcaccacctcggactcctgcgaccgcatcaaagacgaatttcagctactgcaagctcagtaccacagcctcaagctcgaatgtgacaagttggccagtgagaagtcagagatgcagcgtcactatgtgatgtactacgagattcctncngcttgaacatcgagatgcacaaacaggctgagatcgtcaaaaggctgaacgcggcggcggccccgggagctgccgatcggcgccgggacaaaggcgcggccgcccggcgcccccagcagcccgagccggggcgcacagccggggcgcagcccgcgccccccgccgcgattgacatgatgtttccacaaagcaggcattcgggctcctcgcacctaccccagcaactcaaattcaccacctcggactcctgcgaccgcatcaaagacgaatttcagctactgcaagctcagtaccacagcctcaagctcgaatgtgacaagttggccagtgagaagtcagagatgcagcgtcactatgtgatggtaacgtcactccgcccccagtactacgagatgtcctacggcttgaacatcgagatgcacaaacaggctgagatcgtcaaaaggctgaacgggatttgtgcccaggtcctgccctacctctcccaagagcaccagcagcaggtcttgggagccattgagagggccaagcaggtcaccgctcccgagctgaactctatcatccgacagcagctccaagcccaccagctgtcccagctgcaggccctggccctgcccttgaccccactacccgtggggctgcagccgccttcgctgccggcggtcagcgcaggcaccggcctcctctcgctgtccgcgctgggttcccaggcccacctctccaaggaagacaagaacgggcacgatggtgacacccaccaggaggatgatggcgagaagtcggattagcagggggccgggacggggaggttgggaggggggacagaggggagacagaggcacggagagaaaggaatgtttagcacaagacacagcggagctcgggattggctaaactcccatagtatttatggtggccgccggcgggggccccagcccagcttgcaggccacctctagctttcttcctaccccattcccggcttccctcctcctcccctgcagcctggttaggtggatacctgccctgacatgtgaggcaagctaaggcctggagggtcagatgggagaccaggtcccaagggagcaagacctcgcgaagcgcagcagccccggcccttcccccgttttgaacatgtgtaaccgacagtctgcctgggccacagccctctcaccctggtactgcatgcacgcaatgctagctgcccctttcccgtcctgggcaccccgagtctcccccgaccccgggtcccaggtatgctcccacctccacctgccccactcaccacctctgctagttccagacacctccacgcccacctggtcctctcccatcgcccacaaaagggggggcacgagggacgagcttagctgagctgggaggagcagggtgagggtgggcgacccaggattccccctccccttcccaaataaagatgagggtactaaagttgtcttggtttttattttattattatttttttctttttccagtatactagcttgtcttttaagaaaggggatattaaaaaaaaaaaaagacaaaagtgtttttaaaaaaaagcaacacccacacctgtgtctgtatatagtcagcttatctcgtgttcaatcgtctgatctctacagagagaagtggaaaatgctgtatcaagggtgggcttagctgtgcctttccaataaagatgtgagaagcttcaaaaaaaaaaggcgccgctcgcgatctagaactag

SEQ ID NO: 313950 - DNA, 1429 bp, Homo sapiens
tggacgtctttacacagcctgtcaatcgtctcttggcctggtactccttgatgaaggatggacctgtggcatccttcactgggacagtatcgtttgtcacctcaggggctcgcccagtgctggaagctgagatcgtcaaaaggctgaacgggatttgtgcccaggtcctgccctacctctcccaagagcaccagcagcaggtcttgggagccattgagagggccaagcaggtcaccgctcccgagctgaactctatcatccgacagcagctccaagcccaccagctgtcccagctgcaggccctggccctgcccttgaccccactacccgtggggctgcagccgccttcgctgccggcggtcagcgcaggcaccggcctcctctcgctgtccgcgctgggttcccaggcccacctctccaaggaagacaagaacgggcacgatggtgacacccaccaggaggatgatggcgagaagtcggattagcagggggccgggacggggaggttgggaggggggacagaggggagacagaggcacggagagaaaggaatgtttagcacaagacacagcggagctcgggattggctaaactcccatagtatttatggtggccgccggcgggggccccagcccagcttgcaggccacctctagctttcttcctaccccattcccggcttccctcctcctcccctgcagcctggttaggtggatacctgccctgacatgtgaggcaagctaaggcctggagggtcagatgggagaccaggtcccaagggagcaagacctcgcgaagcgcagcagccccggcccttcccccgttttgaacatgtgtaaccgacagtctgcctgggccacagccctctcaccctggtactgcatgcacgcaatgctagctgcccctttcccgtcctgggcaccccgagtctcccccgaccccgggtcccaggtatgctcccacctccacctgccccactcaccacctctgctagttccagacacctccacgcccacctggtcctctcccatcgcccacaaaagggggggcacgagggacgagcttagctgagctgggaggagcagggtgagggtgggcgacccaggattccccctccccttcccaaataaagatgagggtactaaagttgtcttggtttttattttattattatttttttctttttccagtatactagcttgtcttttaagaaaggggatattaaaaaaaaaaaaagacaaaagtgtttttaaaaaaaagcaacacccacacctgtgtctgtatatagtcagcttatctcgtgttcaatcgtctgatctctacagagagaagtggaaaatgctgtatcaagggtgggcttagctgtgcctttccaataaagatgtgagaagcttcaaaaaaaaaaggcgccgctcgcgatctagaactag

SEQ ID NO: 313951 - DNA, 1467 bp, Homo sapiens
aatcggaacaaacttaggctaggtacgaggctggggtgcggcggcggccccgggagctgccgatcggcgccgggacaaaggcgcggccgcccggcgcccccagcagcccgagccggggcgcacagccggggcgcagcccgcgccccccgccgcgattgacatgatgtttccacaaagcaggcattcgggctcctcgcacctaccccagcaactcaaattcaccacctcggactcctgcgaccgcatcaaagacgaatttcagctactgcaagctcagtaccacagcctcaagctcgaatgtgacaagttggccagtgagaagtcagagatgcagcgtcactatgtgatgtactacgagatgtcctacggcttgaacatcgagatgcacaaacaggctgagatcgtcaaaaggctgaacgggatttgtgcccaggtcctgccctacctctcccaagagcaccagcagcaggtcttgggagccattgagagggccaagcaggtcaccgctcccgagctgaactctatcatccgacagcagctccaagcccaccagctgtcccagctgcaggccctggccctgcccttgaccccactacccgtggggctgcagccgccttcgctgccggcggtcagcgcaggcaccggcctcctctcgctgtccgcgctgggttcccaggcccacctctccaaggaagacaagaacgggcacgatggtgacacccaccaggaggatgatggcgagaagtcggattagcagggggccgggacggggaggttgggaggggggacagaggggagacagaggcacggagagaaaggaatgtttagcacaagacacagcggagctcgggattggctaaactcccatagtatttatggtggccgccggcgggggccccagcccagcttgcaggccacctctagctttcttcctaccccattcccggcttccctcctcctcccctgcagcctggttaggtggatacctgccctgacatgtgaggcaagctaaggcctggagggtcagatgggagaccaggtcccaagggagcaagacctcgcgaagcgcagcagccccggcccttcccccgttttgaacatgtgtaaccgacagtctgcctggcgagggacgagcttagctgagctgggaggagcagggtgagggtgggcgacccaggattccccctccccttcccaaataaagatgagggtactaaagttgtcttggtttttattttattattatttttttctttttccagtatactagcttgtcttttaagaaaggggatattaaaaaaaaaaaaagacaaaagtgtttttaaaaaaaagcaacacccacacctgtgtctgtatatagtcagcttatctcgtgttcaatcgtctgatctctacagagagaagtggaaaatgctgtatcaagggtgggcttagctgtgcctttccaataaagatgtgagaagcttc

SEQ ID NO: 313952 - DNA, 1501 bp, Homo sapiens
aatcggaacaaacttaggctaggtacgaggctggggtgcggcggcggccccgggagctgccgatcggcgccgggacaaaggcgcggccgcccggcgcccccagcagcccgagccggggcgcacagccggggcgcagcccgcgccccccgccgcgattgacatgatgtttccacaaagcaggcattcgggctcctcgcacctaccccagcaactcaaattcaccacctcggactcctgcgaccgcatcaaagacgaatttcagctactgcaagctcagtaccacagcctcaagctcgaatgtgacaagttggccagtgagaagtcagagatgcagcgtcactatgtgatgtactacgagatgtcctacggcttgaacatcgagatgcacaaacaggctgagatcgtcaaaaggctgaacgggatttgtgcccaggtcctgccctacctctcccaagagcaccagcagcaggtcttgggagccattgagagggccaagcaggtcaccgctcccgagctgaactctatcatccgacagcagctccaagcccaccagctgtcccagctgcaggccctggccctgcccttgaccccactacccgtggggctgcagccgccttcgctgccggcggtcagcgcaggcaccggcctcctctcgctgtccgcgctgggttcccaggcccacctctccaaggaagacaagaacgggcacgatggtgacacccaccaggaggatgatggcgagaagtcggattagcagggggccgggacggggaggttgggaggggggacagaggggagacagaggcacggagagaaaggaatgtttagcacaagacacagcggagctcgggattggctaaactcccatagtatttatggtggccgccggcgggggccccagcccagcttgcaggccacctctagctttcttcctaccccattcccggcttccctcctcctcccctgcagcctggttaggtggatacctgccctgacatgtgaggcaagctaaggcctggagggtcagatgggagaccaggctgccccactcaccacctctgctagttccagacacctccacgcccacctggtcctctcccatcgcccacaaaagggggggcacgagggacgagcttagctgagctgggaggagcagggtgagggtgggcgacccaggattccccctccccttcccaaataaagatgagggtactaaagttgtcttggtttttattttattattatttttttctttttccagtatactagcttgtcttttaagaaaggggatattaaaaaaaaaaaaagacaaaagtgtttttaaaaaaaagcaacacccacacctgtgtctgtatatagtcagcttatctcgtgttcaatcgtctgatctctacagagagaagtggaaaatgctgtatcaagggtgggcttagctgtgcctttccaataaagatgtgagaagcttcaaaaaaaaaaggcgccgctcgcgatctagaactag

SEQ ID NO: 313953 - DNA, 1893 bp, Homo sapiens
  misc_feature (140)..(140): n is a, c, g, or t
  misc_feature (201)..(201): n is a, c, g, or t
  misc_feature (411)..(411): n is a, c, g, or t
  misc_feature (413)..(413): n is a, c, g, or t
aggatcacgatgtccgtgctccagcgcggggcgggggggggacaagtgagccaggcaagaagaatggattggccctagagtacgggttctccaaatgtaacctcggccctacagatctctgagactatgtcagggggttngtgagattttataacaaaattaagatgttagtacaatatcgtgtttcgccgccgggcgcgnttgacatgatgtttccacaaagcaggcattcgggctcctcgcacctaccccagcaactcaaattcaccacctcggactcctgcgaccgcatcaaagacgaatttcagctactgcaagctcagtaccacagcctcaagctcgaatgtgacaagttggccagtgagaagtcagagatgcagcgtcactatgtgatgtactacgagattcctncngcttgaacatcgagatgcacaaacaggctgagatcgtcaaaaggctgaacgcggcggcggccccgggagctgccgatcggcgccgggacaaaggcgcggccgcccggcgcccccagcagcccgagccggggcgcacagccggggcgcagcccgcgccccccgccgcgattgacatgatgtttccacaaagcaggcattcgggctcctcgcacctaccccagcaactcaaattcaccacccaccagcagcaggtcttgggagccattgagagggccaagcaggtcaccgctcccgagctgaactctatcatccgacagcagctccaagcccaccagctgtcccagctgcaggccctggccctgcccttgaccccactacccgtggggctgcagccgccttcgctgccggcggtcagcgcaggcaccggcctcctctcgctgtccgcgctgggttcccaggcccacctctccaaggaagacaagaacgggcacgatggtgacacccaccaggaggatgatggcgagaagtcggattagcagggggccgggacggggaggttgggaggggggacagaggggagacagaggcacggagagaaaggaatgtttagcacaagacacagcggagctcgggattggctaaactcccatagtatttatggtggccgccggcgggggccccagcccagcttgcaggccacctctagctttcttcctaccccattcccggcttccctcctcctcccctgcagcctggttaggtggatacctgccctgacatgtgaggcaagctaaggcctggagggtcagatgggagaccaggtcccaagggagcaagacctcgcgaagcgcagcagccccggcccttcccccgttttgaacatgtgtaaccgacagtctgcctgggccacagccctctcaccctggtactgcatgcacgcaatgctagctgcccctttcccgtcctgggcaccccgagtctcccccgaccccgggtcccaggtatgctcccacctccacctgccccactcaccacctctgctagttccagacacctccacgcccacctggtcctctcccatcgcccacaaaagggggggcacgagggacgagcttagctgagctgggaggagcagggtgagggtgggcgacccaggattccccctccccttcccaaataaagatgagggtactaaagttgtcttggtttttattttattattatttttttctttttccagtatactagcttgtcttttaagaaaggggatattaaaaaaaaaaaaagacaaaagtgtttttaaaaaaaagcaacacccacacctgtgtctgtatatagtcagcttatctcgtgttcaatcgtctgatctctacagagagaagtggaaaatgctgtatcaagggtgggcttagctgtgcctttccaataaagatgtgagaagcttcaaaaaaaaaaggcgccgctcgcgatctagaactag

SEQ ID NO: 313954 - DNA, 1447 bp, Homo sapiens
aatcggaacaaacttaggctaggtacgaggctggggtgcggcggcggccccgggagctgccgatcggcgccgggacaaaggcgcggccgcccggcgcccccagcagcccgagccggggcgcacagccggggcgcagcccgcgccccccgccgcgattgacatgatgtttccacaaagcaggcattcgggctcctcgcacctaccccagcaactcaaattcaccacctcggactcctgcgaccgcatcaaagacgaatttcagctactgcaagctcagtaccacagcctcaagctcgaatgtgacaagttggccagtgagaagtcagagatgcagcgtcactatgtgatgtactacgagatgtcctacggcttgaacatcgagatgcacaaacaggctgagatcgtcaaaaggctgaacgggatttgtgcccaggtcctgccctacctctcccaagagcaccagcagcaggtcttgggagccattgagagggccaagcaggtcaccgctcccgagctgaactctatcatccgacagcagctccaagcccaccagctgtcccagctgcaggccctggccctgcccttgaccccactacccgtggggctgcagccgccttcgctgccggcggtcagcgcaggcaccggcctcctctcgctgtccgcgctgggttcccaggcccacctctccaaggaagacaagaacgggcacgatggtgacacccaccaggaggatgatggcgagaagtcggattagcagggggccgggacggggaggttgggaggggggacagaggggagacagaggcacggagagaaaggaatgtttagcacaagacacagcggagctcgggattggctaaactcccatagtatttatggtggccgccggcgggggccccagcccagcttgcaggccacctctagctttcttcctaccccattcccggcttccctcctcctcccctgcagcctggttaggtggatacctgccccactcaccacctctgctagttccagacacctccacgcccacctggtcctctcccatcgcccacaaaagggggggcacgagggacgagcttagctgagctgggaggagcagggtgagggtgggcgacccaggattccccctccccttcccaaataaagatgagggtactaaagttgtcttggtttttattttattattatttttttctttttccagtatactagcttgtcttttaagaaaggggatattaaaaaaaaaaaaagacaaaagtgtttttaaaaaaaagcaacacccacacctgtgtctgtatatagtcagcttatctcgtgttcaatcgtctgatctctacagagagaagtggaaaatgctgtatcaagggtgggcttagctgtgcctttccaataaagatgtgagaagcttcaaaaaaaaaaggcgccgctcgcgatctagaactag

SEQ ID NO: 313955 - DNA, 1412 bp, Homo sapiens
aatcggaacaaacttaggctaggtacgaggctggggtgcggcggcggccccgggagctgccgatcggcgccgggacaaaggcgcggccgcccggcgcccccagcagcccgagccggggcgcacagccggggcgcagcccgcgccccccgccgcgattgacatgatgtttccacaaagcaggcattcgggctcctcgcacctaccccagcaactcaaattcaccacctcggactcctgcgaccgcatcaaagacgaatttcagctactgcaagctcagtaccacagcctcaagctcgaatgtgacaagttggccagtgagaagtcagagatgcagcgtcactatgtgatgtactacgagatgtcctacggcttgaacatcgagatgcacaaacaggctgagatcgtcaaaaggctgaacgggatttgtgcccaggtcctgccctacctctcccaagagcaccagcagcaggtcttgggagccattgagagggccaagcaggtcaccgctcccgagctgaactctatcatccgacagcagctccaagcccaccagctgtcccagctgcaggccctggccctgcccttgaccccactacccgtggggctgcagccgccttcgctgccggcggtcagcgcaggcaccggcctcctctcgctgtccgcgctgggttcccaggcccacctctccaaggaagacaagaacgggcacgatggtgacacccaccaggaggatgatggcgagaagtcggattagcagggggccgggacggggaggttgggaggggggacagaggggagacagaggcacggagagaaaggaatgtttagcacaagacacagcggagctcgggattggctaaactcccatagtatttatggtggccgccggcgggggccccagcccagcttgcaggccacctctagctttcttcctaccccattcccggcttccctcctcctcccctgcagcctggttaggtggatacctgccccactcaccacctctgctagttccagacacctccacgcccacctggtcctctcccatcgcccacaaaagggggggcacgagggacgagcttagctgagctgggaggagcagggtgagggtgggcgacccaggattccccctccccttcccaaataaagatgagggtactaaagttgtcttggtttttattttattattatttttttctttttccagtatactagcttgtcttttaagaaaggggatattaaaaaaaaaaaaagacaaaagtgtttttaaaaaaaagcaacacccacacctgtgtctgtatatagtcagcttatctcgtgttcaatcgtctgatctctacagagagaagtggaaaatgctgtatcaagggtgggcttagctgtgcctttccaataaagatgtgagaagcttc

SEQ ID NO: 313956 - DNA, 1085 bp, Homo sapiens
aatcggaacaaacttaggctaggtacgaggctggggtgcggcggcggccccgggagctgccgatcggcgccgggacaaaggcgcggccgcccggcgcccccagcagcccgagccggggcgcacagccggggcgcagcccgcgccccccgccgcgattgacatgatgtttccacaaagcaggcattcgggctcctcgcacctaccccagcaactcaaattcaccacctcggactcctgcgaccgcatcaaagacgaatttcagctactgcaagctcagtaccacagcctcaagctcgaatgtgacaagttggccagtgagaagtcagagatgcagcgtcactatgtgatgtactacgagatgtcctacggcttgaacatcgagatgcacaaacaggctgagatcgtcaaaaggctgaacgggatttgtgcccaggtcctgccctacctctcccaagagcaccagcagcaggtcttgggagccattgagagggccaagcaggtcaccgctcccgagctgaactctatcatccgacagcagctccaagcccaccagctgtcccagctgcaggccctggccctgcccttgaccccactacccgtggggctgcagccgccttcgctgccggcggtcagcgcaggcaccggcctcctctcgctgtccgcgctgggttcccaggcccacctctccaaggaagacaagaacgggcacgatggtgacacccaccaggaggatgatggcgagaagtcggattagcagggggccgggacggggaggttgggaggggggacagaggggagacagaggcacggagagaaaggaatgtttagcacaagacacagcggagctcgggattggctaaactcccatagtatttatggtggccgccggcgggggccccagcccagcttgcaggccacctctagctttcttcctaccccattcccggcttccctcctcctcccctgcagcctggttaggtggatacctgccctgacatgtgaggcaagctaaggcctggagggtcagatgggagaccaggttacacggagcagacctctctcgtaaagtaagctcggtagacgca

SEQ ID NO: 313957 - DNA, 1616 bp, Homo sapiens
  misc_feature (140)..(140): n is a, c, g, or t
  misc_feature (201)..(201): n is a, c, g, or t
  misc_feature (411)..(411): n is a, c, g, or t
  misc_feature (413)..(413): n is a, c, g, or t
aggatcacgatgtccgtgctccagcgcggggcgggggggggacaagtgagccaggcaagaagaatggattggccctagagtacgggttctccaaatgtaacctcggccctacagatctctgagactatgtcagggggttngtgagattttataacaaaattaagatgttagtacaatatcgtgtttcgccgccgggcgcgnttgacatgatgtttccacaaagcaggcattcgggctcctcgcacctaccccagcaactcaaattcaccacctcggactcctgcgaccgcatcaaagacgaatttcagctactgcaagctcagtaccacagcctcaagctcgaatgtgacaagttggccagtgagaagtcagagatgcagcgtcactatgtgatgtactacgagattcctncngcttgaacatcgagatgcacaaacaggctgagatcgtcaaaaggctgaacgcggcggcggccccgggagctgccgatcggcgccgggacaaaggcgcggccgcccggcgcccccagcagcccgagccggggcgcacagccggggcgcagcccgcgccccccgccgcgattgacatgatgtttccacaaagcaggcattcgggctcctcgcacctaccccagcaactcaaattcaccacctcggactcctgcgaccgcatcaaagacgaatttcagctactgcaagctcagtaccacagcctcaagctcgaatgtgacaagttggccagtgagaagtcagagatgcagcgtcactatgtgatgtactacgagatgtcctacggcttgaacatcgagatgcacaaacaggctgagatcgtcaaaaggctgaacgggatttgtgcccaggtcctgccctacctctcccaagagcaccagcagcaggtcttgggagccattgagagggccaagcaggtcaccgctcccgagctgaactctatcatccgatcccaagggagcaagacctcgcgaagcgcagcagccccggcccttcccccgttttgaacatgtgtaaccgacagtctgcctgggccacagccctctcaccctggtactgcatgcacgcaatgctagctgcccctttcccgtcctgggcaccccgagtctcccccgaccccgggtcccaggtatgctcccacctccacctgccccactcaccacctctgctagttccagacacctccacgcccacctggtcctctcccatcgcccacaaaagggggggcacgagggacgagcttagctgagctgggaggagcagggtgagggtgggcgacccaggattccccctccccttcccaaataaagatgagggtactaaagttgtcttggtttttattttattattatttttttctttttccagtatactagcttgtcttttaagaaaggggatattaaaaaaaaaaaaagacaaaagtgtttttaaaaaaaagcaacacccacacctgtgtctgtatatagtcagcttatctcgtgttcaatcgtctgatctctacagagagaagtggaaaatgctgtatcaagggtgggcttagctgtgcctttccaataaagatgtgagaagcttcaaaaaaaaaaggcgccgctcgcgatctagaactag

SEQ ID NO: 313958 - DNA, 951 bp, Homo sapiens
atcagactggatgtcccgctcgtttgacacgagcgggatggagatctggacgggagcggtcagtgtcttccttcttcttcttcttgctgctgcccgcttggtgtctcgcttgctgcatcggtttctgctcctctcactcttgctgcggctgcgactgcgactgcggctctcctctagctttcttcctaccccattcccggcttccctcctcctcccctgcagcctggttaggtggatacctgccctgacatgtgaggcaagctaaggcctggagggtcagatgggagaccaggtcccaagggagcaagacctcgcgaagcgcagcagccccggcccttcccccgttttgaacatgtgtaaccgacagtctgcctgggccacagccctctcaccctggtactgcatgcacgcaatgctagctgcccctttcccgtcctgggcaccccgagtctcccccgaccccgggtcccaggtatgctcccacctccacctgccccactcaccacctctgctagttccagacacctccacgcccacctggtcctctcccatcgcccacaaaagggggggcacgagggacgagcttagctgagctgggaggagcagggtgagggtgggcgacccaggattccccctccccttcccaaataaagatgagggtactaaagttgtcttggtttttattttattattatttttttctttttccagtatactagcttgtcttttaagaaaggggatattaaaaaaaaaaaaagacaaaagtgtttttaaaaaaaagcaacacccacacctgtgtctgtatatagtcagcttatctcgtgttcaatcgtctgatctctacagagagaagtggaaaatgctgtatcaagggtgggcttagctgtgcctttccaataaagatgtgagaagcttcaaaaaaaaaaggcgccgctcgcgatctagaactag

SEQ ID NO: 313959 - DNA, 1352 bp, Homo sapiens
  misc_feature (140)..(140): n is a, c, g, or t
  misc_feature (201)..(201): n is a, c, g, or t
  misc_feature (411)..(411): n is a, c, g, or t
  misc_feature (413)..(413): n is a, c, g, or t
aggatcacgatgtccgtgctccagcgcggggcgggggggggacaagtgagccaggcaagaagaatggattggccctagagtacgggttctccaaatgtaacctcggccctacagatctctgagactatgtcagggggttngtgagattttataacaaaattaagatgttagtacaatatcgtgtttcgccgccgggcgcgnttgacatgatgtttccacaaagcaggcattcgggctcctcgcacctaccccagcaactcaaattcaccacctcggactcctgcgaccgcatcaaagacgaatttcagctactgcaagctcagtaccacagcctcaagctcgaatgtgacaagttggccagtgagaagtcagagatgcagcgtcactatgtgatgtactacgagattcctncngcttgaacatcgagatgcacaaacaggctgagatcgtcaaaaggctgaacgcggcggcggccccgggagctgccgatcggcgccgggacaaaggcgcggccgcccggcgcccccagcagcccgagccggggcgcacagccggggcgcagcccgcgccccccgccgcgattgacatgatgtttccacaaagcaggcattcgtcccctgcagcctggttaggtggatacctgccctgacatgtgaggcaagctaaggcctggagggtcagatgggagaccaggtcccaagggagcaagacctcgcgaagcgcagcagccccggcccttcccccgttttgaacatgtgtaaccgacagtctgcctgggccacagccctctcaccctggtactgcatgcacgcaatgctagctgcccctttcccgtcctgggcaccccgagtctcccccgaccccgggtcccaggtatgctcccacctccacctgccccactcaccacctctgctagttccagacacctccacgcccacctggtcctctcccatcgcccacaaaagggggggcacgagggacgagcttagctgagctgggaggagcagggtgagggtgggcgacccaggattccccctccccttcccaaataaagatgagggtactaaagttgtcttggtttttattttattattatttttttctttttccagtatactagcttgtcttttaagaaaggggatattaaaaaaaaaaaaagacaaaagtgtttttaaaaaaaagcaacacccacacctgtgtctgtatatagtcagcttatctcgtgttcaatcgtctgatctctacagagagaagtggaaaatgctgtatcaagggtgggcttagctgtgcctttccaataaagatgtgagaagcttcaaaaaaaaaaggcgccgctcgcgatctagaactag

SEQ ID NO: 313960 - DNA, 1267 bp, Homo sapiens
  misc_feature (140)..(140): n is a, c, g, or t
  misc_feature (201)..(201): n is a, c, g, or t
  misc_feature (411)..(411): n is a, c, g, or t
  misc_feature (413)..(413): n is a, c, g, or t
aggatcacgatgtccgtgctccagcgcggggcgggggggggacaagtgagccaggcaagaagaatggattggccctagagtacgggttctccaaatgtaacctcggccctacagatctctgagactatgtcagggggttngtgagattttataacaaaattaagatgttagtacaatatcgtgtttcgccgccgggcgcgnttgacatgatgtttccacaaagcaggcattcgggctcctcgcacctaccccagcaactcaaattcaccacctcggactcctgcgaccgcatcaaagacgaatttcagctactgcaagctcagtaccacagcctcaagctcgaatgtgacaagttggccagtgagaagtcagagatgcagcgtcactatgtgatgtactacgagattcctncngcttgaacatcgagatgcacaaacaggctgagatcgtcaaaaggctgaacgcggcggcggccccgggagctgccgatcggcgccgggacaaaggcgcggccgcccggcgcccccagcagcccgagccggggcgcacagccggggcgcagcccgcgccccccgccgcgattgacatgatgtttccacaaagcaggcattcgggctcctcgcacctaccccagcaactcaaattcaccaccttcccccgttttgaacatgtgtaaccgacagtctgcctgggccacagccctctcaccctggtactgcatgcacgcaatgctagctgcccctttcccgtcctgggcaccccgagtctcccccgaccccgggtcccaggtatgctcccacctccacctgccccactcaccacctctgctagttccagacacctccacgcccacctggtcctctcccatcgcccacaaaagggggggcacgagggacgagcttagctgagctgggaggagcagggtgagggtgggcgacccaggattccccctccccttcccaaataaagatgagggtactaaagttgtcttggtttttattttattattatttttttctttttccagtatactagcttgtcttttaagaaaggggatattaaaaaaaaaaaaagacaaaagtgtttttaaaaaaaagcaacacccacacctgtgtctgtatatagtcagcttatctcgtgttcaatcgtctgatctctacagagagaagtggaaaatgctgtatcaagggtgggcttagctgtgcctttccaataaagatgtgagaagcttcaaaaaaaaaaggcgccgctcgcgatctagaactag

SEQ ID NO: 313961 - DNA, 623 bp, Homo sapiens
caggcagactgtcggttacacatgttcaaaacgggggaagggccgggggccacagccctctcaccctggtactgcatgcacgcaatgctagctgcccctttcccgtcctgggcaccccgagtctcccccgaccccgggtcccaggtatgctcccacctccacctgccccactcaccacctctgctagttccagacacctccacgcccacctggtcctctcccatcgcccacaaaagggggggcacgagggacgagcttagctgagctgggaggagcagggtgagggtgggcgacccaggattccccctccccttcccaaataaagatgagggtactaaagttgtcttggtttttattttattattatttttttctttttccagtatactagcttgtcttttaagaaaggggatattaaaaaaaaaaaaagacaaaagtgtttttaaaaaaaagcaacacccacacctgtgtctgtatatagtcagcttatctcgtgttcaatcgtctgatctctacagagagaagtggaaaatgctgtatcaagggtgggcttagctgtgcctttccaataaagatgtgagaagcttcaaaaaaaaaaggcgccgctcgcgatctagaactag

SEQ ID NO: 313962 - DNA, 974 bp, Homo sapiens
  misc_feature (140)..(140): n is a, c, g, or t
  misc_feature (201)..(201): n is a, c, g, or t
  misc_feature (411)..(411): n is a, c, g, or t
  misc_feature (413)..(413): n is a, c, g, or t
aggatcacgatgtccgtgctccagcgcggggcgggggggggacaagtgagccaggcaagaagaatggattggccctagagtacgggttctccaaatgtaacctcggccctacagatctctgagactatgtcagggggttngtgagattttataacaaaattaagatgttagtacaatatcgtgtttcgccgccgggcgcgnttgacatgatgtttccacaaagcaggcattcgggctcctcgcacctaccccagcaactcaaattcaccacctcggactcctgcgaccgcatcaaagacgaatttcagctactgcaagctcagtaccacagcctcaagctcgaatgtgacaagttggccagtgagaagtcagagatgcagcgtcactatgtgatgtactacgagattcctncngcttgaacatcgagatgcacaaacaggctgagatcgtcaaaaggctgaacgcggcggcggccccgggagctgccgatcggcgccgggacaaaggcgcggccgcccggcgcccccagcagcccgagccggggcgcacagccggggcgcagcccgcgccccccgccgcgattgacatgatgtttccacaaagcaggcattcgggctcctcgcacctaccccagcaactcaaattcaccacctcggactcctgcgaccgcatcaaagacgaatttcagctactgcaagctcagtaccacagcctcaagctcgaatgtgacaagttggccagtgagaagtcagagatgcagcgtcactatgtgatgtactacgagatgtcctacggcttgaacatcgagatgcacaaacaggctgagatcgtcaaaaggctgaacgggatttgtgcccaggtcctgccctacctctcccaagagcaccagcagcaggtcttgggagccattgagagggccaagcaggtcaccgctcccgagctgaactctatcatccgaagtatgtatggggacc

SEQ ID NO: 313963 - DNA, 1038 bp, Homo sapiens
  misc_feature (140)..(140): n is a, c, g, or t
  misc_feature (201)..(201): n is a, c, g, or t
  misc_feature (411)..(411): n is a, c, g, or t
  misc_feature (413)..(413): n is a, c, g, or t
aggatcacgatgtccgtgctccagcgcggggcgggggggggacaagtgagccaggcaagaagaatggattggccctagagtacgggttctccaaatgtaacctcggccctacagatctctgagactatgtcagggggttngtgagattttataacaaaattaagatgttagtacaatatcgtgtttcgccgccgggcgcgnttgacatgatgtttccacaaagcaggcattcgggctcctcgcacctaccccagcaactcaaattcaccacctcggactcctgcgaccgcatcaaagacgaatttcagctactgcaagctcagtaccacagcctcaagctcgaatgtgacaagttggccagtgagaagtcagagatgcagcgtcactatgtgatgtactacgagattcctncngcttgaacatcgagatgcacaaacaggctgagatcgtcaaaaggctgaacgcggcggcggccccgggagctgccgatcggcgccgggacaaaggcgcggccgcccggcgcccccagcagcccgagccggggcgcacagccggggcgcagcccgcgccccccgccgcgattgacatgatgtttccacaaagcaggcattcgggctcctcgcacctaccccagcaactcaaattcaccacctcggactcctgcgaccgcatcaaagacgaatttcagctactgcaagctcagtaccacagcctcaagctcgaatgtgacaagttggccagtgagaagtcagagatgcagcgtcactatgtgatgtactacgagatgtcctacggcttgaacatcgagatgcacaaacaggctgagatcgtcaaaaggctgaacgggatttgtgcccaggtcctgccctacctctcccaagagcaccagcagcaggtcttgggagccattgagagggccaagcagcgcgccggggccgggcgcgcggggagggggcgcaggaagcgggcgaggccgggcgcgggaggcggcggcggccccgggagctgccgatcggcgccgggacaaaggcgcggccg

SEQ ID NO: 313964 - DNA, 1014 bp, Homo sapiens
  misc_feature (140)..(140): n is a, c, g, or t
  misc_feature (201)..(201): n is a, c, g, or t
  misc_feature (411)..(411): n is a, c, g, or t
  misc_feature (413)..(413): n is a, c, g, or t
aggatcacgatgtccgtgctccagcgcggggcgggggggggacaagtgagccaggcaagaagaatggattggccctagagtacgggttctccaaatgtaacctcggccctacagatctctgagactatgtcagggggttngtgagattttataacaaaattaagatgttagtacaatatcgtgtttcgccgccgggcgcgnttgacatgatgtttccacaaagcaggcattcgggctcctcgcacctaccccagcaactcaaattcaccacctcggactcctgcgaccgcatcaaagacgaatttcagctactgcaagctcagtaccacagcctcaagctcgaatgtgacaagttggccagtgagaagtcagagatgcagcgtcactatgtgatgtactacgagattcctncngcttgaacatcgagatgcacaaacaggctgagatcgtcaaaaggctgaacgcggcggcggccccgggagctgccgatcggcgccgggacaaaggcgcggccgcccggcgcccccagcagcccgagccggggcgcacagccggggcgcagcccgcgccccccgccgcgattgacatgatgtttccacaaagcaggcattcgggctcctcgcacctaccccagcaactcaaattcaccacctcggactcctgcgaccgcatcaaagacgaatttcagctactgcaagctcagtaccacagcctcaagctcgaatgtgacaagttggccagtgagaagtcagagatgcagcgtcactatgtgatggtaacgtcactccgcccccaggtccagtgttgggggcgggcgacagggccctccacatcccctccaccacgggcagctgctccctcaaccccggccacctcccctgggaagcgcgaggatcggggcctgttctccattcagccggcccctgctgggctgagcctgcctcgctagcctggcagatggccgaggcagtggccgaggtgccaaaccgccgggttgcagaccggccctgccag

SEQ ID NO: 313965 - DNA, 322 bp, Homo sapiens
  misc_feature (25)..(26): n is a, c, g, or t
  misc_feature (29)..(29): n is a, c, g, or t
actactactactaaattcgcggccnntcnctctgctagttccagacacctccacgcccacctggtcctctcccatcgcccacaaaagggggggcacgagggacgagcttagctgagctgggaggagcagggtgagggtgggcgacccaggattccccctccccttcccaaataaagatgagggtaccaaaaataaaaaaatttttaaagataattgtttttttctctgtccctaatatctttatatgtatagcatgtctctcctgataaagctgtcctgtgagcatcttaactgtttccccgtgttttcgagcgatcgggtc

SEQ ID NO: 313966 - DNA, 1367 bp, Homo sapiens
gtctgtctgtctgtctgtctgtctgtctgtgtctgtctgtctgtctgtctgtctgtctgtgtctgtctgtctgtctgtctgtctgtctgtgtctgtctgtctgtctgtctgtctgtctgtgtctgtctgtctgtctgtctgtctgtctgtgtctgtctgtctgtctgtctgtctgtctgtgtctgtctgtctgtctgtctgtctgtctgtgtctgtctgtctgtctgtctgtctgtctgtgtctgtctgtctgtctgtctgtctgtctgtgtctgtctgtctgtctgtctgtctgtctgtgtctgtctgtctgtctgtctgtctgtctgtgtctgtctgtctgtctgtctgtctgtctgtgtctgtctgtctgtctgtctgtctgtctgtgtctgtctgtctgtctgtctgtctgtctgtgtctgtctgtctgtctgtctgtctgtctgtgtctgtctgtctgtctgtctgtctgtctgtgtctgtctgtctgtctgtctgtctgtctctgctagttccagacacctccacgcccacctggtcctctcccatcgcccacaaaagggggggcacgagggacgagcttagctgagctgggaggagcagggtgagggtgggcgacccaggattccccctccccttcccaaataaagatgagggtaccaaagttgtcttggtttttattttattattatttttttctttttccagtatactagcttgtcttttaagaaaggggatattaaaaaaaaaaaagacaaaagtgtttttaaaaaaaagcaacacccacacctgtgtctgtatatagtcagcttatctcgtgttcaatcgtctgatctctacagagagaagtggaaaatgctgtatcaagggtgggcttagctgtgcctttccaataaagatgtgagaagcttcaaaaaaaaaaaaaaaaaaaaaaaaaaaaaaaaaaaaaaaaaaaaaaaaaaaaaaaaaaaaaaaataaaaataagagcgcaaacgaaaaaaaaatcaccacagagagaaggcacagacaggaattaaagagaaaagccaggcgggcggcgtgctggacacaaaaataagcggtcaccaccgactgatggcgacaggcatatcatatatacaacacaacaacaagacgatgtgtgtgtcgcaacaggtaacaaacagtacacggcccatacgaagaatgaggaacaaaaaacattctgaaaacaacgagagaacactagtgtgacgggaggcagagacacacacacactcagctgtggggagggaggaagcaacacaactatgtggaggaacagaccacagccagcaagagaagaagaaacacccagcatgcggggggaggaagactgacgaaa

SEQ ID NO: 313967 - DNA, 938 bp, Homo sapiens
gtctgtctgtctgtctgtctgtctgtctgtgtctgtctgtctgtctgtctgtctgtctgtgtctgtctgtctgtctgtctgtctgtctgtgtctgtctgtctgtctgtctgtctgtctgtgtctgtctgtctgtctgtctgtctgtctgtgtctgtctgtctgtctgtctgtctgtctgtgtctgtctgtctgtctgtctgtctgtctgtgtctgtctgtctgtctgtctgtctgtctgtgtctgtctgtctgtctgtctgtctgtctgtgtctgtctgtctgtctgtctgtctgtctgtgtctgtctgtctgtctgtctgtctgtctgtgtctgtctgtctgtctgtctgtctgtctgtgtctgtctgtctgtctgtctgtctgtctgtgtctgtctgtctgtctgtctgtctgtctgtgtctgtctgtctgtctgtctgtctgtctgtgtctgtctgtctgtctgtctgtctgtctgtgtctgtctgtctgtctgtctgtctgtctctgctagttccagacacctccacgcccacctggtcctctcccatcgcccacaaaagggggggcacgagggacgagcttagctgagctgggaggagcagggtgagggtgggcgacccaggattccccctccccttcccaaataaagatgagggtaccaaagttgtcttggtttttattttattattatttttttctttttccagtatactagcttgtcttttaagaaaggggatattaaaaaaaaaaaagacaaaagtgtttttaaaaaaaagcaacacccacacctgtgtctgtatatagtcagcttatctcgtgttcaatcgtctgatctctacagagagaagtggaaaatgctgtatcaagggtgggcttagctgtgcctttccaataaagatgtgagaagcttccaaaaaggaacaaaaaaaaaaaa

SEQ ID NO: 313968 - DNA, 733 bp, Homo sapiens
ccggtttcccttttttttttggccccgccacagaaaagataggatgtagtaagaaaagtcggagagagagagagagttccagggacagagaagggaacctagtagtcatcagctaaaaaaaagacaaaagtgtttttaaaaaaaagcaacacccacacctgtgtctgtatatagtcagcttatctcgtgttcaatcgtctgatctctacagagagaagtggaaaatgctgtatcaagggtgggcttagctgtgcctttccaataaagatgtgagaagcttcaaaaaaaaaaaaaaaaaaaaaaaaaaaaaaaaaaaaaaaaaaaaaaaaaaaaaaaaaaaaaaaataaaaataagagcgcaaacgaaaaaaaaatcaccacagagagaaggcacagacaggaattaaagagaaaagccaggcgggcggcgtgctggacacaaaaataagcggtcaccaccgactgatggcgacaggcatatcatatatacaacacaacaacaagacgatgtgtgtgtcgcaacaggtaacaaacagtacacggcccatacgaagaatgaggaacaaaaaacattctgaaaacaacgagagaacactagtgtgacgggaggcagagacacacacacactcagctgtggggagggaggaagcaacacaactatgtggaggaacagaccacagccagcaagagaagaagaaacacccagcatgcggggggaggaagactgacgaaa

SEQ ID NO: 313969 - DNA, 1842 bp, Homo sapiens
  misc_feature (140)..(140): n is a, c, g, or t
  misc_feature (201)..(201): n is a, c, g, or t
  misc_feature (411)..(411): n is a, c, g, or t
  misc_feature (413)..(413): n is a, c, g, or t
aggatcacgatgtccgtgctccagcgcggggcgggggggggacaagtgagccaggcaagaagaatggattggccctagagtacgggttctccaaatgtaacctcggccctacagatctctgagactatgtcagggggttngtgagattttataacaaaattaagatgttagtacaatatcgtgtttcgccgccgggcgcgnttgacatgatgtttccacaaagcaggcattcgggctcctcgcacctaccccagcaactcaaattcaccacctcggactcctgcgaccgcatcaaagacgaatttcagctactgcaagctcagtaccacagcctcaagctcgaatgtgacaagttggccagtgagaagtcagagatgcagcgtcactatgtgatgtactacgagattcctncngcttgaacatcgagatgcacaaacaggctgagatcgtcaaaaggctgaacgcggcggcggccccgggagctgccgatcggcgccgggacaaaggcgcggccgcccggcgcccccagcagcccgagccggggcgcacagccggggcgcagcccgcgccccccgccgcgattgacatgatgtttccacaaagcaggcattcgggctcctcgcacctaccccagcaactcaaattcaccacctcggactcctgcgaccgcatcaaagacgaatttcagctactgcaagctcagtaccacagcctcaagctcgaatgtgacaagttggccagtgagaagtcagagatgcagcgtcactatgtgatgtactacgagatgtcctacggcttgaacatcgagatgcacaaacaggctgagatcgtcaaaaggctgaacgggatttgtgcccaggtcctgccctacctctcccaagagcaccagcagcaggtcttgggagccattgagagggccaagcaggtcaccgctcccgagctgaactctatcatccgacagcagctccaagcccaccagctgtcccagctgcaggccctggccctgcccttgaccccactacccgtggggctgcagccgccttcgctgccggcggtcagcgcaggcaccggcctcctctcgctgtccgcgctgggttcccaggcccacctctccaaggaagacaagaacgggcacgatggtgacacccaccaggaggatgatggcgagaagtcggattagcagggggccgggacggggaggttgggaggggggacagaggggagacagaggcacggagagaaaggaatgtttagcacaagacacagcggagctcgggattggctaaactcccatagtatttatggtggccgccggcgggggccccagcccagcttgcaggccacctctagctttcttcctaccccattcccggcttccctcctcctcccctgcagcctggttaggtggatacctgccctgacatgtgaggcaagctaaggcctggagggtcagatgggagaccaggtcccaagggagcaagacctcgcgaagcgcagcagccccggcccttcccccgttttgaacatgtgtaaccgacagtctgcctgggccacagccctctcaccctggtactgcatgcacgcaatgctagctgcccctttcccgtcctgggcaccccgagtctcccccgaccccgggtcccaggtatgctcccacctccacctgccccactcaccacctctgctagttccagacacctccacgcccacctggtcctctcccatcgcccacaaaagggggggcacgagggacgagcttagctgagctgggaggagcagggtgagggtgggcgacccaggattccccctccccttcccaaataaagatgagggtactaaagt

SEQ ID NO: 313970 - DNA, 1663 bp, Homo sapiens
aatcggaacaaacttaggctaggtacgaggctggggtgcggcggcggccccgggagctgccgatcggcgccgggacaaaggcgcggccgcccggcgcccccagcagcccgagccggggcgcacagccggggcgcagcccgcgccccccgccgcgattgacatgatgtttccacaaagcaggcattcgggctcctcgcacctaccccagcaactcaaattcaccacctcggactcctgcgaccgcatcaaagacgaatttcagctactgcaagctcagtaccacagcctcaagctcgaatgtgacaagttggccagtgagaagtcagagatgcagcgtcactatgtgatgtactacgagatgtcctacggcttgaacatcgagatgcacaaacaggctgagatcgtcaaaaggctgaacgggatttgtgcccaggtcctgccctacctctcccaagagcaccagcagcaggtcttgggagccattgagagggccaagcaggtcaccgctcccgagctgaactctatcatccgacagcagctccaagcccaccagctgtcccagctgcaggccctggccctgcccttgaccccactacccgtggggctgcagccgccttcgctgccggcggtcagcgcaggcaccggcctcctctcgctgtccgcgctgggttcccaggcccacctctccaaggaagacaagaacgggcacgatggtgacacccaccaggaggatgatggcgagaagtcggattagcagggggccgggacggggaggttgggaggggggacagaggggagacagaggcacggagagaaaggaatgtttagcacaagacacagcggagctcgggattggctaaactcccatagtatttatggtggccgccggcgggggccccagcccagcttgcaggccacctctagctttcttcctaccccattcccggcttccctcctcctcccctgcagcctggttaggtggatacctgccctgacatgtgaggcaagctaaggcctggagggtcagatgggagaccaggtcccaagggagcaagacctcgcgaagcgcagcagccccggcccttcccccgttttgaacatgtgtaaccgacagtctgcctgggccacagccctctcaccctggtactgcatgcacgcaatgctagctgcccctttcccgtcctgggcaccccgagtctcccccgaccccgggtcccaggtatgctcccacctccacctgccccactcaccacctctgctagttccagacacctccacgcccacctggtcctctcccatcgcccacaaaagggggggcacgagggacgagcttagctgagctgggaggagcagggtgagggtgggcgacccaggattccccctccccttcccaaataaagatgagggtactaaagttgtcttggtttttattttattattatttttttctttttccagtatactagcttgtcttttaagaaaggggatattaaaaaaaaaaaaagacaaaagtgtttttaaaaaaaagcaacacccacacctgtgtctgtatatagtcagcttatctcgtgttcaatcgtctgatctctacagagagaagtggaaaatgctgtatcaagggtgggcttagctgtgcctttccaataaagatgtgagaagcttc

SEQ ID NO: 313971 - DNA, 2475 bp, Homo sapiens
aatcggaacaaacttaggctaggtacgaggctggggtgcggcggcggccccgggagctgccgatcggcgccgggacaaaggcgcggccgcccggcgcccccagcagcccgagccggggcgcacagccggggcgcagcccgcgccccccgccgcgattgacatgatgtttccacaaagcaggcattcgggctcctcgcacctaccccagcaactcaaattcaccacctcggactcctgcgaccgcatcaaagacgaatttcagctactgcaagctcagtaccacagcctcaagctcgaatgtgacaagttggccagtgagaagtcagagatgcagcgtcactatgtgatgtactacgagatgtcctacggcttgaacatcgagatgcacaaacaggctgagatcgtcaaaaggctgaacgggatttgtgcccaggtcctgccctacctctcccaagagcaccagcagcaggtcttgggagccattgagagggccaagcaggtcaccgctcccgagctgaactctatcatccgacagcagctccaagcccaccagctgtcccagctgcaggccctggccctgcccttgaccccactacccgtggggctgcagccgccttcgctgccggcggtcagcgcaggcaccggcctcctctcgctgtccgcgctgggttcccaggcccacctctccaaggaagacaagaacgggcacgatggtgacacccaccaggaggatgatggcgagaagtcggattagcagggggccgggacggggaggttgggaggggggacagaggggagacagaggcacggagagaaaggaatgtttagcacaagacacagcggagctcgggattggctaaactcccatagtatttatggtggccgccggcgggggccccagcccagcttgcaggccacctctagctttcttcctaccccattcccggcttccctcctcctcccctgcagcctggttaggtggatacctgccctgacatgtgaggcaagctaaggcctggagggtcagatgggagaccaggtcccaagggagcaagacctcgcgaagcgcagcagccccggcccttcccccgttttgaacatgtgtaaccgacagtctgcctgggccacagccctctcaccctggtactgcatgcacgcaatgctagctgcccctttcccgtcctgggcaccccgagtctcccccgaccccgggtcccaggtatgctcccacctccacctgccccactcaccacctctgctagttccagacacctccacgcccacctggtcctctcccatcgcccacaaaagggggggcacgagggacgagcttagctgagctgggaggagcagggtgagggtgggcgacccaggattccccctccccttcccaaataaagatgagggtactaaagttgtcttggtttttattttattattatttttttctttttccagtatactagcttgtcttttaagaaaggggatattaaaaaaaaaaaaagacaaaagtgtttttaaaaaaaagcaacacccacacctgtgtctgtatatagtcagcttatctcgtgttcaatcgtctgatctctacagagagaagtggaaaatgctgtatcaagggtgggcttagctgtgcctttccaataaagatgtgagaagcttcaaaaacacaaaaaccacacaccaaacaacaacttttgcgcgcccggccccggccctaggaaagctttcaaacaccattcgtgtggggcgcggggcgcccaggaggcgtaacgcagacccgttggggtcaacagcgtttgtccccaaggcgacaaccgcgcgaccagtaacatacggtgtcgggaacttccaccaaataaaaaaagcgccgggtgaacaaccggcgcgtgtctgcgaacaaaactcacgaaatggacaggcaactcgaagcgcacataacagcgcatctatcaacgcgggactcccacggagacggccggacatatacaattacgcccccgccgacgagtatcgccagacacaagcgaagcagccaccacagcaagccagacaccagaggacgacaagacaagagcaaggcgaacaacaaacgaggaaagtaacgagacagaacgagccgcagacgcggacagagagcctacgccagatagccgcgggaacgtacgcgcgggcaggagcagcagaagctggggaggagagagatcgcgcgacgcatgagagacggccgccgcagaccgaggacgtgaggacgacagcatagaacggggccagtcgagcagacgtacggtcacgcgccggcagcgaccggacgcatgacacactcctcagccgagacaccgggcacgccaggatgggcgccgacagagacagatgatgtgagtagagagagagattggaggacgggagcgagagagacggcagcggcgcgacggagcagaggcgtcagagactcggagaagggagtcgaagaat

SEQ ID NO: 313972 - DNA, 1732 bp, Homo sapiens
ggcggcattaccgctgcctttctgcataataggaatatcttatatgtgtcttcttgtctatatgtttctcttctctgtctctctagtccagagccaaggtcacagagcacgtccgtggcacgcgtccaggtcgtgccacagcagggccggcggcttcgacgcgggcagccgggtcccttttctttgacagatggggaaaccgaggcccggccggctgccggggctcctcgcacctaccccagcaactcaaattcaccacctcggactcctgcgaccgcatcaaagacgaatttcagctactgcaagctcagtaccacagcctcaagctcgaatgtgacaagttggccagtgagaagtcagagatgcagcgtcactatgtgatgtactacgagatgtcctacggcttgaacatcgagatgcacaaacaggctgagatcgtcaaaaggctgaacgggatttgtgcccaggtcctgccctacctctcccaagagcaccagcagcaggtcttgggagccattgagagggccaagcaggtcaccgctcccgagctgaactctatcatccgacagcagctccaagcccaccagctgtcccagctgcaggccctggccctgcccttgaccccactacccgtggggctgcagccgccttcgctgccggcggtcagcgcaggcaccggcctcctctcgctgtccgcgctgggttcccaggcccacctctccaaggaagacaagaacgggcacgatggtgacacccaccaggaggatgatggcgagaagtcggattagcagggggccgggacggggaggttgggaggggggacagaggggagacagaggcacggagagaaaggaatgtttagcacaagacacagcggagctcgggattggctaaactcccatagtatttatggtggccgccggcgggggccccagcccagcttgcaggccacctctagctttcttcctaccccattcccggcttccctcctcctcccctgcagcctggttaggtggatacctgccctgacatgtgaggcaagctaaggcctggagggtcagatgggagaccaggtcccaagggagcaagacctcgcgaagcgcagcagccccggcccttcccccgttttgaacatgtgtaaccgacagtctgcctgggccacagccctctcaccctggtactgcatgcacgcaatgctagctgcccctttcccgtcctgggcaccccgagtctcccccgaccccgggtcccaggtatgctcccacctccacctgccccactcaccacctctgctagttccagacacctccacgcccacctggtcctctcccatcgcccacaaaagggggggcacgagggacgagcttagctgagctgggaggagcagggtgagggtgggcgacccaggattccccctccccttcccaaataaagatgagggtactaaagttgtcttggtttttattttattattatttttttctttttccagtatactagcttgtcttttaagaaaggggatattaaaaaaaaaaaaagacaaaagtgtttttaaaaaaaagcaacacccacacctgtgtctgtatatagtcagcttatctcgtgttcaatcgtctgatctctacagagagaagtggaaaatgctgtatcaagggtgggcttagctgtgcctttccaataaagatgtgagaagcttcaaaaaaaaaaggcgccgctcgcgatctagaactag

SEQ ID NO: 313973 - DNA, 1744 bp, Homo sapiens
  misc_feature (140)..(140): n is a, c, g, or t
  misc_feature (201)..(201): n is a, c, g, or t
aggatcacgatgtccgtgctccagcgcggggcgggggggggacaagtgagccaggcaagaagaatggattggccctagagtacgggttctccaaatgtaacctcggccctacagatctctgagactatgtcagggggttngtgagattttataacaaaattaagatgttagtacaatatcgtgtttcgccgccgggcgcgnttgacatgatgtttccacaaagcaggcattcgggctcctcgcacctaccccagcaactcaaattcaccacctcggactcctgcgaccgcatcaaagacgaatttcagctactgcaagctcagtaccacagcctcaagctcgaatgtgacaagttggccagtgagaagtcagagatgcagcgtcactatgtgatgtactacgagatgtcctacggcttgaacatcgagatgcacaaacaggctgagatcgtcaaaaggctgaacgggatttgtgcccaggtcctgccctacctctcccaagagcaccagcagcaggtcttgggagccattgagagggccaagcaggtcaccgctcccgagctgaactctatcatccgacagcagctccaagcccaccagctgtcccagctgcaggccctggccctgcccttgaccccactacccgtggggctgcagccgccttcgctgccggcggtcagcgcaggcaccggcctcctctcgctgtccgcgctgggttcccaggcccacctctccaaggaagacaagaacgggcacgatggtgacacccaccaggaggatgatggcgagaagtcggattagcagggggccgggacggggaggttgggaggggggacagaggggagacagaggcacggagagaaaggaatgtttagcacaagacacagcggagctcgggattggctaaactcccatagtatttatggtggccgccggcgggggccccagcccagcttgcaggccacctctagctttcttcctaccccattcccggcttccctcctcctcccctgcagcctggttaggtggatacctgccctgacatgtgaggcaagctaaggcctggagggtcagatgggagaccaggtcccaagggagcaagacctcgcgaagcgcagcagccccggcccttcccccgttttgaacatgtgtaaccgacagtctgcctgggccacagccctctcaccctggtactgcatgcacgcaatgctagctgcccctttcccgtcctgggcaccccgagtctcccccgaccccgggtcccaggtatgctcccacctccacctgccccactcaccacctctgctagttccagacacctccacgcccacctggtcctctcccatcgcccacaaaagggggggcacgagggacgagcttagctgagctgggaggagcagggtgagggtgggcgacccaggattccccctccccttcccaaataaagatgagggtactaaagttgtcttggtttttattttattattatttttttctttttccagtatactagcttgtcttttaagaaaggggatattaaaaaaaaaaaaagacaaaagtgtttttaaaaaaaagcaacacccacacctgtgtctgtatatagtcagcttatctcgtgttcaatcgtctgatctctacagagagaagtggaaaatgctgtatcaagggtgggcttagctgtgcctttccaataaagatgtgagaagcttcaaaaaaaaaaggcgccgctcgcgatctagaactag

SEQ ID NO: 313974 - DNA, 1339 bp, Homo sapiens
aatcggaacaaacttaggctaggtacgaggctggggtgcggcggcggccccgggagctgccgatcggcgccgggacaaaggcgcggccgcccggcgcccccagcagcccgagccggggcgcacagccggggcgcagcccgcgccccccgccgcgattgacatgatgtttccacaaagcaggcattcgggctcctcgcacctaccccagcaactcaaattcaccacctcggactcctgcgaccgcatcaaagacgaatttcagctactgcaagctcagtaccacagcctcaagctcgaatgtgacaagttggccagtgagaagtcagagatgcagcgtcactatgtgatgtactacgagatgtcctacggcttgaacatcgagatgcacaaacaggctgagatcgtcaaaaggctgaacgggatttgtgcccaggtcctgccctacctctcccaagagcaccagcagcaggtcttgggagccattgagagggccaagcaggtcaccgctcccgagctgaactctatcatccgacagcagctccaagcccaccagctgtcccagctgcaggccctggccctgcccttgaccccactacccgtggggctgcagccgccttcgctgccggcggtcagcgcaggcaccggcctcctctcgctgtccgcgctgggttcccaggcccacctctccaaggaagacaagaacgggcacgatggtgacacccaccaggaggatgatggcgagaagtcggattagcagggggccgggacggggaggttgggaggggggacagaggggagacagaggcacggagagaaaggaatgtttagcacaagacacagcggagctcgggattggctaaactcccatagtatttatggtggccgccggcgggggccccagcccagcttgcaggccacctctagctttcttcctaccccattcccggcttccctcctcctcccctgcagcctggttaggtggatacctgccctgacatgtgaggcaagctaaggcctggagggtcagatgggagaccaggtcccaagggagcaagacctcgcgaagcgcagcagccccggcccttcccccgttttgaacatgtgtaaccgacagtctgcctgggccacagccctctcaccctggtactgcatgcacgcaatgctagctgcccctttcccgtcctgggcaccccgagtctcccccgaccccgggtcccaggtatgctcccacctccacctgccccactcaccacctctgctagttccagacacctccacgcccacctggtcctctcccatcgcccacaaaagggggggcaagaaaaaaaaaataaaacaa

SEQ ID NO: 313975 - DNA, 1293 bp, Homo sapiens
aatcggaacaaacttaggctaggtacgaggctggggtgcggcggcggccccgggagctgccgatcggcgccgggacaaaggcgcggccgcccggcgcccccagcagcccgagccggggcgcacagccggggcgcagcccgcgccccccgccgcgattgacatgatgtttccacaaagcaggcattcgggctcctcgcacctaccccagcaactcaaattcaccacctcggactcctgcgaccgcatcaaagacgaatttcagctactgcaagctcagtaccacagcctcaagctcgaatgtgacaagttggccagtgagaagtcagagatgcagcgtcactatgtgatgtactacgagatgtcctacggcttgaacatcgagatgcacaaacaggctgagatcgtcaaaaggctgaacgggatttgtgcccaggtcctgccctacctctcccaagagcaccagcagcaggtcttgggagccattgagagggccaagcaggtcaccgctcccgagctgaactctatcatccgacagcagctccaagcccaccagctgtcccagctgcaggccctggccctgcccttgaccccactacccgtggggctgcagccgccttcgctgccggcggtcagcgcaggcaccggcctcctctcgctgtccgcgctgggttcccaggcccacctctccaaggaagacaagaacgggcacgatggtgacacccaccaggaggatgatggcgagaagtcggattagcagggggccgggacggggaggttgggaggggggacagaggggagacagaggcacggagagaaaggaatgtttagcacaagacacagcggagctcgggattggctaaactcccatagtatttatggtggccgccggcgggggccccagcccagcttgcaggccacctctagctttcttcctaccccattcccggcttccctcctcctcccctgcagcctggttaggtggatacctgccctgacatgtgaggcaagctaaggcctggagggtcagatgggagaccaggtcccaagggagcaagacctcgcgaagcgcagcagccccggcccttcccccgttttgaacatgtgtaaccgacagtctgcctgggccacagccctctcaccctggtactgcatgcacgcaatgctagctgcccctttcccgtcctgggcaccccgagtctcccccgaccccgggtcccaggtatgctcccacctccacttgaccccactacccgtggggctgcagccgccttcactgccggcggtcagcgcagg

SEQ ID NO: 313976 - DNA, 1584 bp, Homo sapiens
aatcggaacaaacttaggctaggtacgaggctggggtgcggcggcggccccgggagctgccgatcggcgccgggacaaaggcgcggccgcccggcgcccccagcagcccgagccggggcgcacagccggggcgcagcccgcgccccccgccgcgattgacatgatgtttccacaaagcaggcattcgggctcctcgcacctaccccagcaactcaaattcaccacctcggactcctgcgaccgcatcaaagacgaatttcagctactgcaagctcagtaccacagcctcaagctcgaatgtgacaagttggccagtgagaagtcagagatgcagcgtcactatgtgatgtactacgagatgtcctacggcttgaacatcgagatgcacaaacaggctgagatcgtcaaaaggctgaacgggatttgtgcccaggtcctgccctacctctcccaagagcaccagcagcaggtcttgggagccattgagagggccaagcaggtcaccgctcccgagctgaactctatcatccgacagcagctccaagcccaccagctgtcccagctgcaggccctggccctgcccttgaccccactacccgtggggctgcagccgccttcgctgccggcggtcagcgcaggcaccggcctcctctcgctgtccgcgctgggttcccaggcccacctctccaaggaagacaagaacgggcacgatggtgacacccaccaggaggatgatggcgagaagtcggattagcagggggccgggacggggaggttgggaggggggacagaggggagacagaggcacggagagaaaggaatgtttagcacaagacacagcggagctcgggattggctaaactcccatagtatttatggtggccgccggcgggggccccagcccagcttgcaggccacctctagctttcttcctaccccattcccggcttccctcctcctcccctgcagcctggttaggtggatacctgccctgacatgtgaggcaagctaaggcctggagggtcagatgggagaccaggtcccaagggagcaagacctcgcgaagcgcagcagccccggcccttcccccgttttgaacatgtgtaaccgacagtctgcctggctgccccactcaccacctctgctagttccagacacctccacgcccacctggtcctctcccatcgcccacaaaagggggggcacgagggacgagcttagctgagctgggaggagcagggtgagggtgggcgacccaggattccccctccccttcccaaataaagatgagggtactaaagttgtcttggtttttattttattattatttttttctttttccagtatactagcttgtcttttaagaaaggggatattaaaaaaaaaaaaagacaaaagtgtttttaaaaaaaagcaacacccacacctgtgtctgtatatagtcagcttatctcgtgttcaatcgtctgatctctacagagagaagtggaaaatgctgtatcaagggtgggcttagctgtgcctttccaataaagatgtgagaagcttcaaaaaaaaaaggcgccgctcgcgatctagaactag

SEQ ID NO: 313977 - DNA, 1423 bp, Homo sapiens
  misc_feature (91)..(91): n is a, c, g, or t
  misc_feature (93)..(93): n is a, c, g, or t
cccgcgagaattcctgctgctcccgcgagaattcctgctgctaattcctgctgctcccgcgagaattcctgctgctcccgcgagattcctncngcttgaacatcgagatgcacaaacaggctgagatcgtcaaaaggctgaacgggatttgtgcccaggtcctgccctacctctcccaagagcaccagcagcaggtcttgggagccattgagagggccaagcaggtcaccgctcccgagctgaactctatcatccgacagcagctccaagcccaccagctgtcccagctgcaggccctggccctgcccttgaccccactacccgtggggctgcagccgccttcgctgccggcggtcagcgcaggcaccggcctcctctcgctgtccgcgctgggttcccaggcccacctctccaaggaagacaagaacgggcacgatggtgacacccaccaggaggatgatggcgagaagtcggattagcagggggccgggacggggaggttgggaggggggacagaggggagacagaggcacggagagaaaggaatgtttagcacaagacacagcggagctcgggattggctaaactcccatagtatttatggtggccgccggcgggggccccagcccagcttgcaggccacctctagctttcttcctaccccattcccggcttccctcctcctcccctgcagcctggttaggtggatacctgccctgacatgtgaggcaagctaaggcctggagggtcagatgggagaccaggtcccaagggagcaagacctcgcgaagcgcagcagccccggcccttcccccgttttgaacatgtgtaaccgacagtctgcctgggccacagccctctcaccctggtactgcatgcacgcaatgctagctgcccctttcccgtcctgggcaccccgagtctcccccgaccccgggtcccaggtatgctcccacctccacctgccccactcaccacctctgctagttccagacacctccacgcccacctggtcctctcccatcgcccacaaaagggggggcacgagggacgagcttagctgagctgggaggagcagggtgagggtgggcgacccaggattccccctccccttcccaaataaagatgagggtactaaagttgtcttggtttttattttattattatttttttctttttccagtatactagcttgtcttttaagaaaggggatattaaaaaaaaaaaaagacaaaagtgtttttaaaaaaaagcaacacccacacctgtgtctgtatatagtcagcttatctcgtgttcaatcgtctgatctctacagagagaagtggaaaatgctgtatcaagggtgggcttagctgtgcctttccaataaagatgtgagaagcttcaaaaaaaaaaggcgccgctcgcgatctagaactag

SEQ ID NO: 313978 - DNA, 1345 bp, Homo sapiens
aatcggaacaaacttaggctaggtacgaggctggggtgcggcggcggccccgggagctgccgatcggcgccgggacaaaggcgcggccgcccggcgcccccagcagcccgagccggggcgcacagccggggcgcagcccgcgccccccgccgcgattgacatgatgtttccacaaagcaggcattcgggctcctcgcacctaccccagcaactcaaattcaccacctcggactcctgcgaccgcatcaaagacgaatttcagctactgcaagctcagtaccacagcctcaagctcgaatgtgacaagttggccagtgagaagtcagagatgcagcgtcactatgtgatgtactacgagatgtcctacggcttgaacatcgagatgcacaaacaggctgagatcgtcaaaaggctgaacgggatttgtgcccaggtcctgccctacctctcccaagagcaccagcagcaggtcttgggagccattgagagggccaagcaggtcaccgctcccgagctgaactctatcatccgacagcagctccaagcccaccagctgtcccagctgcaggccctggccctgcccttgaccccactacccgtggggctgcagccgccttcgctgccggcggtcagcgcaggcaccggcctcctctcgctgtccgcgctgggttcccaggcccacctctccaaggaagacaagaacgggcacgatggtgacacccaccaggaggatgatggcgagaagtcggattagcagggggccgggacggggaggttgggaggggggacagaggggagacagaggcacggagagaaaggaatgtttagcacaagacacagcggagctcgggattggctaaactcccatagtatttatggtggccgccggcgggggccccagcccagcttgcaggccacctctagctttcttcctaccccattcccggcttccctcctcctcccctgcagcctggttaggtggatacctgccctgacatgtgaggcaagctaaggcctggagggtcagatgggagaccaggtcccaagggagcaagacctcgcgaagcgcagcagccccggcccttcccccgttttgaacatgtgtaaccgacagtctgcctggctgccccactcaccacctctgctagttccagacacctccacgcccacctggtcctctcccatcgcccacaaaagggggggcacgagggacgagcttagctgagctgggaggagcagggtgagggtgggcgacccaggggcgcaggaagcgggcgaggccgggcgcgggaggcggcggcggccccgggagctgccgatcggcgccgggacaaaggcgcggccg

SEQ ID NO: 313979 - DNA, 1119 bp, Homo sapiens
aatcggaacaaacttaggctaggtacgaggctggggtgcggcggcggccccgggagctgccgatcggcgccgggacaaaggcgcggccgcccggcgcccccagcagcccgagccggggcgcacagccggggcgcagcccgcgccccccgccgcgattgacatgatgtttccacaaagcaggcattcgggctcctcgcacctaccccagcaactcaaattcaccacctcggactcctgcgaccgcatcaaagacgaatttcagctactgcaagctcagtaccacagcctcaagctcgaatgtgacaagttggccagtgagaagtcagagatgcagcgtcactatgtgatgtactacgagatgtcctacggcttgaacatcgagatgcacaaacaggctgagatcgtcaaaaggctgaacgggatttgtgcccaggtcctgccctacctctcccaagagcaccagcagcaggtcttgggagccattgagagggccaagcaggtcaccgctcccgagctgaactctatcatccgacagcagctccaagcccaccagctgtcccagctgcaggccctggccctgcccttgaccccactacccgtggggctgcagccgccttcgctgccggcggtcagcgcaggcaccggcctcctctcgctgtccgcgctgggttcccaggcccacctctccaaggaagacaagaacgggcacgatggtgacacccaccaggaggatgatggcgagaagtcggattagcagggggccgggacggggaggttgggaggggggacagaggggagacagaggcacggagagaaaggaatgtttagcacaagacacagcggagctcgggattggctaaactcccatagtatttatggtggccgccggcgggggccccagcccagcttgcaggccacctctagctttcttcctaccccattcccggcttccctcctcctcccctgcagcctggttaggtggatacctgccctgacatgtgaggcaagctaaggcctggagggtcagatgggagaccaggtcccaagggagcaagacctcgcgaagcgcagcagccccggcccaccctgggaagattacagggatcctcatagaacagc

SEQ ID NO: 313980 - DNA, 1819 bp, Homo sapiens
  misc_feature (140)..(140): n is a, c, g, or t
  misc_feature (201)..(201): n is a, c, g, or t
  misc_feature (411)..(411): n is a, c, g, or t
  misc_feature (413)..(413): n is a, c, g, or t
aggatcacgatgtccgtgctccagcgcggggcgggggggggacaagtgagccaggcaagaagaatggattggccctagagtacgggttctccaaatgtaacctcggccctacagatctctgagactatgtcagggggttngtgagattttataacaaaattaagatgttagtacaatatcgtgtttcgccgccgggcgcgnttgacatgatgtttccacaaagcaggcattcgggctcctcgcacctaccccagcaactcaaattcaccacctcggactcctgcgaccgcatcaaagacgaatttcagctactgcaagctcagtaccacagcctcaagctcgaatgtgacaagttggccagtgagaagtcagagatgcagcgtcactatgtgatgtactacgagattcctncngcttgaacatcgagatgcacaaacaggctgagatcgtcaaaaggctgaacgcggcggcggccccgggagctgccgatcggcgccgggacaaaggcgcggccgcccggcgcccccagcagcccgagccggggcgcacagccggggcgcagcccgcgccccccgccgcgattgacatgatgtttccacaaagcaggcattcgggctcctcgcacctaccccagcaactcaaattcaccacctcggactcctgcgaccgcatcaaagacgaatttcagctactgcaagctcagtaccacagcctcaagctcgaatgtgacaagttggccagtgagaagtcagagatgcagcgtcactatgtgatgtactacgagatgtcctacggcttgaacatcgagatgcacaaacaggctgagatcgtcaaaaggctgaacgggatttgtgcccaggtcctgccctacctctcccaagagcaccagcagcaggtcttgggagccattgagagggccaagcaggcacggagagaaaggaatgtttagcacaagacacagcggagctcgggattggctaaactcccatagtatttatggtggccgccggcgggggccccagcccagcttgcaggccacctctagctttcttcctaccccattcccggcttccctcctcctcccctgcagcctggttaggtggatacctgccctgacatgtgaggcaagctaaggcctggagggtcagatgggagaccaggtcccaagggagcaagacctcgcgaagcgcagcagccccggcccttcccccgttttgaacatgtgtaaccgacagtctgcctgggccacagccctctcaccctggtactgcatgcacgcaatgctagctgcccctttcccgtcctgggcaccccgagtctcccccgaccccgggtcccaggtatgctcccacctccacctgccccactcaccacctctgctagttccagacacctccacgcccacctggtcctctcccatcgcccacaaaagggggggcacgagggacgagcttagctgagctgggaggagcagggtgagggtgggcgacccaggattccccctccccttcccaaataaagatgagggtactaaagttgtcttggtttttattttattattatttttttctttttccagtatactagcttgtcttttaagaaaggggatattaaaaaaaaaaaaagacaaaagtgtttttaaaaaaaagcaacacccacacctgtgtctgtatatagtcagcttatctcgtgttcaatcgtctgatctctacagagagaagtggaaaatgctgtatcaagggtgggcttagctgtgcctttccaataaagatgtgagaagcttcaaaaaaaaaaggcgccgctcgcgatctagaactag

SEQ ID NO: 313981 - DNA, 1431 bp, Homo sapiens
  misc_feature (140)..(140): n is a, c, g, or t
  misc_feature (201)..(201): n is a, c, g, or t
  misc_feature (411)..(411): n is a, c, g, or t
  misc_feature (413)..(413): n is a, c, g, or t
aggatcacgatgtccgtgctccagcgcggggcgggggggggacaagtgagccaggcaagaagaatggattggccctagagtacgggttctccaaatgtaacctcggccctacagatctctgagactatgtcagggggttngtgagattttataacaaaattaagatgttagtacaatatcgtgtttcgccgccgggcgcgnttgacatgatgtttccacaaagcaggcattcgggctcctcgcacctaccccagcaactcaaattcaccacctcggactcctgcgaccgcatcaaagacgaatttcagctactgcaagctcagtaccacagcctcaagctcgaatgtgacaagttggccagtgagaagtcagagatgcagcgtcactatgtgatgtactacgagattcctncngcttgaacatcgagatgcacaaacaggctgagatcgtcaaaaggctgaacgcggcggcggccccgggagctgccgatcggcgccgggacaaaggcgcggccgcccggcgcccccagcagcccgagccggggcgcacagccggggcgcagcccgcgccccccgccgcgattgacatgatgtttccacaaagcaggcattcgggccgccggcgggggccccagcccagcttgcaggccacctctagctttcttcctaccccattcccggcttccctcctcctcccctgcagcctggttaggtggatacctgccctgacatgtgaggcaagctaaggcctggagggtcagatgggagaccaggtcccaagggagcaagacctcgcgaagcgcagcagccccggcccttcccccgttttgaacatgtgtaaccgacagtctgcctgggccacagccctctcaccctggtactgcatgcacgcaatgctagctgcccctttcccgtcctgggcaccccgagtctcccccgaccccgggtcccaggtatgctcccacctccacctgccccactcaccacctctgctagttccagacacctccacgcccacctggtcctctcccatcgcccacaaaagggggggcacgagggacgagcttagctgagctgggaggagcagggtgagggtgggcgacccaggattccccctccccttcccaaataaagatgagggtactaaagttgtcttggtttttattttattattatttttttctttttccagtatactagcttgtcttttaagaaaggggatattaaaaaaaaaaaaagacaaaagtgtttttaaaaaaaagcaacacccacacctgtgtctgtatatagtcagcttatctcgtgttcaatcgtctgatctctacagagagaagtggaaaatgctgtatcaagggtgggcttagctgtgcctttccaataaagatgtgagaagcttcaaaaaaaaaaggcgccgctcgcgatctagaactag

SEQ ID NO: 313982 - DNA, 1574 bp, Homo sapiens
  misc_feature (140)..(140): n is a, c, g, or t
  misc_feature (201)..(201): n is a, c, g, or t
  misc_feature (411)..(411): n is a, c, g, or t
  misc_feature (413)..(413): n is a, c, g, or t
aggatcacgatgtccgtgctccagcgcggggcgggggggggacaagtgagccaggcaagaagaatggattggccctagagtacgggttctccaaatgtaacctcggccctacagatctctgagactatgtcagggggttngtgagattttataacaaaattaagatgttagtacaatatcgtgtttcgccgccgggcgcgnttgacatgatgtttccacaaagcaggcattcgggctcctcgcacctaccccagcaactcaaattcaccacctcggactcctgcgaccgcatcaaagacgaatttcagctactgcaagctcagtaccacagcctcaagctcgaatgtgacaagttggccagtgagaagtcagagatgcagcgtcactatgtgatgtactacgagattcctncngcttgaacatcgagatgcacaaacaggctgagatcgtcaaaaggctgaacgcggcggcggccccgggagctgccgatcggcgccgggacaaaggcgcggccgcccggcgcccccagcagcccgagccggggcgcacagccggggcgcagcccgcgccccccgccgcgattgacatgatgtttccacaaagcaggcattcgggctcctcgcacctaccccagcaactcaaattcaccacctcggactcctgcgaccgcatcaaagacgaatttcagctactgcaagctcagtaccacagcctcaagctcgaatgtgacaagttggccagtgagaagtcagagatgcagcgtcactatgtgatgtactacgagatgtcctacggcttgaacatcgagatgcacaaacaggctgagatcgtcaaaaggctgaacgggatttgtgcccaggtcctgccctgacatgtgaggcaagctaaggcctggagggtcagatgggagaccaggtcccaagggagcaagacctcgcgaagcgcagcagccccggcccttcccccgttttgaacatgtgtaaccgacagtctgcctgggccacagccctctcaccctggtactgcatgcacgcaatgctagctgcccctttcccgtcctgggcaccccgagtctcccccgaccccgggtcccaggtatgctcccacctccacctgccccactcaccacctctgctagttccagacacctccacgcccacctggtcctctcccatcgcccacaaaagggggggcacgagggacgagcttagctgagctgggaggagcagggtgagggtgggcgacccaggattccccctccccttcccaaataaagatgagggtactaaagttgtcttggtttttattttattattatttttttctttttccagtatactagcttgtcttttaagaaaggggatattaaaaaaaaaaaaagacaaaagtgtttttaaaaaaaagcaacacccacacctgtgtctgtatatagtcagcttatctcgtgttcaatcgtctgatctctacagagagaagtggaaaatgctgtatcaagggtgggcttagctgtgcctttccaataaagatgtgagaagcttcaaaaaaaaaaggcgccgctcgcgatctagaactag

SEQ ID NO: 313983 - DNA, 1395 bp, Homo sapiens
  misc_feature (140)..(140): n is a, c, g, or t
  misc_feature (201)..(201): n is a, c, g, or t
  misc_feature (411)..(411): n is a, c, g, or t
  misc_feature (413)..(413): n is a, c, g, or t
aggatcacgatgtccgtgctccagcgcggggcgggggggggacaagtgagccaggcaagaagaatggattggccctagagtacgggttctccaaatgtaacctcggccctacagatctctgagactatgtcagggggttngtgagattttataacaaaattaagatgttagtacaatatcgtgtttcgccgccgggcgcgnttgacatgatgtttccacaaagcaggcattcgggctcctcgcacctaccccagcaactcaaattcaccacctcggactcctgcgaccgcatcaaagacgaatttcagctactgcaagctcagtaccacagcctcaagctcgaatgtgacaagttggccagtgagaagtcagagatgcagcgtcactatgtgatgtactacgagattcctncngcttgaacatcgagatgcacaaacaggctgagatcgtcaaaaggctgaacgcggcggcggccccgggagctgccgatcggcgccgggacaaaggcgcggccgcccggcgcccccagcagcccgagccggggcgcacagccggggcgcagcccgcgccccccgccgcgattgacatgatgtttccacaaagcaggcattcgggctcctcgcacctaccccagcaactcaaattcaccacctcggactcctgcgaccgcatcaaagacgaatttcagctactgcaagctcagtaccacagcctcaagctcgaatgtgacaagttggccagtgagaagtcagagatgcagcgtcactatgtgatgtactacgagatgtcctacggcttgaacatcgagatgcacaaacaggccacagccctctcaccctggtactgcatgcacgcaatgctagctgcccctttcccgtcctgggcaccccgagtctcccccgaccccgggtcccaggtatgctcccacctccacctgccccactcaccacctctgctagttccagacacctccacgcccacctggtcctctcccatcgcccacaaaagggggggcacgagggacgagcttagctgagctgggaggagcagggtgagggtgggcgacccaggattccccctccccttcccaaataaagatgagggtactaaagttgtcttggtttttattttattattatttttttctttttccagtatactagcttgtcttttaagaaaggggatattaaaaaaaaaaaaagacaaaagtgtttttaaaaaaaagcaacacccacacctgtgtctgtatatagtcagcttatctcgtgttcaatcgtctgatctctacagagagaagtggaaaatgctgtatcaagggtgggcttagctgtgcctttccaataaagatgtgagaagcttcaaaaaaaaaaggcgccgctcgcgatctagaactag

SEQ ID NO: 313984 - DNA, 1115 bp, Homo sapiens
  misc_feature (140)..(140): n is a, c, g, or t
  misc_feature (201)..(201): n is a, c, g, or t
  misc_feature (411)..(411): n is a, c, g, or t
  misc_feature (413)..(413): n is a, c, g, or t
aggatcacgatgtccgtgctccagcgcggggcgggggggggacaagtgagccaggcaagaagaatggattggccctagagtacgggttctccaaatgtaacctcggccctacagatctctgagactatgtcagggggttngtgagattttataacaaaattaagatgttagtacaatatcgtgtttcgccgccgggcgcgnttgacatgatgtttccacaaagcaggcattcgggctcctcgcacctaccccagcaactcaaattcaccacctcggactcctgcgaccgcatcaaagacgaatttcagctactgcaagctcagtaccacagcctcaagctcgaatgtgacaagttggccagtgagaagtcagagatgcagcgtcactatgtgatgtactacgagattcctncngcttgaacatcgagatgcacaaacaggctgagatcgtcaaaaggctgaacgcggcggcggccccgggagctgccgatcggcgccgggacaaaggcgcggccgcccggcgcccccagcagcccgagccggggcgcacagccggggcgcagcccgcgccccccgccgcgattgacatgatgtttccacaaagcaggcattcgtctcccccgaccccgggtcccaggtatgctcccacctccacctgccccactcaccacctctgctagttccagacacctccacgcccacctggtcctctcccatcgcccacaaaagggggggcacgagggacgagcttagctgagctgggaggagcagggtgagggtgggcgacccaggattccccctccccttcccaaataaagatgagggtactaaagttgtcttggtttttattttattattatttttttctttttccagtatactagcttgtcttttaagaaaggggatattaaaaaaaaaaaaagacaaaagtgtttttaaaaaaaagcaacacccacacctgtgtctgtatatagtcagcttatctcgtgttcaatcgtctgatctctacagagagaagtggaaaatgctgtatcaagggtgggcttagctgtgcctttccaataaagatgtgagaagcttcaaaaaaaaaaggcgccgctcgcgatctagaactag

SEQ ID NO: 313985 - DNA, 1452 bp, Homo sapiens
  misc_feature (140)..(140): n is a, c, g, or t
  misc_feature (201)..(201): n is a, c, g, or t
  misc_feature (411)..(411): n is a, c, g, or t
  misc_feature (413)..(413): n is a, c, g, or t
aggatcacgatgtccgtgctccagcgcggggcgggggggggacaagtgagccaggcaagaagaatggattggccctagagtacgggttctccaaatgtaacctcggccctacagatctctgagactatgtcagggggttngtgagattttataacaaaattaagatgttagtacaatatcgtgtttcgccgccgggcgcgnttgacatgatgtttccacaaagcaggcattcgggctcctcgcacctaccccagcaactcaaattcaccacctcggactcctgcgaccgcatcaaagacgaatttcagctactgcaagctcagtaccacagcctcaagctcgaatgtgacaagttggccagtgagaagtcagagatgcagcgtcactatgtgatgtactacgagattcctncngcttgaacatcgagatgcacaaacaggctgagatcgtcaaaaggctgaacgcggcggcggccccgggagctgccgatcggcgccgggacaaaggcgcggccgcccggcgcccccagcagcccgagccggggcgcacagccggggcgcagcccgcgccccccgccgcgattgacatgatgtttccacaaagcaggcattcgggctcctcgcacctaccccagcaactcaaattcaccacctcggactcctgcgaccgcatcaaagacgaatttcagctactgcaagctcagtaccacagcctcaagctcgaatgtgacaagttggccagtgagaagtcagagatgcagcgtcactatgtgatgtactacgagatgtcctacggcttgaacatcgagatgcacaaacaggctgagatcgtcaaaaggctgaacgggatttgtgcccaggtcctgccctacctctcccaagaggtaagagccagggccttggggaggggttgtgagggggccccgcacttgcccagcccctgtccactgcagccatcttgggtggtgtgctgggcgccccagggcacacgcctcccctctctggacctccctggctctgaacaccagagccggcctgtgcagaagaatccccgggccagagacactccaggggtgcaggcgtgtggggggcgggcctcaccctgctctggaattcccagctggagtgagtcatgtcataggtagaaatgtcagatgggcctaaactgcaccaggaatgtttttttctcatctctcttcctcctttcaccctcttgagacatcctcctccaggccatgcgggctgcacaggaccaaggactagagggtgttaggggattgtgggggaaggggtagcacagggtggtcacacatggacacagccacacagataggcacgagcacatcaacacacgggagatacacagatgcagacacggatacacgtgtgtgcagacagcacagggacacgcatgcaggaatgtgcagctacacgtgggcacacgtgatcctga

SEQ ID NO: 313986 - DNA, 919 bp, Homo sapiens
  misc_feature (140)..(140): n is a, c, g, or t
  misc_feature (201)..(201): n is a, c, g, or t
  misc_feature (411)..(411): n is a, c, g, or t
  misc_feature (413)..(413): n is a, c, g, or t
aggatcacgatgtccgtgctccagcgcggggcgggggggggacaagtgagccaggcaagaagaatggattggccctagagtacgggttctccaaatgtaacctcggccctacagatctctgagactatgtcagggggttngtgagattttataacaaaattaagatgttagtacaatatcgtgtttcgccgccgggcgcgnttgacatgatgtttccacaaagcaggcattcgggctcctcgcacctaccccagcaactcaaattcaccacctcggactcctgcgaccgcatcaaagacgaatttcagctactgcaagctcagtaccacagcctcaagctcgaatgtgacaagttggccagtgagaagtcagagatgcagcgtcactatgtgatgtactacgagattcctncngcttgaacatcgagatgcacaaacaggctgagatcgtcaaaaggctgaacgcggcggcggccccgggagctgccgatcggcgccgggacaaaggcgcggccgcccggcgcccccagcagcccgagccggggcgcacagccggggcgcagcccgcgccccccgccgcgattgacatgatgtttccacaaagcaggcattcgggctcctcgcacctaccccagcaactcaaattcaccacctcggactcctgcgaccgcatcaaagacgaatttcagctactgcaagctcagtaccacaggtgagctgggggactgggggtccctgcgtcccgagaatgtgagtccccccatttcttctgcgcagatggcaaggctgaggcctggagattgggaaaataatatatgctagactctgacctaatcacttgacaaatactgaattcatttattttaaacagccccattttgtagaggagaaaaccgaggcacaaaaatagttaaataatt

SEQ ID NO: 313987 - DNA, 4140 bp, Homo sapiens
atgttacgacgctaccgccctgacatcaccagttgccatggtagcaccgccgagagtaaaggaggggtggtgctagacgtttcgggcagagctcggccgctgcggaggacaaggaactctccctctcccactagtctgacttcttccaaaatgagcggcctggatgggggcaacaagctccctctcgcccaaaccggcggcctggctgctcccgaccatgcctcaggagatccggacctagaccagtgccaagggctccgtgaagaaaccgaggcgacacaggtgatggcgaacacaggtgggggcagcctggagaccgttgcggaggggggtgcatcccaggatcctgtcgactgtggccccgcgctccgcgtcccagttgccgggagtcgcggcggtgcagcgaccaaagccgggcaggaggatgctccaccttctacgaaaggtctggaagcagcctctgccgccgaggctgctgacagcagccagaaaaatggctgtcagcttggagagccccgtggccctgctgggcagaaggctctagaagcctgtggcgcagggggcttggggtctcagatgataccggggaagaaggccaaggaagtgacgactaaaaaacgcgccatctcggcagcagtggaaaaggagggagaagcaggggcggcgatggaggaaaagaaggtagtgcagaaggaaaaaaaggtggcaggaggggtgaaagaggagacacggcccagggccccgaagatcaataactgcatggactcactggaggccatcgatcaagagttgtcaaacgtaaatgcccaggctgacagggccttccttcagcttgagcgcaagtttggccgcatgcgaaggctccacatgcagcgcagaagtttcattatccagaatatcccaggtttctgggttactgcctttcgaaaccacccccagctgtcacctatgatcagtggccaagatgaagacatgctgaggtacatgatcaatttggaggtggaggagcttaaacaccccagagcaggctgcaaattcaagttcatctttcagggcaacccctacttccgaaatgaggggcttgtcaaggaatatgaacgcagatcctctggccgggtggtgtctctttccactccaatccgctggcaccgaggccaagacccccaggctcatatccacagaaaccgggaagggaacactatccctagtttcttcaactggttttcagaccacagccttctagaattcgacagaattgcagagattatcaaaggagaactgtggcccaatcccctacaatactacctgatgggtgaagggccccgtagaggaattcgaggcccaccaaggcagccagtggagagcgccagatccttcaggttccagtctggctaatctctgtcctgtgagaagcttctgcacaagtttccttaccacctcctcttggacctatgcttggccaacagcatgcagtcttccatctgctttctcttcatactgtggattatcttttcctttggttctaaatcttcagtaatcggttgcaagattgttggcttacctgcctgtgccattcttcctctgggccttcatgcttttctgcattgtgttaacatgtttcaagtgcatggccttctacggcttctatgccaagcgtatgatactatagatatagtgtaccatactgcctttctttgcatggcttggaccctatctgtgaccatgctcttctcccaatttaagtggttctgtaccacaaagaatcttgatacattttcacaaataactgattgggcttcatactttatgctggctgtgtcctgatacccatgtacttatggtaagctatttgggtattaccactgcaagacaaaactgatatcttaacccggccatcaacccaaattggacattccagactaccaccaactggatcccagctgccttcctgggcttgtgccatccaccctactggttatctgatagaacaagctggtggctgatgggtgactgctaggcgtgactgaggtaatagatgaaaagtgttctatgttatcacattggttttcctgtacctttggttactctacgtcatgaccagctgctggtgagtatgaagcctgtgctatagcccacccctactcactctcaccttctggttgaactttgcttaggccaccattgtctgcctcatcaggaactatctgtagacgtagctcccagggagctcacagcaacaccccctaccaccaggatgggcagtaatatgtgacagagcccaaagcaaggctggaacgcagtcccttccagcttagtctttctgactcctagccaacaaaccatccttaatgtgagcaacttctttaggcatttcctcttttccccgcctgcacccactctgaacatgacaaaagttgccagagttggggcattgaggaagagatatttctggaatgtgagacttgttatgcctctgtctctttctctccctcctcctcccctctccctccccctctccctcccatcccttttcttccctttcactctgaagcagttttagcttattaacagaaaacaaaactggcaaagcaggctttttgtttaatttgctctttccctgattgtgttcagagagaaaggttatgattaaatgggctccagatctcttattgcccttattcctccaccccacttcttttagcaaggtctgaaagtttcaaagggagacctataggttaattgtttagttataggcagtgttaaattaggcagattttgacatatttatctttttaccccatccattctaccaaaacctgtgtatttcttgagtttttagtttgagaagctggaaagagagagaagggcctcacagtgatgggttcaggacgggtcaaaggcaaaggcctttgtgatgtgagcaaaggcaaccgactgcttctagggtagcattttgtaggtcactcttctcctttgtactattttgtttctgccctgatgtcccttgggtctccatcctactgcctggctttcttggccctcatttctcagcttctgcatttccttccctgctcctaacaaatgaagaagcaggctgcagcctgcattgtggaagatctccagcctccttgtaggggataaggggatgtgcagcatctgtgtggattttcacggacaagttccagtaggtgggacagtgatgccgtcaaggcttagttatgatcatgtgtggtgataaagaccatccaccatcacccttttcccctttggttttgaaggccttgccctaagctacctgagggtttaggaggtctgaacacacacagtggagaggttaatctaggttgggaaactgagtaaaagtccagagcaggaatgagcctgctgtggcgtgggtttggaaaggctcacaggaaagaacctgcaggatcaggggtgggaggggaggcccctgaggtgctctccagggaagaggggctggggtttaaatagcatgcttggaggaagattttccttcaatttttcctaagtccttgaattcaccagtagatttttgtaaacaaaatgtaagtcgatgttttctctcaattatcctaggagtgacctttatatgtgtggaagattaatggtatatgctccttatgtcactgtttttgagtaaaatccatttcctttctctgtttcagcctatgacaaaattgatgtttacaggcctgctttttgcttataattgacaacatgtgcaaaaataccaaatttgtgtcctgtgcagtatgaagaattcagtgaatattcattaatgtattagcttgttttgctctctgttcatatatggctctattcttagaaatataatttgaatgtgatctttcaatagtctgaatattttacaaattatagctatgtcttgtgaaaataacctcaaaaagaaaaatacgactctgttgtcttacttgatatttcttgccctagtaatgtacttgacatttatgttcctaagcagtgtaagtaccagtagaatttctctgtcaaactcaatgatcatttagtacttttgtcttctcccatgtgcttgaaggaaaaataaagtgtcactaccgtatttcttgttttcatcaaaaaataaaaataatttaaaaa

SEQ ID NO: 313988 - DNA, 4141 bp, Homo sapiens
atgttacgacgctaccgccctgacatcaccagttgccatggtagcaccgccgagagtaaaggaggggtggtgctagacgtttcgggcagagctcggccgctgcggaggacaaggaactctccctctcccactagtctgacttcttccaaaatgagcggcctggatgggggcaacaagctccctctcgcccaaaccggcggcctggctgctcccgaccatgcctcaggagatccggacctagaccagtgccaagggctccgtgaagaaaccgaggcgacacaggtgatggcgaacacaggtgggggcagcctggagaccgttgcggaggggggtgcatcccaggatcctgtcgactgtggccccgcgctccgcgtcccagttgccgggagtcgcggcggtgcagcgaccaaagccgggcaggaggatgctccaccttctacgaaaggtctggaagcagcctctgccgccgaggctgctgacagcagccagaaaaatggctgtcagcttggagagccccgtggccctgctgggcagaaggctctagaagcctgtggcgcagggggcttggggtctcagatgataccggggaagaaggccaaggaagtgacgactaaaaaacgcgccatctcggcagcagtggaaaaggagggagaagcaggggcggcgatggaggaaaagaaggtagtgcagaaggaaaaaaaggtggcaggaggggtgaaagaggagacacggcccagggccccgaagatcaataactgcatggactcactggaggccatcgatcaagagttgtcaaacgtaaatgcccaggctgacagggccttccttcagcttgagcgcaagtttggccgcatgcgaaggctccacatgcagcgcagaagtttcattatccagaatatcccaggtttctgggttactgcctttcgaaaccacccccagctgtcacctatgatcagtggccaagatgaagacatgctgaggtacatgatcaatttggaggtggaggagcttaaacaccccagagcaggctgcaaattcaagttcatctttcagggcaacccctacttccgaaatgaggggcttgtcaaggaatatgaacgcagatcctctggccgggtggtgtctctttccactccaatccgctggcaccgaggccaagacccccaggctcatatccacagaaaccgggaagggaacactatccctagtttcttcaactggttttcagaccacagccttctagaattcgacagaattgcagagattatcaaaggagaactgtggcccaatcccctacaatactacctgatgggtgaagggccccgtagaggaattcgaggcccaccaaggcagccagtggagagcgccagatccttcaggttccagtctggctaatctctgtcctgtgagaagcttctgcacaagtttccttaccacctcctcttggacctatgcttggccaacagcatgcagtcttccatctgctttctcttcatactgtggattatcttttcctttggttctaaatcttcagtaatcggttgcaagattgttggcttacctgcctgtgccattcttcctctgggccttcatgcttttctgcattgtgttaacatgtttcaagtgcatggccttctacggcttctatgccaagcgtatgatactatagatatagtgtaccatactgcctttctttgcatggcttggaccctatctgtgaccatgctcttctcccaatttaagtggttctgtaccacaaagaatcttgatacattttcacaaataactgattgggcttcatactttatgctggctgtgtcctgatacccatgtacttatggtaagctatttgggtattaccactgcaagacaaaactgatatcttaacccggccatcaacccaaattggacattccagactaccaccaactggatcccagctgccttcctgggcttgtgccatccaccctactggttatctgatagaacaagctggtggctgatgggtgactgctaggcgtgactgaggtaatagatgtcatgaccagctgctggtgagtatgaagcctgtgctatagcccacccctactcactctcaccttctggttgaactttgcttaggccaccattgtctgcctcatcaggaactatctgtagacgtagctcccagggagctcacagcaacaccccctaccaccaggatgggcagtaatatgtgacagagcccaaagcaaggctggaacgcagtcccttccagcttagtctttctgactcctagccaacaaaccatccttaatgtgagcaacttctttaggcatttcctcttttccccgcctgcacccactctgaacatgacaaaagttgccagagttggggcattgaggaagagatatttctggaatgtgagacttgttatgcctctgtctctttctctccctcctcctcccctctccctccccctctccctcccatcccttttcttccctttcactctgaagcagttttagcttattaacagaaaacaaaactggcaaagcaggctttttgtttaatttgctctttccctgattgtgttcagagagaaaggttatgattaaatgggctccagatctcttattgcccttattcctccaccccacttcttttagcaaggtctgaaagtttcaaagggagacctataggttaattgtttagttataggcagtgttaaattaggcagattttgacatatttatctttttaccccatccattctaccaaaacctgtgtatttcttgagtttttagtttgagaagctggaaagagagagaagggcctcacagtgatgggttcaggacgggtcaaaggcaaaggcctttgtgatgtgagcaaaggcaaccaaaacttagcctcactccacttttctaaagatggaaattcttttttgggccttggactgcttctagggtagcattttgtaggtcactcttctcctttgtactattttgtttctgccctgatgtcccttgggtctccatcctactgcctggctttcttggccctcatttctcagcttctgcatttccttccctgctcctaacaaatgaagaagcaggctgcagcctgcattgtggaagatctccagcctccttgtaggggataaggggatgtgcagcatctgtgtggattttcacggacaagttccagtaggtgggacagtgatgccgtcaaggcttagttatgatcatgtgtggtgataaagaccatccaccatcacccttttcccctttggttttgaaggccttgccctaagctacctgagggtttaggaggtctgaacacacacagtggagaggttaatctaggttgggaaactgagtaaaagtccagagcaggaatgagcctgctgtggcgtgggtttggaaaggctcacaggaaagaacctgcaggatcaggggtgggaggggaggcccctgaggtgctctccagggaagaggggctggggtttaaatagcatgcttggaggaagattttccttcaatttttcctaagtccttgaattcaccagtagatttttgtaaacaaaatgtaagtcgatgttttctctcaattatcctaggagtgacctttatatgtgtggaagattaatggtatatgctccttatgtcactgtttttgagtaaaatccatttcctttctctgtttcagcctatgacaaaattgatgtttacaggcctgctttttgcttataattgacaacatgtgcaaaaataccaaatttgtgtcctgtgcagtatgaagaattcagtgaatattcattaatgtattagcttgttttgctctctgttcatatatggctctattcttagaaatataatttgaatgtgatctttcaatagtctgaatattttacaaattatagctatgtcttgtgaaaataacctcaaaaagaaaaatacgactctgttgtcttacttgatatttcttgccctagtaatgtacttgacatttatgttcctaagcagtgtaagtaccagtagaatttctctgtcaaactcaatgatcatttagtacttttgtcttctcccatgtgcttgaaggaaaaataaagtgtcactaccgtatttcttgttttcatcaaaaaataaaaataatttaaaaa

SEQ ID NO: 313989 - DNA, 4194 bp, Homo sapiens
atgttacgacgctaccgccctgacatcaccagttgccatggtagcaccgccgagagtaaaggaggggtggtgctagacgtttcgggcagagctcggccgctgcggaggacaaggaactctccctctcccactagtctgacttcttccaaaatgagcggcctggatgggggcaacaagctccctctcgcccaaaccggcggcctggctgctcccgaccatgcctcaggagatccggacctagaccagtgccaagggctccgtgaagaaaccgaggcgacacaggtgatggcgaacacaggtgggggcagcctggagaccgttgcggaggggggtgcatcccaggatcctgtcgactgtggccccgcgctccgcgtcccagttgccgggagtcgcggcggtgcagcgaccaaagccgggcaggaggatgctccaccttctacgaaaggtctggaagcagcctctgccgccgaggctgctgacagcagccagaaaaatggctgtcagcttggagagccccgtggccctgctgggcagaaggctctagaagcctgtggcgcagggggcttggggtctcagatgataccggggaagaaggccaaggaagtgacgactaaaaaacgcgccatctcggcagcagtggaaaaggagggagaagcaggggcggcgatggaggaaaagaaggtagtgcagaaggaaaaaaaggtggcaggaggggtgaaagaggagacacggcccagggccccgaagatcaataactgcatggactcactggaggccatcgatcaagagttgtcaaacgtaaatgcccaggctgacagggccttccttcagcttgagcgcaagtttggccgcatgcgaaggctccacatgcagcgcagaagtttcattatccagaatatcccaggtttctgggttactgcctttcgaaaccacccccagctgtcacctatgatcagtggccaagatgaagacatgctgaggtacatgatcaatttggaggtggaggagcttaaacaccccagagcaggctgcaaattcaagttcatctttcagggcaacccctacttccgaaatgaggggcttgtcaaggaatatgaacgcagatcctctggccgggtggtgtctctttccactccaatccgctggcaccgaggccaagacccccaggctcatatccacagaaaccgggaagggaacactatccctagtttcttcaactggttttcagaccacagccttctagaattcgacagaattgcagagattatcaaaggagaactgtggcccaatcccctacaatactacctgatgggtgaagggccccgtagaggaattcgaggcccaccaaggcagccagtggagagcgccagatccttcaggttccagtctggctaatctctgtcctgtgagaagcttctgcacaagtttccttaccacctcctcttggacctatgcttggccaacagcatgcagtcttccatctgctttctcttcatactgtggattatcttttcctttggttctaaatcttcagtaatcggttgcaagattgttggcttacctgcctgtgccattcttcctctgggccttcatgcttttctgcattgtgttaacatgtttcaagtgcatggccttctacggcttctatgccaagcgtatgatactatagatatagtgtaccatactgcctttctttgcatggcttggaccctatctgtgaccatgctcttctcccaatttaagtggttctgtaccacaaagaatcttgatacattttcacaaataactgattgggcttcatactttatgctggctgtgtcctgatacccatgtacttatggtaagctatttgggtattaccactgcaagacaaaactgatatcttaacccggccatcaacccaaattggacattccagactaccaccaactggatcccagctgccttcctgggcttgtgccatccaccctactggttatctgatagaacaagctggtggctgatgggtgactgctaggcgtgactgaggtaatagatgaaaagtgttctatgttatcacattggttttcctgtacctttggttactctacgtcatgaccagctgctggtgagtatgaagcctgtgctatagcccacccctactcactctcaccttctggttgaactttgcttaggccaccattgtctgcctcatcaggaactatctgtagacgtagctcccagggagctcacagcaacaccccctaccaccaggatgggcagtaatatgtgacagagcccaaagcaaggctggaacgcagtcccttccagcttagtctttctgactcctagccaacaaaccatccttaatgtgagcaacttctttaggcatttcctcttttccccgcctgcacccactctgaacatgacaaaagttgccagagttggggcattgaggaagagatatttctggaatgtgagacttgttatgcctctgtctctttctctccctcctcctcccctctccctccccctctccctcccatcccttttcttccctttcactctgaagcagttttagcttattaacagaaaacaaaactggcaaagcaggctttttgtttaatttgctctttccctgattgtgttcagagagaaaggttatgattaaatgggctccagatctcttattgcccttattcctccaccccacttcttttagcaaggtctgaaagtttcaaagggagacctataggttaattgtttagttataggcagtgttaaattaggcagattttgacatatttatctttttaccccatccattctaccaaaacctgtgtatttcttgagtttttagtttgagaagctggaaagagagagaagggcctcacagtgatgggttcaggacgggtcaaaggcaaaggcctttgtgatgtgagcaaaggcaaccaaaacttagcctcactccacttttctaaagatggaaattcttttttgggccttggactgcttctagggtagcattttgtaggtcactcttctcctttgtactattttgtttctgccctgatgtcccttgggtctccatcctactgcctggctttcttggccctcatttctcagcttctgcatttccttccctgctcctaacaaatgaagaagcaggctgcagcctgcattgtggaagatctccagcctccttgtaggggataaggggatgtgcagcatctgtgtggattttcacggacaagttccagtaggtgggacagtgatgccgtcaaggcttagttatgatcatgtgtggtgataaagaccatccaccatcacccttttcccctttggttttgaaggccttgccctaagctacctgagggtttaggaggtctgaacacacacagtggagaggttaatctaggttgggaaactgagtaaaagtccagagcaggaatgagcctgctgtggcgtgggtttggaaaggctcacaggaaagaacctgcaggatcaggggtgggaggggaggcccctgaggtgctctccagggaagaggggctggggtttaaatagcatgcttggaggaagattttccttcaatttttcctaagtccttgaattcaccagtagatttttgtaaacaaaatgtaagtcgatgttttctctcaattatcctaggagtgacctttatatgtgtggaagattaatggtatatgctccttatgtcactgtttttgagtaaaatccatttcctttctctgtttcagcctatgacaaaattgatgtttacaggcctgctttttgcttataattgacaacatgtgcaaaaataccaaatttgtgtcctgtgcagtatgaagaattcagtgaatattcattaatgtattagcttgttttgctctctgttcatatatggctctattcttagaaatataatttgaatgtgatctttcaatagtctgaatattttacaaattatagctatgtcttgtgaaaataacctcaaaaagaaaaatacgactctgttgtcttacttgatatttcttgccctagtaatgtacttgacatttatgttcctaagcagtgtaagtaccagtagaatttctctgtcaaactcaatgatcatttagtacttttgtcttctcccatgtgcttgaaggaaaaataaagtgtcactaccgtatttcttgttttcatcaaaaaataaaaataatttaaaaa

SEQ ID NO: 313990 - DNA, 2577 bp, Homo sapiens
atgttacgacgctaccgccctgacatcaccagttgccatggtagcaccgccgagagtaaaggaggggtggtgctagacgtttcgggcagagctcggccgctgcggaggacaaggaactctccctctcccactagtctgacttcttccaaaatgagcggcctggatgggggcaacaagctccctctcgcccaaaccggcggcctggctgctcccgaccatgcctcaggagatccggacctagaccagtgccaagggctccgtgaagaaaccgaggcgacacaggtgatggcgaacacaggtgggggcagcctggagaccgttgcggaggggggtgcatcccaggatcctgtcgactgtggccccgcgctccgcgtcccagttgccgggagtcgcggcggtgcagcgaccaaagccgggcaggaggatgctccaccttctacgaaaggtctggaagcagcctctgccgccgaggctgctgacagcagccagaaaaatggctgtcagcttggagagccccgtggccctgctgggcagaaggctctagaagcctgtggcgcagggggcttggggtctcagatgataccggggaagaaggccaaggaagtgacgactaaaaaacgcgccatctcggcagcagtggaaaaggagggagaagcaggggcggcgatggaggaaaagaaggtagtgcagaaggaaaaaaaggtggcaggaggggtgaaagaggagacacggcccagggccccgaagatcaataactgcatggactcactggaggccatcgatcaagagttgtcaaacgtaaatgcccaggctgacagggccttccttcagcttgagcgcaagtttggccgcatgcgaaggctccacatgcagcgcagaagtttcattatccagaatatcccaggtttctgggttactgcctttcactctgaagcagttttagcttattaacagaaaacaaaactggcaaagcaggctttttgtttaatttgctctttccctgattgtgttcagagagaaaggttatgattaaatgggctccagatctcttattgcccttattcctccaccccacttcttttagcaaggtctgaaagtttcaaagggagacctataggttaattgtttagttataggcagtgttaaattaggcagattttgacatatttatctttttaccccatccattctaccaaaacctgtgtatttcttgagtttttagtttgagaagctggaaagagagagaagggcctcacagtgatgggttcaggacgggtcaaaggcaaaggcctttgtgatgtgagcaaaggcaaccaaaacttagcctcactccacttttctaaagatggaaattcttttttgggccttggactgcttctagggtagcattttgtaggtcactcttctcctttgtactattttgtttctgccctgatgtcccttgggtctccatcctactgcctggctttcttggccctcatttctcagcttctgcatttccttccctgctcctaacaaatgaagaagcaggctgcagcctgcattgtggaagatctccagcctccttgtaggggataaggggatgtgcagcatctgtgtggattttcacggacaagttccagtaggtgggacagtgatgccgtcaaggcttagttatgatcatgtgtggtgataaagaccatccaccatcacccttttcccctttggttttgaaggccttgccctaagctacctgagggtttaggaggtctgaacacacacagtggagaggttaatctaggttgggaaactgagtaaaagtccagagcaggaatgagcctgctgtggcgtgggtttggaaaggctcacaggaaagaacctgcaggatcaggggtgggaggggaggcccctgaggtgctctccagggaagaggggctggggtttaaatagcatgcttggaggaagattttccttcaatttttcctaagtccttgaattcaccagtagatttttgtaaacaaaatgtaagtcgatgttttctctcaattatcctaggagtgacctttatatgtgtggaagattaatggtatatgctccttatgtcactgtttttgagtaaaatccatttcctttctctgtttcagcctatgacaaaattgatgtttacaggcctgctttttgcttataattgacaacatgtgcaaaaataccaaatttgtgtcctgtgcagtatgaagaattcagtgaatattcattaatgtattagcttgttttgctctctgttcatatatggctctattcttagaaatataatttgaatgtgatctttcaatagtctgaatattttacaaattatagctatgtcttgtgaaaataacctcaaaaagaaaaatacgactctgttgtcttacttgatatttcttgccctagtaatgtacttgacatttatgttcctaagcagtgtaagtaccagtagaatttctctgtcaaactcaatgatcatttagtacttttgtcttctcccatgtgcttgaaggaaaaataaagtgtcactaccgtatttcttgttttcatcaaaaaataaaaataatttaaaaa

SEQ ID NO: 313991 - DNA, 4880 bp, Homo sapiens
cgccaccgccgccgccgccgccacagccgccagccgcttcgcgttcggcgggggaggagttggaggcggagaagaaggcggtggtggcgggtggaggttcgagcgctgttctcgctccggagccgctgcacatttcggaatcttctgcggcttgtccatagtgtgaataaaaactaaatcacatctataattctactgaactggtcatacagacgctgccatatatgtcacagtacactgaaaaggagccagcagcaatggaccaagaatctggtaaggctgtctggcccaaaccagcaggagggtatcagacaattacaggcaggagatatggaagaagacatgcttatgtcagttttaaaccatgtatgaccagacatgaaagaagcttaggtcgggctggtgatgactatgaagtgttggaactagatgatgttccaaaggaaaattcctcaggttccagtcctttggatcaagttgattcttctttacccagtgaacctatatttgaaaaaagtgaaacagaaattcccacttgtggttcagcattgaatcaaaccactgagagcagtcaatcctttgttgcagtacatcacagtgaggaaggcagggataccttaggaagcagtacaaatcttcataatcactctgagggagagtatattccaggagcttgtagtgcttcaagtgtccaaaatggaattgcattggttcatacagactcttatgatccagatggcaaacatggagaagataatgaccatcttcaactttctgcagaagtcgtggaaggtagtagataccaggaatcattaggcaatacagtatttgagttggaaaacagagaggcagaggcatacactggtctttcaccaccagttccctcatttaactgtgaagtaagagatgagtttgaagagttagattctgtaccattagtgaaaagttctgctggtgatactgagtttgtccatcagaatagccaggaaattcagaggtcttctcaagatgaaatggttagtacgaaacaacaaaataatactagccaggaaagacagacagaacattcacctgaagatgcagcctgtggtccagggcatatttgtagtgaacgaaataccaatgatagggaaaagaaccatggaagttctcctgaacaggtagtgaggccaaaagttagaaaactgataagttcaagccaggtggaccaagaaacaggttttaataggcatgaggcgaaacaaagaagtgttcaaagatggagagaggctttggaagttgaggaaagtggctcagatgacctcttaataaaatgtgaagaatatgatggagagcatgactgtatgttcttggatccaccatactcaagagttattacacaaagggaaacagaaaataaccaaatgacatcagaaagtggagccacagcgggaaggcaagaagtggataacaccttttggaatggctgtggagattattaccaactctatgacaaagatgaagatagttctgaatgcagtgatggggaatggtctgcttctttgcctcatcgattttctggtacagaaaaagatcaatcctcaagtgatgaaagctgggagactctgccaggaaaagatgagaatgaacctgagctacaaagtgatagcagtggccctgaagaagaaaaccaagaattatctcttcaggaaggggaacagacatccttggaagagggagaaattccttggttacagtacaatgaagtcaatgaaagcagcagtgatgagggaaatgaacctgccaatgaatttgcacagccagctttcatgttggatggtaacaataacctggaggatgactccagtgtgagtgaagacttagatgtggattggagcctatttgatggctttgcagatggactaggagttgctgaagctatttcatatgtggatcctcagttccttacctacatggcactagaagaacgcttagcccaggctatggagactgctctggcccatttagagtctcttgcagtggatgttgaggtggccaatccaccagctagtaaggaaagcattgatggtcttccagagacccttgttcttgaagatcacactgctattggtcaggaacaatgctgtccaatctgttgcagtgagtatattaaggatgatatagcaacagagttgccctgtcaccatttctttcacaaaccttgtgtctcaatttggctacaaaagtcgggaacatgccctgtgtgccgccgtcatttcccacctgcggttattgaagcatctgcagctccttcctctgagcctgatcctgatgccccaccttcaaatgacagtattgcagaagcaccctaaaccttgacagttgaaatgagatcagtgtatcaaagtaaatctgcaaattccttctaaatttcatgtgcaaataattatatataaatatatttaaaaatgctatatatagtatatgccatagtttagaaagaatattaacctttctaaactaaatttaggtttgcagaaagtattaaacatttttaagctgaatgttgagacagtgcatccattttctttagttgaatatgtttgtattaattgtaaagccaagcttatcagttgactctctccagaataaataatcatctgtgtggcatacgttattggctttgtctgtaatactgccactaagtgattataattaagctgtcctgtttgcatcaaatgtaaagactgtgttcacaaccgtagtaaaatttggtttcattggaaatgaaacaaattctaaagtatgctttttcactagtccctttgattttgctatatcataacctcttggttcatatgctgagaaatttttcagaaagtccatttttgtttaaaattagaacttttcagaatgccaaatgaaggctaaaattttggccagaacattacaaaagttttaaatcgtagacgtaactccccctgaaataaagttaggtagtaaaatccttaatgaaaccagtggatgtgcttaacgtaaggttagtaaagcatacaaagaatctagtgtgctcagggcttggtacaatgagctgaattagatggccttatgaaactctttctaacctcttacccaacctgtttctccttggttaaaattatacttgaaggcccagaacactcatggcacatttgtttaatattgcttatagttagtttaaggtaattttgcttctacagtattttggaaggtctgaaaacttgcacagggtcatctttgtaattatataaccccaaactaagatgcacaatgtctccttcaggtgatcacacacagtggacgagtatgtgcaaacatggacataatagttcacttacaaatgtgatttgatgttaacactagagaatgatgactgtagaacatttgagcaagtaaaatagtaaagcacatagtgagtgtatgtccgtctaactggtacattgataatttagtttgggcacataaaaggaatatttatatggcttcccaaatgcagagttacatcttattcgtgtatttctctgagtatttatatcccgtctccttttttcattcttaaaaataaatgaattttcactgttggcacatatgaggcttaaatataaggaacataacacttgcattctaatttttgcatatattgtaaatgtgtctggtatttacagcaaaatactgtgtatccttttatgggtaaaacaaaagtgaacattgcatgcatgtaatgtgatgaatttgtaatttaggagttctttggggcttctgtgacttgggaaatgcttacattcaggccttaatgttgcattagctagcatgttttccctctgatgtatatagtcactgttgtataaactaatctttgcttgttttctactctgtgatctttccatatcatatttcattaatgatcagttagtgtcaaggagtcaaaacagattaaaattaatttcatgtgtatatggtggaaatttgtggctagtgtgattttgtttgtttccttttaaggtactgttgatcagttgtgacacttactggttaaacttacgttgctaaagatttctctataataagccacacattatatttagactatattaagggaccttggttttcttctagatagcagctgtcccaaagaaaatatttcttctttgtctgttaagatttagctattatctgccagttgttaagaggttttggttccaaactcaaccagcaatgttgagagctgaacttaagatagctgttgtactttttgctttccatctgttactgtccttcattcttggctccctactatctataaacagctgctgtgaagaagaaaagttgaataagagttggcttaaattttaaaaaagaaaaagaaaattgaggttttaggattttcatggtaacaagctctggtataagctaaggctggcaagttcagatactaaaatattatttgatcatatcttggatccttttgaaaaagttaagactatatgaaggtaaattagaaataagtatgaatattaataaaatagcatttatcttatttctctattttatgttgtgacttaacctaattttatttttttaacattttcttatttcttataatatgaatgctgatatttaaaggtagatctatgtggtattctttgtgtttcttaattgtttaactcttaagattatttgtgatctggatttatgtatttgttagatacatacgaattgttaaaatggaatgcaagtttttcaaaagcccaggtctaaatgtaatggttggtttattgttctataaccccagcccatcattttctgtgtaaatcataaacaataaacagaatatactcggtggtcatttctaatatttaatt

SEQ ID NO: 313992 - DNA, 5063 bp, Homo sapiens
ctcacacccaccttctgcggtttcccgtcaccccgcgtagagcggaaccatcttacgccacaggcctgcagcacccctcccccgaggagccttctgttgccgtcgttttgctgggcgtctgcattttccccgattgtcagtgaggctcggcacgcagacaccccgctcgagccgcagcagtcgctctactcccgggatcagcacctttccgccagggctgctctcagttagcgatgtcaggccagagctcctcttgcagatgcacctttaatttggcctccctcagatgactggtaatcattttgcgcacattcaaaatggaatcttctgcggcttgtccatagtgtgaataaaaactaaatcacatctataattctactgaactggtcatacagacgctgccatatatgtcacagtacactgaaaaggagccagcagcaatggaccaagaatctggtaaggctgtctggcccaaaccagcaggagggtatcagacaattacaggcaggagatatggaagaagacatgcttatgtcagttttaaaccatgtatgaccagacatgaaagaagcttaggtcgggctggtgatgactatgaagtgttggaactagatgatgttccaaaggaaaattcctcaggttccagtcctttggatcaagttgattcttctttacccagtgaacctatatttgaaaaaagtgaaacagaaattcccacttgtggttcagcattgaatcaaaccactgagagcagtcaatcctttgttgcagtacatcacagtgaggaaggcagggataccttaggaagcagtacaaatcttcataatcactctgagggagagtatattccaggagcttgtagtgcttcaagtgtccaaaatggaattgcattggttcatacagactcttatgatccagatggcaaacatggagaagataatgaccatcttcaactttctgcagaagtcgtggaaggtagtagataccaggaatcattaggcaatacagtatttgagttggaaaacagagaggcagaggcatacactggtctttcaccaccagttccctcatttaactgtgaagtaagagatgagtttgaagagttagattctgtaccattagtgaaaagttctgctggtgatactgagtttgtccatcagaatagccaggaaattcagaggtcttctcaagatgaaatggttagtacgaaacaacaaaataatactagccaggaaagacagacagaacattcacctgaagatgcagcctgtggtccagggcatatttgtagtgaacgaaataccaatgatagggaaaagaaccatggaagttctcctgaacaggtagtgaggccaaaagttagaaaactgataagttcaagccaggtggaccaagaaacaggttttaataggcatgaggcgaaacaaagaagtgttcaaagatggagagaggctttggaagttgaggaaagtggctcagatgacctcttaataaaatgtgaagaatatgatggagagcatgactgtatgttcttggatccaccatactcaagagttattacacaaagggaaacagaaaataaccaaatgacatcagaaagtggagccacagcgggaaggcaagaagtggataacaccttttggaatggctgtggagattattaccaactctatgacaaagatgaagatagttctgaatgcagtgatggggaatggtctgcttctttgcctcatcgattttctggtacagaaaaagatcaatcctcaagtgatgaaagctgggagactctgccaggaaaagatgagaatgaacctgagctacaaagtgatagcagtggccctgaagaagaaaaccaagaattatctcttcaggaaggggaacagacatccttggaagagggagaaattccttggttacagtacaatgaagtcaatgaaagcagcagtgatgagggaaatgaacctgccaatgaatttgcacagccagctttcatgttggatggtaacaataacctggaggatgactccagtgtgagtgaagacttagatgtggattggagcctatttgatggctttgcagatggactaggagttgctgaagctatttcatatgtggatcctcagttccttacctacatggcactagaagaacgcttagcccaggctatggagactgctctggcccatttagagtctcttgcagtggatgttgaggtggccaatccaccagctagtaaggaaagcattgatggtcttccagagacccttgttcttgaagatcacactgctattggtcaggaacaatgctgtccaatctgttgcagtgagtatattaaggatgatatagcaacagagttgccctgtcaccatttctttcacaaaccttgtgtctcaatttggctacaaaagtcgggaacatgccctgtgtgccgccgtcatttcccacctgcggttattgaagcatctgcagctccttcctctgagcctgatcctgatgccccaccttcaaatgacagtattgcagaagcaccctaaaccttgacagttgaaatgagatcagtgtatcaaagtaaatctgcaaattccttctaaatttcatgtgcaaataattatatataaatatatttaaaaatgctatatatagtatatgccatagtttagaaagaatattaacctttctaaactaaatttaggtttgcagaaagtattaaacatttttaagctgaatgttgagacagtgcatccattttctttagttgaatatgtttgtattaattgtaaagccaagcttatcagttgactctctccagaataaataatcatctgtgtggcatacgttattggctttgtctgtaatactgccactaagtgattataattaagctgtcctgtttgcatcaaatgtaaagactgtgttcacaaccgtagtaaaatttggtttcattggaaatgaaacaaattctaaagtatgctttttcactagtccctttgattttgctatatcataacctcttggttcatatgctgagaaatttttcagaaagtccatttttgtttaaaattagaacttttcagaatgccaaatgaaggctaaaattttggccagaacattacaaaagttttaaatcgtagacgtaactccccctgaaataaagttaggtagtaaaatccttaatgaaaccagtggatgtgcttaacgtaaggttagtaaagcatacaaagaatctagtgtgctcagggcttggtacaatgagctgaattagatggccttatgaaactctttctaacctcttacccaacctgtttctccttggttaaaattatacttgaaggcccagaacactcatggcacatttgtttaatattgcttatagttagtttaaggtaattttgcttctacagtattttggaaggtctgaaaacttgcacagggtcatctttgtaattatataaccccaaactaagatgcacaatgtctccttcaggtgatcacacacagtggacgagtatgtgcaaacatggacataatagttcacttacaaatgtgatttgatgttaacactagagaatgatgactgtagaacatttgagcaagtaaaatagtaaagcacatagtgagtgtatgtccgtctaactggtacattgataatttagtttgggcacataaaaggaatatttatatggcttcccaaatgcagagttacatcttattcgtgtatttctctgagtatttatatcccgtctccttttttcattcttaaaaataaatgaattttcactgttggcacatatgaggcttaaatataaggaacataacacttgcattctaatttttgcatatattgtaaatgtgtctggtatttacagcaaaatactgtgtatccttttatgggtaaaacaaaagtgaacattgcatgcatgtaatgtgatgaatttgtaatttaggagttctttggggcttctgtgacttgggaaatgcttacattcaggccttaatgttgcattagctagcatgttttccctctgatgtatatagtcactgttgtataaactaatctttgcttgttttctactctgtgatctttccatatcatatttcattaatgatcagttagtgtcaaggagtcaaaacagattaaaattaatttcatgtgtatatggtggaaatttgtggctagtgtgattttgtttgtttccttttaaggtactgttgatcagttgtgacacttactggttaaacttacgttgctaaagatttctctataataagccacacattatatttagactatattaagggaccttggttttcttctagatagcagctgtcccaaagaaaatatttcttctttgtctgttaagatttagctattatctgccagttgttaagaggttttggttccaaactcaaccagcaatgttgagagctgaacttaagatagctgttgtactttttgctttccatctgttactgtccttcattcttggctccctactatctataaacagctgctgtgaagaagaaaagttgaataagagttggcttaaattttaaaaaagaaaaagaaaattgaggttttaggattttcatggtaacaagctctggtataagctaaggctggcaagttcagatactaaaatattatttgatcatatcttggatccttttgaaaaagttaagactatatgaaggtaaattagaaataagtatgaatattaataaaatagcatttatcttatttctctattttatgttgtgacttaacctaattttatttttttaacattttcttatttcttataatatgaatgctgatatttaaaggtagatctatgtggtattctttgtgtttcttaattgtttaactcttaagattatttgtgatctggatttatgtatttgttagatacatacgaattgttaaaatggaatgcaagtttttcaaaagcccaggtctaaatgtaatggttggtttattgttctataaccccagcccatcattttctgtgtaaatcataaacaataaacagaatatactcggtggtcatttctaatatttaatt

SEQ ID NO: 313993 - DNA, 5035 bp, Homo sapiens
cgccaccgccgccgccgccgccacagccgccagccgcttcgcgttcggcgggggaggagttggaggcggagaagaaggcggtggtggcgggtggaggttcgagcgctgttctcgctccggagccgctgcacatttcggaatcttctgcggcttgtccatagtgtgaataaaaactaaatcacatctataattctactgaactggtcatacagacgctgccatatatgtcacagtacactgaaaaggagccagcagcaatggaccaagaatctggtaaggctgtctggcccaaaccagcaggagggtatcagacaattacaggcaggagatatggaagaagacatgcttatgtcagttttaaaccatgtatgaccagacatgaaagaagcttaggtcgggctggtgatgactatgaagtgttggaactagatgatgttccaaaggaaaattcctcaggttccagtcctttggatcaagttgattcttctttacccagtgaacctatatttgaaaaaagtgaaacagaaattcccacttgtggttcagcattgaatcaaaccactgagagcagtcaatcctttgttgcagtacatcacagtgaggaaggcagggataccttaggaagcagtacaaatcttcataatcactctgagggagagtatattccaggagcttgtagtgcttcaagtgtccaaaatggaattgcattggttcatacagactcttatgatccagatggcaaacatggagaagataatgaccatcttcaactttctgcagaagtcgtggaaggtagtagataccaggaatcattaggcaatacagtatttgagttggaaaacagagaggcagaggcatacactggtctttcaccaccagttccctcatttaactgtgaagtaagagatgagtttgaagagttagattctgtaccattagtgaaaagttctgctggtgatactgagtttgtccatcagaatagccaggaaattcagaggtcttctcaagatgaaatggttagtacgaaacaacaaaataatactagccaggaaagacagacagaacattcacctgaagatgcagcctgtggtccagggcatatttgtagtgaacgaaataccaatgatagggaaaagaaccatggaagttctcctgaacaggtagtgaggccaaaagttagaaaactgataagttcaagccaggtggaccaagaaacaggttttaataggcatgaggcgaaacaaagaagtgttcaaagatggagagaggctttggaagttgaggaaagtggctcagatgacctcttaataaaatgtgaagaatatgatggagagcatgactgtatgttcttggatccaccatactcaagagttattacacaaagggaaacagaaaataaccaaatgacatcagaaagtggagccacagcgggaaggcaagaagtggataacaccttttggaatggctgtggagattattaccaactctatgacaaagatgaagatagttctgaatgcagtgatggggaatggtctgcttctttgcctcatcgattttctggtacagaaaaagatcaatcctcaagtgatgaaagctgggagactctgccaggaaaagatgagaatgaacctgagctacaaagtgatagcagtggccctgaagaagaaaaccaagaattatctcttcaggaaggggaacagacatccttggaagagggagaaattccttggttacagtacaatgaagtcaatgaaagcagcagtgatgagggaaatgaacctgccaatgaatttgcacagccagctttcatgttggatggtaacaataacctggaggatgactccagtgtgagtgaagacttagatgtggattggagcctatttgatggctttgcagatggactaggagttgctgaagctatttcatatgtggatcctcagttccttacctacatggcactagaagaacgcttagcccaggctatggagactgctctggcccatttagagtctcttgcagtggatgttgaggtggccaatccaccagctagtaaggaaagcattgatggtcttccagagacccttgttcttgaagatcacactgctattggtcaggaacaatgctgtccaatctgttgcagtgagtatattaaggatgatatagcaacagagttgccctgtcaccatttctttcacaaaccttgtgtctcaatttggctacaaaagtcgggaacatgccctgtgtgccgccgtcatttcccacctgcggttattgaagcatctgcagctccttcctctgagcctgatcctgatgccccaccttcaaatgacagtattgcagaagcaccctaaaccttgacagttgaaatgagatcagtgtatcaaagtaaatctgcaaattccttctaaatttcatgtgcaaataattatatataaatatatttaaaaatgctatatatagtatatgccatagtttagaaagaatattaacctttctaaactaaatttaggtttgcagaaagtattaaacatttttaagctgaatgttgagacagtgcatccattttctttagttgaatatgtttgtattaattgtaaagccaagcttatcagttgactctctccagaataaataatcatctgtgtggcatacgttattggctttgtctgtaatactgccactaagtgattataattaagctgtcctgtttgcatcaaatgtaaagactgtgttcacaaccgtagtaaaatttggtttcattggaaatgaaacaaattctaaagtatgctttttcactagtccctttgattttgctatatcataacctcttggttcatatgctgagaaatttttcagaaagtccatttttgtttaaaattagaacttttcagaatgccaaatgaaggctaaaattttggccagaacattacaaaagttttaaatcgtagacgtaactccccctgaaataaagttaggtagtaaaatccttaatgaaaccagtggatgtgcttaacgtaaggttagtaaagcatacaaagaatctagtgtgctcagggcttggtacaatgagctgaattagatggccttatgaaactctttctaacctcttacccaacctgtttctccttggttaaaattatacttgaaggcccagaacactcatggcacatttgtttaatattgcttatagttagtttaaggtaattttgcttctacagtattttggaaggtctgaaaacttgcacagggtcatctttgtaattatataaccccaaactaagatgcacaatgtctccttcaggtgatcacacacagtggacgagtatgtgcaaacatggacataatagttcacttacaaatgtgatttgatgttaacactagagaatgatgactgtagaacatttgagcaagtaaaatagtaaagcacatagtgagtgtatgtccgtctaactggtacattgataatttagtttgggcacataaaaggaatatttatatggcttcccaaatgcagagttacatcttattcgtgtatttctctgagtatttatatcccgtctccttttttcattcttaaaaataaatgaattttcactgttggcacatatgaggcttaaatataaggaacataacacttgcattctaatttttgcatatattgtaaatgtgtctggtatttacagcaaaatactgtgtatccttttatgggtaaaacaaaagtgaacattgcatgcatgtaatgtgatgaatttgtaatttaggagttctttggggcttctgtgacttgggaaatgcttacattcaggccttaatgttgcattagctagcatgttttccctctgatgtatatagtcactgttgtataaactaatctttgcttgttttctactctgtgatctttccatatcatatttcattaatgatcagttagtgtcaaggagtcaaaacagattaaaattaatttcatgtgtatatggtggaaatttgtggctagtgtgattttgtttgtttccttttaaggtactgttgatcagttgtgacacttactggttaaacttacgttgctaaagatttctctataataagccacacattatatttagactatattaagggaccttggttttcttctagatagcagctgtcccaaagaaaatatttcttctttgtctgttaagatttagctattatctgccagttgttaagaggttttggttccaaactcaaccagcaatgttgagagctgaacttaagatagctgttgtactttttgctttccatctgttactgtccttcattcttggctccctactatctataaacagctgctgtgaagaagaaaagttgaataagagttggcttaaattttaaaaaagaaaaagaaaattgaggttttaggattttcatggtaacaagctctggtataagctaaggctggcaagttcagatactaaaatattatttgatcatatcttggatccttttgaaaaagttaagactatatgaaggtaaattagaaataagtatgaatattaataaaatagcatttatcttatttctctattttatgttgtgacttaacctaattttatttttttaacattttcttatttcttataatatgaatgctgatatttaaaggtagatctatgtggtattctttgtgtttcttaattgtttaactcttaagattatttgtgatctggatttatgtatttgttagatacatacgaattgttaaaatggaatgcaagtttttcaaaagcccaggtctaaatgtaatggttggtttattgttctataaccccagcccatcattttctgtgtaaatcataaacaataaacagaatatactcgaaacaaaaaaaagggggcgtctaaagttcctcggaggccaaggtaacgttacaagttttgaagagggccataggggggtttaagaaacggcggagttaaagtgctggaaatgcctgcttggagacatctggggattgaacacagtggcggaaaatggttggtaacttggaaggatatc

SEQ ID NO: 313994 - DNA, 4508 bp, Homo sapiens
cgccaccgccgccgccgccgccacagccgccagccgcttcgcgttcggcgggggaggagttggaggcggagaagaaggcggtggtggcgggtggaggttcgagcgctgttctcgctccggagccgctgcacatttcggaatcttctgcggcttgtccatagtgtgaataaaaactaaatcacatctataattctactgaactggtcatacagacgctgccatatatgtcacagtacactgaaaaggagccagcagcaatggaccaagaatctggtaaggctgtctggcccaaaccagcaggagggtatcagacaattacaggcaggagatatggaagaagacatgcttatgtcagttttaaaccatgtatgaccagacatgaaagaagcttaggtcgggctggtgatgactatgaagtgttggaactagatgatgttccaaaggaaaattcctcaggttccagtcctttggatcaagttgattcttctttacccagtgaacctatatttgaaaaaagtgaaacagaaattcccacttgtggttcagcattgaatcaaaccactgagagcagtcaatcctttgttgcagtacatcacagtgaggaaggcagggataccttaggaagcagtacaaatcttcataatcactctgagggagagtatattccaggagcttgtagtgcttcaagtgtccaaaatggaattgcattggttcatacagactcttatgatccagatggcaaacatggagaagataatgaccatcttcaactttctgcagaagtcgtggaaggtagtagataccaggaatcattaggcaatacagtatttgagttggaaaacagagaggcagaggcatacactggtctttcaccaccagttccctcatttaactgtgaagtaagagatgagtttgaagagttagattctgtaccattagtgaaaagttctgctggtgatactgagtttgtccatcagaatagccaggaaattcagaggtcttctcaagatgaaatggttagtacgaaacaacaaaataatactagccaggaaagacagacagaacattcacctgaagatgcagcctgtggtccagggcatatttgtagtgaacgaaataccaatgatagggaaaagaaccatggaagttctcctgaacaggtagtgaggccaaaagttagaaaactgataagttcaagccaggtggaccaagaaacaggttttaataggcatgaggcgaaacaaagaagtgttcaaagatggagagaggctttggaagttgaggaaagtggctcagatgacctcttaataaaatgtgaagaatatgatggagagcatgactgtatgttcttggatccaccatactcaagagttattacacaaagggaaacagaaaataaccaaatgacatcagaaagtggagccacagcgggaaggcaagaagtggataacaccttttggaatggctgtggagattattaccaactctatgacaaagatgaagatagttctgaatgcagtgatggggaatggtctgcttctttgcctcatcgattttctggtacagaaaaagatcaatcctcaagtgatgaaagctgggagactctgccaggaaaagatgagaatgaacctgagctacaaagtgatagcagtggccctgaagaagaaaaccaagaattatctcttcaggaaggggaacagacatccttggaagagggagaaattccttggttacagtacaatgaagtcaatgaaagcagcagtgatgagggaaatgaacctgccaatgaatttgcacagccagctttcatgttggatggtaacaataacctggaggatgactccagtgtgagtgaagacttagatgtggattggagcctatttgatggctttgcagatggactaggagttgctgaagctatttcatatgtggatcctcagttccttacctacatggcactagaagaacgcttagcccaggctatggagactgctctggcccatttagagtctcttgcagtggatgttgaggtggccaatccaccagctagtaaggaaagcattgatggtcttccagagacccttgttcttgaagatcacactgctattggtcaggaacaatgctgtccaatctgttgcagtgagtatattaaggatgatatagcaacagagttgccctgtcaccatttctttcacaaaccttgtgtctcaatttggctacaaaagtcgggaacatgccctgtgtgccgccgtcatttcccacctgcggttattgaagcatctgcagctccttcctctgagcctgatcctgatgccccaccttcaaatgacagtattgcagaagcaccctaaaccttgacagttgaaatgagatcagtgtatcaaagtaaatctgcaaattccttctaaatttcatgtgcaaataattatatataaatatatttaaaaatgctatatatagtatatgccatagtttagaaagaatattaacctttctaaactaaatttaggtttgcagaaagtattaaacatttttaagctgaatgttgagacagtgcatccattttctttagttgaatatgtttgtattaattgtaaagccaagcttatcagttgactctctccagaataaataatcatctgtgtggcatacgttattggctttgtctgtaatactgccactaagtgattataattaagctgtcctgtttgcatcaaatgtaaagactgtgttcacaaccgtagtaaaatttggtttcattggaaatgaaacaaattctaaagtatgctttttcactagtccctttgattttgctatatcataacctcttggttcatatgctgagaaatttttcagaaagtccatttttgtttaaaattagaacttttcagaatgccaaatgaaggctaaaattttggccagaacattacaaaagttttaaatcgtagacgtaactccccctgaaataaagttaggtagtaaaatccttaatgaaaccagtggatgtgcttaacgtaaggttagtaaagcatacaaagaatctagtgtgctcagggcttggtacaatgagctgaattagatggccttatgaaactctttctaacctcttacccaacctgtttctccttggttaaaattatacttgaaggcccagaacactcatggcacatttgtttaatattgcttatagttagtttaaggtaattttgcttctacagtattttggaaggtctgaaaacttgcacagggtcatctttgtaattatataaccccaaactaagatgcacaatgtctccttcaggtgatcacacacagtggacgagtatgtgcaaacatggacataatagttcacttacaaatgtgatttgatgttaacactagagaatgatgactgtagaacatttgagcaagtaaaatagtaaagcacatagtgagtgtatgtccgtctaactggtacattgataatttagtttgggcacataaaaggaatatttatatggcttcccaaatgcagagttacatcttattcgtgtatttctctgagtatttatatcccgtctccttttttcattcttaaaaataaatgaattttcactgttggcacatatgaggcttaaatataaggaacataacacttgcattctaatttttgcatatattgtaaatgtgtctggtatttacagcaaaatactgtgtatccttttatgggtaaaacaaaagtgaacattgcatgcatgtaatgtgatgaatttgtaatttaggagttctttggggcttctgtgacttgggaaatgcttacattcaggccttaatgttgcattagctagcatgttttccctctgatgtatatagtcactgttgtataaactaatctttgcttgttttctactctgtgatctttccatatcatatttcattaatgatcagttagtgtcaaggagtcaaaacagattaaaattaatttcatgtgtatatggtggaaatttgtggctagtgtgattttgtttgtttccttttaaggtactgttgatcagttgtgacacttactggttaaacttacgttgctaaagatttctctataataagccacacattatatttagactatattaagggaccttggttttcttctagatagcagctgtcccaaagaaaatatttcttctttgtctgttaagatttagctattatctgccagttgttaagaggttttggttccaaactcaaccagcaatgttgagagctgaacttaagatagctgttgtactttttgctttccatctgttactgtccttcattcttggctccctactatctataaacagctgctgtgaagaagaaaagttgaataagagttggcttaaattttaaaaaagaaaaagaaaattgaggttttaggattttcatggtaacaagctctggtataagctaaggctggcaagttcagatactaaaatattatttgatcatatcttggaagctgctgtagttggggtcctctaagtcag

SEQ ID NO: 313995 - DNA, 1826 bp, Homo sapiens
tagaactagtggatccccctgtctgcaggaattcggcacgagagtgtgcttttggcttggtacaatgagctgaattagatggccttatgaaactctttctaacctcttacccaacctgtttctccttggttaaaattatacttgaaggcccagaacactcatggcacatttgtttaatattgcttatagttagtttaaggtaattttgcttctacagtattttggaaggtctgaaaacttgcacagggtcatctttgtaattatataaccccaaactaagatgcacaatgtctccttcaggtgatcacacacagtggacgagtatgtgcaaacatggacataatagttcacttacaaatgtgatttgatgttaacactagagaatgatgactgtagaacatttgagcaagtaaaatagtaaagcacatagtgagtgtatgtccgtctaactggtacattgataatttagtttgggcacataaaaggaatatttatatggcttcccaaatgcagagttacatcttattcgtgtatttctctgagtatttatatcccgtctccttttttcattcttataacacttgcattctaatttttgcatatattgtaaatgtgtctggtatttacagcaaaatactgtgtatccttttatgggtaaaacaaaagtgaacattgcatgcatgtaatgtgatgaatttgtaatttaggagttctttggggcttctgtgacttgggaaatgcttacattcaggccttaatgttgcattagctagcatgttttccctctgatgtatatagtcactgttgtataaactaatctttgcttgttttctactctgtgatctttccatatcatatttcattaatgatcagttagtgtcaaggagtcaaaacagattaaaattaatttcatgtgtatatggtggaaatttgtggctagtgtgattttgtttgtttccttttaaggtactgttgatcagttgtgacacttactggttaaacttacgttgctaaagatttctctataataagccacacattatatttagactatattaagggaccttggttttcttctagatagcagctgtcccaaagaaaatatttcttctttgtctgttaagatttagctattatctgccagttgttaagaggttttggttccaaactcaaccagcaatgttgagagctgaacttaagatagctgttgtactttttgctttccatctgttactgtccttcattcttggctccctactatctataaacagctgctgtgaagaagaaaagttgaataagagttggcttaaattttaaaaaagaaaaagaaaattgaggttttaggattttcatggtaacaagctctggtataagctaaggctggcaagttcagatactaaaatattatttgatcatatcttggatccttttgaaaaagttaagactatatgaaggtaaattagaaataagtatgaatattaataaaatagcatttatcttatttctctattttatgttgtgacttaacctaattttatttttttaacattttcttatttcttataatatgaatgctgatatttaaaggtagatctatgtggtattctttgtgtttcttaattgtttaactcttaagattatttgtgatctggatttatgtatttgttagatacatacgaattgttaaaatggaatgcaagtttttcaaaagcccaggtctaaatgtaatggttggtttattgttctataaccccagcccatcattttctgtgtaaatcataaacaataaacagaatatactcggtggtcatttctaatatttaatt

SEQ ID NO: 313996 - DNA, 986 bp, Homo sapiens
agccccggcccctccacccgcatgtggggacggagccgggaggatcgcgcgctggccgccgccgaaggacccctcgctcctctcggaaatttgtggctagtgtgattttgtttgtttccttttaaggtactgttgatcagttgtgacacttactggttaaacttacgttgctaaagatttctctataataagccacacattatatttagactatattaagggaccttggttttcttctagatagcagctgtcccaaagaaaatatttcttctttgtctgttaagatttagctattatctgccagttgttaagaggttttggttccaaactcaaccagcaatgttgagagctgaacttaagatagctgttgtactttttgctttccatctgttactgtccttcattcttggctccctactatctataaacagctgctgtgaagaagaaaagttgaataagagttggcttaaattttaaaaaagaaaaagaaaattgaggttttaggattttcatggtaacaagctctggtataagctaaggctggcaagttcagatactaaaatattatttgatcatatcttggatccttttgaaaaagttaagactatatgaaggtaaattagaaataagtatgaatattaataaaatagcatttatcttatttctctattttatgttgtgacttaacctaattttatttttttaacattttcttatttcttataatatgaatgctgatatttaaaggtagatctatgtggtattctttgtgtttcttaattgtttaactcttaagattatttgtgatctggatttatgtatttgttagatacatacgaattgttaaaatggaatgcaagtttttcaaaagcccaggtctaaatgtaatggttggtttattgttctataaccccagcccatcattttctgtgtaaatcataaacaataaacagaatatactcggtggtcatttctaatatttaatt

SEQ ID NO: 313997 - DNA, 2469 bp, Homo sapiens
cgccaccgccgccgccgccgccacagccgccagccgcttcgcgttcggcgggggaggagttggaggcggagaagaaggcggtggtggcgggtggaggttcgagcgctgttctcgctccggagccgctgcacatttcggaatcttctgcggcttgtccatagtgtgaataaaaactaaatcacatctataattctactgaactggtcatacagacgctgccatatatgtcacagtacactgaaaaggagccagcagcaatggaccaagaatctggtaaggctgtctggcccaaaccagcaggagggtatcagacaattacaggcaggagatatggaagaagacatgcttatgtcagttttaaaccatgtatgaccagacatgaaagaagcttaggtcgggctggtgatgactatgaagtgttggaactagatgatgttccaaaggaaaattcctcaggttccagtcctttggatcaagttgattcttctttacccagtgaacctatatttgaaaaaagtgaaacagaaattcccacttgtggttcagcattgaatcaaaccactgagagcagtcaatcctttgttgcagtacatcacagtgaggaaggcagggataccttaggaagcagtacaaatcttcataatcactctgagggagagtatattccaggagcttgtagtgcttcaagtgtccaaaatggaattgcattggttcatacagactcttatgatccagatggcaaacatggagaagataatgaccatcttcaactttctgcagaagtcgtggaaggtagtagataccaggaatcattaggcaatacagtatttgagttggaaaacagagaggcagaggcatacactggtctttcaccaccagttccctcatttaactgtgaagtaagagatgagtttgaagagttagattctgtaccattagtgaaaagttctgctggtgatactgagtttgtccatcagaatagccaggaaattcagaggtcttctcaagatgaaatggttagtacgaaacaacaaaataatactagccaggaaagacagacagaacattcacctgaagatgcagcctgtggtccagggcatatttgtagtgaacgaaataccaatgatagggaaaagaaccatggaagttctcctgaacaggtagtgaggccaaaagttagaaaactgataagttcaagccaggtggaccaagaaacaggttttaataggcatgaggcgaaacaaagaagtgttcaaagatggagagaggctttggaagttgaggaaagtggctcagatgacctcttaataaaatgtgaagaatatgatggagagcatgactgtatgttcttggatccaccatactcaagagttattacacaaagggaaacagaaaataaccaaatgacatcagaaagtggagccacagcgggaaggcaagaagtggataacaccttttggaatggctgtggagattattaccaactctatgacaaagatgaagatagttctgaatgcagtgatggggaatggtctgcttctttgcctcatcgattttctggtacagaaaaagatcaatcctcaagtgatgaaagctgggagactctgccaggaaaagatgagaatgaacctgagctacaaagtgatagcagtggccctgaagaagaaaaccaagaattatctcttcaggaaggggaacagacatccttggaagagggagaaattccttggttacagtacaatgaagtcaatgaaagcagcagtgatgagggaaatgaacctgccaatgaatttgcacagccagctttcatgttggatggtaacaataacctggaggatgactccagtgtgagtgaagacttagatgtggattggagcctatttgatggctttgcagatggactaggagttgctgaagctatttcatatgtggatcctcagttccttacctacatggcactagaagaacgcttagcccaggctatggagactgctctggcccatttagagtctcttgcagtggatgttgaggtggccaatccaccagctagtaaggaaagcattgatggtcttccagagacccttgttcttgaagatcacactgctattggtcaggaacaatgctgtccaatctgttgcagtgagtatattaaggatgatatagcaacagagttgccctgtcaccatttctttcacaaaccttgtgtctcaatttggctacaaaagtcgggaacatgccctgtgtgccgccgtcatttcccacctgcggttattgaagcatctgcagctccttcctctgagcctgatcctgatgccccaccttcaaatgacagtattgcagaagcaccctaaaccttgacagttgaaatgagatcagggtccagtaatcggttctcctaattctgggcagtaatcttattcagattcaacgggcttatgacatgccacgtcgaggaatcctcacacatgg

SEQ ID NO: 313998 - DNA, 676 bp, Homo sapiens
gtgattcacagtgcactgattttatttacagatcaaaagccacttaaataatctgcagacacaagtgctgtccagggcagaagcctggggtccaaatcagccttatccctcctcatgcccacagtcagcccaatgctgtctccgttccatgggccagcacaggcaggcgccactctgctgacatgaggacctggggtagctcagacatttctcgtgccgaattcggcacgctggcaagttcagatactaaaatattatttgatcatatcttggatccttttgaaaaagttaagactatatgaaggtaaattagaaataagtatgaatattaataaaatagcatttatcttatttctctattttatgttgtgacttaacctaattttatttttttaacattttcttatttcttataatatgaatgctgatatttaaaggtagatctatgtggtattctttgtgtttcttaattgtttaactcttaagattatttgtgatctggatttatgtatttgttagatacatacgaattgttaaaatggaatgcaagtttttcaaaagcccaggtctaaatgtaatggttggtttattgttctataaccccagcccatcattttctgtgtaaatcataaacaataaacagaatatactcggtggtcatttctaatatttaatt

SEQ ID NO: 313999 - DNA, 467 bp, Homo sapiens
ccccgctcgagccgcagcagtcgctctactcccgggatcagcacctttccgccagggctgctctcagttagcgatgtcaggccagagctcctcttgcagatgcacctttaatttggcctccctcagatgactggtaatcattttgcgcacattcaaaatggtgaggttaaagacgctcagaccaagttgaagcaaaggggaggtggtaaatagtcgttttgcagggaggagagtaatctgagagttccttctccggacattaaaaaaaaaaaaatttacatccgcataggcgcttcttttgagtctgctggttctgtgaagtttaaaattttcattgcaggcttaatgtattctgttttatcatgaaatatttggtcacatttctttaaaatggcagtcacctttgctgaaggctacggatcatttgaagtgtatgtgaataaacctgaggataacagtaataaacg

SEQ ID NO: 314000 - DNA, 621 bp, Homo sapiens
caggccccatctccaacattttggattacagttcaacatgagatttggtggggacacagatccaaaccatatcatctagttaacaccccaaatgataaaaataactgaacacattatgatagtttatttctcttctgatttgcagttctgaatgcagtgatggggaatggtctgcttctttgcctcatcgattttctggtacagaaaaagatcaatcctcaagtgatgaaagctgggagactctgccaggaaaagatgagaatgaacctgagctacaaagtgatagcagtggccctgaagaagaaaaccaagaattatctcttcaggaagggtatgttcaacagtgagatttatttttctgtatattgtacaagagtggtatattttacattcaaatgttggatatgccattaattgtatttataagccttatgtagaaccagtaggcccccctgattttttcattatgcttttggtattttaaaaagaacaattaagttgaaaatactgataatttcagtatcgtttatggagatacaatatatgtctccacttggctttaataagaaaagttgggcacctaaaatgtcattttggttaagttaggaatgggtgaattag

SEQ ID NO: 314001 - DNA, 4828 bp, Homo sapiens
cgccaccgccgccgccgccgccacagccgccagccgcttcgcgttcggcgggggaggagttggaggcggagaagaaggcggtggtggcgggtggaggttcgagcgctgttctcgctccggagccgctgcacatttcggaatcttctgcggcttgtccatagtgtgaataaaaactaaatcacatctataattctactgaactggtcatacagacgctgccatatatgtcacagtacactgaaaaggagccagcagcaatggaccaagaatctggtaaggctgtctggcccaaaccagcaggagggtatcagacaattacaggcaggagatatggaagaagacatgcttatgtcagttttaaaccatgtatgaccagacatgaaagaagcttaggtcgggctggtgatgactatgaagtgttggaactagatgatgttccaaaggaaaattcctcaggttccagtcctttggatcaagttgattcttctttacccagtgaacctatatttgaaaaaagtgaaacagaaattcccacttgtggttcagcattgaatcaaaccactgagagcagtcaatcctttgttgcagtacatcacagtgaggaaggcagggataccttaggaagcagtacaaatcttcataatcactctgagggagagtatattccaggagcttgtagtgcttcaagtgtccaaaatggaattgcattggttcatacagactcttatgatccagatggcaaacatggagaagataatgaccatcttcaactttctgcagaagtcgtggaaggtagtagataccaggaatcattaggcaatacagtatttgagttggaaaacagagaggcagaggcatacactggtctttcaccaccagttccctcatttaactgtgaagtaagagatgagtttgaagagttagattctgtaccattagtgaaaagttctgctggtgatactgagtttgtccatcagaatagccaggaaattcagaggtcttctcaagatgaaatggttagtacgaaacaacaaaataatactagccaggaaagacagacagaacattcacctgaagatgcagcctgtggtccagggcatatttgtagtgaacgaaataccaatgatagggaaaagaaccatggaagttctcctgaacaggtagtgaggccaaaagttagaaaactgataagttcaagccaggtggaccaagaaacaggttttaataggcatgaggcgaaacaaagaagtgttcaaagatggagagaggctttggaagttgaggaaagtggctcagatgacctcttaataaaatgtgaagaatatgatggagagcatgactgtatgttcttggatccaccatactcaagagttattacacaaagggaaacagaaaataaccaaatgacatcagaaagtggagccacagcgggaaggcaagaagtggataacaccttttggaatggctgtggagattattaccaactctatgacaaagatgaagatagttctgaatgcagtgatggggaatggtctgcttctttgcctcatcgattttctggtacagaaaaagatcaatcctcaagtgatgaaagctgggagactctgccaggaaaagatgagaatgaacctgagctacaaagtgatagcagtggccctgaagaagaaaaccaagaattatctcttcaggaaggggaacagacatccttggaagagggagaaattccttggttacagtacaatgaagtcaatgaaagcagcagtgatgagggaaatgaacctgccaatgaatttgcacagccagctttcatgttggatggtaacaataacctggaggatgactccagtgtgagtgaagacttagatgtggattggagcctatttgatggctttgcagatggactaggagttgctgaagctatttcatatgtggatcctcagttccttacctacatggcactagaagaacgcttagcccaggctatggagactgctctggcccatttagagtctcttgcagtggatgttgaggtggccaatccaccagctagtaaggaaagcattgatggtcttccagagacccttgttcttgaagatcacactgctattggtcaggaacaatgctgtccaatctgttgcagtgagtatattaaggatgatatagcaacagagttgccctgtcaccatttctttcacaaaccttgtgtctcaatttggctacaaaagcatctgcagctccttcctctgagcctgatcctgatgccccaccttcaaatgacagtattgcagaagcaccctaaaccttgacagttgaaatgagatcagtgtatcaaagtaaatctgcaaattccttctaaatttcatgtgcaaataattatatataaatatatttaaaaatgctatatatagtatatgccatagtttagaaagaatattaacctttctaaactaaatttaggtttgcagaaagtattaaacatttttaagctgaatgttgagacagtgcatccattttctttagttgaatatgtttgtattaattgtaaagccaagcttatcagttgactctctccagaataaataatcatctgtgtggcatacgttattggctttgtctgtaatactgccactaagtgattataattaagctgtcctgtttgcatcaaatgtaaagactgtgttcacaaccgtagtaaaatttggtttcattggaaatgaaacaaattctaaagtatgctttttcactagtccctttgattttgctatatcataacctcttggttcatatgctgagaaatttttcagaaagtccatttttgtttaaaattagaacttttcagaatgccaaatgaaggctaaaattttggccagaacattacaaaagttttaaatcgtagacgtaactccccctgaaataaagttaggtagtaaaatccttaatgaaaccagtggatgtgcttaacgtaaggttagtaaagcatacaaagaatctagtgtgctcagggcttggtacaatgagctgaattagatggccttatgaaactctttctaacctcttacccaacctgtttctccttggttaaaattatacttgaaggcccagaacactcatggcacatttgtttaatattgcttatagttagtttaaggtaattttgcttctacagtattttggaaggtctgaaaacttgcacagggtcatctttgtaattatataaccccaaactaagatgcacaatgtctccttcaggtgatcacacacagtggacgagtatgtgcaaacatggacataatagttcacttacaaatgtgatttgatgttaacactagagaatgatgactgtagaacatttgagcaagtaaaatagtaaagcacatagtgagtgtatgtccgtctaactggtacattgataatttagtttgggcacataaaaggaatatttatatggcttcccaaatgcagagttacatcttattcgtgtatttctctgagtatttatatcccgtctccttttttcattcttaaaaataaatgaattttcactgttggcacatatgaggcttaaatataaggaacataacacttgcattctaatttttgcatatattgtaaatgtgtctggtatttacagcaaaatactgtgtatccttttatgggtaaaacaaaagtgaacattgcatgcatgtaatgtgatgaatttgtaatttaggagttctttggggcttctgtgacttgggaaatgcttacattcaggccttaatgttgcattagctagcatgttttccctctgatgtatatagtcactgttgtataaactaatctttgcttgttttctactctgtgatctttccatatcatatttcattaatgatcagttagtgtcaaggagtcaaaacagattaaaattaatttcatgtgtatatggtggaaatttgtggctagtgtgattttgtttgtttccttttaaggtactgttgatcagttgtgacacttactggttaaacttacgttgctaaagatttctctataataagccacacattatatttagactatattaagggaccttggttttcttctagatagcagctgtcccaaagaaaatatttcttctttgtctgttaagatttagctattatctgccagttgttaagaggttttggttccaaactcaaccagcaatgttgagagctgaacttaagatagctgttgtactttttgctttccatctgttactgtccttcattcttggctccctactatctataaacagctgctgtgaagaagaaaagttgaataagagttggcttaaattttaaaaaagaaaaagaaaattgaggttttaggattttcatggtaacaagctctggtataagctaaggctggcaagttcagatactaaaatattatttgatcatatcttggatccttttgaaaaagttaagactatatgaaggtaaattagaaataagtatgaatattaataaaatagcatttatcttatttctctattttatgttgtgacttaacctaattttatttttttaacattttcttatttcttataatatgaatgctgatatttaaaggtagatctatgtggtattctttgtgtttcttaattgtttaactcttaagattatttgtgatctggatttatgtatttgttagatacatacgaattgttaaaatggaatgcaagtttttcaaaagcccaggtctaaatgtaatggttggtttattgttctataaccccagcccatcattttctgtgtaaatcataaacaataaacagaatatactcggtggtcatttctaatatttaatt

SEQ ID NO: 314002 - DNA, 4827 bp, Homo sapiens
cgccaccgccgccgccgccgccacagccgccagccgcttcgcgttcggcgggggaggagttggaggcggagaagaaggcggtggtggcgggtggaggttcgagcgctgttctcgctccggagccgctgcacatttcggaatcttctgcggcttgtccatagtgtgaataaaaactaaatcacatctataattctactgaactggtcatacagacgctgccatatatgtcacagtacactgaaaaggagccagcagcaatggaccaagaatctggtaaggctgtctggcccaaaccagcaggagggtatcagacaattacaggcaggagatatggaagaagacatgcttatgtcagttttaaaccatgtatgaccagacatgaaagaagcttaggtcgggctggtgatgactatgaagtgttggaactagatgatgttccaaaggaaaattcctcaggttccagtcctttggatcaagttgattcttctttacccagtgaacctatatttgaaaaaagtgaaacagaaattcccacttgtggttcagcattgaatcaaaccactgagagcagtcaatcctttgttgcagtacatcacagtgaggaaggcagggataccttaggaagcagtacaaatcttcataatcactctgagggagagtatattccaggagcttgtagtgcttcaagtgtccaaaatggaattgcattggttcatacagactcttatgatccagatggcaaacatggagaagataatgaccatcttcaactttctgcagaagtcgtggaaggtagtagataccaggaatcattaggcaatacagtatttgagttggaaaacagagaggcagaggcatacactggtctttcaccaccagttccctcatttaactgtgaagtaagagatgagtttgaagagttagattctgtaccattagtgaaaagttctgctggtgatactgagtttgtccatcagaatagccaggaaattcagaggtcttctcaagatgaaatggttagtacgaaacaacaaaataatactagccaggaaagacagacagaacattcacctgaagatgcagcctgtggtccagggcatatttgtagtgaacgaaataccaatgatagggaaaagaaccatggaagttctcctgaacaggtagtgaggccaaaagttagaaaactgataagttcaagccaggtggaccaagaaacaggttttaataggcatgaggcgaaacaaagaagtgttcaaagatggagagaggctttggaagttgaggaaagtggctcagatgacctcttaataaaatgtgaagaatatgatggagagcatgactgtatgttcttggatccaccatactcaagagttattacacaaagggaaacagaaaataaccaaatgacatcagaaagtggagccacagcgggaaggcaagaagtggataacaccttttggaatggctgtggagattattaccaactctatgacaaagatgaagatagttctgaatgcagtgatggggaatggtctgcttctttgcctcatcgattttctggtacagaaaaagatcaatcctcaagtgatgaaagctgggagactctgccaggaaaagatgagaatgaacctgagctacaaagtgatagcagtggccctgaagaagaaaaccaagaattatctcttcaggaaggggaacagacatccttggaagagggagaaattccttggttacagtacaatgaagtcaatgaaagcagcagtgatgagggaaatgaacctgccaatgaatttgcacagccagctttcatgttggatggtaacaataacctggaggatgactccagtgtgagtgaagacttagatgtggattggagcctatttgatggctttgcagatggactaggagttgctgaagctatttcatatgtggatcctcagttccttacctacatggcactagaagaacgcttagcccaggctatggagactgctctggcccatttagagtctcttgcagtggatgttgaggtggccaatccaccagctagtaaggaaagcattgatggtcttccagagacccttgttcttgaagatcacactgctattggtcaggaacaatgctgtccaatctgttgcagtgagtatattaaggatgatatagcaacagagttgccctgtcaccatttctttcacaaaccttgtgtctcaatttggctacaaaagtcgggaacatgccctgtgtgccgccgtcatttcccacctgcggttattgaagcatctgcagctccttcctctgagcctgatcctgatgccccaccttcaaatgacagtattgcagaagcaccctaaaccttgacagttgaaatgagatcagtgtatcaaagtaaatctgcaaattccttctaaatttcatgtgcaaataattatatataaatatatttaaaaatgctatatatagtatatgccatagtttagaaagaatattaacctttctaaactaaatttaggtttgcagaaagtattaaacatttttaagctgaatgttgagacagtgcatccattttctttagttgaatatgtttgtattaattgtaaagccaagcttatcagttgactctctccagaataaataatcatctgtgtggcatacgttattggctttgtctgtaatactgccactaagtgattataattaagctgtcctgtttgcatcaaatgtaaagactgtgttcacaaccgtagtaaaatttggtttcattggaaatgaaacaaattctaaagtatgctttttcactagtccctttgattttgctatatcataacctcttggttcatatgctgagaaatttttcagaaagtccatttttgtttaaaattagaacttttcagaatgccaaatgaaggctaaaattttggccagaacattacaaaagttttaaatcgtagacgtaactccccctgaaataaagttaggtagtaaaatccttaatgaaaccagtggatgtgcttaacgtaaggttagtaaagcatacaaagaatctagtgtgctcagggcttggtacaatgagctgaattagatggccttatgaaactctttctaacctcttacccaacctgtttctccttggttaaaattatacttgaaggcccagaacactcatggcacatttgtttaatattgcttatagttagtttaaggtaattttgcttctacagtattttggaaggtctgaaaacttgcacagggtcatctttgtaattatataaccccaaactaagatgcacaatgtctccttcaggtgatcacacacagtggacgagtatgtgcaaacatggacataatagttcacttacaaatgtgatttgatgttaacactagagaatgatgactgtagaacatttgagcaagtaaaatagtaaagcacatagtgagtgtatgtccgtctaactggtacattgataatttagtttgggcacataaaaggaatatttatatggcttcccaaatgcagagttacatcttattcgtgtatttctctgagtatttatatcccgtctccttttttcattcttataacacttgcattctaatttttgcatatattgtaaatgtgtctggtatttacagcaaaatactgtgtatccttttatgggtaaaacaaaagtgaacattgcatgcatgtaatgtgatgaatttgtaatttaggagttctttggggcttctgtgacttgggaaatgcttacattcaggccttaatgttgcattagctagcatgttttccctctgatgtatatagtcactgttgtataaactaatctttgcttgttttctactctgtgatctttccatatcatatttcattaatgatcagttagtgtcaaggagtcaaaacagattaaaattaatttcatgtgtatatggtggaaatttgtggctagtgtgattttgtttgtttccttttaaggtactgttgatcagttgtgacacttactggttaaacttacgttgctaaagatttctctataataagccacacattatatttagactatattaagggaccttggttttcttctagatagcagctgtcccaaagaaaatatttcttctttgtctgttaagatttagctattatctgccagttgttaagaggttttggttccaaactcaaccagcaatgttgagagctgaacttaagatagctgttgtactttttgctttccatctgttactgtccttcattcttggctccctactatctataaacagctgctgtgaagaagaaaagttgaataagagttggcttaaattttaaaaaagaaaaagaaaattgaggttttaggattttcatggtaacaagctctggtataagctaaggctggcaagttcagatactaaaatattatttgatcatatcttggatccttttgaaaaagttaagactatatgaaggtaaattagaaataagtatgaatattaataaaatagcatttatcttatttctctattttatgttgtgacttaacctaattttatttttttaacattttcttatttcttataatatgaatgctgatatttaaaggtagatctatgtggtattctttgtgtttcttaattgtttaactcttaagattatttgtgatctggatttatgtatttgttagatacatacgaattgttaaaatggaatgcaagtttttcaaaagcccaggtctaaatgtaatggttggtttattgttctataaccccagcccatcattttctgtgtaaatcataaacaataaacagaatatactcggtggtcatttctaatatttaatt

SEQ ID NO: 314003 - DNA, 4827 bp, Homo sapiens
cgccaccgccgccgccgccgccacagccgccagccgcttcgcgttcggcgggggaggagttggaggcggagaagaaggcggtggtggcgggtggaggttcgagcgctgttctcgctccggagccgctgcacatttcggaatcttctgcggcttgtccatagtgtgaataaaaactaaatcacatctataattctactgaactggtcatacagacgctgccatatatgtcacagtacactgaaaaggagccagcagcaatggaccaagaatctggtaaggctgtctggcccaaaccagcaggagggtatcagacaattacaggcaggagatatggaagaagacatgcttatgtcagttttaaaccatgtatgaccagacatgaaagaagcttaggtcgggctggtgatgactatgaagtgttggaactagatgatgttccaaaggaaaattcctcaggttccagtcctttggatcaagttgattcttctttacccagtgaacctatatttgaaaaaagtgaaacagaaattcccacttgtggttcagcattgaatcaaaccactgagagcagtcaatcctttgttgcagtacatcacagtgaggaaggcagggataccttaggaagcagtacaaatcttcataatcactctgagggagagtatattccaggagcttgtagtgcttcaagtgtccaaaatggaattgcattggttcatacagactcttatgatccagatggcaaacatggagaagataatgaccatcttcaactttctgcagaagtcgtggaaggtagtagataccaggaatcattaggcaatacagtatttgagttggaaaacagagaggcagaggcatacactggtctttcaccaccagttccctcatttaactgtgaagtaagagatgagtttgaagagttagattctgtaccattagtgaaaagttctgctggtgatactgagtttgtccatcagaatagccaggaaattcagaggtcttctcaagatgaaatggttagtacgaaacaacaaaataatactagccaggaaagacagacagaacattcacctgaagatgcagcctgtggtccagggcatatttgtagtgaacgaaataccaatgatagggaaaagaaccatggaagttctcctgaacaggtagtgaggccaaaagttagaaaactgataagttcaagccaggtggaccaagaaacaggttttaataggcatgaggcgaaacaaagaagtgttcaaagatggagagaggctttggaagttgaggaaagtggctcagatgacctcttaataaaatgtgaagaatatgatggagagcatgactgtatgttcttggatccaccatactcaagagttattacacaaagggaaacagaaaataaccaaatgacatcagaaagtggagccacagcgggaaggcaagaagtggataacaccttttggaatggctgtggagattattaccaactctatgacaaagatgaagatagttctgaatgcagtgatggggaatggtctgcttctttgcctcatcgattttctggtacagaaaaagatcaatcctcaagtgatgaaagctgggagactctgccaggaaaagatgagaatgaacctgagctacaaagtgatagcagtggccctgaagaagaaaaccaagaattatctcttcaggaaggggaacagacatccttggaagagggagaaattccttggttacagtacaatgaagtcaatgaaagcagcagtgatgagggaaatgaacctgccaatgaatttgcacagccagctttcatgttggatggtaacaataacctggaggatgactccagtgtgagtgaagacttagatgtggattggagcctatttgatggctttgcagatggactaggagttgctgaagctatttcatatgtggatcctcagttccttacctacatggcactagaagaacgcttagcccaggctatggagactgctctggcccatttagagtctcttgcagtggatgttgaggtggccaatccaccagctagtaaggaaagcattgatggtcttccagagacccttgttcttgaagatcacactgctattggtcaggaacaatgctgtccaatctgttgcagtgagtatattaaggatgatatagcaacagagttgccctgtcaccatttctttcacaaaccttgtgtctcaatttggctacaaaagtcgggaacatgccctgtgtgccgccgtcatttcccacctgcggttattgaagcatctgcagctccttcctctgagcctgatcctgatgccccaccttcaaatgacagtattgcagaagcaccctaaaccttgacagttgaaatgagatcagtgtatcaaagtaaatctgcaaattccttctaaatttcatgtgcaaataattatatataaatatatttaaaaatgctatatatagtatatgccatagtttagaaagaatattaacctttctaaactaaatttaggtttgcagaaagtattaaacatttttaagctgaatgttgagacagtgcatccattttctttagttgaatatgtttgtattaattgtaaagccaagcttatcagttgactctctccagaataaataatcatctgtgtggcatacgttattggctttgtctgtaatactgccactaagtgattataattaagctgtcctgtttgcatcaaatgtaaagactgtgttcacaaccgtagtaaaatttggtttcattggaaatgaaacaaattctaaagtatgctttttcactagtccctttgattttgctatatcataacctcttggttcatatgctgagaaatttttcagaaagtccatttttgtttaaaattagaacttttcagaatgccaaatgaaggctaaaattttggccagaacattacaaaagttttaaatcgtagacgtaactccccctgaaataaagttaggtagtaaaatccttaatgaaaccagtggatgtgcttaacgtaaggttagtaaagcatacaaagaatctagtgtgctcagggcttggtacaatgagctgaattagatggccttatgaaactctttctaacctcttacccaacctgtttctccttggttaaaattatacttgaaggcccagaacactcatggcacatttgtttaatattgcttatagttagtttaaggtaattttgcttctacagtattttggaaggtctgaaaacttgcacagggtcatctttgtaattatataaccccaaactaagatgcacaatgtctccttcaggtgatcacacacagtggacgagtatgtgcaaacatggacataatagttcacttacaaatgtgatttgatgttaacactagagaatgatgactgtagaacatttgagcaagtaaaatagtaaagcacatagtgagtgtatgtccgtctaactggtacattgataatttagtttgggcacataaaaggaatatttatatggcttcccaaatgcagagttacatcttattcgtgtatttctctgagtatttatatcccgtctccttttttcattcttaaaaataaatgaattttcactgttggcacatatgaggcttaaatataaggaacataacacttgcattctaatttttgcatatattgtaaatgtgtctggtatttacagcaaaatactgtgtatccttttatgggtaaaacaaaagtgaacattgcatgcatgtaatgtgatgaatttgtaatttaggagttctttggggcttctgtgacttgggaaatgcttacattcaggccttaatgttgcattagctagcatgttttccctctgatgtatatagtcactgttgtataaactaatctttgcttgttttctactctgtgatctttccatatcatatttcattaatgatcagttagtgtcaaggagtcaaaacagatttgtttccttttaaggtactgttgatcagttgtgacacttactggttaaacttacgttgctaaagatttctctataataagccacacattatatttagactatattaagggaccttggttttcttctagatagcagctgtcccaaagaaaatatttcttctttgtctgttaagatttagctattatctgccagttgttaagaggttttggttccaaactcaaccagcaatgttgagagctgaacttaagatagctgttgtactttttgctttccatctgttactgtccttcattcttggctccctactatctataaacagctgctgtgaagaagaaaagttgaataagagttggcttaaattttaaaaaagaaaaagaaaattgaggttttaggattttcatggtaacaagctctggtataagctaaggctggcaagttcagatactaaaatattatttgatcatatcttggatccttttgaaaaagttaagactatatgaaggtaaattagaaataagtatgaatattaataaaatagcatttatcttatttctctattttatgttgtgacttaacctaattttatttttttaacattttcttatttcttataatatgaatgctgatatttaaaggtagatctatgtggtattctttgtgtttcttaattgtttaactcttaagattatttgtgatctggatttatgtatttgttagatacatacgaattgttaaaatggaatgcaagtttttcaaaagcccaggtctaaatgtaatggttggtttattgttctataaccccagcccatcattttctgtgtaaatcataaacaataaacagaatatactcggtggtcatttctaatatttaatt

SEQ ID NO: 314004 - DNA, 3133 bp, Homo sapiens
cgccaccgccgccgccgccgccacagccgccagccgcttcgcgttcggcgggggaggagttggaggcggagaagaaggcggtggtggcgggtggaggttcgagcgctgttctcgctccggagccgctgcacatttcggaatcttctgcggcttgtccatagtgtgaataaaaactaaatcacatctataattctactgaactggtcatacagacgctgccatatatgtcacagtacactgaaaaggagccagcagcaatggaccaagaatctggtaaggctgtctggcccaaaccagcaggagggtatcagacaattacaggcaggagatatggaagaagacatgcttatgtcagttttaaaccatgtatgaccagacatgaaagaagcttaggtcgggctggtgatgactatgaagtgttggaactagatgatgttccaaaggaaaattcctcaggttccagtcctttggatcaagttgattcttctttacccagtgaacctatatttgaaaaaagtgaaacagaaattcccacttgtggttcagcattgaatcaaaccactgagagcagtcaatcctttgttgcagtacatcacagtgaggaaggcagggataccttaggaagcagtacaaatcttcataatcactctgagggagagtatattccaggagcttgtagtgcttcaagtgtccaaaatggaattgcattggttcatacagactcttatgatccagatggcaaacatggagaagataatgaccatcttcaactttctgcagaagtcgtggaaggtagtagataccaggaatcattaggcaatacagtatttgagttggaaaacagagaggcagaggcatacactggtctttcaccaccagttccctcatttaactgtgaagtaagagatgagtttgaagagttagattctgtaccattagtgaaaagttctgctggtgatactgagtttgtccatcagaatagccaggaaattcagaggtcttctcaagatgaaatggttagtacgaaacaacaaaataatactagccaggaaagacagacagaacattcacctgaagatgcagcctgtggtccagggcatatttgtagtgaacgaaataccaatgatagggaaaagaaccatggaagttctcctgaacaggtagtgaggccaaaagttagaaaactgataagttcaagccaggtggaccaagaaacaggttttaataggcatgaggcgaaacaaagaagtgttcaaagatggagagaggctttggaagttgaggaaagtggctcagatgacctcttaataaaatgtgaagaatatgatggagagcatgactgtatgttcttggatccaccatactcaagagttattacacaaagggaaacagaaaataaccaaatgacatcagaaagtggagccacagcgggaaggcaagaagtggataacaccttttggaatggctgtggagattattaccaactctatgacaaagatgaagatagttctgaatgcagtgatggggaatggtctgcttctttgcctcatcgattttctggtacagaaaaagatcaatcctcaagtgatgaaagctgggagactctgccaggaaaagatgagaatgaacctgagctacaaagtgatagcagtggccctgaagaagaaaaccaagaattatctcttcaggaaggggaacagacatccttggaagagggagaaattccttggttacagtacaatgaagtcaatgaaagcagcagtgatgagggaaatgaacctgccaatgaatttgcacagccagctttcatgttggatggtaacaataacctggaggatgactccagtgtgagtgaagacttagatgtggattggagcctatttgatggctttgcagatggactaggagttgctgaagctatttcatatgtggatcctcagttccttacctacatggcactagaagaacgcttagcccaggctatggagactgctctggcccatttagagtctcttgcagtggatgttgaggtggccaatccaccagctagtaaggaaagcattgatggtcttccagagacccttgttcttgaagatcacactgctattggtcaggaacaatgctgtccaatctgttgcagtgagtatattaaggatgatatagcaacagagttgccctgtcaccatttctttcacaaaccttgtgtctcaatttggctacaaaagcatctgcagctccttcctctgagcctgatcctgatgccccaccttcaaatgacagtattgcagaagcaccctaaaccttgacagttgaaatgagatcagtgtatcaaagtaaatctgcaaattccttctaaatttcatgtgcaaataattatatataaatatatttaaaaatgctatatatagtatatgccatagtttagaaagaatattaacctttctaaactaaatttaggtttgcagaaagtattaaacatttttaagctgaatgttgagacagtgcatccattttctttagttgaatatgtttgtattaattgtaaagccaagcttatcagttgactctctccagaataaataatcatctgtgtggcatacgtaaaaaaaaaaaaaaaaaaaaaaagaaacaaaacacaaaaaacaacaaacaaaaaaaaaaacaaaaacaaaaaaaacaaaaacaaaacaacaacaccacacaaaaaaaccaaaacggcgcgggggcgccccacacatgacacctcccccgcggcgggccgccacccccccctcaccccccttctccaaaaatgggacccctctaagaaggggaagtgtattcatattagtagatttatcgagggggaggtgcctataatagtcagaccttggcgcataatgaagagaaaccgaacgtagatggtaggagaacgcacaagtaggagacgggaccctcgccatagcacgaggcgcacgaacagcacaacaacgaggaagagagccccactacctactggtcagtgttatacccacgttgcggagtggaaaaacacacaccaagaccggccaagagaagcgtagcgggagcaccaaggccagcggagataaagcaggacgaccgaaacaagcaagcagtacccccggagggctgg

SEQ ID NO: 314005 - DNA, 1672 bp, Homo sapiens
cgccaccgccgccgccgccgccacagccgccagccgcttcgcgttcggcgggggaggagttggaggcggagaagaaggcggtggtggcgggtggaggttcgagcgctgttctcgctccggagccgctgcacatttcggaatcttctgcggcttgtccatagtgtgaataaaaactaaatcacatctataattctactgaactggtcatacagacgctgccatatatgtcacagtacactgaaaaggagccagcagcaatggaccaagaatctggtaaggctgtctggcccaaaccagcaggagggtatcagacaattacaggcaggagatatggaagaagacatgcttatgtcagttttaaaccatgtatgaccagacatgaaagaagcttaggtcgggctggtgatgactatgaagtgttggaactagatgatgttccaaaggaaaattcctcaggttccagtcctttggatcaagttgattcttctttacccagtgaacctatatttgaaaaaagtgaaacagaaattcccacttgtggttcagcattgaatcaaaccactgagagcagtcaatcctttgttgcagtacatcacagtgaggaaggcagggataccttaggaagcagtacaaatcttcataatcactctgagggagagtatattccaggagcttgtagtgcttcaagtgtccaaaatggaattgcattggttcatacagactcttatgatccagatggcaaacatggagaagataatgaccatcttcaactttctgcagaagtcgtggaaggtagtagataccaggaatcattaggcaatacagtatttgagttggaaaacagagaggcagaggcatacactggtctttcaccaccagttccctcatttaactgtgaagtaagagatgagtttgaagagttagattctgtaccattagtgaaaagttctgctggtgatactgagtttgtccatcagaatagccaggaaattcagaggtcttctcaagatgaaatggttagtacgaaacaacaaaataatactagccaggaaagacagacagaacattcacctgaagatgcagcctgtggtccagggcatatttgtagtgaacgaaataccaatgatagggaaaagaaccatggaagttctcctgaacaggtagtgaggccaaaagttagaaaactgataagttcaagccaggtggaccaagaaacaggttttaataggcatgaggcgaaacaaagaagtgttcaaagatggagagaggctttggaagttgaggaaagtggctcagatgacctcttaataaaatgtgaagaatatgatggagagcatgaacacaggcttatttttaaaataaaaatatttttaacatgggtttccttattgaaaaatcagtgtattagtcataaaaccccatcattaagaataattgaacaataaagtttgctttcagatgcagttttcaaattataatctcatttcaatttataacgttctcagtcctttgttataattttcctttttcatgtaagtttaattatctgcatttatcttttttcctagtttttctaatactaatgttatttcttaaaattcagtgagatataggataaaataatgctttgagaagaatgtttaatagaaaattaaaataaccttttctggca

SEQ ID NO: 314006 - DNA, 1681 bp, Homo sapiens
  misc_feature (658)..(658): n is a, c, g, or t
gttgatttacagcttggttttgtagaaaaatatttagtgagcaaagactctgctgtagaaaagctgatcctatttttttatgtgggctttacaccagctgaatactgatgaaaaaaaatcacatttgacaatattgattttaagatactctgatggtattaaaattttataaaaatgacatgttctgaaaggtaatgatttagttattaagcaaggggacatgctctaaaatttggaaccttaagattaagaatgtatttttctaatgtcagtctcctttgaagtttcatttttatgaagggttttatgtgtgtgtgtgtattgcctatatttaaacatcttttttctctgtgttctaatgatgaccgtgacaaaaattactttctcctgcgcctataaattcattttaaaggtggaaggatgcataaaaatgtctagtttccgtgtagagtagtattcgtaattcaaatagatggcagcattttaaatgtgctcttttgatgtttttcacaggtcgtggcaattctgcagaagttctattccaacagtgaaagtgcattggggttaaatttcatcaatgagctcatcataaggttccggcactgttctaagtgggttggaaggcaagctttcgctttcatttgtcagattctgaaangacttctttgggattaaagaagtgtatgtttctagaagactgcggaaaacatcatttctttggctgtgactttcttggagcaggcagtggtgagcaaggagtgtgtccccgtggaccagttcatggagcacctgcttcccagcctcctgagcctcgcatcagatcctgtgcccaacgtgagggttctgctagccaaggccctaaggcagatgctgttggaaaaggcgtattttagaaatgctggtaaccctcatcttgaagtcattgaagagaccatcttagcattgcagtcagaccgggaccaagatgtttccttttttgcagccctagaaccaaagcggcggaatatcatagacactgctgtactagaaaaacagaattaactacttccgtgatgagttgcaatctgattatttcatgcttggcacatatggcttaccataacttgaaggggaactgattgtattataccagctgggggagattttggaacctttcatactgtgcactcagtgattgacgccttttccatctgtaccccgaagggactgaacctgatgggggctttttctggatggctgggccatcctgatcaagcctgatcagtaagtctgtggaaagattgcagaccaggtggctaactgggcactggagcctctgaaccatcaggctgtctgccagcaagttcttttctccatggcagactgtatgatctgaagtccccccaaccctctccaagtaaagtagtttattagaagctcttaagtctttaatagacctgcatatttccttcccttatgatttcctataaaatatagtttatggtgttatatttttaactgaaatactgtacatatgtaaataactcttgacaggaagaaaatatattaatgtagtatttgccccctatcagtgagctgaacaaatacatcatttaaatctatgctgcactttgagttgctacaaatatggttcgatttgtttatttttgaaaaatgtgataaagaaatctaaagaatgaaa

SEQ ID NO: 314007 - DNA, 1546 bp, Homo sapiens
  misc_feature (34)..(34): n is a, c, g, or t
  misc_feature (43)..(43): n is a, c, g, or t
tgaaatataaaatcaataataatttttatttttngttcagcanagcctgtgcggagcgagccagagctacctgtggaagggacctcagcgaaaaccagtgattgcccacacagcagtagctcctctgacggcccagcggaaagccctgtggaaagctgtgtgtcggctggagctgagtggaccagggtttccccagagaccagcgcctgctcaaagctttctgacatgaatgacctccccatcagcagctaccctggatcagattcctgggcctgcccagggaacactgaggatgtgttcagtcattttctttattggtgaactcctctccctgacataagcaaggacttagagctgcttctgagtgaggctgggcctcaggaggacgactgcagcagacctggggttgtgcacaacagctgtgtggcccggagtgagattcagaaagtccttggtagcttgcaggagcatctgatgaatgatccagatgttcaagctcaagttcaggtattatccgctgcactgagagctgcacagctcgactgcgtgaatgaagctgagagcaagccaacagcaggcctaaaggaagtgtccatttcacatcccagctctgcctctgacaatcagatcgctctggcggcctcatcatctcaggatgagctctttgtggccaggatattacaaagcccagatccaggtggacccagaaatggaaccagtgaccatctggagactgaccagaggcaggatcccaccccacttgaagagaataaatctaaattacaggatgtaatacctcagccgctgctagatcagtatgtgtccatgactgacccagctcgagcccagactgtcgatactgacatagccaaacactgtgcctacagcctcccaggggtggcactgaccctgggcaggcaaaattggcactgcctgaaagatacatatgaaacactggcttctgatgtacagtggaaggtacggcgagccctagccttctccattcacgagctggctgtgattcttggggatcagttaacagcagctgacctggtgcctatcttcaatggatttttaaaggatctggatgaagtgcgaataggagttcttagacacctgtatgattttctaaagttgcttcatgaagacaagaggagagactatctttatcagcttcaagaatttgtagtgactgataacagcaggaattggaggtttcgatatgaactagcagaacagctgatactgattctggaactctatagtcccaatgatgtttatgattacctaatgcacattgccttaaagttgtgtgcagatcaagtttctgaagttcggtggatctccttcaaactagtaaggaatcagggcatttgctctgtgatttttacaaataggaatgttgatgtatcttccattttaactcttttaatttttctgggcttactttgtcagctaacctatgaaactagcttttaaaatttgaaattaggaactatattatagttttatcaatttgtaggatagctttttttgttatatgttt

SEQ ID NO: 314008 - DNA, 1131 bp, Homo sapiens
  misc_feature (34)..(34): n is a, c, g, or t
  misc_feature (43)..(43): n is a, c, g, or t
tgaaatataaaatcaataataatttttatttttngttcagcanagcctgtgcggagcgagccagagctacctgtggaagggacctcagcgaaaaccagtgattgcccacacagcagtagctcctctgacggcccagcggaaagccctgtggaaagctgtgtgtcggctggagctgagtggaccagggtttccccagagaccagcgcctgctcaaagctttctgacatgaatgacctccccatcagcagctaccctggatcagattcctgggcctgcccagggaacactgaggatgtgttcagtcattttctttattggtgaactcctctccctgacataagcaaggacttagagctgcttctgagtgaggctgggcctcaggaggacgactgcagcagacctggggttgtgcacaacagctgtgtggcccggagtgagattcagaaagtccttggtagcttgcaggagcatctgatgaatgatccagatgttcaagctcaagttcaggtattatccgctgcactgagagctgcacagctcgactgcgtgaatgaagctgagagcaagccaacagcaggcctaaaggaagtgtccatttcacatcccagctctgcctctgacaatcagatcgctctggcggcctcatcatctcaggatgagctctttgtggccaggatattacaaagcccagatccaggtggacccagaaatggaaccagtgaccatctggagactgaccagaggcaggatcccaccccacttgaagagaataaatctaaattacaggatgtaatacctcagccgctgctagatcagtatgtgtccatgactgacccagctcgagcccagactgtcgatactgacatagccaaacactgtgcctacagcctcccaggggtggcactgaccctgggcaggcaaaattggcactgcctgaaagatacatatgaaacactggcttctgatgtacaggtaaaagcctttccagaggcacgtgcagaaagagggtgggtcattcattagggagaaaagggaagctgcagcaaggcttattggcctgaattttatgtggatgcaaattggcatgtttactggtctctgatgaaataaagctttaagtggccaacacct

SEQ ID NO: 314009 - DNA, 482 bp, Homo sapiens
ctgaagccctttggctttaggaaggcctcatgttcctctcacatttctgctttattgttttcacctctaaactccaaactccttgtttttcatgagtattttcctgcattcacgatggcctcctttctctctcatttcccaggatgtaatacctcagccgctgctagatcagtatgtgtccatgactgacccagctcgagcccagactgtcgatactgacatagccaaacactgtgcctacagcctcccaggggtggcactgaccctgggcaggcaaaattggcactgcctgaaagatacatatgaaacactggcttctgatgtacaggtaaaagcctttccagaggcacgtgcagaaagagggtgggtcattcattagggagaaaagggaagctgcagcaaggcttattggcctgaattttatgtggatgcaaattggcatgtttactggtctctgatgaaataaagctttaagtggccaa

SEQ ID NO: 314010 - DNA, 2524 bp, Homo sapiens
  misc_feature (34)..(34): n is a, c, g, or t
  misc_feature (43)..(43): n is a, c, g, or t
  misc_feature (1501)..(1501): n is a, c, g, or t
tgaaatataaaatcaataataatttttatttttngttcagcanagcctgtgcggagcgagccagagctacctgtggaagggacctcagcgaaaaccagtgattgcccacacagcagtagctcctctgacggcccagcggaaagccctgtggaaagctgtgtgtcggctggagctgagtggaccagggtttccccagagaccagcgcctgctcaaagctttctgacatgaatgacctccccatcagcagctaccctggatcagattcctgggcctgcccagggaacactgaggatgtgttcagtcattttctttattggtgaactcctctccctgacataagcaaggacttagagctgcttctgagtgaggctgggcctcaggaggacgactgcagcagacctggggttgtgcacaacagctgtgtggcccggagtgagattcagaaagtccttggtagcttgcaggagcatctgatgaatgatccagatgttcaagctcaagttcaggtattatccgctgcactgagagctgcacagctcgactgcgtgaatgaagctgagagcaagccaacagcaggcctaaaggaagtgtccatttcacatcccagctctgcctctgacaatcagatcgctctggcggcctcatcatctcaggatgagctctttgtggccaggatattacaaagcccagatccaggtggacccagaaatggaaccagtgaccatctggagactgaccagaggcaggatcccaccccacttgaagagaataaatctaaattacaggatgtaatacctcagccgctgctagatcagtatgtgtccatgactgacccagctcgagcccagactgtcgatactgacatagccaaacactgtgcctacagcctcccaggggtggcactgaccctgggcaggcaaaattggcactgcctgaaagatacatatgaaacactggcttctgatgtacagtggaaggtacggcgagccctagccttctccattcacgagctggctgtgattcttggggatcagttaacagcagctgacctggtgcctatcttcaatggatttttaaaggatctggatgaagtgcgaataggagttcttagacacctgtatgattttctaaagttgcttcatgaagacaagaggagagactatctttatcagcttcaagaatttgtagtgactgataacagcaggaattggaggtttcgatatgaactagcagaacagctgatactgattctggaactctatagtcccaatgatgtttatgattacctaatgcacattgccttaaagttgtgtgcagatcaagtttctgaagttcggtggatctccttcaaactagtcgtggcaattctgcagaagttctattccaacagtgaaagtgcattggggttaaatttcatcaatgagctcatcataaggttccggcactgttctaagtgggttggaaggcaagctttcgctttcatttgtcagattctgaaangacttctttgggattaaagaagtgtatgtttctagaagactgcggaaaacatcatttctttggctgtgactttcttggagcaggcagtggtgagcaaggagtgtgtccccgtggaccagttcatggagcacctgcttcccagcctcctgagcctcgcatcagatcctgtgcccaacgtgagggttctgctagccaaggccctaaggcagatgctgttggaaaaggcgtattttagaaatgctggtaaccctcatcttgaagtcattgaagagaccatcttagcattgcagtcagaccgggaccaagatgtttccttttttgcagccctagaaccaaagcggcggaatatcatagacactgctgtactagaaaaacagaattaactacttccgtgatgagttgcaatctgattatttcatgcttggcacatatggcttaccataacttgaaggggaactgattgtattataccagctgggggagattttggaacctttcatactgtgcactcagtgattgacgccttttccatctgtaccccgaagggactgaacctgatgggggctttttctggatggctgggccatcctgatcaagcctgatcagtaagtctgtggaaagattgcagaccaggtggctaactgggcactggagcctctgaaccatcaggctgtctgccagcaagttcttttctccatggcagactgtatgatctgaagtccccccaaccctctccaagtaaagtagtttattagaagctcttaagtctttaatagacctgcatatttccttcccttatgatttcctataaaatatagtttatggtgttatatttttaactgaaatactgtacatatgtaaataactcttgacaggaagaaaatatattaatgtagtatttgccccctatcagtgagctgaacaaatacatcatttaaatctatgctgcactttgagttgctacaaatatggttcgatttgtttatttttgaaaaatgtgataaagaaatctaaagaatgaaa

SEQ ID NO: 314011 - DNA, 310 bp, Homo sapiens
atttgaacactcatcagtaactttgatatatagtgaatccgccttttaggaataccttttctatatagttgtttaaacaccaaaggcattttaagaggtagaatatatggactgatactaatccacacttgtcttttctgatgggagaccagaattctctttagagccaacagaaccagccactgttccaattcccttggaacatttttgttgtatatttacagctccctatgcttaagagaatggtgcatctgtctgatggagacgcctggctgcattctttcccagatattaatataggtggcacttt

SEQ ID NO: 314012 - DNA, 725 bp, Homo sapiens
agcgggggaagggcggccgacccatataagcagcctgcggggcgttccctcgggttgtggttggtgtgcgggtttcggttggaggactcgttggggaggtggcctgcgcttgtagagactgcatccccgagacgatggcggagggagataatcgcagcaccaacctgctggctgcagagactgcaagtctggaagaacagctgcaaggatggggagaagtgatgctgatggctgataaagtcctccgatgggaaagagcctggtttccacctgccatcatgggtgtggtttctttggtgtttctgattatctactatctagatccatctgttctgtccggcgtttcctgttttgttatgtttttgtgcttggctgactaccttgttcccattctagcgcctagaatttttggctccaataaatggaccactgaacaacagcaaagattccatgaaatttgcagcaatctagtaaaaactcgacgcagagctgtgggttggtggaaacgcctcttcacactaaaggaagaaaaacctaagatgtacttcatgaccatgatcgtttcccttgctgcggttgcttgggtgggacaacaagtccacaacctgcttctcacctacctgatagtgacttccttactattgcttcctggactaaaccaacatggaatcattttgaagtacattggaatggccaagagggagataaacaaacttctcaaacaa

SEQ ID NO: 314013 - DNA, 885 bp, Homo sapiens
attacaactgggtccgtacaaccgccggcaagtccagccctttccgaaaagggtgaagatctccccccccatgtctgtcactgcctctgccatcggctgatccttttccagccatagaactcccacaggcatcccatctgacaccaccctgccacgtggatggagatgcactcacgcatgactagaacttgaagggtcttcgcggtgaaggagcgaaggacgcacaccaggatctcggttggaggactcgttggggaggtggcctgcgcttgtagagactgcatccccgagacgatggcggagggagataatcgcagcaccaacctgctggctgcagagactgcaagtctggaagaacagctgcaaggatggggagaagtgatgctgatggctgataaagtcctccgatgggaaagagcctggtttccacctgccatcatgggtgtggtttctttggtgtttctgattatctactatctagatccatctgttctgtccggcgtttcctgttttgttatgtttttgtgcttggctgactaccttgttcccattctagcgcctagaatttttggctccaataaatggaccactgaacaacagcaaagattccatgaaatttgcagcaatctagtaaaaactcgacgcagagctgtgggttggtggaaacgcctcttcacactaaaggaagaaaaacctaagatgtacttcatgaccatgatcgtttcccttgctgcggttgcttgggtgggacaacaagtccacaacctgcttctcacctacctgatagtgacttccttactattgcttcctggactaaaccaacatggaatcattttgaagtacattggaatggccaagagggagataaacaaacttctcaaacaa

SEQ ID NO: 314014 - DNA, 329 bp, Homo sapiens
  misc_feature (50)..(50): n is a, c, g, or t
tccttttcctatcacatcatatattcactccgtacccacgctaccattcnctcctctgtccctattaaataagtgttgttttctcctctttaatattgctgtgaacagtggtgcccattgtagcatatgtttgatttttttttattatttcataagaaaactacgttaattttaccttactttcattgtaaataagcctgtcttcctatctggattttttgtgtgcatacatattctactgattaactacttttgcagttttaatcctgtattatttcttctactttgttttgtgtaaaaggggaaaaaataaaaaaagctggaatctt

SEQ ID NO: 314015 - DNA, 835 bp, Homo sapiens
agcgggggaagggcggccgacccatataagcagcctgcggggcgttccctcgggttgtggttggtgtgcgggtttcggttggaggactcgttggggaggtggcctgcgcttgtagagactgcatccccgagacgatggcggagggagataatcgcagcaccaacctgctggctgcagagactgcaagtctggaagaacagctgcaaggatggggagaagtgatgctgatggctgataaagtcctccgatgggaaagagcctggtttccacctgccatcatgggtgtggtttctttggtgtttctgtaagtgagctattagattactatgggttgtgcttcttattaataaagactttttaatatatagcttctgtttgtgggagtgccttaagtcttctgtaatatataacccataaagaacccataaagaatgtttctcataagcacttctagtttccagaatttgtagtacttctgtaaacttggtaacctaaagcacttgagtaaatcagtgactcgcaaactttttgtcctccagacacttaaatttttttttgttattatactttaagttctgggatacatgtgtagaatgtacaggtttgttacataggtatatatacatgtgccatggtggtttgctgcacccatcaacccttcatctacattaggtatttctcctaatgctatccctcccctagtcccccacctccctaaactcttaaaaaagtgctgagaactccaaagagcttttgtccattgatatatacttaaccactgcagctatgatatcagcatgtcacaaagcctctggaaagccacttgtgagaaaat

SEQ ID NO: 314016 - DNA, 2413 bp, Homo sapiens
  misc_feature (2362)..(2362): n is a, c, g, or t
  misc_feature (2381)..(2381): n is a, c, g, or t
  misc_feature (2405)..(2405): n is a, c, g, or t
agcgggggaagggcggccgacccatataagcagcctgcggggcgttccctcgggttgtggttggtgtgcgggtttcggttggaggactcgttggggaggtggcctgcgcttgtagagactgcatccccgagacgatggcggagggagataatcgcagcaccaacctgctggctgcagagactgcaagtctggaagaacagctgcaaggatggggagaagtgatgctgatggctgataaagtcctccgatgggaaagagcctggtttccacctgccatcatgggtgtggtttctttggtgtttctgattatctactatctagatccatctgttctgtccggcgtttcctgttttgttatgtttttgtgcttggctgactaccttgttcccattctagcgcctagaatttttggctccaataaatggaccactgaacaacagcaaagattccatgaaatttgcagcaatctagtaaaaactcgacgcagagctgtgggttggtggaaacgcctcttcacactaaaggaagaaaaacctaagatgtacttcatgaccatgatcgtttcccttgctgcggttgcttgggtgggacaacaagtccacaacctgcttctcacctacctgatagtgacttccttactattgcttcctggactaaaccaacatggaatcattttgaagtacattggaatggccaagagggagataaacaaacttctcaaacaaaaagaaaagaaaaacgaatgattcatctgctttaatcagtgtgattaatgcagcacccattgccccgggaaccgtttctgctgtactatctggatactaaaatgttacggaagtagctctttgttctccctcactctgcccttagttaatagaaattcagactcgccaagtaaggcttcgtgcatagtgtcttcatgtcgcgtatagttgagcgcgttcttagcagttggcttcatggacaactcattagtgttttgacttttcttacccagcgttaattgaattcttgcttttagacaacttcctttttgtagtggtgaaccttgccctttagtacagttcaagtgaatctggataattgttcatctttgctttagcttagataccatgtagtggtctgtggctacaggaagctggttctgtctgcttccacagtctgcttaaaaaactgtctgacttcgtgaatatagagaccaagtttaccacttctgatgaagagaccaattaagattcattcctcattctgtttctttccagtgggagaagagtccccatgaaataagatgaaactgattccatgcactagtacatgtaggcttctcccttgtgcaaagcttagcaatttgtaggaaactttgatctttttgtccaagaaaaggaatgtctgacaggcttaagctttcgtccccttgcacttagactcgaagttagtaaatccttaaaggctttttaatagcagacttccaaaagattgcatttaggatttctagcatgcttttaatttcagattttcagctgacattagctatagtatacagtaggttaagactcatgtctatgactttcactctaagactggcaaaaggacagcagtcttctatgtttagtcaatattcatttcagtagaagataatcttatctaatttttgagaccagaataagccttttaaggtaaacctcaaaattatcattttatggtaatactgaccattttagtcccctaggtttgacatgggagatagtgactacactggtgtctgacttttttcctagagatttctccctgaaaaatacaagggctgttggtgagagcagacttgaggtgatgatagttggcctctggtctacaaagatttcataactccttggaaagcttcttataatcattcttaacttcttggtagctagaaatttagagtagttgcaatctttaggaatgaacttctgagggccaaaaaatgtgactgacgggaacaattcttaaactgattaactagctgtaatatagttttgtgaatttattgcactgatgttgtaccttgtggtatatctgtccctattaaataagtgttgttttctcctctttaatattgctgtgaacagtggtgcccattgtagcatatgtttgatttttttttattatttcataagaaaactacgttaattttaccttactttcattgtaaataagcctgtcttcctatctggattttttgtgtgcatacatattctactgattaactacttttgcagttttaatcctgtattatttcttctactttgttttgtgtaaaaggggaaaaaataaaaaaagctggaatcttaaaaaaaaaaaaaaaaaaaaaaaaaaaaaaaanctcgggggggggccccggnccccaattcggccctatagggggngccgggtt

SEQ ID NO: 314017 - DNA, 2329 bp, Homo sapiens
agcgggggaagggcggccgacccatataagcagcctgcggggcgttccctcgggttgtggttggtgtgcgggtttcggttggaggactcgttggggaggtggcctgcgcttgtagagactgcatccccgagacgatggcggagggagataatcgcagcaccaacctgctggctgcagagactgcaagtctggaagaacagctgcaaggatggggagaagtgatgctgatggctgataaagtcctccgatgggaaagagcctggtttccacctgccatcatgggtgtggtttctttggtgtttctgattatctactatctagatccatctgttctgtccggcgtttcctgttttgttatgtttttgtgcttggctgactaccttgttcccattctagcgcctagaatttttggctccaataaatggaccactgaacaacagcaaagattccatgaaatttgcagcaatctagtaaaaactcgacgcagagctgtgggttggtggaaacgcctcttcacactaaaggaagaaaaacctaagatgtacttcatgaccatgatcgtttcccttgctgcggttgcttgggtgggacaacaagtccacaacctgcttctcacctacctgatagtgacttccttactattgcttcctggactaaaccaacatggaatcattttgaagtacattggaatggccaagagggagataaacaaacttctcaaacaaaaagaaaagaaaaacgaatgattcatctgctttaatcagtgtgattaatgcagcacccattgccccgggaaccgtttctgctgtactatctggatactaaaatgttacggaagtagctctttgttctccctcactctgcccttagttaatagaaattcagactcgccaagtaaggcttcgtgcatagtgtcttcatgtcgcgtatagttgagcgcgttcttagcagttggcttcatggacaactcattagtgttttgacttttcttacccagcgttaattgaattcttgcttttagacaacttcctttttgtagtggtgaaccttgccctttagtacagttcaagtgaatctggataattgttcatctttgctttagcttagataccatgtagtggtctgtggctacaggaagctggttctgtctgcttccacagtctgcttaaaaaactgtctgacttcgtgaatatagagaccaagtttaccacttctgatgaagagaccaattaagattcattcctcattctgtttctttccagtgggagaagagtccccatgaaataagatgaaactgattccatgcactagtacatgtaggcttctcccttgtgcaaagcttagcaatttgtaggaaactttgatctttttgtccaagaaaaggaatgtctgacaggcttaagctttcgtccccttgcacttagactcgaagttagtaaatccttaaaggctttttaatagcagacttccaaaagattgcatttaggatttctagcatgcttttaatttcagattttcagctgacattagctatagtatacagtaggttaagactcatgtctatgactttcactctaagactggcaaaaggacagcagtcttctatgtttagtcaatattcatttcagtagaagataatcttatctaatttttgagaccagaataagccttttaaggtaaacctcaaaattatcattttatggtaatactgaccattttagtcccctaggtttgacatgggagatagtgactacactggtgtctgacttttttcctagagatttctccctgaaaaatacaagggctgttggtgagagcagacttgaggtgatgatagttggcctctggtctacaaagatttcataactccttggaaagcttcttataatcattcttaacttcttggtagctagaaatttagagtagttgcaatctttaggaatgaacttctgagggccaaaaaatgtgactgacgggaacaattcttaaactgattaactagctgtaatatagttttgtgaatttattgcactgatgttgtaccttgtggtatatctgtccctattaaataagtgttgttttctcctctttaatattgctgtgaacagtggtgcccattgtagcatatgtttgatttttttttattatttcataagaaaactacgttaattttaccttactttcattgtaaataagcctgtcttcctatctggattttttgtgtgcatacatattctactgattaactacttttgcagttttaatcctgtattatttcttctactttgttttgtgtaaaaggggaaaaaataaaaaaagctggaatctt

SEQ ID NO: 314018 - DNA, 2817 bp, Homo sapiens
  misc_feature (2530)..(2531): n is a, c, g, or t
attacaactgggtccgtacaaccgccggcaagtccagccctttccgaaaagggtgaagatctccccccccatgtctgtcactgcctctgccatcggctgatccttttccagccatagaactcccacaggcatcccatctgacaccaccctgccacgtggatggagatgcactcacgcatgactagaacttgaagggtcttcgcggtgaaggagcgaaggacgcacaccaggatctcggttggaggactcgttggggaggtggcctgcgcttgtagagactgcatccccgagacgatggcggagggagataatcgcagcaccaacctgctggctgcagagactgcaagtctggaagaacagctgcaaggatggggagaagtgatgctgatggctgataaagtcctccgatgggaaagagcctggtttccacctgccatcatgggattatctactatctagatccatctgttctgtccggcgtttcctgttttgttatgtttttgtgcttggctgactaccttgttcccattctagcgcctagaatttttggctccaataaatggaccactgaacaacagcaaagattccatgaaatttgcagcaatctagtaaaaactcgacgcagagctgtgggttggtggaaacgcctcttcacactaaaggaagaaaaacctaagatgtacttcatgaccatgatcgtttcccttgctgcggttgcttgggtgggacaacaagtccacaacctgcttctcacctacctgatagtgacttccttactattgcttcctggactaaaccaacatggaatcattttgaagtacattggaatggccaagagggagataaacaaacttctcaaacaaaaagaaaagaaaaacgaatgattcatctgctttaatcagtgtgattaatgcagcacccattgccccgggaaccgtttctgctgtactatctggatactaaaatgttacggaagtagctctttgttctccctcactctgcccttagttaatagaaattcagactcgccaagtaaggcttcgtgcatagtgtcttcatgtcgcgtatagttgagcgcgttcttagcagttggcttcatggacaactcattagtgttttgacttttcttacccagcgttaattgaattcttgcttttagacaacttcctttttgtagtggtgaaccttgccctttagtacagttcaagtgaatctggataattgttcatctttgctttagcttagataccatgtagtggtctgtggctacaggaagctggttctgtctgcttccacagtctgcttaaaaaactgtctgacttcgtgaatatagagaccaagtttaccacttctgatgaagagaccaattaagattcattcctcattctgtttctttccagtgggagaagagtccccatgaaataagatgaaactgattccatgcactagtacatgtaggcttctcccttgtgcaaagcttagcaatttgtaggaaactttgatctttttgtccaagaaaaggaatgtctgacaggcttaagctttcgtccccttgcacttagactcgaagttagtaaatccttaaaggctttttaatagcagacttccaaaagattgcatttaggatttctagcatgcttttaatttcagattttcagctgacattagctatagtatacagtaggttaagactcatgtctatgactttcactctaagactggcaaaaggacagcagtcttctatgtttagtcaatattcatttcagtagaagataatcttatctaatttttgagaccagaataagccttttaaggtaaacctcaaaattatcattttatggtaatactgaccattttagtcccctaggtttgacatgggagatagtgactacactggtgtctgacttttttcctagagatttctccctgaaaaatacaagggctgttggtgagagcagacttgaggtgatgatagttggcctctggtctacaaagatttcataactccttggaaagcttcttataatcattcttaacttcttggtagctagaaatttagagtagttgcaatctttaggaatgaacttctgagggccaaaaaatgtgactgacgggaacaattcttaaactgattaactagctgtaatatagttttgtgaatttattgcactgatgttgtaccttgtggtatatctgtccctattaaataagtgttgttttctcctctttaatattgctgtgaacagtggtgcccattgtagcatatgtttgatttttttttattatttcataagaaaactacgttaattttaccttactttcattgtaaataagcctgtcttcctatctggattttttgtgtgcatacatattctactgattaactacttttgcagttttaatcctgtattatttcttctactttgttttgtgtaaaaggggaaaaaataaaaaaagctggaatcttaaaaaaaaaaaaaaaaaaaaaaaaaaaaaaaaaaaaagaaaaaagaaaaaaaaaaaaaaaaanncaagaaaaaaaaacaaaaagaaaaacaaaaaaacaaacgaaaaataaaatggagtacaataaaaatcagaacaaagatgaaaaaaaagaggggggcgggccgccgacaagaaaatccatgcgaactccgcggaaggaggaccagaaaagacaacgcaacaacagaagtatattaggaagaggaagacgcagacccacaaagaggagaaaatatatataaaaaaacgacagagcggcgcgcctctataaaacaacacgggagaagaaacaaaacgagcggggtgctt

SEQ ID NO: 314019 - DNA, 2653 bp, Homo sapiens
  misc_feature (2366)..(2367): n is a, c, g, or t
agcgggggaagggcggccgacccatataagcagcctgcggggcgttccctcgggttgtggttggtgtgcgggtttcggttggaggactcgttggggaggtggcctgcgcttgtagagactgcatccccgagacgatggcggagggagataatcgcagcaccaacctgctggctgcagagactgcaagtctggaagaacagctgcaaggatggggagaagtgatgctgatggctgataaagtcctccgatgggaaagagcctggtttccacctgccatcatgggtgtggtttctttggtgtttctgattatctactatctagatccatctgttctgtccggcgtttcctgttttgttatgtttttgtgcttggctgactaccttgttcccattctagcgcctagaatttttggctccaataaatggaccactgaacaacagcaaagattccatgaaatttgcagcaatctagtaaaaactcgacgcagagctgtgggttggtggaaacgcctcttcacactaaaggaagaaaaacctaagatgtacttcatgaccatgatcgtttcccttgctgcggttgcttgggtgggacaacaagtccacaacctgcttctcacctacctgatagctaaaccaacatggaatcattttgaagtacattggaatggccaagagggagataaacaaacttctcaaacaaaaagaaaagaaaaacgaatgattcatctgctttaatcagtgtgattaatgcagcacccattgccccgggaaccgtttctgctgtactatctggatactaaaatgttacggaagtagctctttgttctccctcactctgcccttagttaatagaaattcagactcgccaagtaaggcttcgtgcatagtgtcttcatgtcgcgtatagttgagcgcgttcttagcagttggcttcatggacaactcattagtgttttgacttttcttacccagcgttaattgaattcttgcttttagacaacttcctttttgtagtggtgaaccttgccctttagtacagttcaagtgaatctggataattgttcatctttgctttagcttagataccatgtagtggtctgtggctacaggaagctggttctgtctgcttccacagtctgcttaaaaaactgtctgacttcgtgaatatagagaccaagtttaccacttctgatgaagagaccaattaagattcattcctcattctgtttctttccagtgggagaagagtccccatgaaataagatgaaactgattccatgcactagtacatgtaggcttctcccttgtgcaaagcttagcaatttgtaggaaactttgatctttttgtccaagaaaaggaatgtctgacaggcttaagctttcgtccccttgcacttagactcgaagttagtaaatccttaaaggctttttaatagcagacttccaaaagattgcatttaggatttctagcatgcttttaatttcagattttcagctgacattagctatagtatacagtaggttaagactcatgtctatgactttcactctaagactggcaaaaggacagcagtcttctatgtttagtcaatattcatttcagtagaagataatcttatctaatttttgagaccagaataagccttttaaggtaaacctcaaaattatcattttatggtaatactgaccattttagtcccctaggtttgacatgggagatagtgactacactggtgtctgacttttttcctagagatttctccctgaaaaatacaagggctgttggtgagagcagacttgaggtgatgatagttggcctctggtctacaaagatttcataactccttggaaagcttcttataatcattcttaacttcttggtagctagaaatttagagtagttgcaatctttaggaatgaacttctgagggccaaaaaatgtgactgacgggaacaattcttaaactgattaactagctgtaatatagttttgtgaatttattgcactgatgttgtaccttgtggtatatctgtccctattaaataagtgttgttttctcctctttaatattgctgtgaacagtggtgcccattgtagcatatgtttgatttttttttattatttcataagaaaactacgttaattttaccttactttcattgtaaataagcctgtcttcctatctggattttttgtgtgcatacatattctactgattaactacttttgcagttttaatcctgtattatttcttctactttgttttgtgtaaaaggggaaaaaataaaaaaagctggaatcttaaaaaaaaaaaaaaaaaaaaaaaaaaaaaaaaaaaaagaaaaaagaaaaaaaaaaaaaaaaanncaagaaaaaaaaacaaaaagaaaaacaaaaaaacaaacgaaaaataaaatggagtacaataaaaatcagaacaaagatgaaaaaaaagaggggggcgggccgccgacaagaaaatccatgcgaactccgcggaaggaggaccagaaaagacaacgcaacaacagaagtatattaggaagaggaagacgcagacccacaaagaggagaaaatatatataaaaaaacgacagagcggcgcgcctctataaaacaacacgggagaagaaacaaaacgagcggggtgctt

SEQ ID NO: 314020 - DNA, 2399 bp, Homo sapiens
  misc_feature (2112)..(2113): n is a, c, g, or t
agcgggggaagggcggccgacccatataagcagcctgcggggcgttccctcgggttgtggttggtgtgcgggtttcggttggaggactcgttggggaggtggcctgcgcttgtagagactgcatccccgagacgatggcggagggagataatcgcagcaccaacctgctggctgcagagactgcaagtctggaagaacgaccactgaacaacagcaaagattccatgaaatttgcagcaatctagtaaaaactcgacgcagagctgtgggttggtggaaacgcctcttcacactaaaggaagaaaaacctaagatgtacttcatgaccatgatcgtttcccttgctgcggttgcttgggtgggacaacaagtccacaacctgcttctcacctacctgatagtgacttccttactattgcttcctggactaaaccaacatggaatcattttgaagtacattggaatggccaagagggagataaacaaacttctcaaacaaaaagaaaagaaaaacgaatgattcatctgctttaatcagtgtgattaatgcagcacccattgccccgggaaccgtttctgctgtactatctggatactaaattcagactcgccaagtaaggcttcgtgcatagtgtcttcatgtcgcgtatagttgagcgcgttcttagcagttggcttcatggacaactcattagtgttttgacttttcttacccagcgttaattgaattcttgcttttagacaacttcctttttgtagtggtgaaccttgccctttagtacagttcaagtgaatctggataattgttcatctttgctttagcttagataccatgtagtggtctgtggctacaggaagctggttctgtctgcttccacagtctgcttaaaaaactgtctgacttcgtgaatatagagaccaagtttaccacttctgatgaagagaccaattaagattcattcctcattctgtttctttccagtgggagaagagtccccatgaaataagatgaaactgattccatgcactagtacatgtaggcttctcccttgtgcaaagcttagcaatttgtaggaaactttgatctttttgtccaagaaaaggaatgtctgacaggcttaagctttcgtccccttgcacttagactcgaagttagtaaatccttaaaggctttttaatagcagacttccaaaagattgcatttaggatttctagcatgcttttaatttcagattttcagctgacattagctatagtatacagtaggttaagactcatgtctatgactttcactctaagactggcaaaaggacagcagtcttctatgtttagtcaatattcatttcagtagaagataatcttatctaatttttgagaccagaataagccttttaaggtaaacctcaaaattatcattttatggtaatactgaccattttagtcccctaggtttgacatgggagatagtgactacactggtgtctgacttttttcctagagatttctccctgaaaaatacaagggctgttggtgagagcagacttgaggtgatgatagttggcctctggtctacaaagatttcataactccttggaaagcttcttataatcattcttaacttcttggtagctagaaatttagagtagttgcaatctttaggaatgaacttctgagggccaaaaaatgtgactgacgggaacaattcttaaactgattaactagctgtaatatagttttgtgaatttattgcactgatgttgtaccttgtggtatatctgtccctattaaataagtgttgttttctcctctttaatattgctgtgaacagtggtgcccattgtagcatatgtttgatttttttttattatttcataagaaaactacgttaattttaccttactttcattgtaaataagcctgtcttcctatctggattttttgtgtgcatacatattctactgattaactacttttgcagttttaatcctgtattatttcttctactttgttttgtgtaaaaggggaaaaaataaaaaaagctggaatcttaaaaaaaaaaaaaaaaaaaaaaaaaaaaaaaaaaaaagaaaaaagaaaaaaaaaaaaaaaaanncaagaaaaaaaaacaaaaagaaaaacaaaaaaacaaacgaaaaataaaatggagtacaataaaaatcagaacaaagatgaaaaaaaagaggggggcgggccgccgacaagaaaatccatgcgaactccgcggaaggaggaccagaaaagacaacgcaacaacagaagtatattaggaagaggaagacgcagacccacaaagaggagaaaatatatataaaaaaacgacagagcggcgcgcctctataaaacaacacgggagaagaaacaaaacgagcggggtgctt

SEQ ID NO: 314021 - DNA, 1995 bp, Homo sapiens
  misc_feature (1708)..(1709): n is a, c, g, or t
ctcgtgccgaattcggcacgagcctaaaccaacatggaatcattttgaagtacattggaatggccaagagggagataaacaaacttctcaaacaaaaagaaaagaaaaacgaatgattcatctgctttaatcagtgtgattaatgcagcacccattgccccgggaaccgtttctgctgtactatctggatactaaattcagactcgccaagtaaggcttcgtgcatagtgtcttcatgtcgcgtatagttgagcgcgttcttagcagttggcttcatggacaactcattagtgttttgacttttcttacccagcgttaattgaattcttgcttttagacaacttcctttttgtagtggtgaaccttgccctttagtacagttcaagtgaatctggataattgttcatctttgctttagcttagataccatgtagtggtctgtggctacaggaagctggttctgtctgcttccacagtctgcttaaaaaactgtctgacttcgtgaatatagagaccaagtttaccacttctgatgaagagaccaattaagattcattcctcattctgtttctttccagtgggagaagagtccccatgaaataagatgaaactgattccatgcactagtacatgtaggcttctcccttgtgcaaagcttagcaatttgtaggaaactttgatctttttgtccaagaaaaggaatgtctgacaggcttaagctttcgtccccttgcacttagactcgaagttagtaaatccttaaaggctttttaatagcagacttccaaaagattgcatttaggatttctagcatgcttttaatttcagattttcagctgacattagctatagtatacagtaggttaagactcatgtctatgactttcactctaagactggcaaaaggacagcagtcttctatgtttagtcaatattcatttcagtagaagataatcttatctaatttttgagaccagaataagccttttaaggtaaacctcaaaattatcattttatggtaatactgaccattttagtcccctaggtttgacatgggagatagtgactacactggtgtctgacttttttcctagagatttctccctgaaaaatacaagggctgttggtgagagcagacttgaggtgatgatagttggcctctggtctacaaagatttcataactccttggaaagcttcttataatcattcttaacttcttggtagctagaaatttagagtagttgcaatctttaggaatgaacttctgagggccaaaaaatgtgactgacgggaacaattcttaaactgattaactagctgtaatatagttttgtgaatttattgcactgatgttgtaccttgtggtatatctgtccctattaaataagtgttgttttctcctctttaatattgctgtgaacagtggtgcccattgtagcatatgtttgatttttttttattatttcataagaaaactacgttaattttaccttactttcattgtaaataagcctgtcttcctatctggattttttgtgtgcatacatattctactgattaactacttttgcagttttaatcctgtattatttcttctactttgttttgtgtaaaaggggaaaaaataaaaaaagctggaatcttaaaaaaaaaaaaaaaaaaaaaaaaaaaaaaaaaaaaagaaaaaagaaaaaaaaaaaaaaaaanncaagaaaaaaaaacaaaaagaaaaacaaaaaaacaaacgaaaaataaaatggagtacaataaaaatcagaacaaagatgaaaaaaaagaggggggcgggccgccgacaagaaaatccatgcgaactccgcggaaggaggaccagaaaagacaacgcaacaacagaagtatattaggaagaggaagacgcagacccacaaagaggagaaaatatatataaaaaaacgacagagcggcgcgcctctataaaacaacacgggagaagaaacaaaacgagcggggtgctt

SEQ ID NO: 314022 - DNA, 1102 bp, Homo sapiens
  misc_feature (815)..(816): n is a, c, g, or t
ccgccctcttgtgggggtgtttatttaaagcggtgtcggcgatccggatatgtcgacagcgtcgtatctaatttttgagaccagaataagccttttaaggtaaacctcaaaattatcattttatggtaatactgaccattttagtcccctaggtttgacatgggagatagtgactacactggtgtctgacttttttcctagagatttctccctgaaaaatacaagggctgttggtgagagcagacttgaggtgatgatagttggcctctggtctacaaagatttcataactccttggaaagcttcttataatcattcttaacttcttggtagctagaaatttagagtagttgcaatctttaggaatgaacttctgagggccaaaaaatgtgactgacgggaacaattcttaaactgattaactagctgtaatatagttttgtgaatttattgcactgatgttgtaccttgtggtatatctgtccctattaaataagtgttgttttctcctctttaatattgctgtgaacagtggtgcccattgtagcatatgtttgatttttttttattatttcataagaaaactacgttaattttaccttactttcattgtaaataagcctgtcttcctatctggattttttgtgtgcatacatattctactgattaactacttttgcagttttaatcctgtattatttcttctactttgttttgtgtaaaaggggaaaaaataaaaaaagctggaatcttaaaaaaaaaaaaaaaaaaaaaaaaaaaaaaaaaaaaagaaaaaagaaaaaaaaaaaaaaaaanncaagaaaaaaaaacaaaaagaaaaacaaaaaaacaaacgaaaaataaaatggagtacaataaaaatcagaacaaagatgaaaaaaaagaggggggcgggccgccgacaagaaaatccatgcgaactccgcggaaggaggaccagaaaagacaacgcaacaacagaagtatattaggaagaggaagacgcagacccacaaagaggagaaaatatatataaaaaaacgacagagcggcgcgcctctataaaacaacacgggagaagaaacaaaacgagcggggtgctt

SEQ ID NO: 314023 - DNA, 622 bp, Homo sapiens
agcgggggaagggcggccgacccatataagcagcctgcggggcgttccctcgggttgtggttggtgtgcgggtttcggttggaggactcgttggggaggtggcctgcgcttgtagagactgcatccccgagacgatggcggagggagataatcgcagcaccaacctgctggctgcagagactgcaagtctggaagaacagctgcaaggatggggagaagtgatgctgatggctgataaagtcctccgatgggaaagagcctggtttccacctgccatcatgggtgtggtttctttggtgtttctgattatctactatctagatccatctgttctgtccggcgtttcctgttttgttatgtttttgtgcttggctgactaccttgttcccattctagcgcctagaatttttggctccaataaatggaccactgaacaacagcaaagattccatgaaatttgcagcaatctagtaaaaactcgacgcagagctgtgggttggtggaaacgcctcttcacactaaaggaagaaaaacctaagatgcaacagcaaagattccatgaaatttgcagcaatctagtaaaaactcgacgcagagctgtgggtcggtggaaacgcctcta

SEQ ID NO: 314024 - DNA, 422 bp, Homo sapiens
  misc_feature (3)..(3): n is a, c, g, or t
  misc_feature (8)..(9): n is a, c, g, or t
  misc_feature (16)..(16): n is a, c, g, or t
  misc_feature (18)..(18): n is a, c, g, or t
  misc_feature (20)..(20): n is a, c, g, or t
  misc_feature (30)..(30): n is a, c, g, or t
  misc_feature (34)..(34): n is a, c, g, or t
  misc_feature (47)..(47): n is a, c, g, or t
  misc_feature (54)..(54): n is a, c, g, or t
  misc_feature (58)..(58): n is a, c, g, or t
  misc_feature (63)..(63): n is a, c, g, or t
  misc_feature (73)..(74): n is a, c, g, or t
  misc_feature (76)..(76): n is a, c, g, or t
  misc_feature (78)..(79): n is a, c, g, or t
  misc_feature (83)..(83): n is a, c, g, or t
  misc_feature (87)..(87): n is a, c, g, or t
  misc_feature (91)..(91): n is a, c, g, or t
  misc_feature (93)..(94): n is a, c, g, or t
  misc_feature (100)..(100): n is a, c, g, or t
  misc_feature (104)..(104): n is a, c, g, or t
  misc_feature (112)..(113): n is a, c, g, or t
  misc_feature (119)..(119): n is a, c, g, or t
  misc_feature (130)..(130): n is a, c, g, or t
  misc_feature (132)..(132): n is a, c, g, or t
  misc_feature (159)..(160): n is a, c, g, or t
tanccccnncgcccantntngggaattgancggnaaaaaattccacnggaaaancctngcctngtttccccanngngnntttncccncccntnngggganaaanggtggggnncccccnggtgggggccncncttggacttgtgggtcccccgggttgnnggaattcggcacgagctcctctttaatattgctgtgaacagtggtgcccattgtagcatatgtttgatttttttttattatttcataagaaaactacgttaattttaccttactttcattgtaaataagcctgtcttcctatctggattttttgtgtgcatacatattctactgattaactacttttgcagttttaatcctgtattatttcttctactttgttttgtgtaaaaggggaaaaaataaaaaaagctggaatctt

SEQ ID NO: 314025 - DNA, 797 bp, Homo sapiens
atagcaaaaggcaaatttcttttctagggaccactgaacaacagcaaagattccatgaaatttgcagcaatctagtaaaaactcgacgcagagctgtgggttggtggaaacgcctcttcacactaaaggaagaaaaacctaagatgatggtactttttttgctttgacttaagtacagtaaaattttaagatttgagtcaattcgcctttttgtcttaatagctataatttgaaaattattcattggttaattcctaagtacattcataaatgtttacctgtattaattagactgaatcattttaaagttaaaaattacatttttgcatttaattttttattctaataaaacaaaattcttctgtttcatttttcttactgaaataatagtaaaagacatatacttagaaagcatctgtttaggccgggcacagtggctaatgcctataatcccagctacatggaaggctgaggatcacttgagccctggaggtcgaggctgcagtgagctgtgtttgcgcagtgagctgtttgcaccactgcactccagcctttgtgacagaatgagactctgtctcaaaaaaaaaagctgttccgtgaagttattaactgaaaagatcgtataatttatatcataaaatatttacatacagaattgcagtaattctaggaagaaatgtatccaaattctataaagtagatccaatggaataggtttttaaatctaagaatttttaaagaaaagtgataataaaagctaaattatttcccgaactttgaaacacattcttctttaa

SEQ ID NO: 314026 - DNA, 693 bp, Homo sapiens
agcgggggaagggcggccgacccatataagcagcctgcggggcgttccctcgggttgtggttggtgtgcgggtttcggttggaggactcgttggggaggtggcctgcgcttgtagagactgcatccccgagacgatggcggagggagataatcgcagcaccaacctgctggctgcagagactgcaagtctggaagaacagctgcaaggatggggagaagtgatgctgatggctgataaagtcctccgatgggaaagagcctggtttccacctgccatcatgggtgtggtttctttggtgtttctgattatctactatctagatccatctgttctgtccggcgtttcctgttttgttatgtttttgtgcttggctgactaccttgttcccattctagcgcctagaatttttggctccaataaatggaccactgaacaacagcaaagattccatgaaatttgcagcaatctagtaaaaactcgacgcagagctgtgggttggtggaaacgcctcttcacactaaaggaagaaaaacctaagatgtacttcatgaccatgatcgtttcccttgctgcggttgcttgggtgggacaacaagtccacaacctgcttctcacctacctgatagaccctaaccctggaataagtggaactttcccttaactaatttgcctttccctggggaacctaaaaa

SEQ ID NO: 314027 - DNA, 2679 bp, Homo sapiens
  misc_feature (2392)..(2393): n is a, c, g, or t
agcgggggaagggcggccgacccatataagcagcctgcggggcgttccctcgggttgtggttggtgtgcgggtttcggttggaggactcgttggggaggtggcctgcgcttgtagagactgcatccccgagacgatggcggagggagataatcgcagcaccaacctgctggctgcagagactgcaagtctggaagaacagctgcaaggatggggagaagtgatgctgatggctgataaagtcctccgatgggaaagagcctggtttccacctgccatcatgggtgtggtttctttggtgtttctgattatctactatctagatccatctgttctgtccggcgtttcctgttttgttatgtttttgtgcttggctgactaccttgttcccattctagcgcctagaatttttggctccaataaatggaccactgaacaacagcaaagattccatgaaatttgcagcaatctagtaaaaactcgacgcagagctgtgggttggtggaaacgcctcttcacactaaaggaagaaaaacctaagatgtacttcatgaccatgatcgtttcccttgctgcggttgcttgggtgggacaacaagtccacaacctgcttctcacctacctgatagtgacttccttactattgcttcctggactaaaccaacatggaatcattttgaagtacattggaatggccaagagggagataaacaaacttctcaaacaaaaagaaaagaaaaacgaatgattcatctgctttaatcagtgtgattaatgcagcacccattgccccgggaaccgtttctgctgtactatctggatactaaaatgttacggaagtagctctttgttctccctcactctgcccttagttaatagaaattcagactcgccaagtaaggcttcgtgcatagtgtcttcatgtcgcgtatagttgagcgcgttcttagcagttggcttcatggacaactcattagtgttttgacttttcttacccagcgttaattgaattcttgcttttagacaacttcctttttgtagtggtgaaccttgccctttagtacagttcaagtgaatctggataattgttcatctttgctttagcttagataccatgtagtggtctgtggctacaggaagctggttctgtctgcttccacagtctgcttaaaaaactgtctgacttcgtgaatatagagaccaagtttaccacttctgatgaagagaccaattaagattcattcctcattctgtttctttccagtgggagaagagtccccatgaaataagatgaaactgattccatgcactagtacatgtaggcttctcccttgtgcaaagcttagcaatttgtaggaaactttgatctttttgtccaagaaaaggaatgtctgacaggcttaagctttcgtccccttgcacttagactcgaagttagtaaatccttaaaggctttttaatagcagacttccaaaagattgcatttaggatttctagcatgcttttaatttcagattttcagctgacattagctatagtatacagtaggttaagactcatgtctatgactttcactctaagactggcaaaaggacagcagtcttctatgtttagtcaatattcatttcagtagaagataatcttatctaatttttgagaccagaataagccttttaaggtaaacctcaaaattatcattttatggtaatactgaccattttagtcccctaggtttgacatgggagatagtgactacactggtgtctgacttttttcctagagatttctccctgaaaaatacaagggctgttggtgagagcagacttgaggtgatgatagttggcctctggtctacaaagatttcataactccttggaaagcttcttataatcattcttaacttcttggtagctagaaatttagagtagttgcaatctttaggaatgaacttctgagggccaaaaaatgtgactgacgggaacaattcttaaactgattaactagctgtaatatagttttgtgaatttattgcactgatgttgtaccttgtggtatatctgtccctattaaataagtgttgttttctcctctttaatattgctgtgaacagtggtgcccattgtagcatatgtttgatttttttttattatttcataagaaaactacgttaattttaccttactttcattgtaaataagcctgtcttcctatctggattttttgtgtgcatacatattctactgattaactacttttgcagttttaatcctgtattatttcttctactttgttttgtgtaaaaggggaaaaaataaaaaaagctggaatcttaaaaaaaaaaaaaaaaaaaaaaaaaaaaaaaaaaaaagaaaaaagaaaaaaaaaaaaaaaaanncaagaaaaaaaaacaaaaagaaaaacaaaaaaacaaacgaaaaataaaatggagtacaataaaaatcagaacaaagatgaaaaaaaagaggggggcgggccgccgacaagaaaatccatgcgaactccgcggaaggaggaccagaaaagacaacgcaacaacagaagtatattaggaagaggaagacgcagacccacaaagaggagaaaatatatataaaaaaacgacagagcggcgcgcctctataaaacaacacgggagaagaaacaaaacgagcggggtgctt

SEQ ID NO: 314028 - DNA, 1700 bp, Homo sapiens
agcgggggaagggcggccgacccatataagcagcctgcggggcgttccctcgggttgtggttggtgtgcgggtttcggttggaggactcgttggggaggtggcctgcgcttgtagagactgcatccccgagacgatggcggagggagataatcgcagcaccaacctgctggctgcagagactgcaagtctggaagaacagctgcaaggatggggagaagtgatgctgatggctgataaagtcctccgatgggaaagagcctggtttccacctgccatcatgggtgtggtttctttggtgtttctgattatctactatctagatccatctgttctgtccggcgtttcctgttttgttatgtttttgtgcttggctgactaccttgttcccattctagcgcctagaatttttggctccaataaatggaccactgaacaacagcaaagattccatgaaatttgcagcaatctagtaaaaactcgacgcagagctgtgggttggtggaaacgcctcttcacactaaaggaagaaaaacctaagatgtacttcatgaccatgatcgtttcccttgctgcggttgcttgggtgggacaacaagtccacaacctgcttctcacctacctgatagtgacttccttactattgcttcctggactaaaccaacatggaatcattttgaagtacattggaatggccaagagggagataaacaaacttctcaaacaaaaagaaaagaaaaacgaatgattcatctgctttaatcagtgtgattaatgcagcacccattgccccgggaaccgtttctgctgtactatctggatactaaaatgttacggaagtagctctttgttctccctcactctgcccttagttaatagaaattcagactcgccaagtaaggcttcgtgcatagtgtcttcatgtcgcgtatagttgagcgcgttcttagcagttggcttcatggacaactcattagtgttttgacttttcttacccagcgttaattgaattcttgcttttagacaacttcctttttgtagtggtgaaccttgccctttagtacagttcaagtgaatctggataattgttcatctttgctttagcttagataccatgtagtggtctgtggctacaggaagctggttctgtctgcttccacagtctgcttaaaaaactgtctgacttcgtgaatatagagaccaagtttaccacttctgatgaagagaccaattaagattcattcctcattctgtttctttccagtgggagaagagtccccatgaaataagatgaaactgattccatgcactagtacatgtaggcttctcccttgtgcaaagcttagcaatttgtaggaaactttgatctttttgtccaagaaaaggaatgtctgacaggcttaagctttcgtccccttgcacttagactcgaagttagtaaatccttaaaggctttttaatagcagacttccaaaagattgcatttaggatttctagcatgcttttaatttcagattttcagctgacattagctatagtatacagtaggttaagactcatgtctatgactttcactctaagactggcaaaaggacagcagtcttctatgtttagtcaatattcatttcagtagaagataatctcacctcctaagtgtcccatgaaggccagacagatctgacattatggcacacttatgagg

SEQ ID NO: 314029 - DNA, 2638 bp, Homo sapiens
  misc_feature (2351)..(2352): n is a, c, g, or t
agcgggggaagggcggccgacccatataagcagcctgcggggcgttccctcgggttgtggttggtgtgcgggtttcggttggaggactcgttggggaggtggcctgcgcttgtagagactgcatccccgagacgatggcggagggagataatcgcagcaccaacctgctggctgcagagactgcaagtctggaagaacagctgcaaggatggggagaagtgatgctgatggctgataaagtcctccgatgggaaagagcctggtttccacctgccatcatgggtgtggtttctttggtgtttctgattatctactatctagatccatctgttctgtccggcgtttcctgttttgttatgtttttgtgcttggctgactaccttgttcccattctagcgcctagaatttttggctccaataaatggaccactgaacaacagcaaagattccatgaaatttgcagcaatctagtaaaaactcgacgcagagctgtgggttggtggaaacgcctcttcacactaaaggaagaaaaacctaagatgggtgggacaacaagtccacaacctgcttctcacctacctgatagtgacttccttactattgcttcctggactaaaccaacatggaatcattttgaagtacattggaatggccaagagggagataaacaaacttctcaaacaaaaagaaaagaaaaacgaatgattcatctgctttaatcagtgtgattaatgcagcacccattgccccgggaaccgtttctgctgtactatctggatactaaaatgttacggaagtagctctttgttctccctcactctgcccttagttaatagaaattcagactcgccaagtaaggcttcgtgcatagtgtcttcatgtcgcgtatagttgagcgcgttcttagcagttggcttcatggacaactcattagtgttttgacttttcttacccagcgttaattgaattcttgcttttagacaacttcctttttgtagtggtgaaccttgccctttagtacagttcaagtgaatctggataattgttcatctttgctttagcttagataccatgtagtggtctgtggctacaggaagctggttctgtctgcttccacagtctgcttaaaaaactgtctgacttcgtgaatatagagaccaagtttaccacttctgatgaagagaccaattaagattcattcctcattctgtttctttccagtgggagaagagtccccatgaaataagatgaaactgattccatgcactagtacatgtaggcttctcccttgtgcaaagcttagcaatttgtaggaaactttgatctttttgtccaagaaaaggaatgtctgacaggcttaagctttcgtccccttgcacttagactcgaagttagtaaatccttaaaggctttttaatagcagacttccaaaagattgcatttaggatttctagcatgcttttaatttcagattttcagctgacattagctatagtatacagtaggttaagactcatgtctatgactttcactctaagactggcaaaaggacagcagtcttctatgtttagtcaatattcatttcagtagaagataatcttatctaatttttgagaccagaataagccttttaaggtaaacctcaaaattatcattttatggtaatactgaccattttagtcccctaggtttgacatgggagatagtgactacactggtgtctgacttttttcctagagatttctccctgaaaaatacaagggctgttggtgagagcagacttgaggtgatgatagttggcctctggtctacaaagatttcataactccttggaaagcttcttataatcattcttaacttcttggtagctagaaatttagagtagttgcaatctttaggaatgaacttctgagggccaaaaaatgtgactgacgggaacaattcttaaactgattaactagctgtaatatagttttgtgaatttattgcactgatgttgtaccttgtggtatatctgtccctattaaataagtgttgttttctcctctttaatattgctgtgaacagtggtgcccattgtagcatatgtttgatttttttttattatttcataagaaaactacgttaattttaccttactttcattgtaaataagcctgtcttcctatctggattttttgtgtgcatacatattctactgattaactacttttgcagttttaatcctgtattatttcttctactttgttttgtgtaaaaggggaaaaaataaaaaaagctggaatcttaaaaaaaaaaaaaaaaaaaaaaaaaaaaaaaaaaaaagaaaaaagaaaaaaaaaaaaaaaaanncaagaaaaaaaaacaaaaagaaaaacaaaaaaacaaacgaaaaataaaatggagtacaataaaaatcagaacaaagatgaaaaaaaagaggggggcgggccgccgacaagaaaatccatgcgaactccgcggaaggaggaccagaaaagacaacgcaacaacagaagtatattaggaagaggaagacgcagacccacaaagaggagaaaatatatataaaaaaacgacagagcggcgcgcctctataaaacaacacgggagaagaaacaaaacgagcggggtgctt

SEQ ID NO: 314030 - DNA, 2261 bp, Homo sapiens
  misc_feature (1974)..(1975): n is a, c, g, or t
gctaaacctatgcgttggtggcgcggcctcttcacgcttagtggacgtggtccttactatgtccttacagtgaatcactgagtcgatgtacctcattggctgtcgggattgctctgccgattagtgagacaaacgacgtccgcgacgagaccatgcgtatcctgctaccttgacctgaatcctagacttgtgccgttcattggattggtcttccatggacatctatcaacatggaattcattcggactctgactttggaatggcccacccaggcgcatggagggagataaacaaacttctcaaacaaaaagaaaagaaaaacgaatgattcatctgctttaatcagtgtgattaatgcagcacccattgccccgggaaccgtttctgctgtactatctggatactaaaatgttacggaagtagctctttgttctccctcactctgcccttagttaatagaaattcagactcgccaagtaaggcttcgtgcatagtgtcttcatgtcgcgtatagttgagcgcgttcttagcagttggcttcatggacaactcattagtgttttgacttttcttacccagcgttaattgaattcttgcttttagacaacttcctttttgtagtggtgaaccttgccctttagtacagttcaagtgaatctggataattgttcatctttgctttagcttagataccatgtagtggtctgtggctacaggaagctggttctgtctgcttccacagtctgcttaaaaaactgtctgacttcgtgaatatagagaccaagtttaccacttctgatgaagagaccaattaagattcattcctcattctgtttctttccagtgggagaagagtccccatgaaataagatgaaactgattccatgcactagtacatgtaggcttctcccttgtgcaaagcttagcaatttgtaggaaactttgatctttttgtccaagaaaaggaatgtctgacaggcttaagctttcgtccccttgcacttagactcgaagttagtaaatccttaaaggctttttaatagcagacttccaaaagattgcatttaggatttctagcatgcttttaatttcagattttcagctgacattagctatagtatacagtaggttaagactcatgtctatgactttcactctaagactggcaaaaggacagcagtcttctatgtttagtcaatattcatttcagtagaagataatcttatctaatttttgagaccagaataagccttttaaggtaaacctcaaaattatcattttatggtaatactgaccattttagtcccctaggtttgacatgggagatagtgactacactggtgtctgacttttttcctagagatttctccctgaaaaatacaagggctgttggtgagagcagacttgaggtgatgatagttggcctctggtctacaaagatttcataactccttggaaagcttcttataatcattcttaacttcttggtagctagaaatttagagtagttgcaatctttaggaatgaacttctgagggccaaaaaatgtgactgacgggaacaattcttaaactgattaactagctgtaatatagttttgtgaatttattgcactgatgttgtaccttgtggtatatctgtccctattaaataagtgttgttttctcctctttaatattgctgtgaacagtggtgcccattgtagcatatgtttgatttttttttattatttcataagaaaactacgttaattttaccttactttcattgtaaataagcctgtcttcctatctggattttttgtgtgcatacatattctactgattaactacttttgcagttttaatcctgtattatttcttctactttgttttgtgtaaaaggggaaaaaataaaaaaagctggaatcttaaaaaaaaaaaaaaaaaaaaaaaaaaaaaaaaaaaaagaaaaaagaaaaaaaaaaaaaaaaanncaagaaaaaaaaacaaaaagaaaaacaaaaaaacaaacgaaaaataaaatggagtacaataaaaatcagaacaaagatgaaaaaaaagaggggggcgggccgccgacaagaaaatccatgcgaactccgcggaaggaggaccagaaaagacaacgcaacaacagaagtatattaggaagaggaagacgcagacccacaaagaggagaaaatatatataaaaaaacgacagagcggcgcgcctctataaaacaacacgggagaagaaacaaaacgagcggggtgctt

SEQ ID NO: 314031 - DNA, 1193 bp, Homo sapiens
agcgggggaagggcggccgacccatataagcagcctgcggggcgttccctcgggttgtggttggtgtgcgggtttcggttggaggactcgttggggaggtggcctgcgcttgtagagactgcatccccgagacgatggcggagggagataatcgcagcaccaacctgctggctgcagagactgcaagtctggaagaacagctgcaaggatggggagaagtgatgctgatggctgataaagtcctccgatgggaaagagcctggtttccacctgccatcatgggtgtggtttctttggtgtttctgattatctactatctagatccatctgttctgtccggcgtttcctgttttgttatgtttttgtgcttggctgactaccttgttcccattctagcgcctagaatttttggctccaataaatggaccactgaacaacagcaaagattccatgaaatttgcagcaatctagtaaaaactcgacgcagagctgtgggttggtggaaacgcctcttcacactaaaggaagaaaaacctaagatgatggtactttttttgctttgacttaagtacagtaaaattttaagatttgagtcaattcgcctttttgtcttaatagctataatttgaaaattattcattggttaattcctaagtacattcataaatgtttacctgtattaattagactgaatcattttaaagttaaaaattacatttttgcatttaattttttattctaataaaacaaaattcttctgtttcatttttcttactgaaataatagtaaaagacatatacttagaaagcatctgtttaggccgggcacagtggctaatgcctataatcccagctacatggaaggctgaggatcacttgagccctggaggtcgaggctgcagtgagctgtgtttgcgcagtgagctgtttgcaccactgcactccagcctttgtgacagaatgagactctgtctcaaaaaaaaaagctgttccgtgaagttattaactgaaaagatcgtataatttatatcataaaatatttacatacagaattgcagtaattctaggaagaaatgtatccaaattctataaagtagatccaatggaataggtttttaaatctaagaatttttaaagaaaagtgataataaaagctaaattatttcccgaactttgaaacacattcttctttaa

SEQ ID NO: 314032 - DNA, 543 bp, Homo sapiens
gccctttctttgcggaatcaccatggcggctgggaccctgtacacgtatcctgaaaactggagggccttcaaggctctcatcgctgctcagtacagcggggctcaggtccgcgtgctctccgcaccaccccacttccattttggccaaaccaaccgcacccctgaatttctccgcaaatttcctgccggcaaggtcccagcatttgagggtgatgatggattctgtgtgtttgagagcaacgccattgcctactatgtgagcaatgaggagtgctggatgcttacttgaagacgaggacttttctggtgggcgaacgagtgacattggctgacatcacagttgtctgcaccctgttgtggctctataagcaggttctagagccttctttccgccaggcctttcccaataccaactagtggtgacttaacctgatgaataaaaccgcttttacaatattaattttgagggaaaacacatttgtatagaatggtaggagtaattttacaaaaataagattttttgtaagcatttgtacgtgtccc

SEQ ID NO: 314033 - DNA, 1327 bp, Homo sapiens
gccctttctttgcggaatcaccatggcggctgggaccctgtacacgtatcctgaaaactggagggccttcaaggctctcatcgctgctcagtacagcggggctcaggtccgcgtgctctccgcaccaccccacttccattttggccaaaccaaccgcacccctgaatttctccgcaaatttcctgccggcaaggtcccagcatttgagggtgatgatggattctgtgtgtttgagagcaacgccattgcctactatgtgagcaatgaggagctgcggggaagtactccagagggcatcatgcaccacaacaaacaggccactgagaatgcaaaggaggaagtgaggcgaattctggggctgctggatgcttacttgaagacgaggacttttctggtgggcgaacgagtgacattggctgacatcacagttgtctgcaccctgttgtggctctataagcaggttctagagccttctttccgccaggcctttcccaataccaaccgctggttcctcacctgcattaaccagccccagttccgggctgtcttgggggaagtgaaactgtgtgagaagatggcccagtttgatgctaaaaagtttgcagagacccaacctaaaaaggacacaccacggaaagagaagggttcacgggaagagaagcagaagccccaggctgagcggaaggaggagaaaaaggcggctgcccctgctcctgaggaggagatggatgaatgtgagcaggcgctggctgctgagcccaaggccaaggaccccttcgctcacctgcccaagagtacctttgtgttggatgaatttaagcgcaagtactccaatgaggacacactctctgtggcactgccatatttctgggagcactttgataaggacggctggtccctgtggtactcagagtatcgcttccctgaagaactcactcagaccttcatgagctgcaatctcatcactggaatgttccagcgactggacaagctgaggaagaatgccttcgccagtgtcatcctttttggaaccaacaatagcagctccatttctggagtctgggtcttccgaggccaggagcttgcctttccgctgagtccagattggcaggtggactacgagtcatacacatggcggaaactggatcctggcagcgaggagacccagacgctggttcgagagtacttttcctgggagggggccttccagcatgtgggcaaagccttcaatcagggcaagatcttcaagtgaacatctcttgccatcacctagctgcctgcacctgcccttcagggagatgggggtcattaaaggaaactgaacatt

SEQ ID NO: 314034 - DNA, 1167 bp, Homo sapiens
gccctttctttgcggaatcaccatggcggctgggaccctgtacacgtatcctgaaaactggagggccttcaaggctctcatcgctgctcagtacagcggggctcaggtccgcgtgctctccgcaccaccccaggcatcatgcaccacaacaaacaggccactgagaatgcaaaggaggaagtgaggcgaattctggggctgctggatgcttacttgaagacgaggacttttctggtgggcgaacgagtgacattggctgacatcacagttgtctgcaccctgttgtggctctataagcaggttctagagccttctttccgccaggcctttcccaataccaaccgctggttcctcacctgcattaaccagccccagttccgggctgtcttgggggaagtgaaactgtgtgagaagatggcccagtttgatgctaaaaagtttgcagagacccaacctaaaaaggacacaccacggaaagagaagggttcacgggaagagaagcagaagccccaggctgagcggaaggaggagaaaaaggcggctgcccctgctcctgaggaggagatggatgaatgtgagcaggcgctggctgctgagcccaaggccaaggaccccttcgctcacctgcccaagagtacctttgtgttggatgaatttaagcgcaagtactccaatgaggacacactctctgtggcactgccatatttctgggagcactttgataaggacggctggtccctgtggtactcagagtatcgcttccctgaagaactcactcagaccttcatgagctgcaatctcatcactggaatgttccagcgactggacaagctgaggaagaatgccttcgccagtgtcatcctttttggaaccaacaatagcagctccatttctggagtctgggtcttccgaggccaggagcttgcctttccgctgagtccagattggcaggtggactacgagtcatacacatggcggaaactggatcctggcagcgaggagacccagacgctggttcgagagtacttttcctgggagggggccttccagcatgtgggcaaagccttcaatcagggcaagatcttcaagtgaacatctcttgccatcacctagctgcctgcacctgcccttcagggagatgggggtcattaaaggaaactgaacatt

SEQ ID NO: 314035 - DNA, 1027 bp, Homo sapiens
gccctttctttgcggaatcaccatggcggctgggaccctgtacacgtatcctgaaaactggagggccttcaaggctctcatcgctgctcagtacagcggggctcaggtccgcgtgctctccgcaccaccccacttccattttggccaaaccaaccgcacccctgaatttctccgcaaatttcctgccggcaaggtcccagcatttgagggtgatgatggattctgtgtgtttgagagcaacgccattgcctactatgtgagcaatgaggagctgcggggaagtactccagaggcagcagcccaggtggtgcagtgggtgagctttgctgattccgatatagtgcccccagccagtacctgggtgttccccaccttgggcatcatgcaccacaacaaacaggccactgagaatgcaaaggaggagatggatgaatgtgagcaggcgctggctgctgagcccaaggccaaggaccccttcgctcacctgcccaagagtacctttgtgttggatgaatttaagcgcaagtactccaatgaggacacactctctgtggcactgccatatttctgggagcactttgataaggacggctggtccctgtggtactcagagtatcgcttccctgaagaactcactcagaccttcatgagctgcaatctcatcactggaatgttccagcgactggacaagctgaggaagaatgccttcgccagtgtcatcctttttggaaccaacaatagcagctccatttctggagtctgggtcttccgaggccaggagcttgcctttccgctgagtccagattggcaggtggactacgagtcatacacatggcggaaactggatcctggcagcgaggagacccagacgctggttcgagagtacttttcctgggagggggccttccagcatgtgggcaaagccttcaatcagggcaagatcttcaagtgaacatctcttgccatcacctagctgcctgcacctgcccttcagggagatgggggtcattaaaggaaactgaacatt

SEQ ID NO: 314036 - DNA, 1462 bp, Homo sapiens
gccctttctttgcggaatcaccatggcggctgggaccctgtacacgtatcctgaaaactggagggccttcaaggctctcatcgctgctcagtacagcggggctcaggtccgcgtgctctccgcaccaccccacttccattttggccaaaccaaccgcacccctgaatttctccgcaaatttcctgccggcaaggtcccagcatttgagggtgatgatggattctgtgtgtttgagagcaacgccattgcctactatgtgagcaatgaggagctgcggggaagtactccagaggcagcagcccaggtggtgcagtgggtgagctttgctgattccgatatagtgcccccagccagtacctgggtgttccccaccttgggcacattcaatggccaacccacaaaccacaaccgaggcactgtgcaaaatgtcgcaacggagagggagatgtagagcggagatatacagtggaggcatgcatggaatgccttactttgaaagcaccggagggaattttacttgggtggggcgaaacacgaacgagtgacattggctgacatcacagttgtctgcaccctgttgtggctctataagcaggttctagagccttctttccgccaggcctttcccaataccaaccgctggttcctcacctgcattaaccagccccagttccgggctgtcttgggggaagtgaaactgtgtgagaagatggcccagtttgatgctaaaaagtttgcagagacccaacctaaaaaggacacaccacggaaagagaagggttcacgggaagagaagcagaagccccaggctgagcggaaggaggagaaaaaggcggctgcccctgctcctgaggaggagatggatgaatgtgagcaggcgctggctgctgagcccaaggccaaggaccccttcgctcacctgcccaagagtacctttgtgttggatgaatttaagcgcaagtactccaatgaggacacactctctgtggcactgccatatttctgggagcactttgataaggacggctggtccctgtggtactcagagtatcgcttccctgaagaactcactcagaccttcatgagctgcaatctcatcactggaatgttccagcgactggacaagctgaggaagaatgccttcgccagtgtcatcctttttggaaccaacaatagcagctccatttctggagtctgggtcttccgaggccaggagcttgcctttccgctgagtccagattggcaggtggactacgagtcatacacatggcggaaactggatcctggcagcgaggagacccagacgctggttcgagagtacttttcctgggagggggccttccagcatgtgggcaaagccttcaatcagggcaagatcttcaagtgaacatctcttgccatcacctagctgcctgcacctgcccttcagggagatgggggtcattaaaggaaactgaacatt

SEQ ID NO: 314037 - DNA, 1219 bp, Homo sapiens
actgggccatcttctcacacagtttcatttcccccaagacagcccggaactgggccatcggttcatgcagatgaggaaacacgcgaatggtattgtggtaaggcctgccggaaagaaggctctagaacctgcctatagagccacaacagggtgcagacaactgtgatgtcagccaatgtcactcggcatcatgcaccacaacaaacaggccactgagaatgcaaaggaggaagtgaggcgaattctggggctgctggatgcttacttgaagacgaggacttttctggtgggcgaacgagtgacattggctgacatcacagttgtctgcaccctgttgtggctctataagcaggttctagagccttctttccgccaggcctttcccaataccaaccgctggttcctcacctgcattaaccagccccagttccgggctgtcttgggggaagtgaaactgtgtgagaagatggcccagtttgatgctaaaaagtttgcagagacccaacctaaaaaggacacaccacggaaagagaagggttcacgggaagagaagcagaagccccaggctgagcggaaggaggagaaaaaggcggctgcccctgctcctgaggaggagatggatgaatgtgagcaggcgctggctgctgagcccaaggccaaggaccccttcgctcacctgcccaagagtacctttgtgttggatgaatttaagcgcaagtactccaatgaggacacactctctgtggcactgccatatttctgggagcactttgataaggacggctggtccctgtggtactcagagtatcgcttccctgaagaactcactcagaccttcatgagctgcaatctcatcactggaatgttccagcgactggacaagctgaggaagaatgccttcgccagtgtcatcctttttggaaccaacaatagcagctccatttctggagtctgggtcttccgaggccaggagcttgcctttccgctgagtccagattggcaggtggactacgagtcatacacatggcggaaactggatcctggcagcgaggagacccagacgctggttcgagagtacttttcctgggagggggccttccagcatgtgggcaaagccttcaatcagggcaagatcttcaagtgaacatctcttgccatcacctagctgcctgcacctgcccttcagggagatgggggtcattaaaggaaactgaacatt

SEQ ID NO: 314038 - DNA, 1102 bp, Homo sapiens
gccctttctttgcggaatcaccatggcggctgggaccctgtacacgtatcctgaaaactggagggccttcaaggctctcatcgctgctcagtacagcggggctcaggtccgcgtgctctccgcaccaccccacttccattttggccaaaccaaccgcacccctgaatttctccgcaaatttcctgccggcaaggtcccagcatttgagggtgatgatggattctgtgtgtttgagagcaacgccattgcctactatgtgagcaatgaggagctgcggggaagtactccagagggcatcatgcaccacaacaaacaggccactgagaatgcaaaggaggaagtgaggcgaattctggggctgctggatgcttacttgaagacgaggacttttctggtgggcgaacgagtgacattggctgacatcacagttgtctgcaccctgttgtggctctataagcaggttctagagccttctttccgccaggcctttcccaataccaaccgctggttcctcacctgcattaaccagccccagttccgggctgtcttgggggaagtgaaactgtgtgagaagatggcccagtttgatgctaaaaagtttgcagagacccaacctaaaaaggacacaccacggaaagagaagggttcacgggaagagaagcagaagccccaggctgagcggaaggaggagaaaaaggcggctgcccctgctcctgaggaggagatggatgaatgtgagcaggcgctggctgctgagcccaaggccaaggaccccttcgctcacctgcccaagagtacctttgtgttggatgaatttaagcgcaagtactccaatgaggacacactctctgtggcactgccatatttctgggagcactttgataaggacggctggtccctgtggtactcagagtatcgcttccctgaagaactcactcagaccttcatgagctgcaatctcatcactggaatgttccagcgactggacaagctgaggaagaatgccttcgccagtgtcatcctttttggaaccaacaatagcagctcatgaaggtctgagtgagttcttcagggaagcgatactactgagtaccacaggacc

SEQ ID NO: 314039 - DNA, 1278 bp, Homo sapiens
gccctttctttgcggaatcaccatggcggctgggaccctgtacacgtatcctgaaaactggagggccttcaaggctctcatcgctgctcagtacagcggggctcaggtccgcgtgctctccgcaccaccccacttccattttggccaaaccaaccgcacccctgaatttctccgcaaatttcctgccggcaaggtcccagcatttgagggtgatgatggattctgtgtgtttgagagcaacgccattgcctactatgtgagcaatgaggagctgcggggaagtactccagaggcagcagcccaggtggtgcagtgggtgagctttgctgattccgatatagtgcccccagccagtacctgggtgttccccaccttgggcatcatgcaccacaacaaacaggccactgagaatgcaaaggaggaagtgaggcgaattctggggctgctggatgcttacttgaagacgaggacttttctggtgggcgaacgagtgacattggctgacatcacagttgtctgcaccctgttgtggcttttgatgctaaaaagtttgcagagacccaacctaaaaaggacacaccacggaaagagaagggttcacgggaagagaagcagaagccccaggctgagcggaaggaggagaaaaaggcggctgcccctgctcctgaggaggagatggatgaatgtgagcaggcgctggctgctgagcccaaggccaaggaccccttcgctcacctgcccaagagtacctttgtgttggatgaatttaagcgcaagtactccaatgaggacacactctctgtggcactgccatatttctgggagcactttgataaggacggctggtccctgtggtactcagagtatcgcttccctgaagaactcactcagaccttcatgagctgcaatctcatcactggaatgttccagcgactggacaagctgaggaagaatgccttcgccagtgtcatcctttttggaaccaacaatagcagctccatttctggagtctgggtcttccgaggccaggagcttgcctttccgctgagtccagattggcaggtggactacgagtcatacacatggcggaaactggatcctggcagcgaggagacccagacgctggttcgagagtacttttcctgggagggggccttccagcatgtgggcaaagccttcaatcagggcaagatcttcaagtgaacatctcttgccatcacctagctgcctgcacctgcccttcagggagatgggggtcattaaaggaaactgaacatt

SEQ ID NO: 314040 - DNA, 414 bp, Homo sapiens
  misc_feature (138)..(138): n is a, c, g, or t
aagacaccaacctgtgtgctatccatgccaaacgtgtaacaattatgccaaaagacatccagctagcacgccgcatacgtggagaacgtgcttaagaatccactatgatgggaaacatttcattctcaaaaaaaaaanaaaaaaactcgagactagcgaggccaggagcttgcctttccgctgagtccagattggcaggtggactacgagtcatacacatggcggaaactggatcctggcagcgaggagacccagacgctggttcgagagtacttttcctgggagggggccttccagcatgtgggcaaagccttcaatcagggcaagatcttcaagtgaacatctcttgccatcacctagctgcctgcacctgcccttcagggagatgggggtcattaaaggaaactgaacatt

SEQ ID NO: 314041 - DNA, 1411 bp, Homo sapiens
gccctttctttgcggaatcaccatggcggctgggaccctgtacacgtatcctgaaaactggagggccttcaaggctctcatcgctgctcagtacagcggggctcaggtccgcgtgctctccgcaccaccccacttccattttggccaaaccaaccgcacccctgaatttctccgcaaatttcctgccggcaaggtcccagcatttgagggtgatgatggattctgtgtgtttgagagcaacgccattgcctactatgtgagcaatgaggagctgcggggaagtactccagaggcagcagcccaggtggtgcagtgggtgagctttgctgattccgatatagtgcccccagccagtacctgggtgttccccaccttgggcatcatgcaccacaacaaacaggccactgagaatgcaaaggaggaagtgaggcgaattctggggctgctggatgcttacttgaagacgaggacttttctggtgggcgaacgagtgacattggctgacatcacagttgtctgcaccctgttgtggctctataagcaggttctagagccttctttccgccaggcctttcccaataccaaccgctggttcctcacctgcattaaccagccccagttccgggctgtcttgggggaagtgaaactgtgtgagaagatggcccagtttgatgctaaaaagtttgcagagacccaacctaaaaaggacacaccacggaaagagaagggttcacgggaagagaagcagaagccccaggctgagcggaaggaggagaaaaaggcggctgcccctgctcctgaggaggagatggatgaatgtgagcaggcgctggctgctgagcccaaggccaaggaccccttcgctcacctgcccaagagtacctttgtgttggatgaatttaagcgcaagtactccaatgaggacacactctctgtggcactgccatatttctgggagcactttgataaggacggctggtccctgtggtactcagagtatcgcttccctgaagaactcactcagaccttcatgagctgcaatctcatcactggaatgttccagcgactggacaagctgaggaagaatgccttcgccagtgtcatcctttttggaaccaacaatagcagctccatttctggagtctgggtcttccgaggccaggagcttgcctttccgctgagtccagattggcaggtggactacgagtcatacacatggcggaaactggatcctggcagcgaggagacccagacgctggttcgagagtacttttcctgggagggggccttccagcatgtgggcaaagccttcaatcagggcaagatcttcaagtgaacatctcttgccatcacctagctgcctgcacctgcccttcagggagatgggggtcattaaaggaaactgaacatt

SEQ ID NO: 314042 - DNA, 1063 bp, Homo sapiens
gccctttctttgcggaatcaccatggcggctgggaccctgtacacgtatcctgaaaactggagggccttcaaggctctcatcgctgctcagtacagcggggctcaggtccgcgtgctctccgcaccaccccacttccattttggccaaaccaaccgcacccctgaatttctccgcaaatttcctgccggcaaggtcccagcatttgagggtgatgatggattctgtgtgtttgagagcaacgccattgcctactatgtgagcaatgaggagctgcggggaagtactccagaggcagcagcccaggtggtgcagtgggtgagctttgctgattccgatatagtgcccccagccagtacctgggtgttccccaccttgggcatcatgcaccacaacaaacaggccactgagaatgcaaaggaggaggagaaaaaggcggctgcccctgctcctgaggaggagatggatgaatgtgagcaggcgctggctgctgagcccaaggccaaggaccccttcgctcacctgcccaagagtacctttgtgttggatgaatttaagcgcaagtactccaatgaggacacactctctgtggcactgccatatttctgggagcactttgataaggacggctggtccctgtggtactcagagtatcgcttccctgaagaactcactcagaccttcatgagctgcaatctcatcactggaatgttccagcgactggacaagctgaggaagaatgccttcgccagtgtcatcctttttggaaccaacaatagcagctccatttctggagtctgggtcttccgaggccaggagcttgcctttccgctgagtccagattggcaggtggactacgagtcatacacatggcggaaactggatcctggcagcgaggagacccagacgctggttcgagagtacttttcctgggagggggccttccagcatgtgggcaaagccttcaatcagggcaagatcttcaagtgaacatctcttgccatcacctagctgcctgcacctgcccttcagggagatgggggtcattaaaggaaactgaacatt

SEQ ID NO: 314043 - DNA, 1360 bp, Homo sapiens
gccctttctttgcggaatcaccatggcggctgggaccctgtacacgtatcctgaaaactggagggccttcaaggctctcatcgctgctcagtacagcggggctcaggtccgcgtgctctccgcaccaccccacttccattttggccaaaccaaccgcacccctgaatttctccgcaaatttcctgccggcaaggtcccagcatttgagggtgatgatggattctgtgtgtttgagagcaacgccattgcctactatgtgagcaatgaggagctgcggggaagtactccagaggcagcagcccaggtggtgcagtgggtgagctttgctgattccgatatagtgcccccagccagtacctgggtgttccccaccttgggcatcatgcaccacaacaaacaggccactgagaatgcaaaggaggaagtgaggcgaattctggggctgctggatgcttacttgaagacgaggacttttctggtgggctataagcaggttctagagccttctttccgccaggcctttcccaataccaaccgctggttcctcacctgcattaaccagccccagttccgggctgtcttgggggaagtgaaactgtgtgagaagatggcccagtttgatgctaaaaagtttgcagagacccaacctaaaaaggacacaccacggaaagagaagggttcacgggaagagaagcagaagccccaggctgagcggaaggaggagaaaaaggcggctgcccctgctcctgaggaggagatggatgaatgtgagcaggcgctggctgctgagcccaaggccaaggaccccttcgctcacctgcccaagagtacctttgtgttggatgaatttaagcgcaagtactccaatgaggacacactctctgtggcactgccatatttctgggagcactttgataaggacggctggtccctgtggtactcagagtatcgcttccctgaagaactcactcagaccttcatgagctgcaatctcatcactggaatgttccagcgactggacaagctgaggaagaatgccttcgccagtgtcatcctttttggaaccaacaatagcagctccatttctggagtctgggtcttccgaggccaggagcttgcctttccgctgagtccagattggcaggtggactacgagtcatacacatggcggaaactggatcctggcagcgaggagacccagacgctggttcgagagtacttttcctgggagggggccttccagcatgtgggcaaagccttcaatcagggcaagatcttcaagtgaacatctcttgccatcacctagctgcctgcacctgcccttcagggagatgggggtcattaaaggaaactgaacatt

SEQ ID NO: 314044 - DNA, 1239 bp, Homo sapiens
gccctttctttgcggaatcaccatggcggctgggaccctgtacacgtatcctgaaaactggagggccttcaaggctctcatcgctgctcagtacagcggggctcaggtccgcgtgctctccgcaccaccccacttccattttggccaaaccaaccgcacccctgaatttctccgcaaatttcctgccggcaaggtcccagcatttgagggtgatgatggattctgtgtgtttgagagcaacgccattgcctactatgtgagcaatgaggagtgctggatgcttacttgaagacgaggacttttctggtgggcgaacgagtgacattggctgacatcacagttgtctgcaccctgttgtggctctataagcaggttctagagccttctttccgccaggcctttcccaataccaaccgctggttcctcacctgcattaaccagccccagttccgggctgtcttgggggaagtgaaactgtgtgagaagatggcccagtttgatgctaaaaagtttgcagagacccaacctaaaaaggacacaccacggaaagagaagggttcacgggaagagaagcagaagccccaggctgagcggaaggaggagaaaaaggcggctgcccctgctcctgaggaggagatggatgaatgtgagcaggcgctggctgctgagcccaaggccaaggaccccttcgctcacctgcccaagagtacctttgtgttggatgaatttaagcgcaagtactccaatgaggacacactctctgtggcactgccatatttctgggagcactttgataaggacggctggtccctgtggtactcagagtatcgcttccctgaagaactcactcagaccttcatgagctgcaatctcatcactggaatgttccagcgactggacaagctgaggaagaatgccttcgccagtgtcatcctttttggaaccaacaatagcagctccatttctggagtctgggtcttccgaggccaggagcttgcctttccgctgagtccagattggcaggtggactacgagtcatacacatggcggaaactggatcctggcagcgaggagacccagacgctggttcgagagtacttttcctgggagggggccttccagcatgtgggcaaagccttcaatcagggcaagatcttcaagtgaacatctcttgccatcacctagctgcctgcacctgcccttcagggagatgggggtcattaaaggaaactgaacatt

SEQ ID NO: 314045 - DNA, 1253 bp, Homo sapiens
gccctttctttgcggaatcaccatggcggctgggaccctgtacacgtatcctgaaaactggagggccttcaaggctctcatcgctgctcagtacagcggggctcaggtccgcgtgctctccgcaccaccccacttccattttggccaaaccaaccgcacccctgaatttctccgcaaatttcctgccggcaaggtcccagcatttgagggtgatgatggattctgtgtgtttgagagcaacgccattgcctactatgtgagcaatgaggagctgcggggaagtactccagaggcagcagcccaggtggtgcagtgggtgagctttgctgattccgatatagtgcccccagccagtacctgggtgttccccaccttgctataagcaggttctagagccttctttccgccaggcctttcccaataccaaccgctggttcctcacctgcattaaccagccccagttccgggctgtcttgggggaagtgaaactgtgtgagaagatggcccagtttgatgctaaaaagtttgcagagacccaacctaaaaaggacacaccacggaaagagaagggttcacgggaagagaagcagaagccccaggctgagcggaaggaggagaaaaaggcggctgcccctgctcctgaggaggagatggatgaatgtgagcaggcgctggctgctgagcccaaggccaaggaccccttcgctcacctgcccaagagtacctttgtgttggatgaatttaagcgcaagtactccaatgaggacacactctctgtggcactgccatatttctgggagcactttgataaggacggctggtccctgtggtactcagagtatcgcttccctgaagaactcactcagaccttcatgagctgcaatctcatcactggaatgttccagcgactggacaagctgaggaagaatgccttcgccagtgtcatcctttttggaaccaacaatagcagctccatttctggagtctgggtcttccgaggccaggagcttgcctttccgctgagtccagattggcaggtggactacgagtcatacacatggcggaaactggatcctggcagcgaggagacccagacgctggttcgagagtacttttcctgggagggggccttccagcatgtgggcaaagccttcaatcagggcaagatcttcaagtgaacatctcttgccatcacctagctgcctgcacctgcccttcagggagatgggggtcattaaaggaaactgaacatt

SEQ ID NO: 314046 - DNA, 751 bp, Homo sapiens
gccctttctttgcggaatcaccatggcggctgggaccctgtacacgtatcctgaaaactggagggccttcaaggctctcatcgctgctcagtacagcggggctcaggtccgcgtgctctccgcaccaccccacttccattttggccaaaccaaccgcacccctgaatttctccgcaaatttcctgccggcaaggtcccagcatttgagggtgatgatggattctgtgtgtttgagagcaacgccattgcctactatgtgagcaatgaggagctgcggggaagtactccagaggcagcagcccaggtggtgcagtgggtgagctttgctgattccgatatagtgcccccagccagtacctgggtgttccccaccttgggcatcatgcaccacaacaaacaggccactgagaatgcaaaggaggaagtgaggcgaattctggggctgctggatgcttacttgaagacgaggacttttctggtgggcgaacgagtgacattggctgacatcacagttgtctgcaccctgttgtggctctataagcaggttctagagccttctttccgccaggcctttcccaataccaaccgctggttcctcacctgcattaaccagccccagttccgggctgtcttgggggaagtgaaactgtgtgagaagatggcccagtttgatgctaaaaagtttgccatcacctagctgcctgcacctgcccttcagggagatgggggtcattaaaggaaactgaacatt

SEQ ID NO: 314047 - DNA, 4208 bp, Homo sapiens
caaacttttccgccctgggctcgggatcctggactccggggcctccccgtcctcccctttcccgggttccagctccggcctctggactaggaaccgacagcccccctccccgcgtccctccctctctctccagccgttttggggaggggctctccacgctccggatagttcccgagggtcatccgcgccgcactcgcctttccgtttcgccttcacctggatataatttccgagcgaagctgcccccaggatgaccacgctggccggcgctgtgcccaggatgatgcggccgggcccggggcagaactacccgcgtagcgggttcccgctggaagtgtccactcccctcggccagggccgcgtcaaccagctcggcggcgtttttatcaacggcaggccgctgcccaaccacatccgccacaagatcgtggagatggcccaccacggcatccggccctgcgtcatctcgcgccagctgcgcgtgtcccacggctgcgtctccaagatcctgtgcaggtaccaggagactggctccatacgtcctggtgccatcggcggcagcaagcccaagcaggtgacaacgcctgacgtggagaagaaaattgaggaatacaaaagagagaacccgggcatgttcagctgggaaatccgagacaaattactcaaggacgcggtctgtgatcgaaacaccgtgccgtcagtgagttccatcagccgcatcctgagaagtaaattcgggaaaggtgaagaggaggaggccgacttggagaggaaggaggcagaggaaagcgagaagaaggccaaacacagcatcgacggcatcctgagcgagcgagcctcagcaccccaatcagatgaaggctctgatattgactctgaaccagatttaccactaaagaggaaacagcgcagaagccgaaccaccttcacagcagaacagctggaggaactggagcgtgcttttgagagaactcattaccctgacatttatactagggaggaactggcccagagggcgaagctcaccgaggcccgagtacaggtctggtttagcaaccgccgtgcaagatggaggaagcaagctggggccaatcaactgatggctttcaaccatctcattcccggggggttccctcccactgccatgccgaccttgccaacgtaccagctgtcggagacctcttaccagcccacatctattccacaagctgtgtcagatcccagcagcaccgttcacagacctcaaccgcttcctccaagcactgtacaccaaagcacgattccttccaacccagacagcagctctgcctactgcctccccagcaccaggcatggattttccagctatacagacagctttgtgcctccgtcggggccctccaaccccatgaaccccaccattggcaatggcctctcacctcagaattcaattcgtcataatctgtccctacacagcaagttcattcgtgtgcagaatgaaggaactggaaaaagttcttggtggatgctcaatccagagggtggcaagagcgggaaatctcctaggagaagagctgcatccatggacaacaacagtaaatttgctaagagccgaagccgagctgccaagaagaaagcatctctccagtctggccaggagggtgctggggacagccctggatcacagttttccaaatggcctgcaagccctggctctcacagcaatgatgactttgataactggagtacatttcgccctcgaactagctcaaatgctagtactattagtgggagactctcacccattatgaccgaacaggatgatcttggagaaggggatgtgcattctatggtgtacccgccatctgccgcaaagatggcctctactttacccagtctgtctgagataagcaatcccgaaaacatggaaaatcttttggataatctcaaccttctctcatcaccaacatcattaactgtttcgacccagtcctcacctggcaccatgatgcagcagacgccgtgctactcgtttgcgccaccaaacaccagtttgaattcacccagcccaaactaccaaaaatatacatatggccaatccagcatgagccctttgccccagatgcctatacaaacacttcaggacaataagtcgagttatggaggtatgagtcagtataactgtgcgcctggactcttgaaggagttgctgacttctgactctcctccccataatgacattatgacaccagttgatcctggggtagcccagcccaacagccgggttctgggccagaacgtcatgatgggccctaattcggtcatgtcaacctatggcagccaggcatctcataacaaaatgatgaatcccagctcccatacccaccctggacatgctcagcagacatctgcagttaacgggcgtcccctgccccacacggtaagcaccatgccccacacctcgggtatgaaccgcctgacccaagtgaagacacctgtacaagtgcctctgccccaccccatgcagatgagtgccctggggggctactcctccgtgagcagctgcaatggctatggcagaatgggccttctccaccaggagaagctcccaagtgacttggatggcatgttcattgagcgcttagactgtgacatggaatccatcattcggaatgacctcatggatggagatacattggattttaactttgacaatgtgttgcccaaccaaagcttcccacacagtgtcaagacaacgacacatagctgggtgtcaggctgagggttagtgagcaggttacacttaaaagtacttcagattgtctgacagcaggaactgagagaagcagtccaaagatgtctttcaccaactcccttttagttttcttggttaaaaaaaaaaacaaaaaaaaaaaccctccttttttcctttcgtcagacttggcagcaaagacatttttcctgtacaggatgtttgcccaatgtgtgcaggttatgtgctgctgtagataaggactgtgccattggaaatttcattacaatgaagtgccaaactcactacaccatataattgcagaaaagattttcagatcctggtgtgctttcaagttttgtatataagcagtagatacagattgtatttgtgtgtgtttttggtttttctaaatatccaattggtccaaggaaagtttatactctttttgtaatactgtgatgggcctcatgtcttgataagttaaacttttgtttgtactacctgttttctgcggaactgacggatcacaaagaactgaatctccattctgcatctccattgaacagccttggacctgttcacgttgccacagaattcacatgagaaccaagtagcctgttatcaatctgctaaattaatggacttgttaaacttttggaaaaaaaaagattaaatgccagctttgtacaggtcttttctatttttttttgtttattttgttatttgcaaatttgtacaaacatttaaatggttctaatttccagataaatgatttttgatgttattgttgggacttaagaacatttttggaatagatattgaactgtaataatgttttcttaaaactagagtctactttgttacatagtcagcttgtaaattttgtggaaccacaggtatttgggggcagcattcataattttcattttgtattctaactggattagtactaattttatacatgcttaactggtttgtacactttgggatgctacttagtgatgtttctgactaatcttaaatcattgtaattagtacttgcatattcaacgtttcaggccctggttgggcaggaaagtgatgtatagttatggacactttgcgtttcttatttaggataacttaatatgtttttatgtatgtattttaaagaaatttcactgcttctctgaactatgcgtactgcatagcatcaagtcttctctagagacctctgtagtcctgggaggcctcataatgtttgtagatacagaaagggagactgcatctaaagcaatggtcctttgtcaaacgagggattttgatccacttcaccattttgagttgagctttagcaaaagtttccctcataattctttgctcttgtttcagtccaggtggaggttggttttgtagttctgccttgaggaattatgtcaacactcatacttcatctcattctcccttctgccctgcagattagattacttagcac

SEQ ID NO: 314048 - DNA, 964 bp, Homo sapiens
caaacttttccgccctgggctcgggatcctggactccggggcctccccgtcctcccctttcccgggttccagctccggcctctggactaggaaccgacagcccccctccccgcgtccctccctctctctccagccgttttggggaggggctctccacgctccggatagttcccgagggtcatccgcgccgcactcgcctttccgtttcgccttcacctggatataatttccgagcgaagctgcccccaggatgaccacgctggccggcgctgtgcccaggatgatgcggccgggcccggggcagaactacccgcgtagcgggttcccgctggaagtgtccactcccctcggccagggccgcgtcaaccagctcggcggcgtttttatcaacggcaggccgctgcccaaccacatccgccacaagatcgtggagatggcccaccacggcatccggccctgcgtcatctcgcgccagctgcgcgtgtcccacggctgcgtctccaagatcctgtgcaggtaccaggagactggctccatacgtcctggtgccatcggcggcagcaagcccaagcaggtgacaacgcctgacgtggagaagaaaattgaggaatacaaaagagagaacccgggcatgttcagctgggaaatccgagacaaattactcaaggacgcggtctgtgatcgaaacaccgtgccgtcagtgagttccatcagccgcatcctgagaagtaaattcgggaaaggtgaagaggaggaggccgacttggagaggaaggaggcagaggaaagcgagaagaaggccaaacacagcatcgacggcatcctgagcgagcgaggaaaggccctggtctccggagtttcctcgcattaaaggagagagagagagagtactcttttgggcaacggccctccaaaattgcccccacattggctgccttataaatatgtctgtgtgttgactggt

SEQ ID NO: 314049 - DNA, 1080 bp, Homo sapiens
cgcaagcacactgccacacacacacacacacacacacacacacacacaccaaggagagagagagaaaactgatggggaaaaccagctgtgtcttcttaactgccccagtgataaatgcaaccatttttaggaagctagactagctgtaaaggacctcctaaataaattatttgttactgtatcctcatttgtaatctagttgtcaataaatggcccggacatgtcttgctaacaggatatgggctaccaggaagaaggacttgtttccctttcctgtgtggggagaggtgtgtgacgtttttccagttcacatttatttggtagcccacctgggttggaggaagggcacggtggagagaaagtgacatgcattcacatatctgcttatcagtgtgcaatactgtgtacctcatggatgctttggcaatgcccaaggcgatataagcaaaatcagaagtatatttttgcaggtgcttttattttcacagcccataattcatagtgatagagtgcagtgatgtttgccatttgctggacaaccaacacccgggttgctcctttgattagagaccagatcagataattatgcttttaaactgattacgtttacattcttctcttttctatgaaaggcagggcaagaacagaagtgttcacatggctctcatgtacttttaaattatacaatgatatccaatattaaaagattataggaactgaggtttacatacgtttgtgtggtgacattttagaatgtcaataaatttgctttttgagatgttgagaggaacaagaaggtggaaggcagtgttatttatttctttctattcttggaaccacgaatgaggtaggcacaaatacattccttttagagttaagaactatgacgtagcgagttagtgagactagacatagtaccgaatttagttcatgcattggtcttagagggtgatggaacaagagaagtactatctttgtgttgcagcctcaaccaacaacaatgtgttgtaaaaatgtctttcatgtaaaaagtgcagtaaatatttactatttataatgaataaacagttatgaaaactt

SEQ ID NO: 314050 - DNA, 2399 bp, Homo sapiens
gttgagggtagggaggggagttcctgttgttcctactcctgctcagtgattcctgcccatggtcctcataaggttcatgggggctgttgttgcaagatcatggtgggtccctgaagcccctctactgacctttgacactaaactcttcttttactcctgacaattcgcccaaacaacacagaaggcagagaactcttgcatctatttgccctttcagtctggtttagcaaccgccgtgcaagatggaggaagcaagctggggccaatcaactgatggctttcaaccatctcattcccggggggttccctcccactgccatgccgaccttgccaacgtaccagctgtcggagacctcttaccagcccacatctattccacaagctgtgtcagatcccagcagcaccgttcacagacctcaaccgcttcctccaagcactgtacaccaaagcacgattccttccaacccagacagcagctctgcctactgcctccccagcaccaggcatggattttccagctatacagacagctttgtgcctccgtcggggccctccaaccccatgaaccccaccattggcaatggcctctcacctcaggtaatgggactcctgaccaaccacggtggggtacctcatcagccccagactgattacgcgctctcccctctcaccgggggtctggaacctaccaccacggtgtcggccagctgcagtcagagactagaccatatgaagagcttggacagtctgccaacatctcagtcctactgtccacccacctatagcaccacaggctacagtatggaccctgtcacaggctaccaatatgggcagtatggacaaagtgcctttcattatctcaagccagatatcgcgtaagtgaactgtccacttggagctaaaactggccctgtttctggtcttcgcagcctagatatgaagaatctgctctgaaaacaaaaaaaaattacccttttgttggggggggtggggcagtggtcccaataggagacaaaggagagtgattgattttcttcctccaatagttggtttcaaatccttttgaacacgttcgacaaaagcagtggagaagaggaagacctggagcaataaaagacaaatgcaacattttaaggcaatggtttcacatggttacatatcaaaacatcccaattctttagtgctgatcatcgaggagctagaacattccatttgcttgtgtgcgtgcgtgcgtgtgtgtgtgtgtgtgtgtattgagatttacccagactggtttgggcaagcagactgttctaaaatataatagaataccctaaagtataacatgtcgatgttcgatgctgatacttctacaactttaaaactgctcatttcatgaagcaagaatggaggaatccttgactcttacacactggaaattgaaataaagataaatgcaaccatttttaggaagctagactagctgtaaaggacctcctaaataaattatttgttactgtatcctcatttgtaatctagttgtcaataaatggcccggacatgtcttgctaacaggatatgggctaccaggaagaaggacttgtttccctttcctgtgtggggagaggtgtgtgacgtttttccagttcacatttatttggtagcccacctgggttggaggaagggcacggtggagagaaagtgacatgcattcacatatctgcttatcagtgtgcaatactgtgtacctcatggatgctttggcaatgcccaaggcgatataagcaaaatcagaagtatatttttgcaggtgcttttattttcacagcccataattcatagtgatagagtgcagtgatgtttgccatttgctggacaaccaacacccgggttgctcctttgattagagaccagatcagataattatgcttttaaactgattacgtttacattcttctcttttctatgaaaggcagggcaagaacagaagtgttcacatggctctcatgtacttttaaattatacaatgatatccaatattaaaagattataggaactgaggtttacatacgtttgtgtggtgacattttagaatgtcaataaatttgctttttgagatgttgagaggaacaagaaggtggaaggcagtgttatttatttctttctattcttggaaccacgaatgaggtaggcacaaatacattccttttagagttaagaactatgacgtagcgagttagtgagactagacatagtaccgaatttagttcatgcattggtcttagagggtgatggaacaagagaagtactatctttgtgttgcagcctcaaccaacaacaatgtgttgtaaaaatgtctttcatgtaaaaagtgcagtaaatatttactatttataatgaataaacagttatgaaaactt

SEQ ID NO: 314051 - DNA, 1902 bp, Homo sapiens
  misc_feature (1700)..(1700): n is a, c, g, or t
  misc_feature (1902)..(1902): n is a, c, g, or t
caaacttttccgccctgggctcgggatcctggactccggggcctccccgtcctcccctttcccgggttccagctccggcctctggactaggaaccgacagcccccctccccgcgtccctccctctctctccagccgttttggggaggggctctccacgctccggatagttcccgagggtcatccgcgccgcactcgcctttccgtttcgccttcacctggatataatttccgagcgaagctgcccccaggatgaccacgctggccggcgctgtgcccaggatgatgcggccgggcccggggcagaactacccgcgtagcgggttcccgctggaagtgtccactcccctcggccagggccgcgtcaaccagctcggcggcgtttttatcaacggcaggccgctgcccaaccacatccgccacaagatcgtggagatggcccaccacggcatccggccctgcgtcatctcgcgccagctgcgcgtgtcccacggctgcgtctccaagatcctgtgcaggtaccaggagactggctccatacgtcctggtgccatcggcggcagcaagcccaagcaggtgacaacgcctgacgtggagaagaaaattgaggaatacaaaagagagaacccgggcatgttcagctgggaaatccgagacaaattactcaaggacgcggtctgtgatcgaaacaccgtgccgtcagtgagttccatcagccgcatcctgagaagtaaattcgggaaaggtgaagaggaggaggccgacttggagaggaaggaggcagaggaaagcgagaagaaggccaaacacagcatcgacggcatcctgagcgagcgagcctcagcaccccaatcagatgaaggctctgatattgactctgaaccagatttaccactaaagaggaaacagcgcagaagccgaaccaccttcacagcagaacagctggaggaactggagcgtgcttttgagagaactcattaccctgacatttatactagggaggaactggcccagagggcgaagctcaccgaggcccgagtacaggtctggtttagcaaccgccgtgcaagatggaggaagcaagctggggccaatcaactgatggctttcaaccatctcattcccggggggttccctcccactgccatgccgaccttgccaacgtaccagctgtcggagacctcttaccagcccacatctattccacaagctgtgtcagatcccagcagcaccgttcacagacctcaaccgcttcctccaagcactgtacaccaaagcacgattccttccaacccagacagcagctctgcctactgcctccccagcaccaggcatggattttccagctatacagacagctttgtgcctccgtcggggccctccaaccccatgaaccccaccattggcaatggcctctcacctcaggtaatgggactcctgaccaaccacggtggggtacctcatcagccccagactgattacgcgctctcccctctcaccgggggtctggaacctaccaccacggtgtcggccagctgcagtcagagactagaccatatgaagagcttggacagtctgccaacatctcagtcctactgtccacccacctatagcaccacaggctacagtatggaccctgtcacaggctaccaatatgggcagtatggacaaagtaagccttggactttttagggggcaattnctcctggaagggagataaactcaactcttccttaagaaaggtgaattagaggcaagattaagccacacatgccggtatcaatttttttttttttttgcaaagccagctgactgttccagcaggggcttccttgtgtaattattttcttaactgatgtcaacaacatcttgcggttattaattgttgagacgtgaaacctgan

SEQ ID NO: 314052 - DNA, 536 bp, Homo sapiens
ttctagagcaagctagactctctaccagctgcagggtctcctaagttgccactccccgggcccgaaggggaagacgctttctctggggagaattattttgccccatttgctgtctttacacaagattacatgcgctatattgctgaataatttgaacaaatgtgattgaaaggaggtctgggtctgggagtccgatgtcgagcagtttcagcgtcggtgctgtaacatgaggataggacagaagactgcgaaattacgtgctgctgttctttgctttttattttcctccagtgacttttcccttgcttctctttttcaccttcccacagtgtccactcccctcggccagggccgcgtcaaccagctcggcggcgtttttatcaacggcaggccgctgcccaaccacatccgccacaagatcgtggagatggcccaccacggcatccggccctgcgtcatctcgcgccagctgcgcgtgtcccacggctgcgtctccaagatcctgtgcaggtaccaggagactggctccatacgtc

SEQ ID NO: 314053 - DNA, 1371 bp, Homo sapiens
caaacttttccgccctgggctcgggatcctggactccggggcctccccgtcctcccctttcccgggttccagctccggcctctggactaggaaccgacagcccccctccccgcgtccctccctctctctccagccgttttggggaggggctctccacgctccggatagttcccgagggtcatccgcgccgcactcgcctttccgtttcgccttcacctggatataatttccgagcgaagctgcccccaggatgaccacgctggccggcgctgtgcccaggatgatgcggccgggcccggggcagaactacccgcgtagcgggttcccgctggaagtgtccactcccctcggccagggccgcgtcaaccagctcggcggcgtttttatcaacggcaggccgctgcccaaccacatccgccacaagatcgtggagatggcccaccacggcatccggccctgcgtcatctcgcgccagctgcgcgtgtcccacggctgcgtctccaagatcctgtgcaggtaccaggagactggctccatacgtcctggtgccatcggcggcagcaagcccaagcaggtgacaacgcctgacgtggagaagaaaattgaggaatacaaaagagagaacccgggcatgttcagctgggaaatccgagacaaattactcaaggacgcggtctgtgatcgaaacaccgtgccgtcagtgagttccatcagccgcatcctgagaagtaaattcgggaaaggtgaagaggaggaggccgacttggagaggaaggaggcagaggaaagcgagaagaaggccaaacacagcatcgacggcatcctgagcgagcgaggtaagcggtggcgccttgggcggcgcacttgctgggtgacttggagggcatcggctagctgacattggtgatctgacggcagccaagcccagctcggatcaaggtcccttcatgcgcggtgtctctgcgcctgagtaacgacatggaactgaaagaccagaggacactaggaatcaaaacaaacatttctattctgcttagtttttctgttttgtaaatctttctttcttaccactttcagcccctgggattctagaactgtgaattgtgctctgttgtagggggcaggggaagctctcactctgttgccattaaatgtatgagactgggcatctctgagcaattgtagggcctgggatagagggtacttgaatcttcagaagttgaagtagcttttatgccctcaggaaaggccctggtctccggagtttcctcgcattaaaggagagagagagagagtactcttttgggcaacggccctccaaaattgcccccacattggctgccttataaatatgtctgtgtgttgactggt

SEQ ID NO: 314054 - DNA, 3225 bp, Homo sapiens
caaacttttccgccctgggctcgggatcctggactccggggcctccccgtcctcccctttcccgggttccagctccggcctctggactaggaaccgacagcccccctccccgcgtccctccctctctctccagccgttttggggaggggctctccacgctccggatagttcccgagggtcatccgcgccgcactcgcctttccgtttcgccttcacctggatataatttccgagcgaagctgcccccaggatgaccacgctggccggcgctgtgcccaggatgatgcggccgggcccggggcagaactacccgcgtagcgggttcccgctggaagtgtccactcccctcggccagggccgcgtcaaccagctcggcggcgtttttatcaacggcaggccgctgcccaaccacatccgccacaagatcgtggagatggcccaccacggcatccggccctgcgtcatctcgcgccagctgcgcgtgtcccacggctgcgtctccaagatcctgtgcaggtaccaggagactggctccatacgtcctggtgccatcggcggcagcaagcccaagcaggtgacaacgcctgacgtggagaagaaaattgaggaatacaaaagagagaacccgggcatgttcagctgggaaatccgagacaaattactcaaggacgcggtctgtgatcgaaacaccgtgccgtcagtgagttccatcagccgcatcctgagaagtaaattcgggaaaggtgaagaggaggaggccgacttggagaggaaggaggcagaggaaagcgagaagaaggccaaacacagcatcgacggcatcctgagcgagcgagcctcagcaccccaatcagatgaaggctctgatattgactctgaaccagatttaccactaaagaggaaacagcgcagaagccgaaccaccttcacagcagaacagctggaggaactggagcgtgcttttgagagaactcattaccctgacatttatactagggaggaactggcccagagggcgaagctcaccgaggcccgagtacaggtctggtttagcaaccgccgtgcaagatggaggaagcaagctggggccaatcaactgatggctttcaaccatctcattcccggggggttccctcccactgccatgccgaccttgccaacgtaccagctgtcggagacctcttaccagcccacatctattccacaagctgtgtcagatcccagcagcaccgttcacagacctcaaccgcttcctccaagcactgtacaccaaagcacgattccttccaacccagacagcagctctgcctactgcctccccagcaccaggcatggattttccagctatacagacagctttgtgcctccgtcggggccctccaaccccatgaaccccaccattggcaatggcctctcacctcaggtaatgggactcctgaccaaccacggtggggtacctcatcagccccagactgattacgcgctctcccctctcaccgggggtctggaacctaccaccacggtgtcggccagctgcagtcagagactagaccatatgaagagcttggacagtctgccaacatctcagtcctactgtccacccacctatagcaccacaggctacagtatggaccctgtcacaggctaccaatatgggcagtatggacaaagtgcctttcattatctcaagccagatatcgcgtaagtgaactgtccacttggagctaaaactggccctgtttctggtcttcgcagcctagatatgaagaatctgctctgaaaacaaaaaaaaattacccttttgttggggggggtggggcagtggtcccaataggagacaaaggagagtgattgattttcttcctccaatagttggtttcaaatccttttgaacacgttcgacaaaagcagtggagaagaggaagacctggagcaataaaagacaaatgcaacattttaaggcaatggtttcacatggttacatatcaaaacatcccaattctttagtgctgatcatcgaggagctagaacattccatttgcttgtgtgcgtgcgtgcgtgtgtgtgtgtgtgtgtgtattgagatttacccagactggtttgggcaagcagactgttctaaaatataatagaataccctaaagtataacatgtcgatgttcgatgctgatacttctacaactttaaaactgctcatttcatgaagcaagaatggaggaatccttgactcttacacactggaaattgaaataaagataaatgcaaccatttttaggaagctagactagctgtaaaggacctcctaaataaattatttgttactgtatcctcatttgtaatctagttgtcaataaatggcccggacatgtcttgctaacaggatatgggctaccaggaagaaggacttgtttccctttcctgtgtggggagaggtgtgtgacgtttttccagttcacatttatttggtagcccacctgggttggaggaagggcacggtggagagaaagtgacatgcattcacatatctgcttatcagtgtgcaatactgtgtacctcatggatgctttggcaatgcccaaggcgatataagcaaaatcagaagtatatttttgcaggtgcttttattttcacagcccataattcatagtgatagagtgcagtgatgtttgccatttgctggacaaccaacacccgggttgctcctttgattagagaccagatcagataattatgcttttaaactgattacgtttacattcttctcttttctatgaaaggcagggcaagaacagaagtgttcacatggctctcatgtacttttaaattatacaatgatatccaatattaaaagattataggaactgaggtttacatacgtttgtgtggtgacattttagaatgtcaataaatttgctttttgagatgttgagaggaacaagaaggtggaaggcagtgttatttatttctttctattcttggaaccacgaatgaggtaggcacaaatacattccttttagagttaagaactatgacgtagcgagttagtgagactagacatagtaccgaatttagttcatgcattggtcttagagggtgatggaacaagagaagtactatctttgtgttgcagcctcaaccaacaacaatgtgttgtaaaaatgtctttcatgtaaaaagtgcagtaaatatttactatttataatgaataaacagttatgaaaactt

SEQ ID NO: 314055 - DNA, 3101 bp, Homo sapiens
caaacttttccgccctgggctcgggatcctggactccggggcctccccgtcctcccctttcccgggttccagctccggcctctggactaggaaccgacagcccccctccccgcgtccctccctctctctccagccgttttggggaggggctctccacgctccggatagttcccgagggtcatccgcgccgcactcgcctttccgtttcgccttcacctggatataatttccgagcgaagctgcccccaggatgaccacgctggccggcgctgtgcccaggatgatgcggccgggcccggggcagaactacccgcgtagcgggttcccgctggaagtgtccactcccctcggccagggccgcgtcaaccagctcggcggcgtttttatcaacggcaggccgctgcccaaccacatccgccacaagatcgtggagatggcccaccacggcatccggccctgcgtcatctcgcgccagctgcgcgtgtcccacggctgcgtctccaagatcctgtgcaggtaccaggagactggctccatacgtcctggtgccatcggcggcagcaagcccaagcaggtgacaacgcctgacgtggagaagaaaattgaggaatacaaaagagagaacccgggcatgttcagctgggaaatccgagacaaattactcaaggacgcggtctgtgatcgaaacaccgtgccgtcagtgagttccatcagccgcatcctgagaagtaaattcgggaaaggtgaagaggaggaggccgacttggagaggaaggaggcagaggaaagcgagaagaaggccaaacacagcatcgacggcatcctgagcgagcgagcctcagcaccccaatcagatgaaggctctgatattgactctgaaccagatttaccactaaagaggaaacagcgcagaagccgaaccaccttcacagcagaacagctggaggaactggagcgtgcttttgagagaactcattaccctgacatttatactagggaggaactggcccagagggcgaagctcaccgaggcccgagtacaggtctggtttagcaaccgccgtgcaagatggaggaagcaagctggggccaatcaactgatggctttcaaccatctcattcccggggggttccctcccactgccatgccgaccttgccaacgtaccagctgtcggagacctcttaccagcccacatctattccacaagctgtgtcagatcccagcagcaccgttcacagacctcaaccgcttcctccaagcactgtacaccaaagcacgattccttccaacccagacagcagctctgcctactgcctccccagcaccaggcatggattttccagctatacagacagcttttctcccctctcaccgggggtctggaacctaccaccacggtgtcggccagctgcagtcagagactagaccatatgaagagcttggacagtctgccaacatctcagtcctactgtccacccacctatagcaccacaggctacagtatggaccctgtcacaggctaccaatatgggcagtatggacaaagtgcctttcattatctcaagccagatatcgcgtaagtgaactgtccacttggagctaaaactggccctgtttctggtcttcgcagcctagatatgaagaatctgctctgaaaacaaaaaaaaattacccttttgttggggggggtggggcagtggtcccaataggagacaaaggagagtgattgattttcttcctccaatagttggtttcaaatccttttgaacacgttcgacaaaagcagtggagaagaggaagacctggagcaataaaagacaaatgcaacattttaaggcaatggtttcacatggttacatatcaaaacatcccaattctttagtgctgatcatcgaggagctagaacattccatttgcttgtgtgcgtgcgtgcgtgtgtgtgtgtgtgtgtgtattgagatttacccagactggtttgggcaagcagactgttctaaaatataatagaataccctaaagtataacatgtcgatgttcgatgctgatacttctacaactttaaaactgctcatttcatgaagcaagaatggaggaatccttgactcttacacactggaaattgaaataaagataaatgcaaccatttttaggaagctagactagctgtaaaggacctcctaaataaattatttgttactgtatcctcatttgtaatctagttgtcaataaatggcccggacatgtcttgctaacaggatatgggctaccaggaagaaggacttgtttccctttcctgtgtggggagaggtgtgtgacgtttttccagttcacatttatttggtagcccacctgggttggaggaagggcacggtggagagaaagtgacatgcattcacatatctgcttatcagtgtgcaatactgtgtacctcatggatgctttggcaatgcccaaggcgatataagcaaaatcagaagtatatttttgcaggtgcttttattttcacagcccataattcatagtgatagagtgcagtgatgtttgccatttgctggacaaccaacacccgggttgctcctttgattagagaccagatcagataattatgcttttaaactgattacgtttacattcttctcttttctatgaaaggcagggcaagaacagaagtgttcacatggctctcatgtacttttaaattatacaatgatatccaatattaaaagattataggaactgaggtttacatacgtttgtgtggtgacattttagaatgtcaataaatttgctttttgagatgttgagaggaacaagaaggtggaaggcagtgttatttatttctttctattcttggaaccacgaatgaggtaggcacaaatacattccttttagagttaagaactatgacgtagcgagttagtgagactagacatagtaccgaatttagttcatgcattggtcttagagggtgatggaacaagagaagtactatctttgtgttgcagcctcaaccaacaacaatgtgttgtaaaaatgtctttcatgtaaaaagtgcagtaaatatttactatttataatgaataaacagttatgaaaactt

SEQ ID NO: 314056 - DNA, 8795 bp, Homo sapiens
  misc_feature (1)..(2): n is a, c, g, or t
  misc_feature (4)..(4): n is a, c, g, or t
nngngtgttttcagtctctccgggttgcatgtactgtatgtggagcagtgtacagtgaagcggaggcagagcggctccgcgagcttctctccactttcccatagagaaaccctgactggccgctgagggctagctacacacacgccctcacgcccggcgagcccgcgaggtcactatcatatgacaaaggctttgccgcagttcatcttcctccctgtgtactttccatttgccttcctggaatcctgctgcatcacagaagctggaagttctgatgttccactgaaatcacaatggaaagtcttgacttgactggtcacagtaatgaaaggcagtaatagaaataaggatcattcagcagaaggagaaggggttggaaaacgaccaaaacgaaagtgtcttcagtggcatccattgctagcaaagaaacttcttgatttttcagaagaggaagaagaggaagacgaagaggaggatattgataaggttcaacttcttggggccgatggcctagagcaagatgttggtgaaactgaagatgatgaatcaccagagcagcgagcccggagaccaatgaatgcatttcttttattttgcaaacgccatcgctctcttgtacgtcaggaacaccccaggcttgataaccgaggtgctaccaagatactagctgattggtgggctgttcttgatccaaaggaaaagcagaaatacacagacatggccaaggagtataaggatgcatttatgaaagcaaatcctggctacaaatggtgtcctaccacaaacaagcctgtgaaatccccaacacccactgtcaatccacgaaagaaactttgggccttcccatctgactcttcaagagacttgccaagccccaagaaagcaaagactgaagaaatgcctcagcttaactttggaatggctgatcctactcaaatgggaggcctgagtatgctgctgttagctggagaacatgctcttggcacaccagaggtatcctctggcacatgcaggcctgatgtttcagaatctcctgaattacgtcagaagtcaccattgtttcagtttgccgagatatcttcaagtacgtcccactctgatgcttctacaaagcagtgtcaaacatctgccttgtttcagtttgcagagatttcttcaaacacttcgcagttgggtggtgctgagcctgtaaaacgctgtggaaagtctgcactctttcaactggcagagatgtgcctggcatcagaagggatgaaaatggaagaatcaaagctaataaaagcaaaagaatccgatggtggaagaattaaagaattagagaagggaaaggaagaaaaagaaattaaaatggagaaaacagatgaaactaggttacagaaggaagcagaatttgaaaaatcggctaaggaaaatttaagagattctaaggaattgagaaattttgaggcattgcaaatagatgacataatggctataaaaatggaagatcccaaagaaattagaaaggaagagttagaagaagatcacaaatgtagtcattttcctgatttttcttattctgccagtagcaagataataattagtgatgttcccagtagaaaggatcatatgtgccatcctcatggaattatgatcattgaggatcccgcagcattaaacaagccagaaaagctaaaaaagaaaaagaagaaaagcaaaatggatcgacatggaaatgataaatccacacccaagaagacttgcaaaaagaggcagtcttcggaatctgacattgagagcgtcatatataccattgaagccgtcgcaaaaggagactggggcatagagaaacttggagatacccctcgcaagaaggtccgcacatcctcaagtggcaagggaagcattttggatgccaagccaccaaagaaaaaagtgaaatcaagagagaagaaaatgtcaaaggagaaatcctcagacaccaccaaagagtcaagacctccagatttcattagtatttctgctagcaagaacatttctggtgagacaccagagggtataaaagcagaaccattgacccctatggaagatgcactaccacccagcctatcaggacaggccaagcctgaggacagtgactgtcacagaaaaatagaaacttgtggttccaggaaatccgagaggtcttgcaaaggtgctctttataaaaccctggtgtctgagggcatgctcacctctctgcgagctaatgttgacagaggaaaacgaagctcaggaaaaggaaactcctctgatcatgaagggtgttggaatgaagaaagctggacatttagtcagagtgggaccagtgggagcaagaagttcaagaagacaaagccaaaagaagactgtctccttggctccgcaaagctggatgaagaatttgaaaaaaaattcaacagcctccctcaatatagtcctgttacatttgaccggaaatgtgtacctgtcccaagaaaaaagaagaagactggaaatgtgtcctcagaaccgactaaaaccagcaaaggaagtggggataaatggtcaaacaagcaactcttcttggatgccattcaccctacagaagccatattttcagaagacagaaacaccatggagcctgttcataaggttaaaaatatcccatccattttcaacactccagagccaacaacaacgcaagaacctttggtgggcagccaaaagagaaaagcaaggaaaaccaagattacacaccttgtcaggacagcagatggccgggtatcaccagcaggaggtactttggatgacaaaccaaaggaacaactgcagaggagtctccctaaagcaactgagacagactgcaatgacaaatgctcacacaacaccgaggtcggggagacgcggagcagtactccagaaatgcctgccgtgtctgcgttctttagcctcgctgcgctggctgaagtggcagccatggaaaatgtgcacagaggtcagaggtcaactccgctcacccatgatggacagccaaaagaaatgccgcaggctcctgtacttatttcctgcgctgaccagtgaagcgccctttcattgtaaaacattgtgctttacctactaccctagccttgtctttaccgagggatgctagtgagtccaagtggtggaaaatatagactgcaaacaagtgcttgttgccccacacggcccagattcacttgaagcagaagttagcatcctgggccagtttgttctctcagaacccagaatctttgagggtaaggttatctgtctgatactgagcagaaacagaatgatcctggagctttgctttctattgaaggcttttgacggtaataggtggtaacttggtaaaaggctgcctttactgtagctcacccagcatctcttttaccaaccagagagtgtgaaactagtttcatatattacctagttattctttcaaaacaaaacaaaaaaaaaacaaaaactgacgcactgcactagttattattagatattcttagtcttttttgtacatggagatttaagtttaagatggtttatataataggttatacctacatttatattgtagaataaatattaaaaagcctgttccagagactcccaagcagcctgggcaggcagatgtaccattgttagtggtgtatgctcggcctcgtggtccatatattctgcacttttatatttgccaccagaatggtagtttgctggcaaaaaaaaaaaaaagagagagagaaaaaattacaactcttacaatctgaatttttttcttagccttgagtgaccaagaagaatttgcttgaggcaaattgtggcaaatattttcccagacaggggaagagtcctgcagattacagattactggtgttttcatgccttgaggattcttttatttttacataggggtctaagtgaccaatggattgttcatacaaacaaaaaaaaagacaaaaatattattcagaagtgaccttagtattacttcactattctaaacacattgaagacactcacttcatgtggacttggagctacagaccttttacatccatcacagattggctggacgggttgcaattgctatgcacagcctgattggcactgcaggtttttagagccattttgagtttgtgttgtttaggaggtactgagtcaatgatgagggaggtatgcctgaccagagtgggactctcagtcatagatccacctgcaagtctctgtttcctttttgtgttttgttgcttttgaacataaaaccaaccatacataagcagcgccaagtggattaactggcttagaacattcaacatattgacttaaccacctgacattcacagtgtcttgtttcctagcaacagatgcaaagtgataaatcaaaattagtctgaggctacagattttacagggtatttgttctatagcacaaagtatttccccactcttgcgtcacagcacaaactaccaaattttaattattggattccagcaataatttttaatggttttcaaactggcggaattttgacagtgctagttcgagtttgaagcttttgaattagatctctaaatggtgacagtttacatggttttatctagctttcttatttatacttgactgaattgtaatgattttttttctaattgtaatttgacgtaatagccatacaaaaaatgactctattcatactaggtttagcttctcatggttgtagatattacttcagttccggtgctggaaaatatgtacaacatactaacaggattgaaaaaaaaatagaggtttttcttcttgtttttttttccaaagcaggtaaagagggtagcaaagcatcggaatgatgtgctcaaaaatgcatattcctggtggggatggaggaagaaggcattagtaaaaggttaatcaaacgttacaacttaaccccattcatgtaggaataaatcaagtgagcagttccagacttttgcataatatttttactatgatgctgttttattaatattttctaaatttcaaaacaaaaagtgaatgtttgaaattgctgggtcccgatgttggtggctgttggagttttggaccactcgctagcagtgatttgaagattataattagctaaaatccaaaacaaaaaaccaacaacaaaaattgtatggtgcggaacatgcaccttgacaatggtactaacttgttattctatagaacacgttagaatagatctatttttgccagagcaccctccttcagtcctccgattacatttcactagagttccttacgagattgctgtatattcctgggacctttttttaaaaaaaaaaaaagcaaaacaaaagattactttttttctatgtgattaatatcttacttgatctgcttttcctaaacctcagtggcttttcccttaggcagggttgggggtgggagggcaacttactggagatgactgttttcagatactttaaaacaaacctttttgtagaaatgcttaatttttaagcggttaggcactgagagtagcagaaatcctgcaaagctttatagttccttagactcaccttgtcgattctctgagtaaagtcttgatttcaataattgtgcttctcatgccctgaatctgctggagaggagtgttgttattttcaggtaacaacattcgttagcacaaatatttcagaccaatattagtgctctccaccccaccttttgttatcattttcatttcatttctctcattcttttttattttggaaaatcatattgctatagtgtgtactttaatctgccagcagataccatctacactaacatttgtcccacagcatcctcaagagaaaaagttgttgcaccttatatatatctcaagcaaaccaaaatatgatgctcttctgctttgttttattctaaattgttgtatcatatctttctgaaaccattctgaatttagttgaaattatcaatatttatgcttttaaccttaatttctggattcaagcctgtatataaatcttttgaaaaaaaattgtcctagcccttctctgcgatgctggaagtagaagattgcgtctcagatggagacgcagtactgttccagttttctttagccttttatttatttagttattctgggtatttcctatgtaattttgaagtgtgtagagtatattatagtaactgaagctgcagctgtaagaagctgagtgaaagaaaaaatactgtaagacatccttaaagtttttatttgtttgggtactgtatatgagatcaggaaaaagaaaaatgtcccacagccacattggaaatacaggttcttgtccccaaattaggttagttcccagattttagatcaaaactgttaattcattaaaaccccttttaaaaggtaaattctactgttgtaattccgatagtctttttcccacaaatatcagaaatatatttatttaattctgtcagatgagctttctaccgatgccatgtcccaaagccatgttaaaataattcccacgttatcattgtgattctacttcctgccactaaaattgctggagaaacaaaataatgatggaacactatgaacaaaaaggagcatctgaactggtctggttatttagaatccaatgtgttcaaatccttttgttttcttattaagtcagatgctactgtaagtcagataaaattttgtttgcactctgcagtctttggctcaatgtatggaaatgtttgcacctatgtaaagtcacaagctaattacaaattgctacagaacaggagtaagctgaaaactgaatgccatgttttgtttataaggtggggaggggagggaaaataccaaaaaactctgttccaagtttggcatttgacattaatgtgaagcagtgggaccatgctgcctgctaaactactgtatgaatcgtaaatgttctgaagacgagcagctggaggctggaggatggcattccatacagcaaaggagaagcacccaccacttcatctgggaaaaggaaggaaattgcaggaggcctggagccatcatttgtaaaggggatgttgcggggtgtgatgctgttgaggagattcaccttcaattgcactgctccacagagccctcatataaggccaatcctaatgggctacctcggctttaaaagttaatttcagtaagtcctgtttcaaaagtttgtctttttttgcttctaccttcagtgccactattttccactgcagtgttttgacttcacaaactgcctcctccagagagaacaatgtattgctgaaaatgggcagtagaagcaaatgctgttgttacatttgacctataaagtattcagagtgactgctaggtagaaattaaaacttagctttcccaaatagctccttattttgcaccttataaaaagtatactaattgttaattagatgttgcttttgtttatacaagcattcccaaagaactagatttggattttgttttgagtttttggatttttaaaaattatcttatttagattgactaacagcatacttacaattttaaaagaagctgttgttcagttcatcttaccagatgtgtctggcgaagtattcagggtttgatggactgctttactttcgtttggaagtgatagctaagtttattatactctatattaaacaactttgttcatttcactgaggaccttatcttccttatatttcagaacaaagaagcaacaagcgtgaataaaaagacaaatgtatttgactccctcataatccccatctgtatgtgctacccttccttcaaatatataaatgtgcatctttttttttaaaaaaaaaaaaaaaaaggttcctcttctggccaaatttgatctatggtggtatgattcatactgttaaattgagagaggaaaccttgtggttaaaaattatatggctgctgttttctttttgcagtcagtggtcaaaactgatcatgtgcttaaatcgatttttatgcacagaactagttattgtgaacattactgctccctccaaagatttcctgataacttgggccagaggtggttactgagtaacaaggatctaattcaatgcctcaaaactcttccacccacaatgcaaatcttacctcacaagctctaacctaaatcacagagacatgcatgtttcatgcattaacactgatttcgctctgtggcccaccagaggggtgggctcatgtcccctgactcctcacatgagtgcctcagctctaagagccgtggaacggggggtagggaaggtttgcgatctggagctcagcaactggctcagcaacgttttctccatttcattagcactaaacaagtctcttgctctcaggaatttgtcagaaaaaagaataaaatcacctgagactccacataccagattataaactcttctcgtaggtttgaattgcttactcacatgtcataaattaaccacagcttcatttgaccaccaggtctaaagtctgttgacagtttcagcatgactgaatcgctcattttttttttttgctttcagaaattggcttggttctctttagagttggtgtaaacatgccatgtaataaatgatttccacttaatggtacaacagaattattgctttcttagatgtatgtgtagtaaaagtcaatatacacatttatataatttctttcttcaaaatcttatacctaatttgatatttctaaaaattgcacatgtaagtcatgtgtataacatgctaaagtactttaactgtgatcttaaaactgaataaaaatatttaataaaactttgaa

SEQ ID NO: 314057 - DNA, 8932 bp, Homo sapiens
  misc_feature (1)..(2): n is a, c, g, or t
  misc_feature (4)..(4): n is a, c, g, or t
nngngtgttttcagtctctccgggttgcatgtactgtatgtggagcagtgtacagtgaagcggaggcagagcggctccgcgagcttctctccactttcccatagagaaaccctgactggccgctgagggctagctacacacacgccctcacgcccggcgagcccgcgaggtcactatcatatgacaaaggctttgccgcagttcatcttcctccctgtgtactttccatttgccttcctggaatcctgctgcatcacagaagctggaagttctgatgttccactgaaatcacaatggaaagtcttgacttgactggtcacagtaatgaaaggcagtaatagaaataaggatcattcagcagaaggagaaggggttggaaaacgaccaaaacgaaagtgtcttcagtggcatccattgctagcaaagaaacttcttgatttttcagaagaggaagaagaggaagacgaagaggaggatattgataaggttcaacttcttggggccgatggcctagagcaagatgttggtgaaactgaagatgatgaatcaccagagcagcgagcccggagaccaatgaatgcatttcttttattttgcaaacgccatcgctctcttgtacgtcaggaacaccccaggcttgataaccgaggtgctaccaagatactagctgattggtgggctgttcttgatccaaaggaaaagcagaaatacacagacatggccaaggagtataaggatgcatttatgaaagcaaatcctggctacaaatggtgtcctaccacaaacaagcctgtgaaatccccaacacccactgtcaatccacgaaagaaactttgggccttcccatctgactcttcaagagacttgccaagccccaagaaagcaaagactgaagaaatgcctcagcttaactttggaatggctgatcctactcaaatgggaggcctgagtatgctgctgttagctggagaacatgctcttggcacaccagaggtatcctctggcacatgcaggcctgatgtttcagaatctcctgaattacgtcagaagtcaccattgtttcagtttgccgagatatcttcaagtacgtcccactctgatgcttctacaaagcagtgtcaaacatctgccttgtttcagtttgcagagatttcttcaaacacttcgcagttgggtggtgctgagcctgtaaaacgctgtggaaagtctgcactctttcaactggcagagatgtgcctggcatcagaagggatgaaaatggaagaatcaaagctaataaaagcaaaagaatccgatggtggaagaattaaagaattagagaagggaaaggaagaaaaagaaattaaaatggagaaaacagatgaaactaggttacagaaggaagcagaatttgaaaaatcggctaaggaaaatttaagagattctaaggaattgagaaattttgaggcattgcaaatagatgacataatggctataaaaatggaagatcccaaagaaattagaaaggaagagttagaagaagatcacaaatgtagtcattttcctgatttttcttattctgccagtagcaagataataattagtgatgttcccagtagaaaggatcatatgtgccatcctcatggaattatgatcattgaggatcccgcagcattaaacaagccagaaaagctaaaaaagaaaaagaagaaaagcaaaatggatcgacatggaaatgataaatccacacccaagaagacttgcaaaaagaggcagtcttcggaatctgacattgagagcgtcatatataccattgaagccgtcgcaaaaggagactggggcatagagaaacttggagatacccctcgcaagaaggtccgcacatcctcaagtggcaagggaagcattttggatgccaagccaccaaagaaaaaagtgaaatcaagagagaagaaaatgtcaaaggagaaatcctcagacaccaccaaagagtcaagacctccagatttcattagtatttctgctagcaagaacatttctggtgagacaccagagggtataaaagcagaaccattgacccctatggaagatgcactaccacccagcctatcaggacaggccaagcctgaggacagtgactgtcacagaaaaatagaaacttgtggttccaggaaatccgagaggtcttgcaaaggtgctctttataaaaccctggtgtctgagggcatgctcacctctctgcgagctaatgttgacagaggaaaacgaagctcaggaaaaggaaactcctctgatcatgaagggtgttggaatgaagaaagctggacatttagtcagagtgggaccagtgggagcaagaagttcaagaagacaaagccaaaagaagactgtctccttggctccgcaaagctggatgaagaatttgaaaaaaaattcaacagcctccctcaatatagtcctgttacatttgaccggaaatgtgtacctgtcccaagaaaaaagaagaagactggaaatgtgtcctcagaaccgactaaaaccagcaaaggaagtggggataaatggtcaaacaagcaactcttcttggatgccattcaccctacagaagccatattttcagaagacagaaacaccatggagcctgttcataaggttaaaaatatcccatccattttcaacactccagagccaacaacaacgcaagaacctttggtgggcagccaaaagagaaaagcaaggaaaaccaagattacacaccttgtcaggacagcagatggccgggtatcaccagcaggaggtactttggatgacaaaccaaaggaacaactgcagaggagtctccctaaagcaactgagacagactgcaatgacaaatgctcacacaacaccgaggtcggggagacgcggagcagtactccagaaatgcctgccgtgtctgcgttctttagcctcgctgcgctggctgaagtggcagccatggaaaatgtgcacagaggtcagaggtcaactccgctcacccatgatggacagccaaaagaaatgccgcaggctcctgtacttatttcctgcgctgaccagtgaagcgccctttcattgtaaaacattgtgctttacctactaccctagccttgtctttaccgagggatgctagtgagtccaagtggtggaaaatatagactgcaaacaagtgcttgttgccccacacggcccagattcacttgaagcagaagttagcatcctgggccagtttgttctctcagaacccagaatctttgagggtaaggttatctgtctgatactgagcagaaacagaatgatcctggagctttgctttctattgaaggcttttgacggtaataggtggtaacttggtaaaaggctgcctttactgtagctcacccagcatctcttttaccaaccagagagtgtgaaactagtttcatatattacctagttattctttcaaaacaaaacaaaaaaaaaacaaaaactgacgcactgcactagttattattagatattcttagtcttttttgtacatggagatttaagtttaagatggtttatataataggttatacctacatttatattgtagaataaatattaaaaagcctgttccagagactcccaagcagcctgggcaggcagatgtaccattgttagtggtgtatgctcggcctcgtggtccatatattctgcacttttatatttgccaccagaatggtagtttgctggcaaaaaaaaaaaaaagagagagagaaaaaattacaactcttacaatctgaatttttttcttagccttgagtgaccaagaagaatttgcttgaggcaaattgtggcaaatattttcccagacaggggaagagtcctgcagattacagattactggtgttttcatgccttgaggattcttttatttttacataggggtctaagtgaccaatggattgttcatacaaacaaaaaaaaagacaaaaatattattcagaagtgaccttagtattacttcactattctaaacacattgaagacactcacttcatgtggacttggagctacagaccttttacatccatcacagattggctggacgggttgcaattgctatgcacagcctgattggcactgcaggtttttagagccattttgagtttgtgttgtttaggaggtactgagtcaatgatgagggaggtatgcctgaccagagtgggactctcagtcatagatccacctgcaagtctctgtttcctttttgtgttttgttgcttttgaacataaaaccaaccatacataagcagcgccaagtggattaactggcttagaacattcaacatattgacttaaccacctgacattcacagtgtcttgtttcctagcaacagatgcaaagtgataaatcaaaattagtctgaggctacagattttacagggtatttgttctatagcacaaagtatttccccactcttgcgtcacagcacaaactaccaaattttaattattggattccagcaataatttttaatggttttcaaactggcggaattttgacagtgctagttcgagtttgaagcttttgaattagatctctaaatggtgacagtttacatggttttatctagctttcttatttatacttgactgaattgtaatgattttttttctaattgtaatttgacgtaatagccatacaaaaaatgactctattcatactaggtttagcttctcatggttgtagatattacttcagttccggtgctggaaaatatgtacaacatactaacaggattgaaaaaaaaatagaggtttttcttcttgtttttttttccaaagcaggtaaagagggtagcaaagcatcggaatgatgtgctcaaaaatgcatattcctggtggggatggaggaagaaggcattagtaaaaggttaatcaaacgttacaacttaaccccattcatgtaggaataaatcaagtgagcagttccagacttttgcataatatttttactatgatgctgttttattaatattttctaaatttcaaaacaaaaagtgaatgtttgaaattgctgggtcccgatgttggtggctgttggagttttggaccactcgctagcagtgatttgaagattataattagctaaaatccaaaacaaaaaaccaacaacaaaaattgtatggtgcggaacatgcaccttgacaatggtactaacttgttattctatagaacacgttagaatagatctatttttgccagagcaccctccttcagtcctccgattacatttcactagagttccttacgagattgctgtatattcctgggacctttttttaaaaaaaaaaaaagcaaaacaaaagattactttttttctatgtgattaatatcttacttgatctgcttttcctaaacctcagtggcttttcccttaggcagggttgggggtgggagggcaacttactggagatgactgttttcagatactttaaaacaaacctttttgtagaaatgcttaatttttaagcggttaggcactgagagtagcagaaatcctgcaaagctttatagttccttagactcaccttgtcgattctctgagtaaagtcttgatttcaataattgtgcttctcatgccctgaatctgctggagaggagtgttgttattttcaggtaacaacattcgttagcacaaatatttcagaccaatattagtgctctccaccccaccttttgttatcattttcatttcatttctctcattcttttttattttggaaaatcatattgctatagtgtgtactttaatctgccagcagataccatctacactaacatttgtcccacagcatcctcaagagaaaaagttgttgcaccttatatatatctcaagcaaaccaaaatatgatgctcttctgctttgttttattctaaattgttgtatcatatctttctgaaaccattctgaatttagttgaaattatcaatatttatgcttttaaccttaatttctggattcaagcctgtatataaatcttttgaaaaaaaattgtcctagcccttctctgcgatgctggaagtagaagattgcgtctcagatggagacgcagtactgttccagttttctttagccttttatttatttagttattctgggtatttcctatgtaattttgaagtgtgtagagtatattatagtaactgaagctgcagctgtaagaagctgagtgaaagaaaaaatactgtaagacatccttaaagtttttatttgtttgggtactgtatatgagatcaggaaaaagaaaaatgtcccacagccacattggaaatacaggttcttgtccccaaattaggttagttcccagattttagatcaaaactgttaattcattaaaaccccttttaaaaggtaaattctactgttgtaattccgatagtctttttcccacaaatatcagaaatatatttatttaattctgtcagatgagctttctaccgatgccatgtcccaaagccatgttaaaataattcccacgttatcattgtgattctacttcctgccactaaaattgctggagaaacaaaataatgatggaacactatgaacaaaaaggagcatctgaactggtctggttatttagaatccaatgtgttcaaatccttttgttttcttattaagtcagatgctactgtaagtcagataaaattttgtttgcactctgcagtctttggctcaatgtatggaaatgtttgcacctatgtaaagtcacaagctaattacaaattgctacagaacaggagtaagctgaaaactgaatgccatgttttgtttataaggtggggaggggagggaaaataccaaaaaactctgttccaagtttggcatttgacattaatgtgaagcagtgggaccatgctgcctgctaaactactgtatgaatcgtaaatgttctgaagacgagcagctggaggctggaggatggcattccatacagcaaaggagaagcacccaccacttcatctgggaaaaggaaggaaattgcaggaggcctggagccatcatttgtaaaggggatgttgcggggtgtgatgctgttgaggagattcaccttcaattgcactgctccacagagccctcatataaggccaatcctaatgggctacctcggctttaaaagttaatttcagtaagtcctgtttcaaaagtttgtctttttttgcttctaccttcagtgccactattttccactgcagtgttttgacttcacaaactgcctcctccagagagaacaatgtattgctgaaaatgggcagtagaagcaaatgctgttgttacatttgacctataaagtattcagagtgactgctaggtagaaattaaaacttagctttcccaaatagctccttattttgcaccttataaaaagtatactaattgttaattagatgttgcttttgtttatacaagcattcccaaagaactagatttggattttgttttgagtttttggatttttaaaaattatcttatttagattgactaacagcatacttacaattttaaaagaagctgttgttcagttcatcttaccagatgtgtctggcgaagtattcagggtttgatggactgctttactttcgtttggaagtgatagctaagtttattatactctatattaaacaactttgttcatttcactgaggaccttatcttccttatatttcagaacaaagaagcaacaagcgtgaataaaaagacaaatgtatttgactccctcataatccccatctgtatgtgctacccttccttcaaatatataaatgtgcatctttttttttaaaaaaaaaaaaaaaaaggttcctcttctggccaaatttgatctatggtggtatgattcatactgttaaattgagagaggaaaccttgtggttaaaaattatatggctgctgttttctttttgcagtcagtggtcaaaactgatcatgtgcttaaatcgatttttatgcacagaactagttattgtgaacattactgctccctccaaagatttcctgataacttgggccagaggtggttactgagtaacaaggatctaattcaatgcctcaaaactcttccacccacaatgcaaatcttacctcacaagctctaacctaaatcacagagacatgcatgtttcatgcattaacactgatttcgctctgtggcccaccagaggggtgggctcatgtcccctgactcctcacatgagtgcctcagctctaagagccgtggaacggggggtagggaaggtttgcgatctggagctcagcaactggctcagcaacgttttctccatttcattagcactaaacaagtctcttgctctcaggaatttgtcagaaaaaagaataaaatcacctgagactccacataccagattataaactcttctcgtaggtttgaattgcttactcacatgtcataaattaaccacagcttcatttgaccaccaggtctaaagtctgttgacagtttcagcatgactgaatcgctcattttttttttttgctttcagaaattggcttggttctctttagagttggtgtaaacatgccatgtaataaatgatttccacttaatggtacaacagaattattgctttcttagatgtatgtgtagtaaaagtcaatatacacatttatataatttctttcttcaaaatcttatacctaatttgatatttctaaaaattgcacatgtaagtcatgtgtataacatgctaaagtactttaactgtgatcttaaaactgaataaaaatatttaataaaactttgaaatattttaaagatattattcaaatatatttctttatgttcacactactggccgtagagtatgtgcctttaatgtaccattttcactaaaaacagtaggaaaaatactaataaaagtaagatatttcaactaaaaaaa

SEQ ID NO: 314058 - DNA, 8742 bp, Homo sapiens
  misc_feature (1)..(2): n is a, c, g, or t
  misc_feature (4)..(4): n is a, c, g, or t
nngngtgttttcagtctctccgggttgcatgtactgtatgtggagcagtgtacagtgaagcggaggcagagcggctccgcgagcttctctccactttcccatagagaaaccctgactggccgctgagggctagctacacacacgccctcacgcccggcgagcccgcgaggtcactatcatatgacaaaggctttgccgcagttcatcttcctccctgtgtactttccatttgccttcctggaatcctgctgcatcacagaagctggaagttctgatgttccactgaaatcacaatggaaagtcttgacttgactggtcacagtaatgaaaggcagtaatagaaataaggatcattcagcagaaggagaaggggttggaaaacgaccaaaacgaaagtgtcttcagtggcatccattgctagcaaagaaacttcttgatttttcagaagaggaagaagaggaagacgaagaggaggatattgataaggttcaacttcttggggccgatggcctagagcaagatgttggtgaaactgaagatgatgaatcaccagagcagcgagcccggagaccaatgaatgcatttcttttattttgcaaacgccatcgctctcttgtacgtcaggaacaccccaggcttgataaccgaggtgctaccaagatactagctgattggtgggctgttcttgatccaaaggaaaagcagaaatacacagacatggccaaggagtataaggatgcatttatgaaagcaaatcctggctacaaatggtgtcctaccacaaacaagcctgtgaaatccccaacacccactgtcaatccacgaaagaaactttgggccttcccatctgactcttcaagagacttgccaagccccaagaaagcaaagactgaagaaatgcctcagcttaactttggaatggctgatcctactcaaatgggaggcctgagtatgctgctgttagctggagaacatgctcttggcacaccagaggtatcctctggcacatgcaggcctgatgtttcagaatctcctgaattacgtcagaagtcaccattgtttcagtttgccgagatatcttcaagtacgtcccactctgatgcttctacaaagcagtgtcaaacatctgccttgtttcagtttgcagagatttcttcaaacacttcgcagttgggtggtgctgagcctgtaaaacgctgtggaaagtctgcactctttcaactggcagagatgtgcctggcatcagaagggatgaaaatggaagaatcaaagctaataaaagcaaaagaatccgatggtggaagaattaaagaattagagaagggaaaggaagaaaaagaaattaaaatggagaaaacagatgaaactaggttacagaaggaagcagaatttgaaaaatcggctaaggaaaatttaagagattctaaggaattgagaaattttgaggcattgcaaatagatgacataatggctataaaaatggaagatcccaaagaaattagaaaggaagagttagaagaagatcacaaatgtagtcattttcctgatttttcttattctgccagtagcaagataataattagtgatgttcccagtagaaaggatcatatgtgccatcctcatggaattatgatcattgaggatcccgcagcattaaacaagccagaaaagctaaaaaagaaaaagaagaaaagcaaaatggatcgacatggaaatgataaatccacacccaagaagacttgcaaaaagaggcagtcttcggaatctgacattgagagcgtcatatataccattgaagccgtcgcaaaaggagactggggcatagagaaacttggagatacccctcgcaagaaggtccgcacatcctcaagtggcaagggaagcattttggatgccaagccaccaaagaaaaaagtgaaatcaagagagaagaaaatgtcaaaggagaaatcctcagacaccaccaaagagtcaagacctccagatttcattagtatttctgctagcaagaacatttctggtgagacaccagagggtataaaagcagaaccattgacccctatggaagatgcactaccacccagcctatcaggacaggccaagcctgaggacagtgactgtcacagaaaaatagaaacttgtggttccaggaaatccgagaggtcttgcaaaggtgctctttataaaaccctggtgtctgagggcatgctcacctctctgcgagctaatgttgacagaggaaaacgaagctcaggaaaaggaaactcctctgatcatgaagggtgttggaatgaagaaagctggacatttagtcagagtgggaccagtgggagcaagaagttcaagaagacaaagccaaaagaagactgtctccttggctccgcaaagctggatgaagaatttgaaaaaaaattcaacagcctccctcaatatagtcctgttacatttgaccggaaatgtgtacctgtcccaagaaaaaagaagaagactggaaatgtgtcctcagaaccgactaaaaccagcaaaggaagtggggataaatggtcaaacaagcaactcttcttggatgccattcaccctacagaagccatattttcagaagacagaaacaccatggagcctgttcataaggttaaaaatatcccatccattttcaacactccagagccaacaacaacgcaagaacctttggtgggcagccaaaagagaaaagcaaggaaaaccaagattacacaccttgtcaggacagcagatggccgggtatcaccagcaggaggtactttggatgacaaaccaaaggaacaactgcagaggagtctccctaaagcaactgagacagactgcaatgacaaatgctcacacaacaccgaggtcggggagacgcggagcagtactccagaaatgcctgccgtgtctgcgttctttagcctcgctgcgctggctgaagtggcagccatggaaaatgtgcacagaggtcagaggtcaactccgctcacccatgatggacagccaaaagaaatgccgcaggctcctgtacttatttcctgcgctgaccagtgaagcgccctttcattgtaaaacattgtgctttacctactaccctagccttgtctttaccgagggatgctagtgagtccaagtggtggaaaatatagactgcaaacaagtgcttgttgccccacacggcccagattcacttgaagcagaagttagcatcctgggccagtttgttctctcagaacccagaatctttgagggtaaggttatctgtctgatactgagcagaaacagaatgatcctggagctttgctttctattgaaggcttttgacggtaataggtggtaacttggtaaaaggctgcctttactgtagctcacccagcatctcttttaccaaccagagagtgtgaaactagtttcatatattacctagttattctttcaaaacaaaacaaaaaaaaaacaaaaactgacgcactgcactagttattattagatattcttagtcttttttgtacatggagatttaagtttaagatggtttatataataggttatacctacatttatattgtagaataaatattaaaaagcctgttccagagactcccaagcagcctgggcaggcagatgtaccattgttagtggtgtatgctcggcctcgtggtccatatattctgcacttttatatttgccaccagaatggtagtttgctggcaaaaaaaaaaaaaagagagagagaaaaaattacaactcttacaatctgaatttttttcttagccttgagtgaccaagaagaatttgcttgaggcaaattgtggcaaatattttcccagacaggggaagagtcctgcagattacagattactggtgttttcatgccttgaggattcttttatttttacataggggtctaagtgaccaatggattgttcatacaaacaaaaaaaaagacaaaaatattattcagaagtgaccttagtattacttcactattctaaacacattgaagacactcacttcatgtggacttggagctacagaccttttacatccatcacagattggctggacgggttgcaattgctatgcacagcctgattggcactgcaggtttttagagccattttgagtttgtgttgtttaggaggtactgagtcaatgatgagggaggtatgcctgaccagagtgggactctcagtcatagatccacctgcaagtctctgtttcctttttgtgttttgttgcttttgaacataaaaccaaccatacataagcagcgccaagtggattaactggcttagaacattcaacatattgacttaaccacctgacattcacagtgtcttgtttcctagcaacagatgcaaagtgataaatctatttccccactcttgcgtcacagcacaaactaccaaattttaattattggattccagcaataatttttaatggttttcaaactggcggaattttgacagtgctagttcgagtttgaagcttttgaattagatctctaaatggtgacagtttacatggttttatctagctttcttatttatacttgactgaattgtaatgattttttttctaattgtaatttgacgtaatagccatacaaaaaatgactctattcatactaggtttagcttctcatggttgtagatattacttcagttccggtgctggaaaatatgtacaacatactaacaggattgaaaaaaaaatagaggtttttcttcttgtttttttttccaaagcaggtaaagagggtagcaaagcatcggaatgatgtgctcaaaaatgcatattcctggtggggatggaggaagaaggcattagtaaaaggttaatcaaacgttacaacttaaccccattcatgtaggaataaatcaagtgagcagttccagacttttgcataatatttttactatgatgctgttttattaatattttctaaatttcaaaacaaaaagtgaatgtttgaaattgctgggtcccgatgttggtggctgttggagttttggaccactcgctagcagtgatttgaagattataattagctaaaatccaaaacaaaaaaccaacaacaaaaattgtatggtgcggaacatgcaccttgacaatggtactaacttgttattctatagaacacgttagaatagatctatttttgccagagcaccctccttcagtcctccgattacatttcactagagttccttacgagattgctgtatattcctgggacctttttttaaaaaaaaaaaaagcaaaacaaaagattactttttttctatgtgattaatatcttacttgatctgcttttcctaaacctcagtggcttttcccttaggcagggttgggggtgggagggcaacttactggagatgactgttttcagatactttaaaacaaacctttttgtagaaatgcttaatttttaagcggttaggcactgagagtagcagaaatcctgcaaagctttatagttccttagactcaccttgtcgattctctgagtaaagtcttgatttcaataattgtgcttctcatgccctgaatctgctggagaggagtgttgttattttcaggtaacaacattcgttagcacaaatatttcagaccaatattagtgctctccaccccaccttttgttatcattttcatttcatttctctcattcttttttattttggaaaatcatattgctatagtgtgtactttaatctgccagcagataccatctacactaacatttgtcccacagcatcctcaagagaaaaagttgttgcaccttatatatatctcaagcaaaccaaaatatgatgctcttctgctttgttttattctaaattgttgtatcatatctttctgaaaccattctgaatttagttgaaattatcaatatttatgcttttaaccttaatttctggattcaagcctgtatataaatcttttgaaaaaaaattgtcctagcccttctctgcgatgctggaagtagaagattgcgtctcagatggagacgcagtactgttccagttttctttagccttttatttatttagttattctgggtatttcctatgtaattttgaagtgtgtagagtatattatagtaactgaagctgcagctgtaagaagctgagtgaaagaaaaaatactgtaagacatccttaaagtttttatttgtttgggtactgtatatgagatcaggaaaaagaaaaatgtcccacagccacattggaaatacaggttcttgtccccaaattaggttagttcccagattttagatcaaaactgttaattcattaaaaccccttttaaaaggtaaattctactgttgtaattccgatagtctttttcccacaaatatcagaaatatatttatttaattctgtcagatgagctttctaccgatgccatgtcccaaagccatgttaaaataattcccacgttatcattgtgattctacttcctgccactaaaattgctggagaaacaaaataatgatggaacactatgaacaaaaaggagcatctgaactggtctggttatttagaatccaatgtgttcaaatccttttgttttcttattaagtcagatgctactgtaagtcagataaaattttgtttgcactctgcagtctttggctcaatgtatggaaatgtttgcacctatgtaaagtcacaagctaattacaaattgctacagaacaggagtaagctgaaaactgaatgccatgttttgtttataaggtggggaggggagggaaaataccaaaaaactctgttccaagtttggcatttgacattaatgtgaagcagtgggaccatgctgcctgctaaactactgtatgaatcgtaaatgttctgaagacgagcagctggaggctggaggatggcattccatacagcaaaggagaagcacccaccacttcatctgggaaaaggaaggaaattgcaggaggcctggagccatcatttgtaaaggggatgttgcggggtgtgatgctgttgaggagattcaccttcaattgcactgctccacagagccctcatataaggccaatcctaatgggctacctcggctttaaaagttaatttcagtaagtcctgtttcaaaagtttgtctttttttgcttctaccttcagtgccactattttccactgcagtgttttgacttcacaaactgcctcctccagagagaacaatgtattgctgaaaatgggcagtagaagcaaatgctgttgttacatttgacctataaagtattcagagtgactgctaggtagaaattaaaacttagctttcccaaatagctccttattttgcaccttataaaaagtatactaattgttaattagatgttgcttttgtttatacaagcattcccaaagaactagatttggattttgttttgagtttttggatttttaaaaattatcttatttagattgactaacagcatacttacaattttaaaagaagctgttgttcagttcatcttaccagatgtgtctggcgaagtattcagggtttgatggactgctttactttcgtttggaagtgatagctaagtttattatactctatattaaacaactttgttcatttcactgaggaccttatcttccttatatttcagaacaaagaagcaacaagcgtgaataaaaagacaaatgtatttgactccctcataatccccatctgtatgtgctacccttccttcaaatatataaatgtgcatctttttttttaaaaaaaaaaaaaaaaaggttcctcttctggccaaatttgatctatggtggtatgattcatactgttaaattgagagaggaaaccttgtggttaaaaattatatggctgctgttttctttttgcagtcagtggtcaaaactgatcatgtgcttaaatcgatttttatgcacagaactagttattgtgaacattactgctccctccaaagatttcctgataacttgggccagaggtggttactgagtaacaaggatctaattcaatgcctcaaaactcttccacccacaatgcaaatcttacctcacaagctctaacctaaatcacagagacatgcatgtttcatgcattaacactgatttcgctctgtggcccaccagaggggtgggctcatgtcccctgactcctcacatgagtgcctcagctctaagagccgtggaacggggggtagggaaggtttgcgatctggagctcagcaactggctcagcaacgttttctccatttcattagcactaaacaagtctcttgctctcaggaatttgtcagaaaaaagaataaaatcacctgagactccacataccagattataaactcttctcgtaggtttgaattgcttactcacatgtcataaattaaccacagcttcatttgaccaccaggtctaaagtctgttgacagtttcagcatgactgaatcgctcattttttttttttgctttcagaaattggcttggttctctttagagttggtgtaaacatgccatgtaataaatgatttccacttaatggtacaacagaattattgctttcttagatgtatgtgtagtaaaagtcaatatacacatttatataatttctttcttcaaaatcttatacctaatttgatatttctaaaaattgcacatgtaagtcatgtgtataacatgctaaagtactttaactgtgatcttaaaactgaataaaaatatttaataaaactttgaa

SEQ ID NO: 314059 - DNA, 8741 bp, Homo sapiens
  misc_feature (1)..(2): n is a, c, g, or t
  misc_feature (4)..(4): n is a, c, g, or t
nngngtgttttcagtctctccgggttgcatgtactgtatgtggagcagtgtacagtgaagcggaggcagagcggctccgcgagcttctctccactttcccatagagaaaccctgactggccgctgagggctagctacacacacgccctcacgcccggcgagcccgcgaggtcactatcatatgacaaaggctttgccgcagttcatcttcctccctgtgtactttccatttgccttcctggaatcctgctgcatcacagaagctggaagttctgatgttccactgaaatcacaatggaaagtcttgacttgactggtcacagtaatgaaaggcagtaatagaaataaggatcattcagcagaaggagaaggggttggaaaacgaccaaaacgaaagtgtcttcagtggcatccattgctagcaaagaaacttcttgatttttcagaagaggaagaagaggaagacgaagaggaggatattgataaggttcaacttcttggggccgatggcctagagcaagatgttggtgaaactgaagatgatgaatcaccagagcagcgagcccggagaccaatgaatgcatttcttttattttgcaaacgccatcgctctcttgtacgtcaggaacaccccaggcttgataaccgaggtgctaccaagatactagctgattggtgggctgttcttgatccaaaggaaaagcagaaatacacagacatggccaaggagtataaggatgcatttatgaaagcaaatcctggctacaaatggtgtcctaccacaaacaagcctgtgaaatccccaacacccactgtcaatccacgaaagaaactttgggccttcccatctgactcttcaagagacttgccaagccccaagaaagcaaagactgaagaaatgcctcagcttaactttggaatggctgatcctactcaaatgggaggcctgagtatgctgctgttagctggagaacatgctcttggcacaccagaggtatcctctggcacatgcaggcctgatgtttcagaatctcctgaattacgtcagaagtcaccattgtttcagtttgccgagatatcttcaagtacgtcccactctgatgcttctacaaagcagtgtcaaacatctgccttgtttcagtttgcagagatttcttcaaacacttcgcagttgggtggtgctgagcctgtaaaacgctgtggaaagtctgcactctttcaactggcagagatgtgcctggcatcagaagggatgaaaatggaagaatcaaagctaataaaagcaaaagaatccgatggtggaagaattaaagaattagagaagggaaaggaagaaaaagaaattaaaatggagaaaacagatgaaactaggttacagaaggaagcagaatttgaaaaatcggctaaggaaaatttaagagattctaaggaattgagaaattttgaggcattgcaaatagatgacataatggctataaaaatggaagatcccaaagaaattagaaaggaagagttagaagaagatcacaaatgtagtcattttcctgatttttcttattctgccagtagcaagataataattagtgatgttcccagtagaaaggatcatatgtgccatcctcatggaattatgatcattgaggatcccgcagcattaaacaagccagaaaagctaaaaaagaaaaagaagaaaagcaaaatggatcgacatggaaatgataaatccacacccaagaagacttgcaaaaagaggcagtcttcggaatctgacattgagagcgtcatatataccattgaagccgtcgcaaaaggagactggggcatagagaaacttggagatacccctcgcaagaaggtccgcacatcctcaagtggcaagggaagcattttggatgccaagccaccaaagaaaaaagtgaaatcaagagagaagaaaatgtcaaaggagaaatcctcagacaccaccaaagagtcaagacctccagatttcattagtatttctgctagcaagaacatttctggtgagacaccagagggtataaaagcagaaccattgacccctatggaagatgcactaccacccagcctatcaggacaggccaagcctgaggacagtgactgtcacagaaaaatagaaacttgtggttccaggaaatccgagaggtcttgcaaaggtgctctttataaaaccctggtgtctgagggcatgctcacctctctgcgagctaatgttgacagaggaaaacgaagctcaggaaaaggaaactcctctgatcatgaagggtgttggaatgaagaaagctggacatttagtcagagtgggaccagtgggagcaagaagttcaagaagacaaagccaaaagaagactgtctccttggctccgcaaagctggatgaagaatttgaaaaaaaattcaacagcctccctcaatatagtcctgttacatttgaccggaaatgtgtacctgtcccaagaaaaaagaagaagactggaaatgtgtcctcagaaccgactaaaaccagcaaaggaagtggggataaatggtcaaacaagcaactcttcttggatgccattcaccctacagaagccatattttcagaagacagaaacaccatggagcctgttcataaggttaaaaatatcccatccattttcaacactccagagccaacaacaacgcaagaacctttggtgggcagccaaaagagaaaagcaaggaaaaccaagattacacaccttgtcaggacagcagatggccgggtatcaccagcaggaggtactttggatgacaaaccaaaggaacaactgcagaggagtctccctaaagcaactgagacagactgcaatgacaaatgctcacacaacaccgaggtcggggagacgcggagcagtactccagaaatgcctgccgtgtctgcgttctttagcctcgctgcgctggctgaagtggcagccatggaaaatgtgcacagaggtcagaggtcaactccgctcacccatgatggacagccaaaagaaatgccgcaggctcctgtacttatttcctgcgctgaccagtgaagcgccctttcattgtaaaacattgtgctttacctactaccctagccttgtctttaccgagggatgctagtgagtccaagtggtggaaaatatagactgcaaacaagtgcttgttgccccacacggcccagattcacttgaagcagaagttagcatcctgggccagtttgttctctcagaacccagaatctttgagggtaaggttatctgtctgatactgagcagaaacagaatgatcctggagctttgctttctattgaaggcttttgacggtaataggtggtaacttggtaaaaggctgcctttactgtagctcacccagcatctcttttaccaaccagagagtgtgaaactagtttcatatattacctagttattctttcaaaacaaaacaaaaaaaaaacaaaaactgacgcactgcactagttattattagatattcttagtcttttttgtacatggagatttaagtttaagatggtttatataataggttatacctacatttatattgtagaataaatattaaaaagcctgttccagagactcccaagcagcctgggcaggcagatgtaccattgttagtggtgtatgctcggcctcgtggtccatatattctgcacttttatatttgccaccagaatggtagtttgctggcaaaaaaaaaaaaaagagagagagaaaaaattacaactcttacaatctgaatttttttcttagccttgagtgaccaagaagaatttgcttgaggcaaattgtggcaaatattttcccagacaggggaagagtcctgcagattacagattactggtgttttcatgccttgaggattcttttatttttacataggggtctaagtgaccaatggattgttcatacaaacaaaaaaaaagacaaaaatattattcagaagtgaccttagtattacttcactattctaaacacattgaagacactcacttcatgtggacttggagctacagaccttttacatccatcacagattggctggacgggttgcaattgctatgcacagcctgattggcactgcaggtttttagagccattttgagtttgtgttgtttaggaggtactgagtcaatgatgagggaggtatgcctgaccagagtgggactctcagtcatagatccacctgcaagtctctgtttcctttttgtgttttgttgcttttgaacataaatattgacttaaccacctgacattcacagtgtcttgtttcctagcaacagatgcaaagtgataaatcaaaattagtctgaggctacagattttacagggtatttgttctatagcacaaagtatttccccactcttgcgtcacagcacaaactaccaaattttaattattggattccagcaataatttttaatggttttcaaactggcggaattttgacagtgctagttcgagtttgaagcttttgaattagatctctaaatggtgacagtttacatggttttatctagctttcttatttatacttgactgaattgtaatgattttttttctaattgtaatttgacgtaatagccatacaaaaaatgactctattcatactaggtttagcttctcatggttgtagatattacttcagttccggtgctggaaaatatgtacaacatactaacaggattgaaaaaaaaatagaggtttttcttcttgtttttttttccaaagcaggtaaagagggtagcaaagcatcggaatgatgtgctcaaaaatgcatattcctggtggggatggaggaagaaggcattagtaaaaggttaatcaaacgttacaacttaaccccattcatgtaggaataaatcaagtgagcagttccagacttttgcataatatttttactatgatgctgttttattaatattttctaaatttcaaaacaaaaagtgaatgtttgaaattgctgggtcccgatgttggtggctgttggagttttggaccactcgctagcagtgatttgaagattataattagctaaaatccaaaacaaaaaaccaacaacaaaaattgtatggtgcggaacatgcaccttgacaatggtactaacttgttattctatagaacacgttagaatagatctatttttgccagagcaccctccttcagtcctccgattacatttcactagagttccttacgagattgctgtatattcctgggacctttttttaaaaaaaaaaaaagcaaaacaaaagattactttttttctatgtgattaatatcttacttgatctgcttttcctaaacctcagtggcttttcccttaggcagggttgggggtgggagggcaacttactggagatgactgttttcagatactttaaaacaaacctttttgtagaaatgcttaatttttaagcggttaggcactgagagtagcagaaatcctgcaaagctttatagttccttagactcaccttgtcgattctctgagtaaagtcttgatttcaataattgtgcttctcatgccctgaatctgctggagaggagtgttgttattttcaggtaacaacattcgttagcacaaatatttcagaccaatattagtgctctccaccccaccttttgttatcattttcatttcatttctctcattcttttttattttggaaaatcatattgctatagtgtgtactttaatctgccagcagataccatctacactaacatttgtcccacagcatcctcaagagaaaaagttgttgcaccttatatatatctcaagcaaaccaaaatatgatgctcttctgctttgttttattctaaattgttgtatcatatctttctgaaaccattctgaatttagttgaaattatcaatatttatgcttttaaccttaatttctggattcaagcctgtatataaatcttttgaaaaaaaattgtcctagcccttctctgcgatgctggaagtagaagattgcgtctcagatggagacgcagtactgttccagttttctttagccttttatttatttagttattctgggtatttcctatgtaattttgaagtgtgtagagtatattatagtaactgaagctgcagctgtaagaagctgagtgaaagaaaaaatactgtaagacatccttaaagtttttatttgtttgggtactgtatatgagatcaggaaaaagaaaaatgtcccacagccacattggaaatacaggttcttgtccccaaattaggttagttcccagattttagatcaaaactgttaattcattaaaaccccttttaaaaggtaaattctactgttgtaattccgatagtctttttcccacaaatatcagaaatatatttatttaattctgtcagatgagctttctaccgatgccatgtcccaaagccatgttaaaataattcccacgttatcattgtgattctacttcctgccactaaaattgctggagaaacaaaataatgatggaacactatgaacaaaaaggagcatctgaactggtctggttatttagaatccaatgtgttcaaatccttttgttttcttattaagtcagatgctactgtaagtcagataaaattttgtttgcactctgcagtctttggctcaatgtatggaaatgtttgcacctatgtaaagtcacaagctaattacaaattgctacagaacaggagtaagctgaaaactgaatgccatgttttgtttataaggtggggaggggagggaaaataccaaaaaactctgttccaagtttggcatttgacattaatgtgaagcagtgggaccatgctgcctgctaaactactgtatgaatcgtaaatgttctgaagacgagcagctggaggctggaggatggcattccatacagcaaaggagaagcacccaccacttcatctgggaaaaggaaggaaattgcaggaggcctggagccatcatttgtaaaggggatgttgcggggtgtgatgctgttgaggagattcaccttcaattgcactgctccacagagccctcatataaggccaatcctaatgggctacctcggctttaaaagttaatttcagtaagtcctgtttcaaaagtttgtctttttttgcttctaccttcagtgccactattttccactgcagtgttttgacttcacaaactgcctcctccagagagaacaatgtattgctgaaaatgggcagtagaagcaaatgctgttgttacatttgacctataaagtattcagagtgactgctaggtagaaattaaaacttagctttcccaaatagctccttattttgcaccttataaaaagtatactaattgttaattagatgttgcttttgtttatacaagcattcccaaagaactagatttggattttgttttgagtttttggatttttaaaaattatcttatttagattgactaacagcatacttacaattttaaaagaagctgttgttcagttcatcttaccagatgtgtctggcgaagtattcagggtttgatggactgctttactttcgtttggaagtgatagctaagtttattatactctatattaaacaactttgttcatttcactgaggaccttatcttccttatatttcagaacaaagaagcaacaagcgtgaataaaaagacaaatgtatttgactccctcataatccccatctgtatgtgctacccttccttcaaatatataaatgtgcatctttttttttaaaaaaaaaaaaaaaaaggttcctcttctggccaaatttgatctatggtggtatgattcatactgttaaattgagagaggaaaccttgtggttaaaaattatatggctgctgttttctttttgcagtcagtggtcaaaactgatcatgtgcttaaatcgatttttatgcacagaactagttattgtgaacattactgctccctccaaagatttcctgataacttgggccagaggtggttactgagtaacaaggatctaattcaatgcctcaaaactcttccacccacaatgcaaatcttacctcacaagctctaacctaaatcacagagacatgcatgtttcatgcattaacactgatttcgctctgtggcccaccagaggggtgggctcatgtcccctgactcctcacatgagtgcctcagctctaagagccgtggaacggggggtagggaaggtttgcgatctggagctcagcaactggctcagcaacgttttctccatttcattagcactaaacaagtctcttgctctcaggaatttgtcagaaaaaagaataaaatcacctgagactccacataccagattataaactcttctcgtaggtttgaattgcttactcacatgtcataaattaaccacagcttcatttgaccaccaggtctaaagtctgttgacagtttcagcatgactgaatcgctcattttttttttttgctttcagaaattggcttggttctctttagagttggtgtaaacatgccatgtaataaatgatttccacttaatggtacaacagaattattgctttcttagatgtatgtgtagtaaaagtcaatatacacatttatataatttctttcttcaaaatcttatacctaatttgatatttctaaaaattgcacatgtaagtcatgtgtataacatgctaaagtactttaactgtgatcttaaaactgaataaaaatatttaataaaactttgaa

SEQ ID NO: 314060 - DNA, 8998 bp, Homo sapiens
  misc_feature (1)..(2): n is a, c, g, or t
  misc_feature (4)..(4): n is a, c, g, or t
nngngtgttttcagtctctccgggttgcatgtactgtatgtggagcagtgtacagtgaagcggaggcagagcggctccgcgagcttctctccactttcccatagagaaaccctgactggccgctgagggctagctacacacacgccctcacgcccggcgagcccgcgaggtcactatcatatgacaaaggctttgccgcagttcatcttcctccctgtgtactttccatttgccttcctggaatcctgctgcatcacagaagctggaagttctgatgttccactgaaatcacaatggaaagtcttgacttgactggtcacagtaatgaaaggcagtaatagaaataaggatcattcagcagaaggagaaggggttggaaaacgaccaaaacgaaagtgtcttcagtggcatccattgctagcaaagaaacttcttgatttttcagaagaggaagaagaggaagacgaagaggaggatattgataaggttcaacttcttggggccgatggcctagagcaagatgttggtgaaactgaagatgatgaatcaccagagcagcgagcccggagaccaatgaatgcatttcttttattttgcaaacgccatcgctctcttgtacgtcaggaacaccccaggcttgataaccgaggtgctaccaagatactagctgattggtgggctgttcttgatccaaaggaaaagcagaaatacacagacatggccaaggagtataaggatgcatttatgaaagcaaatcctggctacaaatggtgtcctaccacaaacaagcctgtgaaatccccaacacccactgtcaatccacgaaagaaactttgggccttcccatctgactcttcaagagacttgccaagccccaagaaagcaaagactgaagaaatgcctcagcttaactttggaatggctgatcctactcaaatgggaggcctgagtatgctgctgttagctggagaacatgctcttggcacaccagaggtatcctctggcacatgcaggcctgatgtttcagaatctcctgaattacgtcagaagtcaccattgtttcagtttgccgagatatcttcaagtacgtcccactctgatgcttctacaaagcagtgtcaaacatctgccttgtttcagtttgcagagatttcttcaaacacttcgcagttgggtggtgctgagcctgtaaaacgctgtggaaagtctgcactctttcaactggcagagatgtgcctggcatcagaagggatgaaaatggaagaatcaaagctaataaaagcaaaagaatccgatggtggaagaattaaagaattagagaagggaaaggaagaaaaagaaattaaaatggagaaaacagatgaaactaggttacagaaggaagcagaatttgaaaaatcggctaaggaaaatttaagagattctaaggaattgagaaattttgaggcattgcaaatagatgacataatggctataaaaatggaagatcccaaagaaattagaaaggaagagttagaagaagatcacaaatgtagtcattttcctgatttttcttattctgccagtagcaagataataattagtgatgttcccagtagaaaggatcatatgtgccatcctcatggaattatgatcattgaggatcccgcagcattaaacaagccagaaaagctaaaaaagaaaaagaagaaaagcaaaatggatcgacatggaaatgataaatccacacccaagaagacttgcaaaaagaggcagtcttcggaatctgacattgagagcgtcatatataccattgaagccgtcgcaaaaggagactggggcatagagaaacttggagatacccctcgcaagaaggtccgcacatcctcaagtggcaagggaagcattttggatgccaagccaccaaagaaaaaagtgaaatcaagagagaagaaaatgtcaaaggagaaatcctcagacaccaccaaagagtcaagacctccagatttcattagtatttctgctagcaagaacatttctggtgagacaccagagggtataaaagcagaaccattgacccctatggaagatgcactaccacccagcctatcaggacaggccaagcctgaggacagtgactgtcacagaaaaatagaaacttgtggttccaggaaatccgagaggtcttgcaaaggtgctctttataaaaccctggtgtctgagggcatgctcacctctctgcgagctaatgttgacagaggaaaacgaagctcaggaaaaggaaactcctctgatcatgaagggtgttggaatgaagaaagctggacatttagtcagagtgggaccagtgggagcaagaagttcaagaagacaaagccaaaagaagactgtctccttggctccgcaaagctggatgaagaatttgaaaaaaaattcaacagcctccctcaatatagtcctgttacatttgaccggaaatgtgtacctgtcccaagaaaaaagaagaagactggaaatgtgtcctcagaaccgactaaaaccagcaaaggaagtggggataaatggtcaaacaagcaactcttcttggatgccattcaccctacagaagccatattttcagaagacagaaacaccatggagcctgttcataaggttaaaaatatcccatccattttcaacactccagagccaacaacaacgcaagaacctttggtgggcagccaaaagagaaaagcaaggaaaaccaagattacacaccttgtcaggacagcagatggccgggtatcaccagcaggaggtactttggatgacaaaccaaaggaacaactgcagaggagtctccctaaagcaactgagacagactgcaatgacaaatgctcacacaacaccgaggtcggggagacgcggagcagtactccagaaatgcctgccgtgtctgcgttctttagcctcgctgcgctggctgaagtggcagccatggaaaatgtgcacagaggtcagaggtcaactccgctcacccatgatggacagccaaaagaaatgccgcaggctcctgtacttatttcctgcgctgaccagtgaagcgccctttcattgtaaaacattgtgctttacctactaccctagccttgtctttaccgagggatgctagtgagtccaagtggtggaaaatatagactgcaaacaagtgcttgttgccccacacggcccagattcacttgaagcagaagttagcatcctgggccagtttgttctctcagaacccagaatctttgagggtaaggttatctgtctgatactgagcagaaacagaatgatcctggagctttgctttctattgaaggcttttgacggtaataggtggtaacttggtaaaaggctgcctttactgtagctcacccagcatctcttttaccaaccagagagtgtgaaactagtttcatatattacctagttattctttcaaaacaaaacaaaaaaaaaacaaaaactgacgcactgcactagttattattagatattcttagtcttttttgtacatggagatttaagtttaagatggtttatataataggttatacctacatttatattgtagaataaatattaaaaagcctgttccagagactcccaagcagcctgggcaggcagatgtaccattgttagtggtgtatgctcggcctcgtggtccatatattctgcacttttatatttgccaccagaatggtagtttgctggcaaaaaaaaaaaaaagagagagagaaaaaattacaactcttacaatctgaatttttttcttagccttgagtgaccaagaagaatttgcttgaggcaaattgtggcaaatattttcccagacaggggaagagtcctgcagattacagattactggtgttttcatgccttgaggattcttttatttttacataggggtctaagtgaccaatggattgttcatacaaacaaaaaaaaagacaaaaatattattcagaagtgaccttagtattacttcactattctaaacacattgaagacactcacttcatgtggacttggagctacagaccttttacatccatcacagattggctggacgggttgcaattgctatgcacagcctgattggcactgcaggtttttagagccattttgagtttgtgttgtttaggaggtactgagtcaatgatgagggaggtatgcctgaccagagtgggactctcagtcatagatccacctgcaagtctctgtttcctttttgtgttttgttgcttttgaacataaaaccaaccatacataagcagcgccaagtggattaactggcttagaacattcaacatattgacttaaccacctgacattcacagtgtcttgtttcctagcaacagatgcaaagtgataaatcaaaattagtctgaggctacagattttacagggtatttgttctatagcacaaagtatttccccactcttgcgtcacagcacaaactaccaaattttaattattggattccagcaataatttttaatggttttcaaactggcggaattttgacagtgctagttcgagtttgaagcttttgaattagatctctaaatggtgacagtttacatggttttatctagctttcttatttatacttgactgaattgtaatgattttttttctaattgtaatttgacgtaatagccatacaaaaaatgactctattcatactaggtttagcttctcatggttgtagatattacttcagttccggtgctggaaaatatgtacaacatactaacaggattgaaaaaaaaatagaggtttttcttcttgtttttttttccaaagcaggtaaagagggtagcaaagcatcggaatgatgtgctcaaaaatgcatattcctggtggggatggaggaagaaggcattagtaaaaggttaatcaaacgttacaacttaaccccattcatgtaggaataaatcaagtgagcagttccagacttttgcataatatttttactatgatgctgttttattaatattttctaaatttcaaaacaaaaagtgaatgtttgaaattgctgggtcccgatgttggtggctgttggagttttggaccactcgctagcagtgatttgaagattataattagctaaaatccaaaacaaaaaaccaacaacaaaaattgtatggtgcggaacatgcaccttgacaatggtactaacttgttattctatagaacacgttagaatagatctatttttgccagagcaccctccttcagtcctccgattacatttcactagagttccttacgagattgctgtatattcctgggacctttttttaaaaaaaaaaaaagcaaaacaaaagattactttttttctatgtgattaatatcttacttgatctgcttttcctaaacctcagtggcttttcccttaggcagggttgggggtgggagggcaacttactggagatgactgttttcagatactttaaaacaaacctttttgtagaaatgcttaatttttaagcggttaggcactgagagtagcagaaatcctgcaaagctttatagttccttagactcaccttgtcgattctctgagtaaagtcttgatttcaataattgtgcttctcatgccctgaatctgctggagaggagtgttgttattttcaggtaacaacattcgttagcacaaatatttcagaccaatattagtgctctccaccccaccttttgttatcattttcatttcatttctctcattcttttttattttggaaaatcatattgctatagtgtgtactttaatctgccagcagataccatctacactaacatttgtcccacagcatcctcaagagaaaaagttgttgcaccttatatatatctcaagcaaaccaaaatatgatgctcttctgctttgttttattctaaattgttgtatcatatctttctgaaaccattctgaatttagttgaaattatcaatatttatgcttttaaccttaatttctggattcaagcctgtatataaatcttttgaaaaaaaattgtcctagcccttctctgcgatgctggaagtagaagattgcgtctcagatggagacgcagtactgttccagttttctttagccttttatttatttagttattctgggtatttcctatgtaattttgaagtgtgtagagtatattatagtaactgaagctgcagctgtaagaagctgagtgaaagaaaaaatactgtaagacatccttaaagtttttatttgtttgggtactgtatatgagatcaggaaaaagaaaaatgtcccacagccacattggaaatacaggttcttgtccccaaattaggttagttcccagattttagatcaaaactgttaattcattaaaaccccttttaaaaggtaaattctactgttgtaattccgatagtctttttcccacaaatatcagaaatatatttatttaattctgtcagatgagctttctaccgatgccatgtcccaaagccatgttaaaataattcccacgttatcattgtgattctacttcctgccactaaaattgctggagaaacaaaataatgatggaacactatgaacaaaaaggagcatctgaactggtctggttatttagaatccaatgtgttcaaatccttttgttttcttattaagtcagatgctactgtaagtcagataaaattttgtttgcactctgcagtctttggctcaatgtatggaaatgtttgcacctatgtaaagtcacaagctaattacaaattgctacagaacaggagtaagctgaaaactgaatgccatgttttgtttataaggtggggaggggagggaaaataccaaaaaactctgttccaagtttggcatttgacattaatgtgaagcagtgggaccatgctgcctgctaaactactgtatgaatcgtaaatgttctgaagacgagcagctggaggctggaggatggcattccatacagcaaaggagaagcacccaccacttcatctgggaaaaggaaggaaattgcaggaggcctggagccatcatttgtaaaggggatgttgcggggtgtgatgctgttgaggagattcaccttcaattgcactgctccacagagccctcatataaggccaatcctaatgggctacctcggctttaaaagttaatttcagtaagtcctgtttcaaaagtttgtctttttttgcttctaccttcagtgccactattttccactgcagtgttttgacttcacaaactgcctcctccagagagaacaatgtattgctgaaaatgggcagtagaagcaaatgctgttgttacatttgacctataaagtattcagagtgactgctaggtagaaattaaaacttagctttcccaaatagctccttattttgcaccttataaaaagtatactaattgttaattagatgttgcttttgtttatacaagcattcccaaagaactagatttggattttgttttgagtttttggatttttaaaaattatcttatttagattgactaacagcatacttacaattttaaaagaagctgttgttcagttcatcttaccagatgtgtctggcgaagtattcagggtttgatggactgctttactttcgtttggaagtgatagctaagtttattatactctatattaaacaactttgttcatttcactgaggaccttatcttccttatatttcagaacaaagaagcaacaagcgtgaataaaaagacaaatgtatttgactccctcataatccccatctgtatgtgctacccttccttcaaatatataaatgtgcatctttttttttaaaaaaaaaaaaaaaaaggttcctcttctggccaaatttgatctatggtggtatgattcatactgttaaattgagagaggaaaccttgtggttaaaaattatatggctgctgttttctttttgcagtcagtggtcaaaactgatcatgtgcttaaatcgatttttatgcacagaactagttattgtgaacattactgctccctccaaagatttcctgataacttgggccagaggtggttactgagtaacaaggatctaattcaatgcctcaaaactcttccacccacaatgcaaatcttacctcacaagctctaacctaaatcacagagacatgcatgtttcatgcattaacactgatttcgctctgtggcccaccagaggggtgggctcatgtcccctgactcctcacatgagtgcctcagctctaagagccgtggaacggggggtagggaaggtttgcgatctggagctcagcaactggctcagcaacgttttctccatttcattagcactaaacaagtctcttgctctcaggaatttgtcagaaaaaagaataaaatcacctgagactccacataccagattataaactcttctcgtaggtttgaattgcttactcacatgtcataaattaaccacagcttcatttgaccaccaggtctaaagtctgttgacagtttcagcatgactgaatcgctcattttttttttttgctttcagaaattggcttggttctctttagagttggtgtaaacatgccatgtaataaatgatttccacttaatggtacaacagaattattgctttcttagatgtatgtgtagtaaaagtcaatatacacatttatataatttctttcttcaaaatcttatacctaatttgatatttctaaaaattgcacatgtaagtcatgtgtataacatgctaaagtactttaactgtgatcttaaaactgaataaaaatatttaataaaactttgaaatattttaaagatattattcaaatatatttctttatgttccacccctcaaaaaaaaaaaaaaaaaaacaacacaaaacacaacacaacaaagccggagcacgcaacaaaaaaaacccaagcaaagagacaaaaaacacaaacaatcttcacaaacgccaacaaaaagaattatcaaacacaaaaccacgccacaaaaaaaatc

SEQ ID NO: 314061 - DNA, 8973 bp, Homo sapiens
  misc_feature (1)..(2): n is a, c, g, or t
  misc_feature (4)..(4): n is a, c, g, or t
nngngtgttttcagtctctccgggttgcatgtactgtatgtggagcagtgtacagtgaagcggaggcagagcggctccgcgagcttctctccactttcccatagagaaaccctgactggccgctgagggctagctacacacacgccctcacgcccggcgagcccgcgaggtcactatcatatgacaaaggctttgccgcagttcatcttcctccctgtgtactttccatttgccttcctggaatcctgctgcatcacagaagctggaagttctgatgttccactgaaatcacaatggaaagtcttgacttgactggtaagagctgttgtgaaggtacatcttacttacttacctggaagcagtgaggcagtcaagaattatgtgctgtcagagctggtctcagcatgatcaaggaagtgtgatcattggatatttttttcttgtcaattttattattttttaaagtgtgacttttattgatctccattatcaagtcacagtaatgaaaggcagtaatagaaataaggatcattcagcagaaggagaaggggttggaaaacgaccaaaacgaaagtgtcttcagtggcatccattgctagcaaagaaacttcttgatttttcagaagaggaagaagaggaagacgaagaggaggatattgataaggttcaacttcttggggccgatggcctagagcaagatgttggtgaaactgaagatgatgaatcaccagagcagcgagcccggagaccaatgaatgcatttcttttattttgcaaacgccatcgctctcttgtacgtcaggaacaccccaggcttgataaccgaggtgctaccaagatactagctgattggtgggctgttcttgatccaaaggaaaagcagaaatacacagacatggccaaggagtataaggatgcatttatgaaagcaaatcctggctacaaatggtgtcctaccacaaacaagcctgtgaaatccccaacacccactgtcaatccacgaaagaaactttgggccttcccatctgactcttcaagagacttgccaagccccaagaaagcaaagactgaagaaatgcctcagcttaactttggaatggctgatcctactcaaatgggaggcctgagtatgctgctgttagctggagaacatgctcttggcacaccagaggtatcctctggcacatgcaggcctgatgtttcagaatctcctgaattacgtcagaagtcaccattgtttcagtttgccgagatatcttcaagtacgtcccactctgatgcttctacaaagcagtgtcaaacatctgccttgtttcagtttgcagagatttcttcaaacacttcgcagttgggtggtgctgagcctgtaaaacgctgtggaaagtctgcactctttcaactggcagagatgtgcctggcatcagaagggatgaaaatggaagaatcaaagctaataaaagcaaaagaatccgatggtggaagaattaaagaattagagaagggaaaggaagaaaaagaaattaaaatggagaaaacagatgaaactaggttacagaaggaagcagaatttgaaaaatcggctaaggaaaatttaagagattctaaggaattgagaaattttgaggcattgcaaatagatgacataatggctataaaaatggaagatcccaaagaaattagaaaggaagagttagaagaagatcacaaatgtagtcattttcctgatttttcttattctgccagtagcaagataataattagtgatgttcccagtagaaaggatcatatgtgccatcctcatggaattatgatcattgaggatcccgcagcattaaacaagccagaaaagctaaaaaagaaaaagaagaaaagcaaaatggatcgacatggaaatgataaatccacacccaagaagacttgcaaaaagaggcagtcttcggaatctgacattgagagcgtcatatataccattgaagccgtcgcaaaaggagactggggcatagagaaacttggagatacccctcgcaagaaggtccgcacatcctcaagtggcaagggaagcattttggatgccaagccaccaaagaaaaaagtgaaatcaagagagaagaaaatgtcaaaggagaaatcctcagacaccaccaaagagtcaagacctccagatttcattagtatttctgctagcaagaacatttctggtgagacaccagagggtataaaagcagaaccattgacccctatggaagatgcactaccacccagcctatcaggacaggccaagcctgaggacagtgactgtcacagaaaaatagaaacttgtggttccaggaaatccgagaggtcttgcaaaggtgctctttataaaaccctggtgtctgagggcatgctcacctctctgcgagctaatgttgacagaggaaaacgaagctcaggaaaaggaaactcctctgatcatgaagggtgttggaatgaagaaagctggacatttagtcagagtgggaccagtgggagcaagaagttcaagaagacaaagccaaaagaagactgtctccttggctccgcaaagctggatgaagaatttgaaaaaaaattcaacagcctccctcaatatagtcctgttacatttgaccggaaatgtgtacctgtcccaagaaaaaagaagaagactggaaatgtgtcctcagaaccgactaaaaccagcaaaggaagtggggataaatggtcaaacaagcaactcttcttggatgccattcaccctacagaagccatattttcagaagacagaaacaccatggagcctgttcataaggttaaaaatatcccatccattttcaacactccagagccaacaacaacgcaagaacctttggtgggcagccaaaagagaaaagcaaggaaaaccaagattacacaccttgtcaggacagcagatggccgggtatcaccagcaggaggtactttggatgacaaaccaaaggaacaactgcagaggagtctccctaaagcaactgagacagactgcaatgacaaatgctcacacaacaccgaggtcggggagacgcggagcagtactccagaaatgcctgccgtgtctgcgttctttagcctcgctgcgctggctgaagtggcagccatggaaaatgtgcacagaggtcagaggtcaactccgctcacccatgatggacagccaaaagaaatgccgcaggctcctgtacttatttcctgcgctgaccagtgaagcgccctttcattgtaaaacattgtgctttacctactaccctagccttgtctttaccgagggatgctagtgagtccaagtggtggaaaatatagactgcaaacaagtgcttgttgccccacacggcccagattcacttgaagcagaagttagcatcctgggccagtttgttctctcagaacccagaatctttgagggtaaggttatctgtctgatactgagcagaaacagaatgatcctggagctttgctttctattgaaggcttttgacggtaataggtggtaacttggtaaaaggctgcctttactgtagctcacccagcatctcttttaccaaccagagagtgtgaaactagtttcatatattacctagttattctttcaaaacaaaacaaaaaaaaaacaaaaactgacgcactgcactagttattattagatattcttagtcttttttgtacatggagatttaagtttaagatggtttatataataggttatacctacatttatattgtagaataaatattaaaaagcctgttccagagactcccaagcagcctgggcaggcagatgtaccattgttagtggtgtatgctcggcctcgtggtccatatattctgcacttttatatttgccaccagaatggtagtttgctggcaaaaaaaaaaaaaagagagagagaaaaaattacaactcttacaatctgaatttttttcttagccttgagtgaccaagaagaatttgcttgaggcaaattgtggcaaatattttcccagacaggggaagagtcctgcagattacagattactggtgttttcatgccttgaggattcttttatttttacataggggtctaagtgaccaatggattgttcatacaaacaaaaaaaaagacaaaaatattattcagaagtgaccttagtattacttcactattctaaacacattgaagacactcacttcatgtggacttggagctacagaccttttacatccatcacagattggctggacgggttgcaattgctatgcacagcctgattggcactgcaggtttttagagccattttgagtttgtgttgtttaggaggtactgagtcaatgatgagggaggtatgcctgaccagagtgggactctcagtcatagatccacctgcaagtctctgtttcctttttgtgttttgttgcttttgaacataaaaccaaccatacataagcagcgccaagtggattaactggcttagaacattcaacatattgacttaaccacctgacattcacagtgtcttgtttcctagcaacagatgcaaagtgataaatcaaaattagtctgaggctacagattttacagggtatttgttctatagcacaaagtatttccccactcttgcgtcacagcacaaactaccaaattttaattattggattccagcaataatttttaatggttttcaaactggcggaattttgacagtgctagttcgagtttgaagcttttgaattagatctctaaatggtgacagtttacatggttttatctagctttcttatttatacttgactgaattgtaatgattttttttctaattgtaatttgacgtaatagccatacaaaaaatgactctattcatactaggtttagcttctcatggttgtagatattacttcagttccggtgctggaaaatatgtacaacatactaacaggattgaaaaaaaaatagaggtttttcttcttgtttttttttccaaagcaggtaaagagggtagcaaagcatcggaatgatgtgctcaaaaatgcatattcctggtggggatggaggaagaaggcattagtaaaaggttaatcaaacgttacaacttaaccccattcatgtaggaataaatcaagtgagcagttccagacttttgcataatatttttactatgatgctgttttattaatattttctaaatttcaaaacaaaaagtgaatgtttgaaattgctgggtcccgatgttggtggctgttggagttttggaccactcgctagcagtgatttgaagattataattagctaaaatccaaaacaaaaaaccaacaacaaaaattgtatggtgcggaacatgcaccttgacaatggtactaacttgttattctatagaacacgttagaatagatctatttttgccagagcaccctccttcagtcctccgattacatttcactagagttccttacgagattgctgtatattcctgggacctttttttaaaaaaaaaaaaagcaaaacaaaagattactttttttctatgtgattaatatcttacttgatctgcttttcctaaacctcagtggcttttcccttaggcagggttgggggtgggagggcaacttactggagatgactgttttcagatactttaaaacaaacctttttgtagaaatgcttaatttttaagcggttaggcactgagagtagcagaaatcctgcaaagctttatagttccttagactcaccttgtcgattctctgagtaaagtcttgatttcaataattgtgcttctcatgccctgaatctgctggagaggagtgttgttattttcaggtaacaacattcgttagcacaaatatttcagaccaatattagtgctctccaccccaccttttgttatcattttcatttcatttctctcattcttttttattttggaaaatcatattgctatagtgtgtactttaatctgccagcagataccatctacactaacatttgtcccacagcatcctcaagagaaaaagttgttgcaccttatatatatctcaagcaaaccaaaatatgatgctcttctgctttgttttattctaaattgttgtatcatatctttctgaaaccattctgaatttagttgaaattatcaatatttatgcttttaaccttaatttctggattcaagcctgtatataaatcttttgaaaaaaaattgtcctagcccttctctgcgatgctggaagtagaagattgcgtctcagatggagacgcagtactgttccagttttctttagccttttatttatttagttattctgggtatttcctatgtaattttgaagtgtgtagagtatattatagtaactgaagctgcagctgtaagaagctgagtgaaagaaaaaatactgtaagacatccttaaagtttttatttgtttgggtactgtatatgagatcaggaaaaagaaaaatgtcccacagccacattggaaatacaggttcttgtccccaaattaggttagttcccagattttagatcaaaactgttaattcattaaaaccccttttaaaaggtaaattctactgttgtaattccgatagtctttttcccacaaatatcagaaatatatttatttaattctgtcagatgagctttctaccgatgccatgtcccaaagccatgttaaaataattcccacgttatcattgtgattctacttcctgccactaaaattgctggagaaacaaaataatgatggaacactatgaacaaaaaggagcatctgaactggtctggttatttagaatccaatgtgttcaaatccttttgttttcttattaagtcagatgctactgtaagtcagataaaattttgtttgcactctgcagtctttggctcaatgtatggaaatgtttgcacctatgtaaagtcacaagctaattacaaattgctacagaacaggagtaagctgaaaactgaatgccatgttttgtttataaggtggggaggggagggaaaataccaaaaaactctgttccaagtttggcatttgacattaatgtgaagcagtgggaccatgctgcctgctaaactactgtatgaatcgtaaatgttctgaagacgagcagctggaggctggaggatggcattccatacagcaaaggagaagcacccaccacttcatctgggaaaaggaaggaaattgcaggaggcctggagccatcatttgtaaaggggatgttgcggggtgtgatgctgttgaggagattcaccttcaattgcactgctccacagagccctcatataaggccaatcctaatgggctacctcggctttaaaagttaatttcagtaagtcctgtttcaaaagtttgtctttttttgcttctaccttcagtgccactattttccactgcagtgttttgacttcacaaactgcctcctccagagagaacaatgtattgctgaaaatgggcagtagaagcaaatgctgttgttacatttgacctataaagtattcagagtgactgctaggtagaaattaaaacttagctttcccaaatagctccttattttgcaccttataaaaagtatactaattgttaattagatgttgcttttgtttatacaagcattcccaaagaactagatttggattttgttttgagtttttggatttttaaaaattatcttatttagattgactaacagcatacttacaattttaaaagaagctgttgttcagttcatcttaccagatgtgtctggcgaagtattcagggtttgatggactgctttactttcgtttggaagtgatagctaagtttattatactctatattaaacaactttgttcatttcactgaggaccttatcttccttatatttcagaacaaagaagcaacaagcgtgaataaaaagacaaatgtatttgactccctcataatccccatctgtatgtgctacccttccttcaaatatataaatgtgcatctttttttttaaaaaaaaaaaaaaaaaggttcctcttctggccaaatttgatctatggtggtatgattcatactgttaaattgagagaggaaaccttgtggttaaaaattatatggctgctgttttctttttgcagtcagtggtcaaaactgatcatgtgcttaaatcgatttttatgcacagaactagttattgtgaacattactgctccctccaaagatttcctgataacttgggccagaggtggttactgagtaacaaggatctaattcaatgcctcaaaactcttccacccacaatgcaaatcttacctcacaagctctaacctaaatcacagagacatgcatgtttcatgcattaacactgatttcgctctgtggcccaccagaggggtgggctcatgtcccctgactcctcacatgagtgcctcagctctaagagccgtggaacggggggtagggaaggtttgcgatctggagctcagcaactggctcagcaacgttttctccatttcattagcactaaacaagtctcttgctctcaggaatttgtcagaaaaaagaataaaatcacctgagactccacataccagattataaactcttctcgtaggtttgaattgcttactcacatgtcataaattaaccacagcttcatttgaccaccaggtctaaagtctgttgacagtttcagcatgactgaatcgctcattttttttttttgctttcagaaattggcttggttctctttagagttggtgtaaacatgccatgtaataaatgatttccacttaatggtacaacagaattattgctttcttagatgtatgtgtagtaaaagtcaatatacacatttatataatttctttcttcaaaatcttatacctaatttgatatttctaaaaattgcacatgtaagtcatgtgtataacatgctaaagtactttaactgtgatcttaaaactgaataaaaatatttaataaaactttgaa

SEQ ID NO: 314062 - DNA, 8373 bp, Homo sapiens
  misc_feature (1)..(2): n is a, c, g, or t
  misc_feature (4)..(4): n is a, c, g, or t
nngngtgttttcagtctctccgggttgcatgtactgtatgtggagcagtgtacagtgaagcggaggcagagcggctccgcgagcttctctccactttcccatagagaaaccctgactggccgctgagggctagctacacacacgccctcacgcccggcgagcccgcgaggtcactatcatatgacaaaggctttgccgcagttcatcttcctccctgtgtactttccatttgccttcctggaatcctgctgcatcacagaagctggaagttctgatgttccactgaaatcacaatggaaagtcttgacttgactggtcacagtaatgaaaggcagtaatagaaataaggatcattcagcagaaggagaaggggttggaaaacgaccaaaacgaaagtgtcttcagtggcatccattgctagcaaagaaacttcttgatttttcagaagaggaagaagaggaagacgaagaggaggatattgataaggttcaacttcttggggccgatggcctagagcaagatgttggtgaaactgaagatgatgaatcaccagagcagcgagcccggagaccaatgaatgcatttcttttattttgcaaacgccatcgctctcttgtacgtcaggaacaccccaggcttgataaccgaggtgctaccaagatactagctgattggtgggctgttcttgatccaaaggaaaagcagaaatacacagacatggccaaggagtataaggatgcatttatgaaagcaaatcctggctacaaatggtgtcctaccacaaacaagcctgtgaaatccccaacacccactgtcaatccacgaaagaaactttgggccttcccatctgactcttcaagagacttgccaagccccaagaaagcaaagactgaagaaatgcctcagcttaactttggaatggctgatcctactcaaatgggaggcctgagtatgctgctgttagctggagaacatgctcttggcacaccagaggtatcctctggcacatgcaggcctgatgtttcagaatctcctgaattacgtcagaagtcaccattgtttcagtttgccgagatatcttcaagtacgtcccactctgatgcttctacaaagcagtgtcaaacatctgccttgtttcagtttgcagagatttcttcaaacacttcgcagttgggtggtgctgagcctgtaaaacgctgtggaaagtctgcactctttcaactggcagagatgtgcctggcatcagaagggatgaaaatggaagaatcaaagctaataaaagcaaaagaatccgatggtggaagaattaaagaattagagaagggaaaggaagaaaaagaaattaaaatggagaaaacagatgaaactaggttacagaaggaagcagaatttgaaaaatcggctaaggaaaatttaagagattctaaggaattgagaaattttgaggcattgcaaatagatgacataatggctataaaaatggaagatcccaaagaaattagaaaggaagagttagaagaagatcacaaatgtagtcattttcctgatttttcttattctgccagtagcaagataataattagtgatgttcccagtagaaaggatcatatgtgccatcctcatggaattatgatcattgaggatcccgcagcattaaacaagccagaaaagctaaaaaagaaaaagaagaaaagcaaaatggatcgacatggaaatgataaatccacacccaagaagacttgcaaaaagaggcagtcttcggaatctgacattgagagcgtcatatataccattgaagccgtcgcaaaaggagactggggcatagagaaacttggagatacccctcgcaagaaggtccgcacatcctcaagtggcaagggaagcattttggatgccaagccaccaaagaaaaaagtgaaatcaagagagaagaaaatgtcaaaggagaaatcctcagacaccaccaaagagtcaagacctccagatttcattagtatttctgctagcaagaacatttctggtgagacaccagagggtataaaagcagaaccattgacccctatggaagatgcactaccacccagcctatcaggacaggccaagcctgaggacagtgactgtcacagaaaaatagaaacttgtggttccaggaaatccgagaggtcttgcaaaggtgctctttataaaaccctggtgtctgagggcatgctcacctctctgcgagctaatgttgacagaggaaaacgaagctcaggaaaaggaaactcctctgatcatgaagggtgttggaatgaagaaagctggacatttagtcagagtgggaccagtgggagcaagaagttcaagaagacaaagccaaaagaagactgtctccttggctccgcaaagctggatgaagaatttgaaaaaaaattcaacagcctccctcaatatagtcctgttacatttgaccggaaatgtgtacctgtcccaagaaaaaagaagaagactggaaatgtgtcctcagaaccgactaaaaccagcaaaggaagtggggataaatggtcaaacaagcaactcttcttggatgccattcaccctacagaagccatattttcagaagacagaaacaccatggagcctgttcataaggttaaaaatatcccatccattttcaacactccagagccaacaacaacgcaagaacctttggtgggcagccaaaagagaaaagcaaggaaaaccaagattacacaccttgtcaggacagcagatggccgggtatcaccagcaggaggtactttggatgacaaaccaaaggaacaactgcagaggagtctccctaaagcaactgagacagactgcaatgacaaatgctcacacaacaccgaggtcggggagacgcggagcagtactccagaaatgcctgccgtgtctgcgttctttagcctcgctgcgctggctgaagtggcagccatggaaaatgtgcacagaggtcagaggtcaactccgctcacccatgatggacagccaaaagaaatgccgcaggctcctgtacttatttcctgcgctgaccagtgaagcgccctttcattgtaaaacattgtgctttacctactaccctagccttgtctttaccgagggatgctagtgagtccaagtggtggaaaatatagactgcaaacaagtgcttgttgccccacacggcccagattcacttgaagcagaagttagcatcctgggccagtttgttctctcagaacccagaatctttgagggtaaggttatctgtctgatactgagcagaaacagaatgatcctggagctttgctttctattgaaggcttttgacggtaataggtggtaacttggtaaaaggctgcctttactgtagctcacccagcatctcttttaccaaccagagagtgtgaaactagtttcatatattacctagttattctttcaaaacaaaacaaaaaaaaaacaaaaactgacgcactgcactagttattattagatattcttagtcttttttgtacatggagatttaagtttaagatggtttatataataggttatacctacatttatattgtagaataaatattaaaaagcctgttccagagactcccaagcagcctgggcaggcagatgtaccattgttagtggtgtatgctcggcctcgtggtccatatattctgcacttttatatttgccaccagaatggtagtttgctggcaaaaaaaaaaaaaagagagagagaaaaaattacaactcttacaatctgaatttttttcttagccttgagtgaccaagaagaatttgcttgaggcaaattgtggcaaatattttcccagacaggggaagagtcctgcagattacagattactggtgttttcatgccttgaggattcttttatttttacataggggtctaagtgaccaatggattgttcatacaaacaaaaaaaaagacaaaaatattattcagaagtgaccttagtattacttcactattctaaacacattgaagacactcacttcatgtggacttggagctacagaccttttacatccatcacagattggctggacgggttgcaattgctatgcacagcctgattggcactgcaggtttttagagccattttgagtttgtgttgtttaggaggtactgagtcaatgatgagggaggtatgcctgaccagagtgggactctcagtcatagatccacctgcaagtctctgtttcctttttgtgttttgttgcttttgaacataaaaccaaccatacataagcagcgccaagtggattaactggcttagaacattcaacatattgacttaaccacctgacattcacagtgtcttgtttcctagcaacagatgcaaagtgataaatcaaaattagtctgaggctacagattttacagggtatttgttctatagcacaaagtatttccccactcttgcgtcacagcacaaactaccaaattttaattattggattccagcaataatttttaatggttttcaaactggcggaattttgacagtgctagttcgagtttgaagcttttgaattagatctctaaatggtgacagtttacatggttttatctagctttcttatttatacttgactgaattgtaatgattttttttctaattgtaatttgacgtaatagccatacaaaaaatgactctattcatactaggtttagcttctcatggttgtagatattacttcagttccggtgctggaaaatatgtacaacatactaacaggattgaaaaaaaaatagaggtttttcttcttgtttttttttccaaagcaggtaaagagggtagcaaagcatcggaatgatgtgctcaaaaatgcatattcctggtggggatggaggaagaaggcattagtaaaaggttaatcaaacgttacaacttaaccccattcatgtaggaataaatcaagtgagcagttccagacttttgcataatatttttactatgatgctgttttattaatattttctaaatttcaaaacaaaaagtgaatgtttgaaattgctgggtcccgatgttggtggctgttggagttttggaccactcgctagcagtgatttgaagattataattagctaaaatccaaaacaaaaaaccaacaacaaaaattgtatggtgcggaacatgcaccttgacaatggtactaacttgttattctatagaacacgttagaatagatctatttttgccagagcaccctccttcagtcctccgattacatttcactagagttccttacgagattgctgtatattcctgggacctttttttaaaaaaaaaaaaagcaaaacaaaagattactttttttctatgtgattaatatcttacttgatctgcttttcctaaacctcagtggcttttcccttaggcagggttgggggtgggagggcaacttactggagatgactgttttcagatactttaaaacaaacctttttgtagaaatgcttaatttttaagcggttaggcactgagagtagcagaaatcctgcaaagctttatagttccttagactcaccttgtcgattctctgagtaaagtcttgatttcaataattgtgcttctcatgccctgaatctgctggagaggagtgttgttattttcaggtaacaacattcgttagcacaaatatttcagaccaatattagtgctctccaccccaccttttgttatcattttcatttcatttctctcattcttttttattttggaaaatcatattgctatagtgtgtactttaatctgccagcagataccatctacactaacatttgtcccacagcatcctcaagagaaaaagttgttgcaccttatatatatctcaagcaaaccaaaatatgatgctcttctgctttgttttattctaaattgttgtatcatatctttctgaaaccattctgaatttagttgaaattatcaatatttatgcttttaaccttaatttctggattcaagcctgtatataaatcttttgaaaaaaaattgtcctagcccttctctgcgatgctggaagtagaagattgcgtctcagatggagacgcagtactgttccagttttctttagccttttatttatttagttattctgggtatttcctatgtaattttgaagtgtgtagagtatattatagtaactgaagctgcagctgtaagaagctgagtgaaagaaaaaatactgtaagacatccttaaagtttttatttgtttgggtactgtatatgagatcaggaaaaagaaaaatgtcccacagccacattggaaatacaggttcttgtccccaaattaggttagttcccagattttagatcaaaactgttaattcattaaaaccccttttaaaaggtaaattctactgttgtaattccgatagtctttttcccacaaatatcagaaatatatttatttaattctgtcagatgagctttctaccgatgccatgtcccaaagccatgttaaaataattcccacgttatcattgtgattctacttcctgccactaaaattgctggagaaacaaaataatgatggaacactatgaacaaaaaggagcatctgaactggtctggttatttagaatccaatgtgttcaaatccttttgttttcttattaagtcagatgctactgtaagtcagataaaattttgtttgcactctgcagtctttggctcaatgtatggaaatgtttgcacctatgtaaagtcacaagctaattacaaattgctacagaacaggagtaagctgaaaactgaatgccatgttttgtttataaggtggggaggggagggaaaataccaaaaaactctgttccaagtttggcatttgacattaatgtgaagcagtgggaccatgctgcctgctaaactactgtatgaatcgtaaatgttctgaagacgagcagctggaggctggaggatggcattccatacagcaaaggagaagcacccaccacttcatctgggaaaaggaaggaaattgcaggaggcctggagccatcatttgtaaaggggatgttgcggggtgtgatgctgttgaggagattcaccttcaattgcactgctccacagagccctcatataaggccaatcctaatgggctacctcggctttaaaagttaatttcagtaagtcctgtttcaaaagtttgtctttttttgcttctaccttcagtgccactattttccactgcagtgttttgacttcacaaactgcctcctccagagagaacaatgtattgctgaaaatgggcagtagaagcaaatgctgttgttacatttgacctataaagtattcagagtgactgctaggtagaaattaaaacttagctttcccaaatagctccttattttgcaccttataaaaagtatactaattgttaattagatgttgcttttgtttatacaagcattcccaaagaactagatttggattttgttttgagtttttggatttttaaaaattatcttatttagattgactaacagcatacttacaattttaaaagaagctgttgttcagttcatcttaccagatgtgtctggcgaagtattcagggtttgatggactgctttactttcgtttggaagtgatagctaagtttattatactctatattaaacaactttgttcatttcactgaggaccttatcttccttatatttcagaacaaagaagcaacaagcgtgaataaaaagacaaatgtatttgactccctcataatccccatctgtatgtgctacccttccttcaaatatataaatgtgcatctttttttttaaaaaaaaaaaaaaaaaggttcctcttctggccaaatttgatctatggtggtatgattcatactgttaaattgagagaggaaaccttgtggttaaaaattatatggctgctgttttctttttgcagtcagtggtcaaaactgatcatgtgcttaaatcgatttttatgcacagaactagttattgtgaacattactgctccctccaaagatttcctgataacttgggccagaggtggttactgagtaacaaggatctaattcaatgcctcaaaactcttccacccacaatgcaaatcttacctcacaagctctaacctaaatcacagagacatgcatgtttcatgcattaacactgatttcgctctgtggcccaccagaggggtgggctcatgtcccctgactcctcacatgagtgcctcagctctaagagccgtggaacggggggtagggaaggtttgcgatctggagctcagcgaagcttaaatgccatgtgcatatacaacacgcagcatgaagtaggccccaagtatccagtcagtcactcgacaaacatttaggg

SEQ ID NO: 314063 - DNA, 8709 bp, Homo sapiens
agcaggcacgggcacggggacaccccactcgttgctcctccgttatggaaaggtgtttagcagacttttacgcccggagtgtggtcactatcatatgacaaaggctttgccgcagttcatcttcctccctgtgtactttccatttgccttcctggaatcctgctgcatcacagaagctggaagttctgatgttccactgaaatcacaatggaaagtcttgacttgactggtcacagtaatgaaaggcagtaatagaaataaggatcattcagcagaaggagaaggggttggaaaacgaccaaaacgaaagtgtcttcagtggcatccattgctagcaaagaaacttcttgatttttcagaagaggaagaagaggaagacgaagaggaggatattgataaggttcaacttcttggggccgatggcctagagcaagatgttggtgaaactgaagatgatgaatcaccagagcagcgagcccggagaccaatgaatgcatttcttttattttgcaaacgccatcgctctcttgtacgtcaggaacaccccaggcttgataaccgaggtgctaccaagatactagctgattggtgggctgttcttgatccaaaggaaaagcagaaatacacagacatggccaaggagtataaggatgcatttatgaaagcaaatcctggctacaaatggtgtcctaccacaaacaagcctgtgaaatccccaacacccactgtcaatccacgaaagaaactttgggccttcccatctgactcttcaagagacttgccaagccccaagaaagcaaagactgaagaaatgcctcagcttaactttggaatggctgatcctactcaaatgggaggcctgagtatgctgctgttagctggagaacatgctcttggcacaccagaggtatcctctggcacatgcaggcctgatgtttcagaatctcctgaattacgtcagaagtcaccattgtttcagtttgccgagatatcttcaagtacgtcccactctgatgcttctacaaagcagtgtcaaacatctgccttgtttcagtttgcagagatttcttcaaacacttcgcagttgggtggtgctgagcctgtaaaacgctgtggaaagtctgcactctttcaactggcagagatgtgcctggcatcagaagggatgaaaatggaagaatcaaagctaataaaagcaaaagaatccgatggtggaagaattaaagaattagagaagggaaaggaagaaaaagaaattaaaatggagaaaacagatgaaactaggttacagaaggaagcagaatttgaaaaatcggctaaggaaaatttaagagattctaaggaattgagaaattttgaggcattgcaaatagatgacataatggctataaaaatggaagatcccaaagaaattagaaaggaagagttagaagaagatcacaaatgtagtcattttcctgatttttcttattctgccagtagcaagataataattagtgatgttcccagtagaaaggatcatatgtgccatcctcatggaattatgatcattgaggatcccgcagcattaaacaagccagaaaagctaaaaaagaaaaagaagaaaagcaaaatggatcgacatggaaatgataaatccacacccaagaagacttgcaaaaagaggcagtcttcggaatctgacattgagagcgtcatatataccattgaagccgtcgcaaaaggagactggggcatagagaaacttggagatacccctcgcaagaaggtccgcacatcctcaagtggcaagggaagcattttggatgccaagccaccaaagaaaaaagtgaaatcaagagagaagaaaatgtcaaaggagaaatcctcagacaccaccaaagagtcaagacctccagatttcattagtatttctgctagcaagaacatttctggtgagacaccagagggtataaaagcagaaccattgacccctatggaagatgcactaccacccagcctatcaggacaggccaagcctgaggacagtgactgtcacagaaaaatagaaacttgtggttccaggaaatccgagaggtcttgcaaaggtgctctttataaaaccctggtgtctgagggcatgctcacctctctgcgagctaatgttgacagaggaaaacgaagctcaggaaaaggaaactcctctgatcatgaagggtgttggaatgaagaaagctggacatttagtcagagtgggaccagtgggagcaagaagttcaagaagacaaagccaaaagaagactgtctccttggctccgcaaagctggatgaagaatttgaaaaaaaattcaacagcctccctcaatatagtcctgttacatttgaccggaaatgtgtacctgtcccaagaaaaaagaagaagactggaaatgtgtcctcagaaccgactaaaaccagcaaaggaagtggggataaatggtcaaacaagcaactcttcttggatgccattcaccctacagaagccatattttcagaagacagaaacaccatggagcctgttcataaggttaaaaatatcccatccattttcaacactccagagccaacaacaacgcaagaacctttggtgggcagccaaaagagaaaagcaaggaaaaccaagattacacaccttgtcaggacagcagatggccgggtatcaccagcaggaggtactttggatgacaaaccaaaggaacaactgcagaggagtctccctaaagcaactgagacagactgcaatgacaaatgctcacacaacaccgaggtcggggagacgcggagcagtactccagaaatgcctgccgtgtctgcgttctttagcctcgctgcgctggctgaagtggcagccatggaaaatgtgcacagaggtcagaggtcaactccgctcacccatgatggacagccaaaagaaatgccgcaggctcctgtacttatttcctgcgctgaccagtgaagcgccctttcattgtaaaacattgtgctttacctactaccctagccttgtctttaccgagggatgctagtgagtccaagtggtggaaaatatagactgcaaacaagtgcttgttgccccacacggcccagattcacttgaagcagaagttagcatcctgggccagtttgttctctcagaacccagaatctttgagggtaaggttatctgtctgatactgagcagaaacagaatgatcctggagctttgctttctattgaaggcttttgacggtaataggtggtaacttggtaaaaggctgcctttactgtagctcacccagcatctcttttaccaaccagagagtgtgaaactagtttcatatattacctagttattctttcaaaacaaaacaaaaaaaaaacaaaaactgacgcactgcactagttattattagatattcttagtcttttttgtacatggagatttaagtttaagatggtttatataataggttatacctacatttatattgtagaataaatattaaaaagcctgttccagagactcccaagcagcctgggcaggcagatgtaccattgttagtggtgtatgctcggcctcgtggtccatatattctgcacttttatatttgccaccagaatggtagtttgctggcaaaaaaaaaaaaaagagagagagaaaaaattacaactcttacaatctgaatttttttcttagccttgagtgaccaagaagaatttgcttgaggcaaattgtggcaaatattttcccagacaggggaagagtcctgcagattacagattactggtgttttcatgccttgaggattcttttatttttacataggggtctaagtgaccaatggattgttcatacaaacaaaaaaaaagacaaaaatattattcagaagtgaccttagtattacttcactattctaaacacattgaagacactcacttcatgtggacttggagctacagaccttttacatccatcacagattggctggacgggttgcaattgctatgcacagcctgattggcactgcaggtttttagagccattttgagtttgtgttgtttaggaggtactgagtcaatgatgagggaggtatgcctgaccagagtgggactctcagtcatagatccacctgcaagtctctgtttcctttttgtgttttgttgcttttgaacataaaaccaaccatacataagcagcgccaagtggattaactggcttagaacattcaacatattgacttaaccacctgacattcacagtgtcttgtttcctagcaacagatgcaaagtgataaatcaaaattagtctgaggctacagattttacagggtatttgttctatagcacaaagtatttccccactcttgcgtcacagcacaaactaccaaattttaattattggattccagcaataatttttaatggttttcaaactggcggaattttgacagtgctagttcgagtttgaagcttttgaattagatctctaaatggtgacagtttacatggttttatctagctttcttatttatacttgactgaattgtaatgattttttttctaattgtaatttgacgtaatagccatacaaaaaatgactctattcatactaggtttagcttctcatggttgtagatattacttcagttccggtgctggaaaatatgtacaacatactaacaggattgaaaaaaaaatagaggtttttcttcttgtttttttttccaaagcaggtaaagagggtagcaaagcatcggaatgatgtgctcaaaaatgcatattcctggtggggatggaggaagaaggcattagtaaaaggttaatcaaacgttacaacttaaccccattcatgtaggaataaatcaagtgagcagttccagacttttgcataatatttttactatgatgctgttttattaatattttctaaatttcaaaacaaaaagtgaatgtttgaaattgctgggtcccgatgttggtggctgttggagttttggaccactcgctagcagtgatttgaagattataattagctaaaatccaaaacaaaaaaccaacaacaaaaattgtatggtgcggaacatgcaccttgacaatggtactaacttgttattctatagaacacgttagaatagatctatttttgccagagcaccctccttcagtcctccgattacatttcactagagttccttacgagattgctgtatattcctgggacctttttttaaaaaaaaaaaaagcaaaacaaaagattactttttttctatgtgattaatatcttacttgatctgcttttcctaaacctcagtggcttttcccttaggcagggttgggggtgggagggcaacttactggagatgactgttttcagatactttaaaacaaacctttttgtagaaatgcttaatttttaagcggttaggcactgagagtagcagaaatcctgcaaagctttatagttccttagactcaccttgtcgattctctgagtaaagtcttgatttcaataattgtgcttctcatgccctgaatctgctggagaggagtgttgttattttcaggtaacaacattcgttagcacaaatatttcagaccaatattagtgctctccaccccaccttttgttatcattttcatttcatttctctcattcttttttattttggaaaatcatattgctatagtgtgtactttaatctgccagcagataccatctacactaacatttgtcccacagcatcctcaagagaaaaagttgttgcaccttatatatatctcaagcaaaccaaaatatgatgctcttctgctttgttttattctaaattgttgtatcatatctttctgaaaccattctgaatttagttgaaattatcaatatttatgcttttaaccttaatttctggattcaagcctgtatataaatcttttgaaaaaaaattgtcctagcccttctctgcgatgctggaagtagaagattgcgtctcagatggagacgcagtactgttccagttttctttagccttttatttatttagttattctgggtatttcctatgtaattttgaagtgtgtagagtatattatagtaactgaagctgcagctgtaagaagctgagtgaaagaaaaaatactgtaagacatccttaaagtttttatttgtttgggtactgtatatgagatcaggaaaaagaaaaatgtcccacagccacattggaaatacaggttcttgtccccaaattaggttagttcccagattttagatcaaaactgttaattcattaaaaccccttttaaaaggtaaattctactgttgtaattccgatagtctttttcccacaaatatcagaaatatatttatttaattctgtcagatgagctttctaccgatgccatgtcccaaagccatgttaaaataattcccacgttatcattgtgattctacttcctgccactaaaattgctggagaaacaaaataatgatggaacactatgaacaaaaaggagcatctgaactggtctggttatttagaatccaatgtgttcaaatccttttgttttcttattaagtcagatgctactgtaagtcagataaaattttgtttgcactctgcagtctttggctcaatgtatggaaatgtttgcacctatgtaaagtcacaagctaattacaaattgctacagaacaggagtaagctgaaaactgaatgccatgttttgtttataaggtggggaggggagggaaaataccaaaaaactctgttccaagtttggcatttgacattaatgtgaagcagtgggaccatgctgcctgctaaactactgtatgaatcgtaaatgttctgaagacgagcagctggaggctggaggatggcattccatacagcaaaggagaagcacccaccacttcatctgggaaaaggaaggaaattgcaggaggcctggagccatcatttgtaaaggggatgttgcggggtgtgatgctgttgaggagattcaccttcaattgcactgctccacagagccctcatataaggccaatcctaatgggctacctcggctttaaaagttaatttcagtaagtcctgtttcaaaagtttgtctttttttgcttctaccttcagtgccactattttccactgcagtgttttgacttcacaaactgcctcctccagagagaacaatgtattgctgaaaatgggcagtagaagcaaatgctgttgttacatttgacctataaagtattcagagtgactgctaggtagaaattaaaacttagctttcccaaatagctccttattttgcaccttataaaaagtatactaattgttaattagatgttgcttttgtttatacaagcattcccaaagaactagatttggattttgttttgagtttttggatttttaaaaattatcttatttagattgactaacagcatacttacaattttaaaagaagctgttgttcagttcatcttaccagatgtgtctggcgaagtattcagggtttgatggactgctttactttcgtttggaagtgatagctaagtttattatactctatattaaacaactttgttcatttcactgaggaccttatcttccttatatttcagaacaaagaagcaacaagcgtgaataaaaagacaaatgtatttgactccctcataatccccatctgtatgtgctacccttccttcaaatatataaatgtgcatctttttttttaaaaaaaaaaaaaaaaaggttcctcttctggccaaatttgatctatggtggtatgattcatactgttaaattgagagaggaaaccttgtggttaaaaattatatggctgctgttttctttttgcagtcagtggtcaaaactgatcatgtgcttaaatcgatttttatgcacagaactagttattgtgaacattactgctccctccaaagatttcctgataacttgggccagaggtggttactgagtaacaaggatctaattcaatgcctcaaaactcttccacccacaatgcaaatcttacctcacaagctctaacctaaatcacagagacatgcatgtttcatgcattaacactgatttcgctctgtggcccaccagaggggtgggctcatgtcccctgactcctcacatgagtgcctcagctctaagagccgtggaacggggggtagggaaggtttgcgatctggagctcagcaactggctcagcaacgttttctccatttcattagcactaaacaagtctcttgctctcaggaatttgtcagaaaaaagaataaaatcacctgagactccacataccagattataaactcttctcgtaggtttgaattgcttactcacatgtcataaattaaccacagcttcatttgaccaccaggtctaaagtctgttgacagtttcagcatgactgaatcgctcattttttttttttgctttcagaaattggcttggttctctttagagttggtgtaaacatgccatgtaataaatgatttccacttaatggtacaacagaattattgctttcttagatgtatgtgtagtaaaagtcaatatacacatttatataatttctttcttcaaaatcttatacctaatttgatatttctaaaaattgcacatgtaagtcatgtgtataacatgctaaagtactttaactgtgatcttaaaactgaataaaaatatttaataaaactttgaa

SEQ ID NO: 314064 - DNA, 9176 bp, Homo sapiens
  misc_feature (1)..(2): n is a, c, g, or t
  misc_feature (4)..(4): n is a, c, g, or t
nngngtgttttcagtctctccgggttgcatgtactgtatgtggagcagtgtacagtgaagcggaggcagagcggctccgcgagcttctctccactttcccatagagaaaccctgactggccgctgagggctagctacacacacgccctcacgcccggcgagcccgcgaggtcactatcatatgacaaaggctttgccgcagttcatcttcctccctgtgtactttccatttgccttcctggaatcctgctgcatcacagaagctggaagttctgatgttccactgaaatcacaatggaaagtcttgacttgactggtaagagctgttgtgaaggtacatcttacttacttacctggaagcagtgaggcagtcaagaattatgtgctgtcagagctggtctcagcatgatcaaggaagtgtgatcattggatatttttttcttgtcaattttattattttttaaagtgtgacttttattgatctccattatcaaatggggaaactgaagaacagagaggtgaaattatctgcccaaggttacgctgctaataagtggcaaagctggaattcaaactcaggctgtctggctgcagggtttgttctcctaaccacaccaccacactgcctgtagattatcctcacatgtttgggtatccttttacattcatgtgcatgaatgcactgtttatttttaacgtcacagtaatgaaaggcagtaatagaaataaggatcattcagcagaaggagaaggggttggaaaacgaccaaaacgaaagtgtcttcagtggcatccattgctagcaaagaaacttcttgatttttcagaagaggaagaagaggaagacgaagaggaggatattgataaggttcaacttcttggggccgatggcctagagcaagatgttggtgaaactgaagatgatgaatcaccagagcagcgagcccggagaccaatgaatgcatttcttttattttgcaaacgccatcgctctcttgtacgtcaggaacaccccaggcttgataaccgaggtgctaccaagatactagctgattggtgggctgttcttgatccaaaggaaaagcagaaatacacagacatggccaaggagtataaggatgcatttatgaaagcaaatcctggctacaaatggtgtcctaccacaaacaagcctgtgaaatccccaacacccactgtcaatccacgaaagaaactttgggccttcccatctgactcttcaagagacttgccaagccccaagaaagcaaagactgaagaaatgcctcagcttaactttggaatggctgatcctactcaaatgggaggcctgagtatgctgctgttagctggagaacatgctcttggcacaccagaggtatcctctggcacatgcaggcctgatgtttcagaatctcctgaattacgtcagaagtcaccattgtttcagtttgccgagatatcttcaagtacgtcccactctgatgcttctacaaagcagtgtcaaacatctgccttgtttcagtttgcagagatttcttcaaacacttcgcagttgggtggtgctgagcctgtaaaacgctgtggaaagtctgcactctttcaactggcagagatgtgcctggcatcagaagggatgaaaatggaagaatcaaagctaataaaagcaaaagaatccgatggtggaagaattaaagaattagagaagggaaaggaagaaaaagaaattaaaatggagaaaacagatgaaactaggttacagaaggaagcagaatttgaaaaatcggctaaggaaaatttaagagattctaaggaattgagaaattttgaggcattgcaaatagatgacataatggctataaaaatggaagatcccaaagaaattagaaaggaagagttagaagaagatcacaaatgtagtcattttcctgatttttcttattctgccagtagcaagataataattagtgatgttcccagtagaaaggatcatatgtgccatcctcatggaattatgatcattgaggatcccgcagcattaaacaagccagaaaagctaaaaaagaaaaagaagaaaagcaaaatggatcgacatggaaatgataaatccacacccaagaagacttgcaaaaagaggcagtcttcggaatctgacattgagagcgtcatatataccattgaagccgtcgcaaaaggagactggggcatagagaaacttggagatacccctcgcaagaaggtccgcacatcctcaagtggcaagggaagcattttggatgccaagccaccaaagaaaaaagtgaaatcaagagagaagaaaatgtcaaaggagaaatcctcagacaccaccaaagagtcaagacctccagatttcattagtatttctgctagcaagaacatttctggtgagacaccagagggtataaaagcagaaccattgacccctatggaagatgcactaccacccagcctatcaggacaggccaagcctgaggacagtgactgtcacagaaaaatagaaacttgtggttccaggaaatccgagaggtcttgcaaaggtgctctttataaaaccctggtgtctgagggcatgctcacctctctgcgagctaatgttgacagaggaaaacgaagctcaggaaaaggaaactcctctgatcatgaagggtgttggaatgaagaaagctggacatttagtcagagtgggaccagtgggagcaagaagttcaagaagacaaagccaaaagaagactgtctccttggctccgcaaagctggatgaagaatttgaaaaaaaattcaacagcctccctcaatatagtcctgttacatttgaccggaaatgtgtacctgtcccaagaaaaaagaagaagactggaaatgtgtcctcagaaccgactaaaaccagcaaaggaagtggggataaatggtcaaacaagcaactcttcttggatgccattcaccctacagaagccatattttcagaagacagaaacaccatggagcctgttcataaggttaaaaatatcccatccattttcaacactccagagccaacaacaacgcaagaacctttggtgggcagccaaaagagaaaagcaaggaaaaccaagattacacaccttgtcaggacagcagatggccgggtatcaccagcaggaggtactttggatgacaaaccaaaggaacaactgcagaggagtctccctaaagcaactgagacagactgcaatgacaaatgctcacacaacaccgaggtcggggagacgcggagcagtactccagaaatgcctgccgtgtctgcgttctttagcctcgctgcgctggctgaagtggcagccatggaaaatgtgcacagaggtcagaggtcaactccgctcacccatgatggacagccaaaagaaatgccgcaggctcctgtacttatttcctgcgctgaccagtgaagcgccctttcattgtaaaacattgtgctttacctactaccctagccttgtctttaccgagggatgctagtgagtccaagtggtggaaaatatagactgcaaacaagtgcttgttgccccacacggcccagattcacttgaagcagaagttagcatcctgggccagtttgttctctcagaacccagaatctttgagggtaaggttatctgtctgatactgagcagaaacagaatgatcctggagctttgctttctattgaaggcttttgacggtaataggtggtaacttggtaaaaggctgcctttactgtagctcacccagcatctcttttaccaaccagagagtgtgaaactagtttcatatattacctagttattctttcaaaacaaaacaaaaaaaaaacaaaaactgacgcactgcactagttattattagatattcttagtcttttttgtacatggagatttaagtttaagatggtttatataataggttatacctacatttatattgtagaataaatattaaaaagcctgttccagagactcccaagcagcctgggcaggcagatgtaccattgttagtggtgtatgctcggcctcgtggtccatatattctgcacttttatatttgccaccagaatggtagtttgctggcaaaaaaaaaaaaaagagagagagaaaaaattacaactcttacaatctgaatttttttcttagccttgagtgaccaagaagaatttgcttgaggcaaattgtggcaaatattttcccagacaggggaagagtcctgcagattacagattactggtgttttcatgccttgaggattcttttatttttacataggggtctaagtgaccaatggattgttcatacaaacaaaaaaaaagacaaaaatattattcagaagtgaccttagtattacttcactattctaaacacattgaagacactcacttcatgtggacttggagctacagaccttttacatccatcacagattggctggacgggttgcaattgctatgcacagcctgattggcactgcaggtttttagagccattttgagtttgtgttgtttaggaggtactgagtcaatgatgagggaggtatgcctgaccagagtgggactctcagtcatagatccacctgcaagtctctgtttcctttttgtgttttgttgcttttgaacataaaaccaaccatacataagcagcgccaagtggattaactggcttagaacattcaacatattgacttaaccacctgacattcacagtgtcttgtttcctagcaacagatgcaaagtgataaatcaaaattagtctgaggctacagattttacagggtatttgttctatagcacaaagtatttccccactcttgcgtcacagcacaaactaccaaattttaattattggattccagcaataatttttaatggttttcaaactggcggaattttgacagtgctagttcgagtttgaagcttttgaattagatctctaaatggtgacagtttacatggttttatctagctttcttatttatacttgactgaattgtaatgattttttttctaattgtaatttgacgtaatagccatacaaaaaatgactctattcatactaggtttagcttctcatggttgtagatattacttcagttccggtgctggaaaatatgtacaacatactaacaggattgaaaaaaaaatagaggtttttcttcttgtttttttttccaaagcaggtaaagagggtagcaaagcatcggaatgatgtgctcaaaaatgcatattcctggtggggatggaggaagaaggcattagtaaaaggttaatcaaacgttacaacttaaccccattcatgtaggaataaatcaagtgagcagttccagacttttgcataatatttttactatgatgctgttttattaatattttctaaatttcaaaacaaaaagtgaatgtttgaaattgctgggtcccgatgttggtggctgttggagttttggaccactcgctagcagtgatttgaagattataattagctaaaatccaaaacaaaaaaccaacaacaaaaattgtatggtgcggaacatgcaccttgacaatggtactaacttgttattctatagaacacgttagaatagatctatttttgccagagcaccctccttcagtcctccgattacatttcactagagttccttacgagattgctgtatattcctgggacctttttttaaaaaaaaaaaaagcaaaacaaaagattactttttttctatgtgattaatatcttacttgatctgcttttcctaaacctcagtggcttttcccttaggcagggttgggggtgggagggcaacttactggagatgactgttttcagatactttaaaacaaacctttttgtagaaatgcttaatttttaagcggttaggcactgagagtagcagaaatcctgcaaagctttatagttccttagactcaccttgtcgattctctgagtaaagtcttgatttcaataattgtgcttctcatgccctgaatctgctggagaggagtgttgttattttcaggtaacaacattcgttagcacaaatatttcagaccaatattagtgctctccaccccaccttttgttatcattttcatttcatttctctcattcttttttattttggaaaatcatattgctatagtgtgtactttaatctgccagcagataccatctacactaacatttgtcccacagcatcctcaagagaaaaagttgttgcaccttatatatatctcaagcaaaccaaaatatgatgctcttctgctttgttttattctaaattgttgtatcatatctttctgaaaccattctgaatttagttgaaattatcaatatttatgcttttaaccttaatttctggattcaagcctgtatataaatcttttgaaaaaaaattgtcctagcccttctctgcgatgctggaagtagaagattgcgtctcagatggagacgcagtactgttccagttttctttagccttttatttatttagttattctgggtatttcctatgtaattttgaagtgtgtagagtatattatagtaactgaagctgcagctgtaagaagctgagtgaaagaaaaaatactgtaagacatccttaaagtttttatttgtttgggtactgtatatgagatcaggaaaaagaaaaatgtcccacagccacattggaaatacaggttcttgtccccaaattaggttagttcccagattttagatcaaaactgttaattcattaaaaccccttttaaaaggtaaattctactgttgtaattccgatagtctttttcccacaaatatcagaaatatatttatttaattctgtcagatgagctttctaccgatgccatgtcccaaagccatgttaaaataattcccacgttatcattgtgattctacttcctgccactaaaattgctggagaaacaaaataatgatggaacactatgaacaaaaaggagcatctgaactggtctggttatttagaatccaatgtgttcaaatccttttgttttcttattaagtcagatgctactgtaagtcagataaaattttgtttgcactctgcagtctttggctcaatgtatggaaatgtttgcacctatgtaaagtcacaagctaattacaaattgctacagaacaggagtaagctgaaaactgaatgccatgttttgtttataaggtggggaggggagggaaaataccaaaaaactctgttccaagtttggcatttgacattaatgtgaagcagtgggaccatgctgcctgctaaactactgtatgaatcgtaaatgttctgaagacgagcagctggaggctggaggatggcattccatacagcaaaggagaagcacccaccacttcatctgggaaaaggaaggaaattgcaggaggcctggagccatcatttgtaaaggggatgttgcggggtgtgatgctgttgaggagattcaccttcaattgcactgctccacagagccctcatataaggccaatcctaatgggctacctcggctttaaaagttaatttcagtaagtcctgtttcaaaagtttgtctttttttgcttctaccttcagtgccactattttccactgcagtgttttgacttcacaaactgcctcctccagagagaacaatgtattgctgaaaatgggcagtagaagcaaatgctgttgttacatttgacctataaagtattcagagtgactgctaggtagaaattaaaacttagctttcccaaatagctccttattttgcaccttataaaaagtatactaattgttaattagatgttgcttttgtttatacaagcattcccaaagaactagatttggattttgttttgagtttttggatttttaaaaattatcttatttagattgactaacagcatacttacaattttaaaagaagctgttgttcagttcatcttaccagatgtgtctggcgaagtattcagggtttgatggactgctttactttcgtttggaagtgatagctaagtttattatactctatattaaacaactttgttcatttcactgaggaccttatcttccttatatttcagaacaaagaagcaacaagcgtgaataaaaagacaaatgtatttgactccctcataatccccatctgtatgtgctacccttccttcaaatatataaatgtgcatctttttttttaaaaaaaaaaaaaaaaaggttcctcttctggccaaatttgatctatggtggtatgattcatactgttaaattgagagaggaaaccttgtggttaaaaattatatggctgctgttttctttttgcagtcagtggtcaaaactgatcatgtgcttaaatcgatttttatgcacagaactagttattgtgaacattactgctccctccaaagatttcctgataacttgggccagaggtggttactgagtaacaaggatctaattcaatgcctcaaaactcttccacccacaatgcaaatcttacctcacaagctctaacctaaatcacagagacatgcatgtttcatgcattaacactgatttcgctctgtggcccaccagaggggtgggctcatgtcccctgactcctcacatgagtgcctcagctctaagagccgtggaacggggggtagggaaggtttgcgatctggagctcagcaactggctcagcaacgttttctccatttcattagcactaaacaagtctcttgctctcaggaatttgtcagaaaaaagaataaaatcacctgagactccacataccagattataaactcttctcgtaggtttgaattgcttactcacatgtcataaattaaccacagcttcatttgaccaccaggtctaaagtctgttgacagtttcagcatgactgaatcgctcattttttttttttgctttcagaaattggcttggttctctttagagttggtgtaaacatgccatgtaataaatgatttccacttaatggtacaacagaattattgctttcttagatgtatgtgtagtaaaagtcaatatacacatttatataatttctttcttcaaaatcttatacctaatttgatatttctaaaaattgcacatgtaagtcatgtgtataacatgctaaagtactttaactgtgatcttaaaactgaataaaaatatttaataaaactttgaa

SEQ ID NO: 314065 - DNA, 9084 bp, Homo sapiens
  misc_feature (1)..(2): n is a, c, g, or t
  misc_feature (4)..(4): n is a, c, g, or t
nngngtgttttcagtctctccgggttgcatgtactgtatgtggagcagtgtacagtgaagcggaggcagagcggctccgcgagcttctctccactttcccatagagaaaccctgactggccgctgagggctagctacacacacgccctcacgcccggcgagcccgcgaggtcactatcatatgacaaaggctttgccgcagttcatcttcctccctgtgtactttccatttgccttcctggaatcctgctgcatcacagaagctggaagttctgatgttccactgaaatcacaatggaaagtcttgacttgactggtaagagctgttgtgaaggtacatcttacttacttacctggaagcagtgaggcagtcaagaattatgtgctgtcagagctggtctcagcatgatcaaggaagtgtgatcattggatatttttttcttgtcaattttattattttttaaagtgtgacttttattgatctccattatcaagcatatgggccactgaaaacttctgagcaatggatataaatgagatggaacagaaggaaaaaaaggtagacattggaaagactggtttagggggctttactattatcctaggtcacagtaatgaaaggcagtaatagaaataaggatcattcagcagaaggagaaggggttggaaaacgaccaaaacgaaagtgtcttcagtggcatccattgctagcaaagaaacttcttgatttttcagaagaggaagaagaggaagacgaagaggaggatattgataaggttcaacttcttggggccgatggcctagagcaagatgttggtgaaactgaagatgatgaatcaccagagcagcgagcccggagaccaatgaatgcatttcttttattttgcaaacgccatcgctctcttgtacgtcaggaacaccccaggcttgataaccgaggtgctaccaagatactagctgattggtgggctgttcttgatccaaaggaaaagcagaaatacacagacatggccaaggagtataaggatgcatttatgaaagcaaatcctggctacaaatggtgtcctaccacaaacaagcctgtgaaatccccaacacccactgtcaatccacgaaagaaactttgggccttcccatctgactcttcaagagacttgccaagccccaagaaagcaaagactgaagaaatgcctcagcttaactttggaatggctgatcctactcaaatgggaggcctgagtatgctgctgttagctggagaacatgctcttggcacaccagaggtatcctctggcacatgcaggcctgatgtttcagaatctcctgaattacgtcagaagtcaccattgtttcagtttgccgagatatcttcaagtacgtcccactctgatgcttctacaaagcagtgtcaaacatctgccttgtttcagtttgcagagatttcttcaaacacttcgcagttgggtggtgctgagcctgtaaaacgctgtggaaagtctgcactctttcaactggcagagatgtgcctggcatcagaagggatgaaaatggaagaatcaaagctaataaaagcaaaagaatccgatggtggaagaattaaagaattagagaagggaaaggaagaaaaagaaattaaaatggagaaaacagatgaaactaggttacagaaggaagcagaatttgaaaaatcggctaaggaaaatttaagagattctaaggaattgagaaattttgaggcattgcaaatagatgacataatggctataaaaatggaagatcccaaagaaattagaaaggaagagttagaagaagatcacaaatgtagtcattttcctgatttttcttattctgccagtagcaagataataattagtgatgttcccagtagaaaggatcatatgtgccatcctcatggaattatgatcattgaggatcccgcagcattaaacaagccagaaaagctaaaaaagaaaaagaagaaaagcaaaatggatcgacatggaaatgataaatccacacccaagaagacttgcaaaaagaggcagtcttcggaatctgacattgagagcgtcatatataccattgaagccgtcgcaaaaggagactggggcatagagaaacttggagatacccctcgcaagaaggtccgcacatcctcaagtggcaagggaagcattttggatgccaagccaccaaagaaaaaagtgaaatcaagagagaagaaaatgtcaaaggagaaatcctcagacaccaccaaagagtcaagacctccagatttcattagtatttctgctagcaagaacatttctggtgagacaccagagggtataaaagcagaaccattgacccctatggaagatgcactaccacccagcctatcaggacaggccaagcctgaggacagtgactgtcacagaaaaatagaaacttgtggttccaggaaatccgagaggtcttgcaaaggtgctctttataaaaccctggtgtctgagggcatgctcacctctctgcgagctaatgttgacagaggaaaacgaagctcaggaaaaggaaactcctctgatcatgaagggtgttggaatgaagaaagctggacatttagtcagagtgggaccagtgggagcaagaagttcaagaagacaaagccaaaagaagactgtctccttggctccgcaaagctggatgaagaatttgaaaaaaaattcaacagcctccctcaatatagtcctgttacatttgaccggaaatgtgtacctgtcccaagaaaaaagaagaagactggaaatgtgtcctcagaaccgactaaaaccagcaaaggaagtggggataaatggtcaaacaagcaactcttcttggatgccattcaccctacagaagccatattttcagaagacagaaacaccatggagcctgttcataaggttaaaaatatcccatccattttcaacactccagagccaacaacaacgcaagaacctttggtgggcagccaaaagagaaaagcaaggaaaaccaagattacacaccttgtcaggacagcagatggccgggtatcaccagcaggaggtactttggatgacaaaccaaaggaacaactgcagaggagtctccctaaagcaactgagacagactgcaatgacaaatgctcacacaacaccgaggtcggggagacgcggagcagtactccagaaatgcctgccgtgtctgcgttctttagcctcgctgcgctggctgaagtggcagccatggaaaatgtgcacagaggtcagaggtcaactccgctcacccatgatggacagccaaaagaaatgccgcaggctcctgtacttatttcctgcgctgaccagtgaagcgccctttcattgtaaaacattgtgctttacctactaccctagccttgtctttaccgagggatgctagtgagtccaagtggtggaaaatatagactgcaaacaagtgcttgttgccccacacggcccagattcacttgaagcagaagttagcatcctgggccagtttgttctctcagaacccagaatctttgagggtaaggttatctgtctgatactgagcagaaacagaatgatcctggagctttgctttctattgaaggcttttgacggtaataggtggtaacttggtaaaaggctgcctttactgtagctcacccagcatctcttttaccaaccagagagtgtgaaactagtttcatatattacctagttattctttcaaaacaaaacaaaaaaaaaacaaaaactgacgcactgcactagttattattagatattcttagtcttttttgtacatggagatttaagtttaagatggtttatataataggttatacctacatttatattgtagaataaatattaaaaagcctgttccagagactcccaagcagcctgggcaggcagatgtaccattgttagtggtgtatgctcggcctcgtggtccatatattctgcacttttatatttgccaccagaatggtagtttgctggcaaaaaaaaaaaaaagagagagagaaaaaattacaactcttacaatctgaatttttttcttagccttgagtgaccaagaagaatttgcttgaggcaaattgtggcaaatattttcccagacaggggaagagtcctgcagattacagattactggtgttttcatgccttgaggattcttttatttttacataggggtctaagtgaccaatggattgttcatacaaacaaaaaaaaagacaaaaatattattcagaagtgaccttagtattacttcactattctaaacacattgaagacactcacttcatgtggacttggagctacagaccttttacatccatcacagattggctggacgggttgcaattgctatgcacagcctgattggcactgcaggtttttagagccattttgagtttgtgttgtttaggaggtactgagtcaatgatgagggaggtatgcctgaccagagtgggactctcagtcatagatccacctgcaagtctctgtttcctttttgtgttttgttgcttttgaacataaaaccaaccatacataagcagcgccaagtggattaactggcttagaacattcaacatattgacttaaccacctgacattcacagtgtcttgtttcctagcaacagatgcaaagtgataaatcaaaattagtctgaggctacagattttacagggtatttgttctatagcacaaagtatttccccactcttgcgtcacagcacaaactaccaaattttaattattggattccagcaataatttttaatggttttcaaactggcggaattttgacagtgctagttcgagtttgaagcttttgaattagatctctaaatggtgacagtttacatggttttatctagctttcttatttatacttgactgaattgtaatgattttttttctaattgtaatttgacgtaatagccatacaaaaaatgactctattcatactaggtttagcttctcatggttgtagatattacttcagttccggtgctggaaaatatgtacaacatactaacaggattgaaaaaaaaatagaggtttttcttcttgtttttttttccaaagcaggtaaagagggtagcaaagcatcggaatgatgtgctcaaaaatgcatattcctggtggggatggaggaagaaggcattagtaaaaggttaatcaaacgttacaacttaaccccattcatgtaggaataaatcaagtgagcagttccagacttttgcataatatttttactatgatgctgttttattaatattttctaaatttcaaaacaaaaagtgaatgtttgaaattgctgggtcccgatgttggtggctgttggagttttggaccactcgctagcagtgatttgaagattataattagctaaaatccaaaacaaaaaaccaacaacaaaaattgtatggtgcggaacatgcaccttgacaatggtactaacttgttattctatagaacacgttagaatagatctatttttgccagagcaccctccttcagtcctccgattacatttcactagagttccttacgagattgctgtatattcctgggacctttttttaaaaaaaaaaaaagcaaaacaaaagattactttttttctatgtgattaatatcttacttgatctgcttttcctaaacctcagtggcttttcccttaggcagggttgggggtgggagggcaacttactggagatgactgttttcagatactttaaaacaaacctttttgtagaaatgcttaatttttaagcggttaggcactgagagtagcagaaatcctgcaaagctttatagttccttagactcaccttgtcgattctctgagtaaagtcttgatttcaataattgtgcttctcatgccctgaatctgctggagaggagtgttgttattttcaggtaacaacattcgttagcacaaatatttcagaccaatattagtgctctccaccccaccttttgttatcattttcatttcatttctctcattcttttttattttggaaaatcatattgctatagtgtgtactttaatctgccagcagataccatctacactaacatttgtcccacagcatcctcaagagaaaaagttgttgcaccttatatatatctcaagcaaaccaaaatatgatgctcttctgctttgttttattctaaattgttgtatcatatctttctgaaaccattctgaatttagttgaaattatcaatatttatgcttttaaccttaatttctggattcaagcctgtatataaatcttttgaaaaaaaattgtcctagcccttctctgcgatgctggaagtagaagattgcgtctcagatggagacgcagtactgttccagttttctttagccttttatttatttagttattctgggtatttcctatgtaattttgaagtgtgtagagtatattatagtaactgaagctgcagctgtaagaagctgagtgaaagaaaaaatactgtaagacatccttaaagtttttatttgtttgggtactgtatatgagatcaggaaaaagaaaaatgtcccacagccacattggaaatacaggttcttgtccccaaattaggttagttcccagattttagatcaaaactgttaattcattaaaaccccttttaaaaggtaaattctactgttgtaattccgatagtctttttcccacaaatatcagaaatatatttatttaattctgtcagatgagctttctaccgatgccatgtcccaaagccatgttaaaataattcccacgttatcattgtgattctacttcctgccactaaaattgctggagaaacaaaataatgatggaacactatgaacaaaaaggagcatctgaactggtctggttatttagaatccaatgtgttcaaatccttttgttttcttattaagtcagatgctactgtaagtcagataaaattttgtttgcactctgcagtctttggctcaatgtatggaaatgtttgcacctatgtaaagtcacaagctaattacaaattgctacagaacaggagtaagctgaaaactgaatgccatgttttgtttataaggtggggaggggagggaaaataccaaaaaactctgttccaagtttggcatttgacattaatgtgaagcagtgggaccatgctgcctgctaaactactgtatgaatcgtaaatgttctgaagacgagcagctggaggctggaggatggcattccatacagcaaaggagaagcacccaccacttcatctgggaaaaggaaggaaattgcaggaggcctggagccatcatttgtaaaggggatgttgcggggtgtgatgctgttgaggagattcaccttcaattgcactgctccacagagccctcatataaggccaatcctaatgggctacctcggctttaaaagttaatttcagtaagtcctgtttcaaaagtttgtctttttttgcttctaccttcagtgccactattttccactgcagtgttttgacttcacaaactgcctcctccagagagaacaatgtattgctgaaaatgggcagtagaagcaaatgctgttgttacatttgacctataaagtattcagagtgactgctaggtagaaattaaaacttagctttcccaaatagctccttattttgcaccttataaaaagtatactaattgttaattagatgttgcttttgtttatacaagcattcccaaagaactagatttggattttgttttgagtttttggatttttaaaaattatcttatttagattgactaacagcatacttacaattttaaaagaagctgttgttcagttcatcttaccagatgtgtctggcgaagtattcagggtttgatggactgctttactttcgtttggaagtgatagctaagtttattatactctatattaaacaactttgttcatttcactgaggaccttatcttccttatatttcagaacaaagaagcaacaagcgtgaataaaaagacaaatgtatttgactccctcataatccccatctgtatgtgctacccttccttcaaatatataaatgtgcatctttttttttaaaaaaaaaaaaaaaaaggttcctcttctggccaaatttgatctatggtggtatgattcatactgttaaattgagagaggaaaccttgtggttaaaaattatatggctgctgttttctttttgcagtcagtggtcaaaactgatcatgtgcttaaatcgatttttatgcacagaactagttattgtgaacattactgctccctccaaagatttcctgataacttgggccagaggtggttactgagtaacaaggatctaattcaatgcctcaaaactcttccacccacaatgcaaatcttacctcacaagctctaacctaaatcacagagacatgcatgtttcatgcattaacactgatttcgctctgtggcccaccagaggggtgggctcatgtcccctgactcctcacatgagtgcctcagctctaagagccgtggaacggggggtagggaaggtttgcgatctggagctcagcaactggctcagcaacgttttctccatttcattagcactaaacaagtctcttgctctcaggaatttgtcagaaaaaagaataaaatcacctgagactccacataccagattataaactcttctcgtaggtttgaattgcttactcacatgtcataaattaaccacagcttcatttgaccaccaggtctaaagtctgttgacagtttcagcatgactgaatcgctcattttttttttttgctttcagaaattggcttggttctctttagagttggtgtaaacatgccatgtaataaatgatttccacttaatggtacaacagaattattgctttcttagatgtatgtgtagtaaaagtcaatatacacatttatataatttctttcttcaaaatcttatacctaatttgatatttctaaaaattgcacatgtaagtcatgtgtataacatgctaaagtactttaactgtgatcttaaaactgaataaaaatatttaataaaactttgaa

SEQ ID NO: 314066 - DNA, 8913 bp, Homo sapiens
  misc_feature (1)..(2): n is a, c, g, or t
  misc_feature (4)..(4): n is a, c, g, or t
nngngtgttttcagtctctccgggttgcatgtactgtatgtggagcagtgtacagtgaagcggaggcagagcggctccgcgagcttctctccactttcccatagagaaaccctgactggccgctgagggctagctacacacacgccctcacgcccggcgagcccgcgaggtcactatcatatgacaaaggctttgccgcagttcatcttcctccctgtgtactttccatttgccttcctgggaatatccttggaattaatatacctggaacaattctttctgcagttaaagattggtgcctggccagaaatgcctgtgaaacagctgtggtttaagcttcaactgtaaaagacagacggaatcctgctgcatcacagaagctggaagttctgatgttccactgaaatcacaatggaaagtcttgacttgactggtcacagtaatgaaaggcagtaatagaaataaggatcattcagcagaaggagaaggggttggaaaacgaccaaaacgaaagtgtcttcagtggcatccattgctagcaaagaaacttcttgatttttcagaagaggaagaagaggaagacgaagaggaggatattgataaggttcaacttcttggggccgatggcctagagcaagatgttggtgaaactgaagatgatgaatcaccagagcagcgagcccggagaccaatgaatgcatttcttttattttgcaaacgccatcgctctcttgtacgtcaggaacaccccaggcttgataaccgaggtgctaccaagatactagctgattggtgggctgttcttgatccaaaggaaaagcagaaatacacagacatggccaaggagtataaggatgcatttatgaaagcaaatcctggctacaaatggtgtcctaccacaaacaagcctgtgaaatccccaacacccactgtcaatccacgaaagaaactttgggccttcccatctgactcttcaagagacttgccaagccccaagaaagcaaagactgaagaaatgcctcagcttaactttggaatggctgatcctactcaaatgggaggcctgagtatgctgctgttagctggagaacatgctcttggcacaccagaggtatcctctggcacatgcaggcctgatgtttcagaatctcctgaattacgtcagaagtcaccattgtttcagtttgccgagatatcttcaagtacgtcccactctgatgcttctacaaagcagtgtcaaacatctgccttgtttcagtttgcagagatttcttcaaacacttcgcagttgggtggtgctgagcctgtaaaacgctgtggaaagtctgcactctttcaactggcagagatgtgcctggcatcagaagggatgaaaatggaagaatcaaagctaataaaagcaaaagaatccgatggtggaagaattaaagaattagagaagggaaaggaagaaaaagaaattaaaatggagaaaacagatgaaactaggttacagaaggaagcagaatttgaaaaatcggctaaggaaaatttaagagattctaaggaattgagaaattttgaggcattgcaaatagatgacataatggctataaaaatggaagatcccaaagaaattagaaaggaagagttagaagaagatcacaaatgtagtcattttcctgatttttcttattctgccagtagcaagataataattagtgatgttcccagtagaaaggatcatatgtgccatcctcatggaattatgatcattgaggatcccgcagcattaaacaagccagaaaagctaaaaaagaaaaagaagaaaagcaaaatggatcgacatggaaatgataaatccacacccaagaagacttgcaaaaagaggcagtcttcggaatctgacattgagagcgtcatatataccattgaagccgtcgcaaaaggagactggggcatagagaaacttggagatacccctcgcaagaaggtccgcacatcctcaagtggcaagggaagcattttggatgccaagccaccaaagaaaaaagtgaaatcaagagagaagaaaatgtcaaaggagaaatcctcagacaccaccaaagagtcaagacctccagatttcattagtatttctgctagcaagaacatttctggtgagacaccagagggtataaaagcagaaccattgacccctatggaagatgcactaccacccagcctatcaggacaggccaagcctgaggacagtgactgtcacagaaaaatagaaacttgtggttccaggaaatccgagaggtcttgcaaaggtgctctttataaaaccctggtgtctgagggcatgctcacctctctgcgagctaatgttgacagaggaaaacgaagctcaggaaaaggaaactcctctgatcatgaagggtgttggaatgaagaaagctggacatttagtcagagtgggaccagtgggagcaagaagttcaagaagacaaagccaaaagaagactgtctccttggctccgcaaagctggatgaagaatttgaaaaaaaattcaacagcctccctcaatatagtcctgttacatttgaccggaaatgtgtacctgtcccaagaaaaaagaagaagactggaaatgtgtcctcagaaccgactaaaaccagcaaaggaagtggggataaatggtcaaacaagcaactcttcttggatgccattcaccctacagaagccatattttcagaagacagaaacaccatggagcctgttcataaggttaaaaatatcccatccattttcaacactccagagccaacaacaacgcaagaacctttggtgggcagccaaaagagaaaagcaaggaaaaccaagattacacaccttgtcaggacagcagatggccgggtatcaccagcaggaggtactttggatgacaaaccaaaggaacaactgcagaggagtctccctaaagcaactgagacagactgcaatgacaaatgctcacacaacaccgaggtcggggagacgcggagcagtactccagaaatgcctgccgtgtctgcgttctttagcctcgctgcgctggctgaagtggcagccatggaaaatgtgcacagaggtcagaggtcaactccgctcacccatgatggacagccaaaagaaatgccgcaggctcctgtacttatttcctgcgctgaccagtgaagcgccctttcattgtaaaacattgtgctttacctactaccctagccttgtctttaccgagggatgctagtgagtccaagtggtggaaaatatagactgcaaacaagtgcttgttgccccacacggcccagattcacttgaagcagaagttagcatcctgggccagtttgttctctcagaacccagaatctttgagggtaaggttatctgtctgatactgagcagaaacagaatgatcctggagctttgctttctattgaaggcttttgacggtaataggtggtaacttggtaaaaggctgcctttactgtagctcacccagcatctcttttaccaaccagagagtgtgaaactagtttcatatattacctagttattctttcaaaacaaaacaaaaaaaaaacaaaaactgacgcactgcactagttattattagatattcttagtcttttttgtacatggagatttaagtttaagatggtttatataataggttatacctacatttatattgtagaataaatattaaaaagcctgttccagagactcccaagcagcctgggcaggcagatgtaccattgttagtggtgtatgctcggcctcgtggtccatatattctgcacttttatatttgccaccagaatggtagtttgctggcaaaaaaaaaaaaaagagagagagaaaaaattacaactcttacaatctgaatttttttcttagccttgagtgaccaagaagaatttgcttgaggcaaattgtggcaaatattttcccagacaggggaagagtcctgcagattacagattactggtgttttcatgccttgaggattcttttatttttacataggggtctaagtgaccaatggattgttcatacaaacaaaaaaaaagacaaaaatattattcagaagtgaccttagtattacttcactattctaaacacattgaagacactcacttcatgtggacttggagctacagaccttttacatccatcacagattggctggacgggttgcaattgctatgcacagcctgattggcactgcaggtttttagagccattttgagtttgtgttgtttaggaggtactgagtcaatgatgagggaggtatgcctgaccagagtgggactctcagtcatagatccacctgcaagtctctgtttcctttttgtgttttgttgcttttgaacataaaaccaaccatacataagcagcgccaagtggattaactggcttagaacattcaacatattgacttaaccacctgacattcacagtgtcttgtttcctagcaacagatgcaaagtgataaatcaaaattagtctgaggctacagattttacagggtatttgttctatagcacaaagtatttccccactcttgcgtcacagcacaaactaccaaattttaattattggattccagcaataatttttaatggttttcaaactggcggaattttgacagtgctagttcgagtttgaagcttttgaattagatctctaaatggtgacagtttacatggttttatctagctttcttatttatacttgactgaattgtaatgattttttttctaattgtaatttgacgtaatagccatacaaaaaatgactctattcatactaggtttagcttctcatggttgtagatattacttcagttccggtgctggaaaatatgtacaacatactaacaggattgaaaaaaaaatagaggtttttcttcttgtttttttttccaaagcaggtaaagagggtagcaaagcatcggaatgatgtgctcaaaaatgcatattcctggtggggatggaggaagaaggcattagtaaaaggttaatcaaacgttacaacttaaccccattcatgtaggaataaatcaagtgagcagttccagacttttgcataatatttttactatgatgctgttttattaatattttctaaatttcaaaacaaaaagtgaatgtttgaaattgctgggtcccgatgttggtggctgttggagttttggaccactcgctagcagtgatttgaagattataattagctaaaatccaaaacaaaaaaccaacaacaaaaattgtatggtgcggaacatgcaccttgacaatggtactaacttgttattctatagaacacgttagaatagatctatttttgccagagcaccctccttcagtcctccgattacatttcactagagttccttacgagattgctgtatattcctgggacctttttttaaaaaaaaaaaaagcaaaacaaaagattactttttttctatgtgattaatatcttacttgatctgcttttcctaaacctcagtggcttttcccttaggcagggttgggggtgggagggcaacttactggagatgactgttttcagatactttaaaacaaacctttttgtagaaatgcttaatttttaagcggttaggcactgagagtagcagaaatcctgcaaagctttatagttccttagactcaccttgtcgattctctgagtaaagtcttgatttcaataattgtgcttctcatgccctgaatctgctggagaggagtgttgttattttcaggtaacaacattcgttagcacaaatatttcagaccaatattagtgctctccaccccaccttttgttatcattttcatttcatttctctcattcttttttattttggaaaatcatattgctatagtgtgtactttaatctgccagcagataccatctacactaacatttgtcccacagcatcctcaagagaaaaagttgttgcaccttatatatatctcaagcaaaccaaaatatgatgctcttctgctttgttttattctaaattgttgtatcatatctttctgaaaccattctgaatttagttgaaattatcaatatttatgcttttaaccttaatttctggattcaagcctgtatataaatcttttgaaaaaaaattgtcctagcccttctctgcgatgctggaagtagaagattgcgtctcagatggagacgcagtactgttccagttttctttagccttttatttatttagttattctgggtatttcctatgtaattttgaagtgtgtagagtatattatagtaactgaagctgcagctgtaagaagctgagtgaaagaaaaaatactgtaagacatccttaaagtttttatttgtttgggtactgtatatgagatcaggaaaaagaaaaatgtcccacagccacattggaaatacaggttcttgtccccaaattaggttagttcccagattttagatcaaaactgttaattcattaaaaccccttttaaaaggtaaattctactgttgtaattccgatagtctttttcccacaaatatcagaaatatatttatttaattctgtcagatgagctttctaccgatgccatgtcccaaagccatgttaaaataattcccacgttatcattgtgattctacttcctgccactaaaattgctggagaaacaaaataatgatggaacactatgaacaaaaaggagcatctgaactggtctggttatttagaatccaatgtgttcaaatccttttgttttcttattaagtcagatgctactgtaagtcagataaaattttgtttgcactctgcagtctttggctcaatgtatggaaatgtttgcacctatgtaaagtcacaagctaattacaaattgctacagaacaggagtaagctgaaaactgaatgccatgttttgtttataaggtggggaggggagggaaaataccaaaaaactctgttccaagtttggcatttgacattaatgtgaagcagtgggaccatgctgcctgctaaactactgtatgaatcgtaaatgttctgaagacgagcagctggaggctggaggatggcattccatacagcaaaggagaagcacccaccacttcatctgggaaaaggaaggaaattgcaggaggcctggagccatcatttgtaaaggggatgttgcggggtgtgatgctgttgaggagattcaccttcaattgcactgctccacagagccctcatataaggccaatcctaatgggctacctcggctttaaaagttaatttcagtaagtcctgtttcaaaagtttgtctttttttgcttctaccttcagtgccactattttccactgcagtgttttgacttcacaaactgcctcctccagagagaacaatgtattgctgaaaatgggcagtagaagcaaatgctgttgttacatttgacctataaagtattcagagtgactgctaggtagaaattaaaacttagctttcccaaatagctccttattttgcaccttataaaaagtatactaattgttaattagatgttgcttttgtttatacaagcattcccaaagaactagatttggattttgttttgagtttttggatttttaaaaattatcttatttagattgactaacagcatacttacaattttaaaagaagctgttgttcagttcatcttaccagatgtgtctggcgaagtattcagggtttgatggactgctttactttcgtttggaagtgatagctaagtttattatactctatattaaacaactttgttcatttcactgaggaccttatcttccttatatttcagaacaaagaagcaacaagcgtgaataaaaagacaaatgtatttgactccctcataatccccatctgtatgtgctacccttccttcaaatatataaatgtgcatctttttttttaaaaaaaaaaaaaaaaaggttcctcttctggccaaatttgatctatggtggtatgattcatactgttaaattgagagaggaaaccttgtggttaaaaattatatggctgctgttttctttttgcagtcagtggtcaaaactgatcatgtgcttaaatcgatttttatgcacagaactagttattgtgaacattactgctccctccaaagatttcctgataacttgggccagaggtggttactgagtaacaaggatctaattcaatgcctcaaaactcttccacccacaatgcaaatcttacctcacaagctctaacctaaatcacagagacatgcatgtttcatgcattaacactgatttcgctctgtggcccaccagaggggtgggctcatgtcccctgactcctcacatgagtgcctcagctctaagagccgtggaacggggggtagggaaggtttgcgatctggagctcagcaactggctcagcaacgttttctccatttcattagcactaaacaagtctcttgctctcaggaatttgtcagaaaaaagaataaaatcacctgagactccacataccagattataaactcttctcgtaggtttgaattgcttactcacatgtcataaattaaccacagcttcatttgaccaccaggtctaaagtctgttgacagtttcagcatgactgaatcgctcattttttttttttgctttcagaaattggcttggttctctttagagttggtgtaaacatgccatgtaataaatgatttccacttaatggtacaacagaattattgctttcttagatgtatgtgtagtaaaagtcaatatacacatttatataatttctttcttcaaaatcttatacctaatttgatatttctaaaaattgcacatgtaagtcatgtgtataacatgctaaagtactttaactgtgatcttaaaactgaataaaaatatttaataaaactttgaa

SEQ ID NO: 314067 - DNA, 8587 bp, Homo sapiens
cagattgacagagattcatacaaggaaggaaagaatcctgctgcatcacagaagctggaagttctgatgttccactgaaatcacaatggaaagtcttgacttgactggtcacagtaatgaaaggcagtaatagaaataaggatcattcagcagaaggagaaggggttggaaaacgaccaaaacgaaagtgtcttcagtggcatccattgctagcaaagaaacttcttgatttttcagaagaggaagaagaggaagacgaagaggaggatattgataaggttcaacttcttggggccgatggcctagagcaagatgttggtgaaactgaagatgatgaatcaccagagcagcgagcccggagaccaatgaatgcatttcttttattttgcaaacgccatcgctctcttgtacgtcaggaacaccccaggcttgataaccgaggtgctaccaagatactagctgattggtgggctgttcttgatccaaaggaaaagcagaaatacacagacatggccaaggagtataaggatgcatttatgaaagcaaatcctggctacaaatggtgtcctaccacaaacaagcctgtgaaatccccaacacccactgtcaatccacgaaagaaactttgggccttcccatctgactcttcaagagacttgccaagccccaagaaagcaaagactgaagaaatgcctcagcttaactttggaatggctgatcctactcaaatgggaggcctgagtatgctgctgttagctggagaacatgctcttggcacaccagaggtatcctctggcacatgcaggcctgatgtttcagaatctcctgaattacgtcagaagtcaccattgtttcagtttgccgagatatcttcaagtacgtcccactctgatgcttctacaaagcagtgtcaaacatctgccttgtttcagtttgcagagatttcttcaaacacttcgcagttgggtggtgctgagcctgtaaaacgctgtggaaagtctgcactctttcaactggcagagatgtgcctggcatcagaagggatgaaaatggaagaatcaaagctaataaaagcaaaagaatccgatggtggaagaattaaagaattagagaagggaaaggaagaaaaagaaattaaaatggagaaaacagatgaaactaggttacagaaggaagcagaatttgaaaaatcggctaaggaaaatttaagagattctaaggaattgagaaattttgaggcattgcaaatagatgacataatggctataaaaatggaagatcccaaagaaattagaaaggaagagttagaagaagatcacaaatgtagtcattttcctgatttttcttattctgccagtagcaagataataattagtgatgttcccagtagaaaggatcatatgtgccatcctcatggaattatgatcattgaggatcccgcagcattaaacaagccagaaaagctaaaaaagaaaaagaagaaaagcaaaatggatcgacatggaaatgataaatccacacccaagaagacttgcaaaaagaggcagtcttcggaatctgacattgagagcgtcatatataccattgaagccgtcgcaaaaggagactggggcatagagaaacttggagatacccctcgcaagaaggtccgcacatcctcaagtggcaagggaagcattttggatgccaagccaccaaagaaaaaagtgaaatcaagagagaagaaaatgtcaaaggagaaatcctcagacaccaccaaagagtcaagacctccagatttcattagtatttctgctagcaagaacatttctggtgagacaccagagggtataaaagcagaaccattgacccctatggaagatgcactaccacccagcctatcaggacaggccaagcctgaggacagtgactgtcacagaaaaatagaaacttgtggttccaggaaatccgagaggtcttgcaaaggtgctctttataaaaccctggtgtctgagggcatgctcacctctctgcgagctaatgttgacagaggaaaacgaagctcaggaaaaggaaactcctctgatcatgaagggtgttggaatgaagaaagctggacatttagtcagagtgggaccagtgggagcaagaagttcaagaagacaaagccaaaagaagactgtctccttggctccgcaaagctggatgaagaatttgaaaaaaaattcaacagcctccctcaatatagtcctgttacatttgaccggaaatgtgtacctgtcccaagaaaaaagaagaagactggaaatgtgtcctcagaaccgactaaaaccagcaaaggaagtggggataaatggtcaaacaagcaactcttcttggatgccattcaccctacagaagccatattttcagaagacagaaacaccatggagcctgttcataaggttaaaaatatcccatccattttcaacactccagagccaacaacaacgcaagaacctttggtgggcagccaaaagagaaaagcaaggaaaaccaagattacacaccttgtcaggacagcagatggccgggtatcaccagcaggaggtactttggatgacaaaccaaaggaacaactgcagaggagtctccctaaagcaactgagacagactgcaatgacaaatgctcacacaacaccgaggtcggggagacgcggagcagtactccagaaatgcctgccgtgtctgcgttctttagcctcgctgcgctggctgaagtggcagccatggaaaatgtgcacagaggtcagaggtcaactccgctcacccatgatggacagccaaaagaaatgccgcaggctcctgtacttatttcctgcgctgaccagtgaagcgccctttcattgtaaaacattgtgctttacctactaccctagccttgtctttaccgagggatgctagtgagtccaagtggtggaaaatatagactgcaaacaagtgcttgttgccccacacggcccagattcacttgaagcagaagttagcatcctgggccagtttgttctctcagaacccagaatctttgagggtaaggttatctgtctgatactgagcagaaacagaatgatcctggagctttgctttctattgaaggcttttgacggtaataggtggtaacttggtaaaaggctgcctttactgtagctcacccagcatctcttttaccaaccagagagtgtgaaactagtttcatatattacctagttattctttcaaaacaaaacaaaaaaaaaacaaaaactgacgcactgcactagttattattagatattcttagtcttttttgtacatggagatttaagtttaagatggtttatataataggttatacctacatttatattgtagaataaatattaaaaagcctgttccagagactcccaagcagcctgggcaggcagatgtaccattgttagtggtgtatgctcggcctcgtggtccatatattctgcacttttatatttgccaccagaatggtagtttgctggcaaaaaaaaaaaaaagagagagagaaaaaattacaactcttacaatctgaatttttttcttagccttgagtgaccaagaagaatttgcttgaggcaaattgtggcaaatattttcccagacaggggaagagtcctgcagattacagattactggtgttttcatgccttgaggattcttttatttttacataggggtctaagtgaccaatggattgttcatacaaacaaaaaaaaagacaaaaatattattcagaagtgaccttagtattacttcactattctaaacacattgaagacactcacttcatgtggacttggagctacagaccttttacatccatcacagattggctggacgggttgcaattgctatgcacagcctgattggcactgcaggtttttagagccattttgagtttgtgttgtttaggaggtactgagtcaatgatgagggaggtatgcctgaccagagtgggactctcagtcatagatccacctgcaagtctctgtttcctttttgtgttttgttgcttttgaacataaaaccaaccatacataagcagcgccaagtggattaactggcttagaacattcaacatattgacttaaccacctgacattcacagtgtcttgtttcctagcaacagatgcaaagtgataaatcaaaattagtctgaggctacagattttacagggtatttgttctatagcacaaagtatttccccactcttgcgtcacagcacaaactaccaaattttaattattggattccagcaataatttttaatggttttcaaactggcggaattttgacagtgctagttcgagtttgaagcttttgaattagatctctaaatggtgacagtttacatggttttatctagctttcttatttatacttgactgaattgtaatgattttttttctaattgtaatttgacgtaatagccatacaaaaaatgactctattcatactaggtttagcttctcatggttgtagatattacttcagttccggtgctggaaaatatgtacaacatactaacaggattgaaaaaaaaatagaggtttttcttcttgtttttttttccaaagcaggtaaagagggtagcaaagcatcggaatgatgtgctcaaaaatgcatattcctggtggggatggaggaagaaggcattagtaaaaggttaatcaaacgttacaacttaaccccattcatgtaggaataaatcaagtgagcagttccagacttttgcataatatttttactatgatgctgttttattaatattttctaaatttcaaaacaaaaagtgaatgtttgaaattgctgggtcccgatgttggtggctgttggagttttggaccactcgctagcagtgatttgaagattataattagctaaaatccaaaacaaaaaaccaacaacaaaaattgtatggtgcggaacatgcaccttgacaatggtactaacttgttattctatagaacacgttagaatagatctatttttgccagagcaccctccttcagtcctccgattacatttcactagagttccttacgagattgctgtatattcctgggacctttttttaaaaaaaaaaaaagcaaaacaaaagattactttttttctatgtgattaatatcttacttgatctgcttttcctaaacctcagtggcttttcccttaggcagggttgggggtgggagggcaacttactggagatgactgttttcagatactttaaaacaaacctttttgtagaaatgcttaatttttaagcggttaggcactgagagtagcagaaatcctgcaaagctttatagttccttagactcaccttgtcgattctctgagtaaagtcttgatttcaataattgtgcttctcatgccctgaatctgctggagaggagtgttgttattttcaggtaacaacattcgttagcacaaatatttcagaccaatattagtgctctccaccccaccttttgttatcattttcatttcatttctctcattcttttttattttggaaaatcatattgctatagtgtgtactttaatctgccagcagataccatctacactaacatttgtcccacagcatcctcaagagaaaaagttgttgcaccttatatatatctcaagcaaaccaaaatatgatgctcttctgctttgttttattctaaattgttgtatcatatctttctgaaaccattctgaatttagttgaaattatcaatatttatgcttttaaccttaatttctggattcaagcctgtatataaatcttttgaaaaaaaattgtcctagcccttctctgcgatgctggaagtagaagattgcgtctcagatggagacgcagtactgttccagttttctttagccttttatttatttagttattctgggtatttcctatgtaattttgaagtgtgtagagtatattatagtaactgaagctgcagctgtaagaagctgagtgaaagaaaaaatactgtaagacatccttaaagtttttatttgtttgggtactgtatatgagatcaggaaaaagaaaaatgtcccacagccacattggaaatacaggttcttgtccccaaattaggttagttcccagattttagatcaaaactgttaattcattaaaaccccttttaaaaggtaaattctactgttgtaattccgatagtctttttcccacaaatatcagaaatatatttatttaattctgtcagatgagctttctaccgatgccatgtcccaaagccatgttaaaataattcccacgttatcattgtgattctacttcctgccactaaaattgctggagaaacaaaataatgatggaacactatgaacaaaaaggagcatctgaactggtctggttatttagaatccaatgtgttcaaatccttttgttttcttattaagtcagatgctactgtaagtcagataaaattttgtttgcactctgcagtctttggctcaatgtatggaaatgtttgcacctatgtaaagtcacaagctaattacaaattgctacagaacaggagtaagctgaaaactgaatgccatgttttgtttataaggtggggaggggagggaaaataccaaaaaactctgttccaagtttggcatttgacattaatgtgaagcagtgggaccatgctgcctgctaaactactgtatgaatcgtaaatgttctgaagacgagcagctggaggctggaggatggcattccatacagcaaaggagaagcacccaccacttcatctgggaaaaggaaggaaattgcaggaggcctggagccatcatttgtaaaggggatgttgcggggtgtgatgctgttgaggagattcaccttcaattgcactgctccacagagccctcatataaggccaatcctaatgggctacctcggctttaaaagttaatttcagtaagtcctgtttcaaaagtttgtctttttttgcttctaccttcagtgccactattttccactgcagtgttttgacttcacaaactgcctcctccagagagaacaatgtattgctgaaaatgggcagtagaagcaaatgctgttgttacatttgacctataaagtattcagagtgactgctaggtagaaattaaaacttagctttcccaaatagctccttattttgcaccttataaaaagtatactaattgttaattagatgttgcttttgtttatacaagcattcccaaagaactagatttggattttgttttgagtttttggatttttaaaaattatcttatttagattgactaacagcatacttacaattttaaaagaagctgttgttcagttcatcttaccagatgtgtctggcgaagtattcagggtttgatggactgctttactttcgtttggaagtgatagctaagtttattatactctatattaaacaactttgttcatttcactgaggaccttatcttccttatatttcagaacaaagaagcaacaagcgtgaataaaaagacaaatgtatttgactccctcataatccccatctgtatgtgctacccttccttcaaatatataaatgtgcatctttttttttaaaaaaaaaaaaaaaaaggttcctcttctggccaaatttgatctatggtggtatgattcatactgttaaattgagagaggaaaccttgtggttaaaaattatatggctgctgttttctttttgcagtcagtggtcaaaactgatcatgtgcttaaatcgatttttatgcacagaactagttattgtgaacattactgctccctccaaagatttcctgataacttgggccagaggtggttactgagtaacaaggatctaattcaatgcctcaaaactcttccacccacaatgcaaatcttacctcacaagctctaacctaaatcacagagacatgcatgtttcatgcattaacactgatttcgctctgtggcccaccagaggggtgggctcatgtcccctgactcctcacatgagtgcctcagctctaagagccgtggaacggggggtagggaaggtttgcgatctggagctcagcaactggctcagcaacgttttctccatttcattagcactaaacaagtctcttgctctcaggaatttgtcagaaaaaagaataaaatcacctgagactccacataccagattataaactcttctcgtaggtttgaattgcttactcacatgtcataaattaaccacagcttcatttgaccaccaggtctaaagtctgttgacagtttcagcatgactgaatcgctcattttttttttttgctttcagaaattggcttggttctctttagagttggtgtaaacatgccatgtaataaatgatttccacttaatggtacaacagaattattgctttcttagatgtatgtgtagtaaaagtcaatatacacatttatataatttctttcttcaaaatcttatacctaatttgatatttctaaaaattgcacatgtaagtcatgtgtataacatgctaaagtactttaactgtgatcttaaaactgaataaaaatatttaataaaactttgaa

SEQ ID NO: 314068 - DNA, 6954 bp, Homo sapiens
gaacaagtacatgtaaatgaaaatataggtacccctgagcctggagagcaccaagaggccaagaaatcatgagaactcatcaaatgagaagaaaatgtcaaaggagaaatcctcagacaccaccaaagagtcaagacctccagatttcattagtatttctgctagcaagaacatttctggtgagacaccagagggtataaaagcagaaccattgacccctatggaagatgcactaccacccagcctatcaggacaggccaagcctgaggacagtgactgtcacagaaaaatagaaacttgtggttccaggaaatccgagaggtcttgcaaaggtgctctttataaaaccctggtgtctgagggcatgctcacctctctgcgagctaatgttgacagaggaaaacgaagctcaggaaaaggaaactcctctgatcatgaagggtgttggaatgaagaaagctggacatttagtcagagtgggaccagtgggagcaagaagttcaagaagacaaagccaaaagaagactgtctccttggctccgcaaagctggatgaagaatttgaaaaaaaattcaacagcctccctcaatatagtcctgttacatttgaccggaaatgtgtacctgtcccaagaaaaaagaagaagactggaaatgtgtcctcagaaccgactaaaaccagcaaaggaagtggggataaatggtcaaacaagcaactcttcttggatgccattcaccctacagaagccatattttcagaagacagaaacaccatggagcctgttcataaggttaaaaatatcccatccattttcaacactccagagccaacaacaacgcaagaacctttggtgggcagccaaaagagaaaagcaaggaaaaccaagattacacaccttgtcaggacagcagatggccgggtatcaccagcaggaggtactttggatgacaaaccaaaggaacaactgcagaggagtctccctaaagcaactgagacagactgcaatgacaaatgctcacacaacaccgaggtcggggagacgcggagcagtactccagaaatgcctgccgtgtctgcgttctttagcctcgctgcgctggctgaagtggcagccatggaaaatgtgcacagaggtcagaggtcaactccgctcacccatgatggacagccaaaagaaatgccgcaggctcctgtacttatttcctgcgctgaccagtgaagcgccctttcattgtaaaacattgtgctttacctactaccctagccttgtctttaccgagggatgctagtgagtccaagtggtggaaaatatagactgcaaacaagtgcttgttgccccacacggcccagattcacttgaagcagaagttagcatcctgggccagtttgttctctcagaacccagaatctttgagggtaaggttatctgtctgatactgagcagaaacagaatgatcctggagctttgctttctattgaaggcttttgacggtaataggtggtaacttggtaaaaggctgcctttactgtagctcacccagcatctcttttaccaaccagagagtgtgaaactagtttcatatattacctagttattctttcaaaacaaaacaaaaaaaaaacaaaaactgacgcactgcactagttattattagatattcttagtcttttttgtacatggagatttaagtttaagatggtttatataataggttatacctacatttatattgtagaataaatattaaaaagcctgttccagagactcccaagcagcctgggcaggcagatgtaccattgttagtggtgtatgctcggcctcgtggtccatatattctgcacttttatatttgccaccagaatggtagtttgctggcaaaaaaaaaaaaaagagagagagaaaaaattacaactcttacaatctgaatttttttcttagccttgagtgaccaagaagaatttgcttgaggcaaattgtggcaaatattttcccagacaggggaagagtcctgcagattacagattactggtgttttcatgccttgaggattcttttatttttacataggggtctaagtgaccaatggattgttcatacaaacaaaaaaaaagacaaaaatattattcagaagtgaccttagtattacttcactattctaaacacattgaagacactcacttcatgtggacttggagctacagaccttttacatccatcacagattggctggacgggttgcaattgctatgcacagcctgattggcactgcaggtttttagagccattttgagtttgtgttgtttaggaggtactgagtcaatgatgagggaggtatgcctgaccagagtgggactctcagtcatagatccacctgcaagtctctgtttcctttttgtgttttgttgcttttgaacataaaaccaaccatacataagcagcgccaagtggattaactggcttagaacattcaacatattgacttaaccacctgacattcacagtgtcttgtttcctagcaacagatgcaaagtgataaatcaaaattagtctgaggctacagattttacagggtatttgttctatagcacaaagtatttccccactcttgcgtcacagcacaaactaccaaattttaattattggattccagcaataatttttaatggttttcaaactggcggaattttgacagtgctagttcgagtttgaagcttttgaattagatctctaaatggtgacagtttacatggttttatctagctttcttatttatacttgactgaattgtaatgattttttttctaattgtaatttgacgtaatagccatacaaaaaatgactctattcatactaggtttagcttctcatggttgtagatattacttcagttccggtgctggaaaatatgtacaacatactaacaggattgaaaaaaaaatagaggtttttcttcttgtttttttttccaaagcaggtaaagagggtagcaaagcatcggaatgatgtgctcaaaaatgcatattcctggtggggatggaggaagaaggcattagtaaaaggttaatcaaacgttacaacttaaccccattcatgtaggaataaatcaagtgagcagttccagacttttgcataatatttttactatgatgctgttttattaatattttctaaatttcaaaacaaaaagtgaatgtttgaaattgctgggtcccgatgttggtggctgttggagttttggaccactcgctagcagtgatttgaagattataattagctaaaatccaaaacaaaaaaccaacaacaaaaattgtatggtgcggaacatgcaccttgacaatggtactaacttgttattctatagaacacgttagaatagatctatttttgccagagcaccctccttcagtcctccgattacatttcactagagttccttacgagattgctgtatattcctgggacctttttttaaaaaaaaaaaaagcaaaacaaaagattactttttttctatgtgattaatatcttacttgatctgcttttcctaaacctcagtggcttttcccttaggcagggttgggggtgggagggcaacttactggagatgactgttttcagatactttaaaacaaacctttttgtagaaatgcttaatttttaagcggttaggcactgagagtagcagaaatcctgcaaagctttatagttccttagactcaccttgtcgattctctgagtaaagtcttgatttcaataattgtgcttctcatgccctgaatctgctggagaggagtgttgttattttcaggtaacaacattcgttagcacaaatatttcagaccaatattagtgctctccaccccaccttttgttatcattttcatttcatttctctcattcttttttattttggaaaatcatattgctatagtgtgtactttaatctgccagcagataccatctacactaacatttgtcccacagcatcctcaagagaaaaagttgttgcaccttatatatatctcaagcaaaccaaaatatgatgctcttctgctttgttttattctaaattgttgtatcatatctttctgaaaccattctgaatttagttgaaattatcaatatttatgcttttaaccttaatttctggattcaagcctgtatataaatcttttgaaaaaaaattgtcctagcccttctctgcgatgctggaagtagaagattgcgtctcagatggagacgcagtactgttccagttttctttagccttttatttatttagttattctgggtatttcctatgtaattttgaagtgtgtagagtatattatagtaactgaagctgcagctgtaagaagctgagtgaaagaaaaaatactgtaagacatccttaaagtttttatttgtttgggtactgtatatgagatcaggaaaaagaaaaatgtcccacagccacattggaaatacaggttcttgtccccaaattaggttagttcccagattttagatcaaaactgttaattcattaaaaccccttttaaaaggtaaattctactgttgtaattccgatagtctttttcccacaaatatcagaaatatatttatttaattctgtcagatgagctttctaccgatgccatgtcccaaagccatgttaaaataattcccacgttatcattgtgattctacttcctgccactaaaattgctggagaaacaaaataatgatggaacactatgaacaaaaaggagcatctgaactggtctggttatttagaatccaatgtgttcaaatccttttgttttcttattaagtcagatgctactgtaagtcagataaaattttgtttgcactctgcagtctttggctcaatgtatggaaatgtttgcacctatgtaaagtcacaagctaattacaaattgctacagaacaggagtaagctgaaaactgaatgccatgttttgtttataaggtggggaggggagggaaaataccaaaaaactctgttccaagtttggcatttgacattaatgtgaagcagtgggaccatgctgcctgctaaactactgtatgaatcgtaaatgttctgaagacgagcagctggaggctggaggatggcattccatacagcaaaggagaagcacccaccacttcatctgggaaaaggaaggaaattgcaggaggcctggagccatcatttgtaaaggggatgttgcggggtgtgatgctgttgaggagattcaccttcaattgcactgctccacagagccctcatataaggccaatcctaatgggctacctcggctttaaaagttaatttcagtaagtcctgtttcaaaagtttgtctttttttgcttctaccttcagtgccactattttccactgcagtgttttgacttcacaaactgcctcctccagagagaacaatgtattgctgaaaatgggcagtagaagcaaatgctgttgttacatttgacctataaagtattcagagtgactgctaggtagaaattaaaacttagctttcccaaatagctccttattttgcaccttataaaaagtatactaattgttaattagatgttgcttttgtttatacaagcattcccaaagaactagatttggattttgttttgagtttttggatttttaaaaattatcttatttagattgactaacagcatacttacaattttaaaagaagctgttgttcagttcatcttaccagatgtgtctggcgaagtattcagggtttgatggactgctttactttcgtttggaagtgatagctaagtttattatactctatattaaacaactttgttcatttcactgaggaccttatcttccttatatttcagaacaaagaagcaacaagcgtgaataaaaagacaaatgtatttgactccctcataatccccatctgtatgtgctacccttccttcaaatatataaatgtgcatctttttttttaaaaaaaaaaaaaaaaaggttcctcttctggccaaatttgatctatggtggtatgattcatactgttaaattgagagaggaaaccttgtggttaaaaattatatggctgctgttttctttttgcagtcagtggtcaaaactgatcatgtgcttaaatcgatttttatgcacagaactagttattgtgaacattactgctccctccaaagatttcctgataacttgggccagaggtggttactgagtaacaaggatctaattcaatgcctcaaaactcttccacccacaatgcaaatcttacctcacaagctctaacctaaatcacagagacatgcatgtttcatgcattaacactgatttcgctctgtggcccaccagaggggtgggctcatgtcccctgactcctcacatgagtgcctcagctctaagagccgtggaacggggggtagggaaggtttgcgatctggagctcagcaactggctcagcaacgttttctccatttcattagcactaaacaagtctcttgctctcaggaatttgtcagaaaaaagaataaaatcacctgagactccacataccagattataaactcttctcgtaggtttgaattgcttactcacatgtcataaattaaccacagcttcatttgaccaccaggtctaaagtctgttgacagtttcagcatgactgaatcgctcattttttttttttgctttcagaaattggcttggttctctttagagttggtgtaaacatgccatgtaataaatgatttccacttaatggtacaacagaattattgctttcttagatgtatgtgtagtaaaagtcaatatacacatttatataatttctttcttcaaaatcttatacctaatttgatatttctaaaaattgcacatgtaagtcatgtgtataacatgctaaagtactttaactgtgatcttaaaactgaataaaaatatttaataaaactttgaa

SEQ ID NO: 314069 - DNA, 6371 bp, Homo sapiens
tggagtcacagtccatctctgtttctcttccagagtcattgcttttattatcactaaattacctgaaggttaccaattactataggagaactttcccttcaggcaagtcaagaaaaggaatgtgtcatttttaataccaatggatcaacaggaaaattattgtccaagaaccccagtccttgattgaaattttcccacttcttaaagagttgccccaaatctgttggtacttaaaatttcatctcttcaaaatggaagtggttagttgtttgaggccagagggtatgctgttgagttgtatgaggggaattcagatataaaatcttaggaagggagacagaatgggaaggaggaaggggaaaaaaaggataaggaaggggacagaagagaaaaaactctaaagcaaaaacagttttcattaaatgatgtaagtaacagcagtaactgttaaacaagatattggaacacacttgttattcatcgtcctctcctgtctctaataacatatgctgaataagtgactttttcttccttttattttacagaggaggtcagaggtcaactccgctcacccatgatggacagccaaaagaaatgccgcaggctcctgtacttatttcctgcgctgaccagtgaagcgccctttcattgtaaaacattgtgctttacctactaccctagccttgtctttaccgagggatgctagtgagtccaagtggtggaaaatatagactgcaaacaagtgcttgttgccccacacggcccagattcacttgaagcagaagttagcatcctgggccagtttgttctctcagaacccagaatctttgagggtaaggttatctgtctgatactgagcagaaacagaatgatcctggagctttgctttctattgaaggcttttgacggtaataggtggtaacttggtaaaaggctgcctttactgtagctcacccagcatctcttttaccaaccagagagtgtgaaactagtttcatatattacctagttattctttcaaaacaaaacaaaaaaaaaacaaaaactgacgcactgcactagttattattagatattcttagtcttttttgtacatggagatttaagtttaagatggtttatataataggttatacctacatttatattgtagaataaatattaaaaagcctgttccagagactcccaagcagcctgggcaggcagatgtaccattgttagtggtgtatgctcggcctcgtggtccatatattctgcacttttatatttgccaccagaatggtagtttgctggcaaaaaaaaaaaaaagagagagagaaaaaattacaactcttacaatctgaatttttttcttagccttgagtgaccaagaagaatttgcttgaggcaaattgtggcaaatattttcccagacaggggaagagtcctgcagattacagattactggtgttttcatgccttgaggattcttttatttttacataggggtctaagtgaccaatggattgttcatacaaacaaaaaaaaagacaaaaatattattcagaagtgaccttagtattacttcactattctaaacacattgaagacactcacttcatgtggacttggagctacagaccttttacatccatcacagattggctggacgggttgcaattgctatgcacagcctgattggcactgcaggtttttagagccattttgagtttgtgttgtttaggaggtactgagtcaatgatgagggaggtatgcctgaccagagtgggactctcagtcatagatccacctgcaagtctctgtttcctttttgtgttttgttgcttttgaacataaaaccaaccatacataagcagcgccaagtggattaactggcttagaacattcaacatattgacttaaccacctgacattcacagtgtcttgtttcctagcaacagatgcaaagtgataaatcaaaattagtctgaggctacagattttacagggtatttgttctatagcacaaagtatttccccactcttgcgtcacagcacaaactaccaaattttaattattggattccagcaataatttttaatggttttcaaactggcggaattttgacagtgctagttcgagtttgaagcttttgaattagatctctaaatggtgacagtttacatggttttatctagctttcttatttatacttgactgaattgtaatgattttttttctaattgtaatttgacgtaatagccatacaaaaaatgactctattcatactaggtttagcttctcatggttgtagatattacttcagttccggtgctggaaaatatgtacaacatactaacaggattgaaaaaaaaatagaggtttttcttcttgtttttttttccaaagcaggtaaagagggtagcaaagcatcggaatgatgtgctcaaaaatgcatattcctggtggggatggaggaagaaggcattagtaaaaggttaatcaaacgttacaacttaaccccattcatgtaggaataaatcaagtgagcagttccagacttttgcataatatttttactatgatgctgttttattaatattttctaaatttcaaaacaaaaagtgaatgtttgaaattgctgggtcccgatgttggtggctgttggagttttggaccactcgctagcagtgatttgaagattataattagctaaaatccaaaacaaaaaaccaacaacaaaaattgtatggtgcggaacatgcaccttgacaatggtactaacttgttattctatagaacacgttagaatagatctatttttgccagagcaccctccttcagtcctccgattacatttcactagagttccttacgagattgctgtatattcctgggacctttttttaaaaaaaaaaaaagcaaaacaaaagattactttttttctatgtgattaatatcttacttgatctgcttttcctaaacctcagtggcttttcccttaggcagggttgggggtgggagggcaacttactggagatgactgttttcagatactttaaaacaaacctttttgtagaaatgcttaatttttaagcggttaggcactgagagtagcagaaatcctgcaaagctttatagttccttagactcaccttgtcgattctctgagtaaagtcttgatttcaataattgtgcttctcatgccctgaatctgctggagaggagtgttgttattttcaggtaacaacattcgttagcacaaatatttcagaccaatattagtgctctccaccccaccttttgttatcattttcatttcatttctctcattcttttttattttggaaaatcatattgctatagtgtgtactttaatctgccagcagataccatctacactaacatttgtcccacagcatcctcaagagaaaaagttgttgcaccttatatatatctcaagcaaaccaaaatatgatgctcttctgctttgttttattctaaattgttgtatcatatctttctgaaaccattctgaatttagttgaaattatcaatatttatgcttttaaccttaatttctggattcaagcctgtatataaatcttttgaaaaaaaattgtcctagcccttctctgcgatgctggaagtagaagattgcgtctcagatggagacgcagtactgttccagttttctttagccttttatttatttagttattctgggtatttcctatgtaattttgaagtgtgtagagtatattatagtaactgaagctgcagctgtaagaagctgagtgaaagaaaaaatactgtaagacatccttaaagtttttatttgtttgggtactgtatatgagatcaggaaaaagaaaaatgtcccacagccacattggaaatacaggttcttgtccccaaattaggttagttcccagattttagatcaaaactgttaattcattaaaaccccttttaaaaggtaaattctactgttgtaattccgatagtctttttcccacaaatatcagaaatatatttatttaattctgtcagatgagctttctaccgatgccatgtcccaaagccatgttaaaataattcccacgttatcattgtgattctacttcctgccactaaaattgctggagaaacaaaataatgatggaacactatgaacaaaaaggagcatctgaactggtctggttatttagaatccaatgtgttcaaatccttttgttttcttattaagtcagatgctactgtaagtcagataaaattttgtttgcactctgcagtctttggctcaatgtatggaaatgtttgcacctatgtaaagtcacaagctaattacaaattgctacagaacaggagtaagctgaaaactgaatgccatgttttgtttataaggtggggaggggagggaaaataccaaaaaactctgttccaagtttggcatttgacattaatgtgaagcagtgggaccatgctgcctgctaaactactgtatgaatcgtaaatgttctgaagacgagcagctggaggctggaggatggcattccatacagcaaaggagaagcacccaccacttcatctgggaaaaggaaggaaattgcaggaggcctggagccatcatttgtaaaggggatgttgcggggtgtgatgctgttgaggagattcaccttcaattgcactgctccacagagccctcatataaggccaatcctaatgggctacctcggctttaaaagttaatttcagtaagtcctgtttcaaaagtttgtctttttttgcttctaccttcagtgccactattttccactgcagtgttttgacttcacaaactgcctcctccagagagaacaatgtattgctgaaaatgggcagtagaagcaaatgctgttgttacatttgacctataaagtattcagagtgactgctaggtagaaattaaaacttagctttcccaaatagctccttattttgcaccttataaaaagtatactaattgttaattagatgttgcttttgtttatacaagcattcccaaagaactagatttggattttgttttgagtttttggatttttaaaaattatcttatttagattgactaacagcatacttacaattttaaaagaagctgttgttcagttcatcttaccagatgtgtctggcgaagtattcagggtttgatggactgctttactttcgtttggaagtgatagctaagtttattatactctatattaaacaactttgttcatttcactgaggaccttatcttccttatatttcagaacaaagaagcaacaagcgtgaataaaaagacaaatgtatttgactccctcataatccccatctgtatgtgctacccttccttcaaatatataaatgtgcatctttttttttaaaaaaaaaaaaaaaaaggttcctcttctggccaaatttgatctatggtggtatgattcatactgttaaattgagagaggaaaccttgtggttaaaaattatatggctgctgttttctttttgcagtcagtggtcaaaactgatcatgtgcttaaatcgatttttatgcacagaactagttattgtgaacattactgctccctccaaagatttcctgataacttgggccagaggtggttactgagtaacaaggatctaattcaatgcctcaaaactcttccacccacaatgcaaatcttacctcacaagctctaacctaaatcacagagacatgcatgtttcatgcattaacactgatttcgctctgtggcccaccagaggggtgggctcatgtcccctgactcctcacatgagtgcctcagctctaagagccgtggaacggggggtagggaaggtttgcgatctggagctcagcaactggctcagcaacgttttctccatttcattagcactaaacaagtctcttgctctcaggaatttgtcagaaaaaagaataaaatcacctgagactccacataccagattataaactcttctcgtaggtttgaattgcttactcacatgtcataaattaaccacagcttcatttgaccaccaggtctaaagtctgttgacagtttcagcatgactgaatcgctcattttttttttttgctttcagaaattggcttggttctctttagagttggtgtaaacatgccatgtaataaatgatttccacttaatggtacaacagaattattgctttcttagatgtatgtgtagtaaaagtcaatatacacatttatataatttctttcttcaaaatcttatacctaatttgatatttctaaaaattgcacatgtaagtcatgtgtataacatgctaaagtactttaactgtgatcttaaaactgaataaaaatatttaataaaactttgaa

SEQ ID NO: 314070 - DNA, 5926 bp, Homo sapiens
  misc_feature (18)..(18): n is a, c, g, or t
  misc_feature (20)..(20): n is a, c, g, or t
  misc_feature (24)..(24): n is a, c, g, or t
tttttttttttcctgttncncgcnttattgcatgcgcgtcaagggtttgttcgtgttgtgtcgtatcgtagatatggatctgatatgttagttagtgctactgaggtcagaggtcaactccgctcacccatgatggacagccaaaagaaatgccgcaggctcctgtacttatttcctgcgctgaccagtgaagcgccctttcattgtaaaacattgtgctttacctactaccctagccttgtctttaccgagggatgctagtgagtccaagtggtggaaaatatagactgcaaacaagtgcttgttgccccacacggcccagattcacttgaagcagaagttagcatcctgggccagtttgttctctcagaacccagaatctttgagggtaaggttatctgtctgatactgagcagaaacagaatgatcctggagctttgctttctattgaaggcttttgacggtaataggtggtaacttggtaaaaggctgcctttactgtagctcacccagcatctcttttaccaaccagagagtgtgaaactagtttcatatattacctagttattctttcaaaacaaaacaaaaaaaaaacaaaaactgacgcactgcactagttattattagatattcttagtcttttttgtacatggagatttaagtttaagatggtttatataataggttatacctacatttatattgtagaataaatattaaaaagcctgttccagagactcccaagcagcctgggcaggcagatgtaccattgttagtggtgtatgctcggcctcgtggtccatatattctgcacttttatatttgccaccagaatggtagtttgctggcaaaaaaaaaaaaaagagagagagaaaaaattacaactcttacaatctgaatttttttcttagccttgagtgaccaagaagaatttgcttgaggcaaattgtggcaaatattttcccagacaggggaagagtcctgcagattacagattactggtgttttcatgccttgaggattcttttatttttacataggggtctaagtgaccaatggattgttcatacaaacaaaaaaaaagacaaaaatattattcagaagtgaccttagtattacttcactattctaaacacattgaagacactcacttcatgtggacttggagctacagaccttttacatccatcacagattggctggacgggttgcaattgctatgcacagcctgattggcactgcaggtttttagagccattttgagtttgtgttgtttaggaggtactgagtcaatgatgagggaggtatgcctgaccagagtgggactctcagtcatagatccacctgcaagtctctgtttcctttttgtgttttgttgcttttgaacataaaaccaaccatacataagcagcgccaagtggattaactggcttagaacattcaacatattgacttaaccacctgacattcacagtgtcttgtttcctagcaacagatgcaaagtgataaatcaaaattagtctgaggctacagattttacagggtatttgttctatagcacaaagtatttccccactcttgcgtcacagcacaaactaccaaattttaattattggattccagcaataatttttaatggttttcaaactggcggaattttgacagtgctagttcgagtttgaagcttttgaattagatctctaaatggtgacagtttacatggttttatctagctttcttatttatacttgactgaattgtaatgattttttttctaattgtaatttgacgtaatagccatacaaaaaatgactctattcatactaggtttagcttctcatggttgtagatattacttcagttccggtgctggaaaatatgtacaacatactaacaggattgaaaaaaaaatagaggtttttcttcttgtttttttttccaaagcaggtaaagagggtagcaaagcatcggaatgatgtgctcaaaaatgcatattcctggtggggatggaggaagaaggcattagtaaaaggttaatcaaacgttacaacttaaccccattcatgtaggaataaatcaagtgagcagttccagacttttgcataatatttttactatgatgctgttttattaatattttctaaatttcaaaacaaaaagtgaatgtttgaaattgctgggtcccgatgttggtggctgttggagttttggaccactcgctagcagtgatttgaagattataattagctaaaatccaaaacaaaaaaccaacaacaaaaattgtatggtgcggaacatgcaccttgacaatggtactaacttgttattctatagaacacgttagaatagatctatttttgccagagcaccctccttcagtcctccgattacatttcactagagttccttacgagattgctgtatattcctgggacctttttttaaaaaaaaaaaaagcaaaacaaaagattactttttttctatgtgattaatatcttacttgatctgcttttcctaaacctcagtggcttttcccttaggcagggttgggggtgggagggcaacttactggagatgactgttttcagatactttaaaacaaacctttttgtagaaatgcttaatttttaagcggttaggcactgagagtagcagaaatcctgcaaagctttatagttccttagactcaccttgtcgattctctgagtaaagtcttgatttcaataattgtgcttctcatgccctgaatctgctggagaggagtgttgttattttcaggtaacaacattcgttagcacaaatatttcagaccaatattagtgctctccaccccaccttttgttatcattttcatttcatttctctcattcttttttattttggaaaatcatattgctatagtgtgtactttaatctgccagcagataccatctacactaacatttgtcccacagcatcctcaagagaaaaagttgttgcaccttatatatatctcaagcaaaccaaaatatgatgctcttctgctttgttttattctaaattgttgtatcatatctttctgaaaccattctgaatttagttgaaattatcaatatttatgcttttaaccttaatttctggattcaagcctgtatataaatcttttgaaaaaaaattgtcctagcccttctctgcgatgctggaagtagaagattgcgtctcagatggagacgcagtactgttccagttttctttagccttttatttatttagttattctgggtatttcctatgtaattttgaagtgtgtagagtatattatagtaactgaagctgcagctgtaagaagctgagtgaaagaaaaaatactgtaagacatccttaaagtttttatttgtttgggtactgtatatgagatcaggaaaaagaaaaatgtcccacagccacattggaaatacaggttcttgtccccaaattaggttagttcccagattttagatcaaaactgttaattcattaaaaccccttttaaaaggtaaattctactgttgtaattccgatagtctttttcccacaaatatcagaaatatatttatttaattctgtcagatgagctttctaccgatgccatgtcccaaagccatgttaaaataattcccacgttatcattgtgattctacttcctgccactaaaattgctggagaaacaaaataatgatggaacactatgaacaaaaaggagcatctgaactggtctggttatttagaatccaatgtgttcaaatccttttgttttcttattaagtcagatgctactgtaagtcagataaaattttgtttgcactctgcagtctttggctcaatgtatggaaatgtttgcacctatgtaaagtcacaagctaattacaaattgctacagaacaggagtaagctgaaaactgaatgccatgttttgtttataaggtggggaggggagggaaaataccaaaaaactctgttccaagtttggcatttgacattaatgtgaagcagtgggaccatgctgcctgctaaactactgtatgaatcgtaaatgttctgaagacgagcagctggaggctggaggatggcattccatacagcaaaggagaagcacccaccacttcatctgggaaaaggaaggaaattgcaggaggcctggagccatcatttgtaaaggggatgttgcggggtgtgatgctgttgaggagattcaccttcaattgcactgctccacagagccctcatataaggccaatcctaatgggctacctcggctttaaaagttaatttcagtaagtcctgtttcaaaagtttgtctttttttgcttctaccttcagtgccactattttccactgcagtgttttgacttcacaaactgcctcctccagagagaacaatgtattgctgaaaatgggcagtagaagcaaatgctgttgttacatttgacctataaagtattcagagtgactgctaggtagaaattaaaacttagctttcccaaatagctccttattttgcaccttataaaaagtatactaattgttaattagatgttgcttttgtttatacaagcattcccaaagaactagatttggattttgttttgagtttttggatttttaaaaattatcttatttagattgactaacagcatacttacaattttaaaagaagctgttgttcagttcatcttaccagatgtgtctggcgaagtattcagggtttgatggactgctttactttcgtttggaagtgatagctaagtttattatactctatattaaacaactttgttcatttcactgaggaccttatcttccttatatttcagaacaaagaagcaacaagcgtgaataaaaagacaaatgtatttgactccctcataatccccatctgtatgtgctacccttccttcaaatatataaatgtgcatctttttttttaaaaaaaaaaaaaaaaaggttcctcttctggccaaatttgatctatggtggtatgattcatactgttaaattgagagaggaaaccttgtggttaaaaattatatggctgctgttttctttttgcagtcagtggtcaaaactgatcatgtgcttaaatcgatttttatgcacagaactagttattgtgaacattactgctccctccaaagatttcctgataacttgggccagaggtggttactgagtaacaaggatctaattcaatgcctcaaaactcttccacccacaatgcaaatcttacctcacaagctctaacctaaatcacagagacatgcatgtttcatgcattaacactgatttcgctctgtggcccaccagaggggtgggctcatgtcccctgactcctcacatgagtgcctcagctctaagagccgtggaacggggggtagggaaggtttgcgatctggagctcagcaactggctcagcaacgttttctccatttcattagcactaaacaagtctcttgctctcaggaatttgtcagaaaaaagaataaaatcacctgagactccacataccagattataaactcttctcgtaggtttgaattgcttactcacatgtcataaattaaccacagcttcatttgaccaccaggtctaaagtctgttgacagtttcagcatgactgaatcgctcattttttttttttgctttcagaaattggcttggttctctttagagttggtgtaaacatgccatgtaataaatgatttccacttaatggtacaacagaattattgctttcttagatgtatgtgtagtaaaagtcaatatacacatttatataatttctttcttcaaaatcttatacctaatttgatatttctaaaaattgcacatgtaagtcatgtgtataacatgctaaagtactttaactgtgatcttaaaactgaataaaaatatttaataaaactttgaa

SEQ ID NO: 314071 - DNA, 3121 bp, Homo sapiens
cggacgcgtgggtcgacccacgcgtcccaccttttgttatcattttcatttcatttctctcattcttttttattttggaaaatcatattgctatagtgtgtactttaatctgccagcagataccatctacactaacatttgtcccacagcatcctcaagagaaaaagttgttgcaccttatatatatctcaagcaaaccaaaatatgatgctcttctgctttgttttattctaaattgttgtatcatatctttctgaaaccattctgaatttagttgaaattatcaatatttatgcttttaaccttaatttctggattcaagcctgtatataaatcttttgaaaaaaaattgtcctagcccttctctgcgatgctggaagtagaagattgcgtctcagatggagacgcagtactgttccagttttctttagccttttatttatttagttattctgggtatttcctatgtaattttgaagtgtgtagagtatattatagtaactgaagctgcagctgtaagaagctgagtgaaagaaaaaatactgtaagacatccttaaagtttttatttgtttgggtactgtatatgagatcaggaaaaagaaaaatgtcccacagccacattggaaatacaggttcttgtccccaaattaggttagttcccagattttagatcaaaactgttaattcattaaaaccccttttaaaaggtaaattctactgttgtaattccgatagtctttttcccacaaatatcagaaatatatttatttaattctgtcagatgagctttctaccgatgccatgtcccaaagccatgttaaaataattcccacgttatcattgtgattctacttcctgccactaaaattgctggagaaacaaaataatgatggaacactatgaacaaaaaggagcatctgaactggtctggttatttagaatccaatgtgttcaaatccttttgttttcttattaagtcagatgctactgtaagtcagataaaattttgtttgcactctgcagtctttggctcaatgtatggaaatgtttgcacctatgtaaagtcacaagctaattacaaattgctacagaacaggagtaagctgaaaactgaatgccatgttttgtttataaggtggggaggggagggaaaataccaaaaaactctgttccaagtttggcatttgacattaatgtgaagcagtgggaccatgctgcctgctaaactactgtatgaatcgtaaatgttctgaagacgagcagctggaggctggaggatggcattccatacagcaaaggagaagcacccaccacttcatctgggaaaaggaaggaaattgcaggaggcctggagccatcatttgtaaaggggatgttgcggggtgtgatgctgttgaggagattcaccttcaattgcactgctccacagagccctcatataaggccaatcctaatgggctacctcggctttaaaagttaatttcagtaagtcctgtttcaaaagtttgtctttttttgcttctaccttcagtgccactattttccactgcagtgttttgacttcacaaactgcctcctccagagagaacaatgtattgctgaaaatgggcagtagaagcaaatgctgttgttacatttgacctataaagtattcagagtgactgctaggtagaaattaaaacttagctttcccaaatagctccttattttgcaccttataaaaagtatactaattgttaattagatgttgcttttgtttatacaagcattcccaaagaactagatttggattttgttttgagtttttggatttttaaaaattatcttatttagattgactaacagcatacttacaattttaaaagaagctgttgttcagttcatcttaccagatgtgtctggcgaagtattcagggtttgatggactgctttactttcgtttggaagtgatagctaagtttattatactctatattaaacaactttgttcatttcactgaggaccttatcttccttatatttcagaacaaagaagcaacaagcgtgaataaaaagacaaatgtatttgactccctcataatccccatctgtatgtgctacccttccttcaaatatataaatgtgcatctttttttttaaaaaaaaaaaaaaaaaggttcctcttctggccaaatttgatctatggtggtatgattcatactgttaaattgagagaggaaaccttgtggttaaaaattatatggctgctgttttctttttgcagtcagtggtcaaaactgatcatgtgcttaaatcgatttttatgcacagaactagttattgtgaacattactgctccctccaaagatttcctgataacttgggccagaggtggttactgagtaacaaggatctaattcaatgcctcaaaactcttccacccacaatgcaaatcttacctcacaagctctaacctaaatcacagagacatgcatgtttcatgcattaacactgatttcgctctgtggcccaccagaggggtgggctcatgtcccctgactcctcacatgagtgcctcagctctaagagccgtggaacggggggtagggaaggtttgcgatctggagctcagcaactggctcagcaacgttttctccatttcattagcactaaacaagtctcttgctctcaggaatttgtcagaaaaaagaataaaatcacctgagactccacataccagattataaactcttctcgtaggtttgaattgcttactcacatgtcataaattaaccacagcttcatttgaccaccaggtctaaagtctgttgacagtttcagcatgactgaatcgctcattttttttttttgctttcagaaattggcttggttctctttagagttggtgtaaacatgccatgtaataaatgatttccacttaatggtacaacagaattattgctttcttagatgtatgtgtagtaaaagtcaatatacacatttatataatttctttcttcaaaatcttatacctaatttgatatttctaaaaattgcacatgtaagtcatgtgtataacatgctaaagtactttaactgtgatcttaaaactgaataaaaatatttaataaaactttgaa

SEQ ID NO: 314072 - DNA, 634 bp, Homo sapiens
aaaaaaaaaaaaaaaaaaaaaaaaaaaaaaaaaaaaaaaaaaaaaaaaaaaaaaaaaaaaaaaaaaaaatcacacctgctattgaaacttctaaaactaggcctagttttagaagtttcaatagcaccttagttccagacctacaccagaagtttcattagcactaaacaagtctcttgctctcaggaatttgtcagaaaaaagaataaaatcacctgagactccacataccagattataaactcttctcgtaggtttgaattgcttactcacatgtcataaattaaccacagcttcatttgaccaccaggtctaaagtctgttgacagtttcagcatgactgaatcgctcattttttttttttgctttcagaaattggcttggttctctttagagttggtgtaaacatgccatgtaataaatgatttccacttaatggtacaacagaattattgctttcttagatgtatgtgtagtaaaagtcaatatacacatttatataatttctttcttcaaaatcttatacctaatttgatatttctaaaaattgcacatgtaagtcatgtgtataacatgctaaagtactttaactgtgatcttaaaactgaataaaaatatttaataaaactttgaa

SEQ ID NO: 314073 - DNA, 569 bp, Homo sapiens
aggacttcaataaaataacaggaaactggatataggatttcgttgcaatgctattgaaacttctaaaactaggcctagttttagaagtttcattagcactaaacaagtctcttgctctcaggaatttgtcagaaaaaagaataaaatcacctgagactccacataccagattataaactcttctcgtaggtttgaattgcttactcacatgtcataaattaaccacagcttcatttgaccaccaggtctaaagtctgttgacagtttcagcatgactgaatcgctcattttttttttttgctttcagaaattggcttggttctctttagagttggtgtaaacatgccatgtaataaatgatttccacttaatggtacaacagaattattgctttcttagatgtatgtgtagtaaaagtcaatatacacatttatataatttctttcttcaaaatcttatacctaatttgatatttctaaaaattgcacatgtaagtcatgtgtataacatgctaaagtactttaactgtgatcttaaaactgaataaaaatatttaataaaactttgaa

SEQ ID NO: 314074 - DNA, 518 bp, Homo sapiens
ctagttttagaagttcatagcacctagttttagaagtttcattagcactaaacaagtctcttgctctcaggaatttgtcagaaaaaagaataaaatcacctgagactccacataccagattataaactcttctcgtaggtttgaattgcttactcacatgtcataaattaaccacagcttcatttgaccaccaggtctaaagtctgttgacagtttcagcatgactgaatcgctcattttttttttttgctttcagaaattggcttggttctctttagagttggtgtaaacatgccatgtaataaatgatttccacttaatggtacaacagaattattgctttcttagatgtatgtgtagtaaaagtcaatatacacatttatataatttctttcttcaaaatcttatacctaatttgatatttctaaaaattgcacatgtaagtcatgtgtataacatgctaaagtactttaactgtgatcttaaaactgaataaaaatatttaataaaactttgaa

SEQ ID NO: 314075 - DNA, 315 bp, Homo sapiens
agtttacttttttttcccctcaaaaggcatatgggccactgaaaacttctgagcaatggatataaatgagatggaacagaaggaaaaaaaggtagacattggaaagactggtttagggggctttactattatcctaggtaagaaaacattcattcttctgtagtgtgttgacagttgtaaaaggggctattatgagagacattatgaaggttatactctggatcttgaaatattttagattgaagtattccaagttacagaactagtctttcccatttacggggcaaaagttaatggatactcagttttaaggat

SEQ ID NO: 314076 - DNA, 470 bp, Homo sapiens
acgttttatttcattttttccatcagtactttgaaaactctgagtgtaaattctccattcagacgggtcagaaatttagacatgtttccttctaagagcaattttggtgccttctgtttttgtgcataactatgcatggtatttcctatttcagccatattttcagaagacagaaacaccatggagcctgttcataaggttaaaaatatcccatccattttcaacactccagagccaacaacaacgcaagaacctttggtgggcagccaaaagagaaaagcaaggaaaaccaagattacacaccttgtcaggacagcagatggccgggtatcaccagcaggaggtactttgggtaagaagagagagctttagaccagaggtgtccaatcttttagcttccctgggccacactggaagaagaattgtcttgagccacaatgaaatacactaacaatagccaatgagctaaa

SEQ ID NO: 314077 - DNA, 7811 bp, Homo sapiens
  misc_feature (1)..(2): n is a, c, g, or t
  misc_feature (4)..(4): n is a, c, g, or t
nngngtgttttcagtctctccgggttgcatgtactgtatgtggagcagtgtacagtgaagcggaggcagagcggctccgcgagcttctctccactttcccatagagaaaccctgactggccgctgagggctagctacacacacgccctcacgcccggcgagcccgcgaggtcactatcatatgacaaaggctttgccgcagttcatcttcctccctgtgtactttccatttgccttcctggaatcctgctgcatcacagaagctggaagttctgatgttccactgaaatcacaatggaaagtcttgacttgactggtcacagtaatgaaaggcagtaatagaaataaggatcattcagcagaaggagaaggggttggaaaacgaccaaaacgaaagtgtcttcagtggcatccattgctagcaaagaaacttcttgatttttcagaagaggaagaagaggaagacgaagaggaggatattgataaggttcaacttcttggggccgatggcctagagcaagatgttggtgaaactgaagatgatgaatcaccagagcagcgagcccggagaccaatgaatgcatttcttttattttgcaaacgccatcgctctcttgtacgtcaggaacaccccaggcttgataaccgaggtgctaccaagatactagctgattggtgggctgttcttgatccaaaggaaaagcagaaatacacagacatggccaaggagtataaggatgcatttatgaaagcaaatcctggctacaaatggtgtcctaccacaaacaagcctgtgaaatccccaacacccactgtcaatccacgaaagaaactttgggccttcccatctgactcttcaagagacttgccaagccccaagaaagcaaagactgaagaaatgcctcagcttaactttggaatggctgatcctactcaaatgggaggcctgagtatgctgctgttagctggagaacatgctcttggcacaccagaggtatcctctggcacatgcaggcctgatgtttcagaatctcctgaattacgtcagaagtcaccattgtttcagtttgccgagatatcttcaagtacgtcccactctgatgcttctacaaagcagtgtcaaacatctgccttgtttcagtttgcagagatttcttcaaacacttcgcagttgggtggtgctgagcctgtaaaacgctgtggaaagtctgcactctttcaactggcagagatgtgcctggcatcagaagggatgaaaatggaagaatcaaagctaataaaagcaaaagaatccgatggtggaagaattaaagaattagagaagggaaaggaagaaaaagaaattaaaatggagaaaacagatgaaactaggttacagaaggaagcagaatttgaaaaatcggctaaggaaaatttaagagattctaaggaattgagaaattttgaggcattgcaaatagatgacataatggctataaaaatggaagatcccaaagaaattagaaaggaagagttagaagaagatcacaaatgtagtcattttcctgatttttcttattctgccagtagcaagataataattagtgatgttcccagtagaaaggatcatatgtgccatcctcatggaattatgatcattgaggatcccgcagcattaaacaagccagaaaagctaaaaaagaaaaagaagaaaagcaaaatggatcgacatggaaatgataaatccacacccaagaagacttgcaaaaagaggcagtcttcggaatctgacattgagagcgtcatatataccattgaagccgtcgcaaaaggagactggggcatagagaaacttggagatacccctcgcaagaaggtccgcacatcctcaagtggcaagggaagcattttggatgccaagccaccaaagaaaaaagtgaaatcaagagagaagaaaatgtcaaaggagaaatcctcagacaccaccaaagagtcaagacctccagatttcattagtatttctgctagcaagaacatttctggtgagacaccagagggtataaaagcagaaccattgacccctatggaagatgcactaccacccagcctatcaggacaggccaagcctgaggacagtgactgtcacagaaaaatagaaacttgtggttccaggaaatccgagaggtcttgcaaaggtgctctttataaaaccctggtgtctgagggcatgctcacctctctgcgagctaatgttgacagaggaaaacgaagctcaggaaaaggaaactcctctgatcatgaagggtgttggaatgaagaaagctggacatttagtcagagtgggaccagtgggagcaagaagttcaagaagacaaagccaaaagaagactgtctccttggctccgcaaagctggatgaagaatttgaaaaaaaattcaacagcctccctcaatatagtcctgttacatttgaccggaaatgtgtacctgtcccaagaaaaaagaagaagactggaaatgtgtcctcagaaccgactaaaaccagcaaaggaagtggggataaatggtcaaacaagcaactcttcttggatgccattcaccctacagaagccatattttcagaagacagaaacaccatggagcctgttcataaggttaaaaatatcccatccattttcaacactccagagccaacaacaacgcaagaacctttggtgggcagccaaaagagaaaagcaaggaaaaccaagattacacaccttgtcaggacagcagatggccgggtatcaccagcaggaggtactttggatgacaaaccaaaggaacaactgcagaggagtctccctaaagcaactgagacagactgcaatgacaaatgctcacacaacaccgaggtcggggagacgcggagcagtactccagaaatgcctgccgtgtctgcgttctttagcctcgctgcgctggctgaagtggcagccatggaaaatgtgcacagaggtcagaggtcaactccgctcacccatgatggacagccaaaagaaatgccgcaggctcctgtacttatttcctgcgctgaccagtgaagcgccctttcattgtaaaacattgtgctttacctactaccctagccttgtctttaccgagggatgctagtgagtccaagtggtggaaaatatagactgcaaacaagtgcttgttgccccacacggcccagattcacttgaagcagaagttagcatcctgggccagtttgttctctcagaacccagaatctttgagggtaaggttatctgtctgatactgagcagaaacagaatgatcctggagctttgctttctattgaaggcttttgacggtaataggtggtaacttggtaaaaggctgcctttactgtagctcacccagcatctcttttaccaaccagagagtgtgaaactagtttcatatattacctagttattctttcaaaacaaaacaaaaaaaaaacaaaaactgacgcactgcactagttattattagatattcttagtcttttttgtacatggagatttaagtttaagatggtttatataataggttatacctacatttatattgtagaataaatattaaaaagcctgttccagagactcccaagcagcctgggcaggcagatgtaccattgttagtggtgtatgctcggcctcgtggtccatatattctgcacttttatatttgccaccagaatggtagtttgctggcaaaaaaaaaaaaaagagagagagaaaaaattacaactcttacaatctgaatttttttcttagccttgagtgaccaagaagaatttgcttgaggcaaattgtggcaaatattttcccagacaggggaagagtcctgcagattacagattactggtgttttcatgccttgaggattcttttatttttacataggggtctaagtgaccaatggattgttcatacaaacaaaaaaaaagacaaaaatattattcagaagtgaccttagtattacttcactattctaaacacattgaagacactcacttcatgtggacttggagctacagaccttttacatccatcacagattggctggacgggttgcaattgctatgcacagcctgattggcactgcaggtttttagagccattttgagtttgtgttgtttaggaggtactgagtcaatgatgagggaggtatgcctgaccagagtgggactctcagtcatagatccacctgcaagtctctgtttcctttttgtgttttgttgcttttgaacataaaaccaaccatacataagcagcgccaagtggattaactggcttagaacattcaacatattgacttaaccacctgacattcacagtgtcttgtttcctagcaacagatgcaaagtgataaatcaaaattagtctgaggctacagattttacagggtatttgttctatagcacaaagtatttccccactcttgcgtcacagcacaaactaccaaattttaattattggattccagcaataatttttaatggttttcaaactggcggaattttgacagtgctagttcgagtttgaagcttttgaattagatctctaaatggtgacagtttacatggttttatctagctttcttatttatacttgactgaattgtaatgattttttttctaattgtaatttgacgtaatagccatacaaaaaatgactctattcatactaggtttagcttctcatggttgtagatattacttcagttccggtgctggaaaatatgtacaacatactaacaggattgaaaaaaaaatagaggtttttcttcttgtttttttttccaaagcaggtaaagagggtagcaaagcatcggaatgatgtgctcaaaaatgcatattcctggtggggatggaggaagaaggcattagtaaaaggttaatcaaacgttacaacttaaccccattcatgtaggaataaatcaagtgagcagttccagacttttgcataatatttttactatgatgctgttttattaatattttctaaatttcaaaacaaaaagtgaatgtttgaaattgctgggtcccgatgttggtggctgttggagttttggaccactcgctagcagtgatttgaagattataattagctaaaatccaaaacaaaaaaccaacaacaaaaattgtatggtgcggaacatgcaccttgacaatggtactaacttgttattctatagaacacgttagaatagatctatttttgccagagcaccctccttcagtcctccgattacatttcactagagttccttacgagattgctgtatattcctgggacctttttttaaaaaaaaaaaaagcaaaacaaaagattactttttttctatgtgattaatatcttacttgatctgcttttcctaaacctcagtggcttttcccttaggcagggttgggggtgggagggcaacttactggagatgactgttttcagatactttaaaacaaacctttttgtagaaatgcttaatttttaagcggttaggcactgagagtagcagaaatcctgcaaagctttatagttccttagactcaccttgtcgattctctgagtaaagtcttgatttcaataattgtgcttctcatgccctgaatctgctggagaggagtgttgttattttcaggtaacaacattcgttagcacaaatatttcagaccaatattagtgctctccaccccaccttttgttatcattttcatttcatttctctcattcttttttattttggaaaatcatattgctatagtgtgtactttaatctgccagcagataccatctacactaacatttgtcccacagcatcctcaagagaaaaagttgttgcaccttatatatatctcaagcaaaccaaaatatgatgctcttctgctttgttttattctaaattgttgtatcatatctttctgaaaccattctgaatttagttgaaattatcaatatttatgcttttaaccttaatttctggattcaagcctgtatataaatcttttgaaaaaaaattgtcctagcccttctctgcgatgctggaagtagaagattgcgtctcagatggagacgcagtactgttccagttttctttagccttttatttatttagttattctgggtatttcctatgtaattttgaagtgtgtagagtatattatagtaactgaagctgcagctgtaagaagctgagtgaaagaaaaaatactgtaagacatccttaaagtttttatttgtttgggtactgtatatgagatcaggaaaaagaaaaatgtcccacagccacattggaaatacaggttcttgtccccaaattaggttagttcccagattttagatcaaaactgttaattcattaaaaccccttttaaaaggtaaattctactgttgtaattccgatagtctttttcccacaaatatcagaaatatatttatttaattctgtcagatgagctttctaccgatgccatgtcccaaagccatgttaaaataattcccacgttatcattgtgattctacttcctgccactaaaattgctggagaaacaaaataatgatggaacactatgaacaaaaaggagcatctgaactggtctggttatttagaatccaatgtgttcaaatccttttgttttcttattaagtcagatgctactgtaagtcagataaaattttgtttgcactctgcagtctttggctcaatgtatggaaatgtttgcacctatgtaaagtcacaagctaattacaaattgctacagaacaggagtaagctgaaaactgaatgccatgttttgtttataaggtggggaggggagggaaaataccaaaaaactctgttccaagtttggcatttgacattaatgtgaagcagtgggaccatgctgcctgctaaactactgtatgaatcgtaaatgttctgaagacgagcagctggaggctggaggatggcattccatacagcaaaggagaagcacccaccacttcatctgggaaaaggaaggaaattgcaggaggcctggagccatcatttgtaaaggggatgttgcggggtgtgatgctgttgaggagattcaccttcaattgcactgctccacagagccctcatataaggccaatcctaatgggctacctcggctttaaaagttaatttcagtaagtcctgtttcaaaagtttgtctttttttgcttctaccttcagtgccactattttccactgcagtgttttgacttcacaaactgcctcctccagagagaacaatgtattgctgaaaatgggcagtagaagcaaatgctgttgttacatttgacctataaagtattcagagtgactgctaggtagaaattaaaacttagctttcccaaatagctccttattttgcaccttataaaaagtatactaattgttaattagatgttgcttttgtttatacaagcattcccaaagaactagatttggattttgttttgagtttttggatttttaaaaattatcttatttagattgactaacagcatacttacaattttaaaagaagctgttgttcagttcatcttaccagatgtgtctggcgaagtattcagggtttgatggactgctttactttcgtttggaagtgatagctaagtttattatactctatattaaacaactttgttcatttcactgaggaccttatcttccttatatttcagaacaaagaagcaacaagcgtgaataaaaagacaaatgtatttgactccctcataatccccatctgtatgtgctacccttccttcaaatatataaatgtgcatcttttttt

SEQ ID NO: 314078 - DNA, 5727 bp, Homo sapiens
  misc_feature (1)..(2): n is a, c, g, or t
  misc_feature (4)..(4): n is a, c, g, or t
nngngtgttttcagtctctccgggttgcatgtactgtatgtggagcagtgtacagtgaagcggaggcagagcggctccgcgagcttctctccactttcccatagagaaaccctgactggccgctgagggctagctacacacacgccctcacgcccggcgagcccgcgaggtcactatcatatgacaaaggctttgccgcagttcatcttcctccctgtgtactttccatttgccttcctggaatcctgctgcatcacagaagctggaagttctgatgttccactgaaatcacaatggaaagtcttgacttgactggtcacagtaatgaaaggcagtaatagaaataaggatcattcagcagaaggagaaggggttggaaaacgaccaaaacgaaagtgtcttcagtggcatccattgctagcaaagaaacttcttgatttttcagaagaggaagaagaggaagacgaagaggaggatattgataaggttcaacttcttggggccgatggcctagagcaagatgttggtgaaactgaagatgatgaatcaccagagcagcgagcccggagaccaatgaatgcatttcttttattttgcaaacgccatcgctctcttgtacgtcaggaacaccccaggcttgataaccgaggtgctaccaagatactagctgattggtgggctgttcttgatccaaaggaaaagcagaaatacacagacatggccaaggagtataaggatgcatttatgaaagcaaatcctggctacaaatggtgtcctaccacaaacaagcctgtgaaatccccaacacccactgtcaatccacgaaagaaactttgggccttcccatctgactcttcaagagacttgccaagccccaagaaagcaaagactgaagaaatgcctcagcttaactttggaatggctgatcctactcaaatgggaggcctgagtatgctgctgttagctggagaacatgctcttggcacaccagaggtatcctctggcacatgcaggcctgatgtttcagaatctcctgaattacgtcagaagtcaccattgtttcagtttgccgagatatcttcaagtacgtcccactctgatgcttctacaaagcagtgtcaaacatctgccttgtttcagtttgcagagatttcttcaaacacttcgcagttgggtggtgctgagcctgtaaaacgctgtggaaagtctgcactctttcaactggcagagatgtgcctggcatcagaagggatgaaaatggaagaatcaaagctaataaaagcaaaagaatccgatggtggaagaattaaagaattagagaagggaaaggaagaaaaagaaattaaaatggagaaaacagatgaaactaggttacagaaggaagcagaatttgaaaaatcggctaaggaaaatttaagagattctaaggaattgagaaattttgaggcattgcaaatagatgacataatggctataaaaatggaagatcccaaagaaattagaaaggaagagttagaagaagatcacaaatgtagtcattttcctgatttttcttattctgccagtagcaagataataattagtgatgttcccagtagaaaggatcatatgtgccatcctcatggaattatgatcattgaggatcccgcagcattaaacaagccagaaaagctaaaaaagaaaaagaagaaaagcaaaatggatcgacatggaaatgataaatccacacccaagaagacttgcaaaaagaggcagtcttcggaatctgacattgagagcgtcatatataccattgaagccgtcgcaaaaggagactggggcatagagaaacttggagatacccctcgcaagaaggtccgcacatcctcaagtggcaagggaagcattttggatgccaagccaccaaagaaaaaagtgaaatcaagagagaagaaaatgtcaaaggagaaatcctcagacaccaccaaagagtcaagacctccagatttcattagtatttctgctagcaagaacatttctggtgagacaccagagggtataaaagcagaaccattgacccctatggaagatgcactaccacccagcctatcaggacaggccaagcctgaggacagtgactgtcacagaaaaatagaaacttgtggttccaggaaatccgagaggtcttgcaaaggtgctctttataaaaccctggtgtctgagggcatgctcacctctctgcgagctaatgttgacagaggaaaacgaagctcaggaaaaggaaactcctctgatcatgaagggtgttggaatgaagaaagctggacatttagtcagagtgggaccagtgggagcaagaagttcaagaagacaaagccaaaagaagactgtctccttggctccgcaaagctggatgaagaatttgaaaaaaaattcaacagcctccctcaatatagtcctgttacatttgaccggaaatgtgtacctgtcccaagaaaaaagaagaagactggaaatgtgtcctcagaaccgactaaaaccagcaaaggaagtggggataaatggtcaaacaagcaactcttcttggatgccattcaccctacagaagccatattttcagaagacagaaacaccatggagcctgttcataaggttaaaaatatcccatccattttcaacactccagagccaacaacaacgcaagaacctttggtgggcagccaaaagagaaaagcaaggaaaaccaagattacacaccttgtcaggacagcagatggccgggtatcaccagcaggaggtactttggatgacaaaccaaaggaacaactgcagaggagtctccctaaagcaactgagacagactgcaatgacaaatgctcacacaacaccgaggtcggggagacgcggagcagtactccagaaatgcctgccgtgtctgcgttctttagcctcgctgcgctggctgaagtggcagccatggaaaatgtgcacagaggtcagaggtcaactccgctcacccatgatggacagccaaaagaaatgccgcaggctcctgtacttatttcctgcgctgaccagtgaagcgccctttcattgtaaaacattgtgctttacctactaccctagccttgtctttaccgagggatgctagtgagtccaagtggtggaaaatatagactgcaaacaagtgcttgttgccccacacggcccagattcacttgaagcagaagttagcatcctgggccagtttgttctctcagaacccagaatctttgagggtaaggttatctgtctgatactgagcagaaacagaatgatcctggagctttgctttctattgaaggcttttgacggtaataggtggtaacttggtaaaaggctgcctttactgtagctcacccagcatctcttttaccaaccagagagtgtgaaactagtttcatatattacctagttattctttcaaaacaaaacaaaaaaaaaacaaaaactgacgcactgcactagttattattagatattcttagtcttttttgtacatggagatttaagtttaagatggtttatataataggttatacctacatttatattgtagaataaatattaaaaagcctgttccagagactcccaagcagcctgggcaggcagatgtaccattgttagtggtgtatgctcggcctcgtggtccatatattctgcacttttatatttgccaccagaatggtagtttgctggcaaaaaaaaaaaaaagagagagagaaaaaattacaactcttacaatctgaatttttttcttagccttgagtgaccaagaagaatttgcttgaggcaaattgtggcaaatattttcccagacaggggaagagtcctgcagattacagattactggtgttttcatgccttgaggattcttttatttttacataggggtctaagtgaccaatggattgttcatacaaacaaaaaaaaagacaaaaatattattcagaagtgaccttagtattacttcactattctaaacacattgaagacactcacttcatgtggacttggagctacagaccttttacatccatcacagattggctggacgggttgcaattgctatgcacagcctgattggcactgcaggtttttagagccattttgagtttgtgttgtttaggaggtactgagtcaatgatgagggaggtatgcctgaccagagtgggactctcagtcatagatccacctgcaagtctctgtttcctttttgtgttttgttgcttttgaacataaaaccaaccatacataagcagcgccaagtggattaactggcttagaacattcaacatattgacttaaccacctgacattcacagtgtcttgtttcctagcaacagatgcaaagtgataaatcaaaattagtctgaggctacagattttacagggtatttgttctatagcacaaagtatttccccactcttgcgtcacagcacaaactaccaaattttaattattggattccagcaataatttttaatggttttcaaactggcggaattttgacagtgctagttcgagtttgaagcttttgaattagatctctaaatggtgacagtttacatggttttatctagctttcttatttatacttgactgaattgtaatgattttttttctaattgtaatttgacgtaatagccatacaaaaaatgactctattcatactaggtttagcttctcatggttgtagatattacttcagttccggtgctggaaaatatgtacaacatactaacaggattgaaaaaaaaatagaggtttttcttcttgtttttttttccaaagcaggtaaagagggtagcaaagcatcggaatgatgtgctcaaaaatgcatattcctggtggggatggaggaagaaggcattagtaaaaggttaatcaaacgttacaacttaaccccattcatgtaggaataaatcaagtgagcagttccagacttttgcataatatttttactatgatgctgttttattaatattttctaaatttcaaaacaaaaagtgaatgtttgaaattgctgggtcccgatgttggtggctgttggagttttggaccactcgctagcagtgatttgaagattataattagctaaaatccaaaacaaaaaaccaacaacaaaaattgtatggtgcggaacatgcaccttgacaatggtactaacttgttattctatagaacacgttagaatagatctatttttgccagagcaccctccttcagtcctccgattacatttcactagagttccttacgagattgctgtatattcctgggacctttttttaaaaaaaaaaaaagcaaaacaaaagattactttttttctatgtgattaatatcttacttgatctgcttttcctaaacctcagtggcttttcccttaggcagggttgggggtgggagggcaacttactggagatgactgttttcagatactttaaaacaaacctttttgtagaaatgcttaatttttaagcggttaggcactgagagtagcagaaatcctgcaaagctttatagttccttagactcaccttgtcgattctctgagtaaagtcttgatttccggattctctattctgttccattggtctgtctgtctgttctcggtaccagataccacacatgttcttgatgactgtggctttgtagtatttcttgaagtccattcagttccaaccaagggggatcctcatagagtc

SEQ ID NO: 314079 - DNA, 2940 bp, Homo sapiens
  misc_feature (1)..(2): n is a, c, g, or t
  misc_feature (4)..(4): n is a, c, g, or t
  misc_feature (2893)..(2893): n is a, c, g, or t
nngngtgttttcagtctctccgggttgcatgtactgtatgtggagcagtgtacagtgaagcggaggcagagcggctccgcgagcttctctccactttcccatagagaaaccctgactggccgctgagggctagctacacacacgccctcacgcccggcgagcccgcgaggtcactatcatatgacaaaggctttgccgcagttcatcttcctccctgtgtactttccatttgccttcctggaatcctgctgcatcacagaagctggaagttctgatgttccactgaaatcacaatggaaagtcttgacttgactggtcacagtaatgaaaggcagtaatagaaataaggatcattcagcagaaggagaaggggttggaaaacgaccaaaacgaaagtgtcttcagtggcatccattgctagcaaagaaacttcttgatttttcagaagaggaagaagaggaagacgaagaggaggatattgataaggttcaacttcttggggccgatggcctagagcaagatgttggtgaaactgaagatgatgaatcaccagagcagcgagcccggagaccaatgaatgcatttcttttattttgcaaacgccatcgctctcttgtacgtcaggaacaccccaggcttgataaccgaggtgctaccaagatactagctgattggtgggctgttcttgatccaaaggaaaagcagaaatacacagacatggccaaggagtataaggatgcatttatgaaagcaaatcctggctacaaatggtgtcctaccacaaacaagcctgtgaaatccccaacacccactgtcaatccacgaaagaaactttgggccttcccatctgactcttcaagagacttgccaagccccaagaaagcaaagactgaagaaatgcctcagcttaactttggaatggctgatcctactcaaatgggaggcctgagtatgctgctgttagctggagaacatgctcttggcacaccagaggtatcctctggcacatgcaggcctgatgtttcagaatctcctgaattacgtcagaagtcaccattgtttcagtttgccgagatatcttcaagtacgtcccactctgatgcttctacaaagcagtgtcaaacatctgccttgtttcagtttgcagagatttcttcaaacacttcgcagttgggtggtgctgagcctgtaaaacgctgtggaaagtctgcactctttcaactggcagagatgtgcctggcatcagaagggatgaaaatggaagaatcaaagctaataaaagcaaaagaatccgatggtggaagaattaaagaattagagaagggaaaggaagaaaaagaaattaaaatggagaaaacagatgaaactaggttacagaaggaagcagaatttgaaaaatcggctaaggaaaatttaagagattctaaggaattgagaaattttgaggcattgcaaatagatgacataatggctataaaaatggaagatcccaaagaaattagaaaggaagagttagaagaagatcacaaatgtagtcattttcctgatttttcttattctgccagtagcaagataataattagtgatgttcccagtagaaaggatcatatgtgccatcctcatggaattatgatcattgaggatcccgcagcattaaacaagccagaaaagctaaaaaagaaaaagaagaaaagcaaaatggatcgacatggaaatgataaatccacacccaagaagacttgcaaaaagaggcagtcttcggaatctgacattgagagcgtcatatataccattgaagccgtcgcaaaaggagactggggcatagagaaacttggagatacccctcgcaagaaggtccgcacatcctcaagtggcaagggaagcattttggatgccaagccaccaaagaaaaaagtgaaatcaagagagaagaaaatgtcaaaggagaaatcctcagacaccaccaaagagtcaagacctccagatttcattagtatttctgctagcaagaacatttctggtgagacaccagagggtataaaagcagaaccattgacccctatggaagatgcactaccacccagcctatcaggacaggccaagcctgaggacagtgactgtcacagaaaaatagaaacttgtggttccaggaaatccgagaggtcttgcaaaggtgctctttataaaaccctggtgtctgagggcatgctcacctctctgcgagctaatgttgacagaggaaaacgaagctcaggaaaaggaaactcctctgatcatgaagggtgttggaatgaagaaagctggacatttagtcagagtgggaccagtgggagcaagaagttcaagaagacaaagccaaaagaagactgtctccttggctccgcaaagctggatgaagaatttgaaaaaaaattcaacagcctccctcaatatagtcctgttacatttgaccggaaatgtgtacctgtcccaagaaaaaagaagaagactggaaatgtgtcctcagaaccgactaaaaccagcaaaggaagtggggataaatggtcaaacaagcaactcttcttggatgccattcaccctacagaagccatattttcagaagacagaaacaccatggagcctgttcataaggttaaaaatatcccatccattttcaacacccttcatgatcagaggagtttccttttcctgagcttcgttttcctctgtcaacattagctcgcagagaggtgagcatgccctcagacaccagggttttataaagagcacctttgcaagacctctcggatttcctggaaccacaagtttctatttttctgtgacagtcactgtcctcaggcttggcctgtcctgataggctgggtggtagtgcatcttccataggggtcaatgnttctgctttataccctctgatgcagaatgacgtcggtaccgagctca

SEQ ID NO: 314080 - DNA, 8885 bp, Homo sapiens
  misc_feature (1)..(2): n is a, c, g, or t
  misc_feature (4)..(4): n is a, c, g, or t
nngngtgttttcagtctctccgggttgcatgtactgtatgtggagcagtgtacagtgaagcggaggcagagcggctccgcgagcttctctccactttcccatagagaaaccctgactggccgctgagggctagctacacacacgccctcacgcccggcgagcccgcgaggtcactatcatatgacaaaggctttgccgcagttcatcttcctccctgtgtactttccatttgccttcctggaatcctgctgcatcacagaagctggaagttctgatgttccactgaaatcacaatggaaagtcttgacttgactggtcacagtaatgaaaggcagtaatagaaataaggatcattcagcagaaggagaaggggttggaaaacgaccaaaacgaaagtgtcttcagtggcatccattgctagcaaagaaacttcttgatttttcagaagaggaagaagaggaagacgaagaggaggatattgataaggttcaacttcttggggccgatggcctagagcaagatgttggtgaaactgaagatgatgaatcaccagagcagcgagcccggagaccaatgaatgcatttcttttattttgcaaacgccatcgctctcttgtacgtcaggaacaccccaggcttgataaccgaggtgctaccaagatactagctgattggtgggctgttcttgatccaaaggaaaagcagaaatacacagacatggccaaggagtataaggatgcatttatgaaagcaaatcctggctacaaatggtgtcctaccacaaacaagcctgtgaaatccccaacacccactgtcaatccacgaaagaaactttgggccttcccatctgactcttcaagagacttgccaagccccaagaaagcaaagactgaagaaatgcctcagcttaactttggaatggctgatcctactcaaatgggaggcctgagtatgctgctgttagctggagaacatgctcttggcacaccagaggtatcctctggcacatgcaggcctgatgtttcagaatctcctgaattacgtcagaagtcaccattgtttcagtttgccgagatatcttcaagtacgtcccactctgatgcttctacaaagcagtgtcaaacatctgccttgtttcagtttgcagagatttcttcaaacacttcgcagttgggtggtgctgagcctgtaaaacgctgtggaaagtctgcactctttcaactggcagagatgtgcctggcatcagaagggatgaaaatggaagaatcaaagctaataaaagcaaaagaatccgatggtggaagaattaaagaattagagaagggaaaggaagaaaaagaaattaaaatggagaaaacagatgaaactaggttacagaaggaagcagaatttgaaaaatcggctaaggaaaatttaagagattctaaggaattgagaaattttgaggcattgcaaatagatgacataatggctataaaaatggaagatcccaaagaaattagaaaggaagagttagaagaagatcacaaatgtagtcattttcctgatttttcttattctgccagtagcaagataataattagtgatgttcccagtagaaaggatcatatgtgccatcctcatggaattatgatcattgaggatcccgcagcattaaacaagccagaaaagctaaaaaagaaaaagaagaaaagcaaaatggatcgacatggaaatgataaatccacacccaagaagacttgcaaaaagaggcagtcttcggaatctgacattgagagcgtcatatataccattgaagccgtcgcaaaaggagactggggcatagagaaacttggagatacccctcgcaagaaggtccgcacatcctcaagtggcaagggaagcattttggatgccaagccaccaaagaaaaaagtgaaatcaagagagaagaaaatgtcaaaggagaaatcctcagacaccaccaaagagtcaagacctccagatttcattagtatttctgctagcaagaacatttctggtgagacaccagagggtataaaagcagaaccattgacccctatggaagatgcactaccacccagcctatcaggacaggccaagcctgaggacagtgactgtcacagaaaaatagaaacttgtggttccaggaaatccgagaggtcttgcaaaggtgctctttataaaaccctggtgtctgagggcatgctcacctctctgcgagctaatgttgacagaggaaaacgaagctcaggaaaaggaaactcctctgatcatgaagggtgttggaatgaagaaagctggacatttagtcagagtgggaccagtgggagcaagaagttcaagaagacaaagccaaaagaagactgtctccttggctccgcaaagctggatgaagaatttgaaaaaaaattcaacagcctccctcaatatagtcctgttacatttgaccggaaatgtgtacctgtcccaagaaaaaagaagaagactggaaatgtgtcctcagaaccgactaaaaccagcaaaggtcctttccagtctcagaaaaagaacttattccacaaaattgtcagcaaatataagcacaaaaaggagaagcccaatgttccggaaaaaggaagtggggataaatggtcaaacaagcaactcttcttggatgccattcaccctacagaagccatattttcagaagacagaaacaccatggagcctgttcataaggttaaaaatatcccatccattttcaacactccagagccaacaacaacgcaagaacctttggtgggcagccaaaagagaaaagcaaggaaaaccaagattacacaccttgtcaggacagcagatggccgggtatcaccagcaggaggtactttggatgacaaaccaaaggaacaactgcagaggagtctccctaaagcaactgagacagactgcaatgacaaatgctcacacaacaccgaggtcggggagacgcggagcagtactccagaaatgcctgccgtgtctgcgttctttagcctcgctgcgctggctgaagtggcagccatggaaaatgtgcacagaggtcagaggtcaactccgctcacccatgatggacagccaaaagaaatgccgcaggctcctgtacttatttcctgcgctgaccagtgaagcgccctttcattgtaaaacattgtgctttacctactaccctagccttgtctttaccgagggatgctagtgagtccaagtggtggaaaatatagactgcaaacaagtgcttgttgccccacacggcccagattcacttgaagcagaagttagcatcctgggccagtttgttctctcagaacccagaatctttgagggtaaggttatctgtctgatactgagcagaaacagaatgatcctggagctttgctttctattgaaggcttttgacggtaataggtggtaacttggtaaaaggctgcctttactgtagctcacccagcatctcttttaccaaccagagagtgtgaaactagtttcatatattacctagttattctttcaaaacaaaacaaaaaaaaaacaaaaactgacgcactgcactagttattattagatattcttagtcttttttgtacatggagatttaagtttaagatggtttatataataggttatacctacatttatattgtagaataaatattaaaaagcctgttccagagactcccaagcagcctgggcaggcagatgtaccattgttagtggtgtatgctcggcctcgtggtccatatattctgcacttttatatttgccaccagaatggtagtttgctggcaaaaaaaaaaaaaagagagagagaaaaaattacaactcttacaatctgaatttttttcttagccttgagtgaccaagaagaatttgcttgaggcaaattgtggcaaatattttcccagacaggggaagagtcctgcagattacagattactggtgttttcatgccttgaggattcttttatttttacataggggtctaagtgaccaatggattgttcatacaaacaaaaaaaaagacaaaaatattattcagaagtgaccttagtattacttcactattctaaacacattgaagacactcacttcatgtggacttggagctacagaccttttacatccatcacagattggctggacgggttgcaattgctatgcacagcctgattggcactgcaggtttttagagccattttgagtttgtgttgtttaggaggtactgagtcaatgatgagggaggtatgcctgaccagagtgggactctcagtcatagatccacctgcaagtctctgtttcctttttgtgttttgttgcttttgaacataaaaccaaccatacataagcagcgccaagtggattaactggcttagaacattcaacatattgacttaaccacctgacattcacagtgtcttgtttcctagcaacagatgcaaagtgataaatcaaaattagtctgaggctacagattttacagggtatttgttctatagcacaaagtatttccccactcttgcgtcacagcacaaactaccaaattttaattattggattccagcaataatttttaatggttttcaaactggcggaattttgacagtgctagttcgagtttgaagcttttgaattagatctctaaatggtgacagtttacatggttttatctagctttcttatttatacttgactgaattgtaatgattttttttctaattgtaatttgacgtaatagccatacaaaaaatgactctattcatactaggtttagcttctcatggttgtagatattacttcagttccggtgctggaaaatatgtacaacatactaacaggattgaaaaaaaaatagaggtttttcttcttgtttttttttccaaagcaggtaaagagggtagcaaagcatcggaatgatgtgctcaaaaatgcatattcctggtggggatggaggaagaaggcattagtaaaaggttaatcaaacgttacaacttaaccccattcatgtaggaataaatcaagtgagcagttccagacttttgcataatatttttactatgatgctgttttattaatattttctaaatttcaaaacaaaaagtgaatgtttgaaattgctgggtcccgatgttggtggctgttggagttttggaccactcgctagcagtgatttgaagattataattagctaaaatccaaaacaaaaaaccaacaacaaaaattgtatggtgcggaacatgcaccttgacaatggtactaacttgttattctatagaacacgttagaatagatctatttttgccagagcaccctccttcagtcctccgattacatttcactagagttccttacgagattgctgtatattcctgggacctttttttaaaaaaaaaaaaagcaaaacaaaagattactttttttctatgtgattaatatcttacttgatctgcttttcctaaacctcagtggcttttcccttaggcagggttgggggtgggagggcaacttactggagatgactgttttcagatactttaaaacaaacctttttgtagaaatgcttaatttttaagcggttaggcactgagagtagcagaaatcctgcaaagctttatagttccttagactcaccttgtcgattctctgagtaaagtcttgatttcaataattgtgcttctcatgccctgaatctgctggagaggagtgttgttattttcaggtaacaacattcgttagcacaaatatttcagaccaatattagtgctctccaccccaccttttgttatcattttcatttcatttctctcattcttttttattttggaaaatcatattgctatagtgtgtactttaatctgccagcagataccatctacactaacatttgtcccacagcatcctcaagagaaaaagttgttgcaccttatatatatctcaagcaaaccaaaatatgatgctcttctgctttgttttattctaaattgttgtatcatatctttctgaaaccattctgaatttagttgaaattatcaatatttatgcttttaaccttaatttctggattcaagcctgtatataaatcttttgaaaaaaaattgtcctagcccttctctgcgatgctggaagtagaagattgcgtctcagatggagacgcagtactgttccagttttctttagccttttatttatttagttattctgggtatttcctatgtaattttgaagtgtgtagagtatattatagtaactgaagctgcagctgtaagaagctgagtgaaagaaaaaatactgtaagacatccttaaagtttttatttgtttgggtactgtatatgagatcaggaaaaagaaaaatgtcccacagccacattggaaatacaggttcttgtccccaaattaggttagttcccagattttagatcaaaactgttaattcattaaaaccccttttaaaaggtaaattctactgttgtaattccgatagtctttttcccacaaatatcagaaatatatttatttaattctgtcagatgagctttctaccgatgccatgtcccaaagccatgttaaaataattcccacgttatcattgtgattctacttcctgccactaaaattgctggagaaacaaaataatgatggaacactatgaacaaaaaggagcatctgaactggtctggttatttagaatccaatgtgttcaaatccttttgttttcttattaagtcagatgctactgtaagtcagataaaattttgtttgcactctgcagtctttggctcaatgtatggaaatgtttgcacctatgtaaagtcacaagctaattacaaattgctacagaacaggagtaagctgaaaactgaatgccatgttttgtttataaggtggggaggggagggaaaataccaaaaaactctgttccaagtttggcatttgacattaatgtgaagcagtgggaccatgctgcctgctaaactactgtatgaatcgtaaatgttctgaagacgagcagctggaggctggaggatggcattccatacagcaaaggagaagcacccaccacttcatctgggaaaaggaaggaaattgcaggaggcctggagccatcatttgtaaaggggatgttgcggggtgtgatgctgttgaggagattcaccttcaattgcactgctccacagagccctcatataaggccaatcctaatgggctacctcggctttaaaagttaatttcagtaagtcctgtttcaaaagtttgtctttttttgcttctaccttcagtgccactattttccactgcagtgttttgacttcacaaactgcctcctccagagagaacaatgtattgctgaaaatgggcagtagaagcaaatgctgttgttacatttgacctataaagtattcagagtgactgctaggtagaaattaaaacttagctttcccaaatagctccttattttgcaccttataaaaagtatactaattgttaattagatgttgcttttgtttatacaagcattcccaaagaactagatttggattttgttttgagtttttggatttttaaaaattatcttatttagattgactaacagcatacttacaattttaaaagaagctgttgttcagttcatcttaccagatgtgtctggcgaagtattcagggtttgatggactgctttactttcgtttggaagtgatagctaagtttattatactctatattaaacaactttgttcatttcactgaggaccttatcttccttatatttcagaacaaagaagcaacaagcgtgaataaaaagacaaatgtatttgactccctcataatccccatctgtatgtgctacccttccttcaaatatataaatgtgcatctttttttttaaaaaaaaaaaaaaaaaggttcctcttctggccaaatttgatctatggtggtatgattcatactgttaaattgagagaggaaaccttgtggttaaaaattatatggctgctgttttctttttgcagtcagtggtcaaaactgatcatgtgcttaaatcgatttttatgcacagaactagttattgtgaacattactgctccctccaaagatttcctgataacttgggccagaggtggttactgagtaacaaggatctaattcaatgcctcaaaactcttccacccacaatgcaaatcttacctcacaagctctaacctaaatcacagagacatgcatgtttcatgcattaacactgatttcgctctgtggcccaccagaggggtgggctcatgtcccctgactcctcacatgagtgcctcagctctaagagccgtggaacggggggtagggaaggtttgcgatctggagctcagcaactggctcagcaacgttttctccatttcattagcactaaacaagtctcttgctctcaggaatttgtcagaaaaaagaataaaatcacctgagactccacataccagattataaactcttctcgtaggtttgaattgcttactcacatgtcataaattaaccacagcttcatttgaccaccaggtctaaagtctgttgacagtttcagcatgactgaatcgctcattttttttttttgctttcagaaattggcttggttctctttagagttggtgtaaacatgccatgtaataaatgatttccacttaatggtacaacagaattattgctttcttagatgtatgtgtagtaaaagtcaatatacacatttatataatttctttcttcaaaatcttatacctaatttgatatttctaaaaattgcacatgtaagtcatgtgtataacatgctaaagtactttaactgtgatcttaaaactgaataaaaatatttaataaaactttgaa

SEQ ID NO: 314081 - DNA, 258 bp, Homo sapiens
gcacgagcggcacgagcggcacgagtttttaaaggaaacaaactctcaaatcatgaagtgatataaaagctgcatatgcctacaaagctctgaattcaggtcccagttgctgtcacaaaggagtgagtgaaactcccaccctacccccttttttatataataaaagtgccttagcatgtgttgcagctgtcaccactacagtaagctggtttacagatgttttccactgagcatcacaataaagagaaccatgtgcta

SEQ ID NO: 314082 - DNA, 254 bp, Homo sapiens
ttcggcacgagaactagtctctttttaaaggaaacaaactctcaaatcatgaagtgatataaaagctgcatatgcctacaaagctctgaattcaggtcccagttgctgtcacaaaggagtgagtgaaactcccaccctacccccttttttatataataaaagtgccttagcatgtgttgcagctgtcaccactacagtaagctggtttacagatgttttccactgagcatcacaataaagagaaccatgtgcta

SEQ ID NO: 314083 - DNA, 230 bp, Homo sapiens
  misc_feature (21)..(21): n is a, c, g, or t
agcacattggttcttctttanttgtgatgcttcagtggaaaacatctgtaaaccagcttactgtagtggtcccagttgctgtcacaaaggagtgagtgaaactcccaccctacccccttttttatataataaaagtgccttagcatgtgttgcagctgtcaccactacagtaagctggttagcacatggttctctttattgtgatgctcagtggaactcgtgctgtaaac

SEQ ID NO: 314084 - DNA, 508 bp, Homo sapiens
cccacggactcaacccagttacctcacatggggcctcttctgagcaaggtctcgaaagcgcaggccgccctggctgagcagcaccgccctttcccagctgcagctcgcccctgagttaactcaggggcgagctgcagcgcgagctggaggacgccactgagacggccgatgccatgaaccgcgaagtcagctccctaaagaacaagctcaggcgcggggacctgccgtttgtcgtgccccgccgaatggcccggaaaggcgccggggatggctccgacgaagaggtagatggcaaagcggatggggctgaggccaaacctgccgaataagcctcttctcctgcagcctgagatggatggacagacagacaccacagcctccccttcccagaccccgcagcctgagttagcagctcgcccctgagttagcagctcgcgcctgagttagcagctcgccctgagtaagcagctgccctggagtagagctcgccatgaggggccgagctcat

SEQ ID NO: 314085 - DNA, 344 bp, Homo sapiens
  misc_feature (190)..(190): n is a, c, g, or t
  misc_feature (283)..(283): n is a, c, g, or t
  misc_feature (315)..(315): n is a, c, g, or t
cgtccttcatcatacctacccaccgaggcgaagctgaaaaagctggaggaggagcagatcatcctggaggaccagaactgcaagctggccaaggataagaaactggaagatgggaagatgatggcagattacggcatcagaaagggcaacttactcttcctggcatcttattgtattggagggtgaccancctgggcatggggtgttggcaggggtcaaaaagcttatttcttttaatctcttactcaacgacacatcttctgatgatttcccaaaattaatnagaatgagatgagtagagtaagatttgggtgnggtaggtatgatagaggacgggggtccta

SEQ ID NO: 314086 - DNA, 485 bp, Homo sapiens
gtgccccaggcaagggtagacccccagaaaagcttgaggacaagaccaggactgttaggtcgggtctgctgtccactgctccgcgctgaccatgttcctcaccacacagagcatttgccaagcggcagcagcagcttaccgccatgaaggtcctccagcggaactgcgctgcctacctgaagctgcggaactggcagtggtggcggctcttcaccaaggtgcgtgctagaagggcctcctgagtagctgggactacgggtgcacaccaccatacatacctgggctaattgtttgtattttttgtagaggtgtggtctcaccatgtcgcccaggttggtcacaaactcttgggctccagcaatcctcctacctcagcctcccaaagtgctgggaattacaggcatgagccactgtgcccggccctttttgatttttagtagagacaaggtcttcactattcttgcccaggctgaccttcctggcct

SEQ ID NO: 314087 - DNA, 83 bp, Homo sapiens
ccttgtctggggagtgcccacgtggccagggcccaccttgctatatcagtggtcggtggatgcccaggctgtgtcccttctga

SEQ ID NO: 314088 - DNA, 6956 bp, Homo sapiens
  misc_feature (449)..(449): n is a, c, g, or t
ggctcgcgagcagataccttcgtggagaaggtgatgcaggagcagggcacccaccccaagttccagaagcccaagcagctgaaggacaaagctgatttctgcattatccactatgccggcaaggtggattacaaagctgacgagtggctgatgaagaacatggatcccctgaatgacaacatcgccacactgctccaccagtcctctgacaagtctgtctcggagctgtggaaggatgtggaccgcatcatcggcctggaccaggtggccggcatgtcggagaccgcactgcccggggccttcaagacgcggaagggcatgttccgcactgtggggcagctttacaaggagcagctggccaagctgatggctacgctgaggaacacgaaccccaactttgtccgctgcatcatccccaacacgagaagaaggccggcaagctggacccncatctcgtgctggaccagctgcgctgcaacggtgttctcgagggcatccgtatctgccgccagggcttctccaacagggtggtcttccaggagtttcggcagagccgatctcctgttggagccgtacaacaaataccgcttcctgtccaatggacacgtcaccatccccgggcagcaggacaaggacatgttccaggagaccatggaggccatgaggattatgggcatcccagaagaggagcaaatgggcctgctgcgggtcatctcaggggttcttcagctcggcaacatcgtcttcaagaaggagcggaacactgaccaggcgtccatgcccgacaacacagctgcccaaaaggtgtcccatctcttgggtatcaatgtgaccgatttcaccagaggaatcctcaccccgcgcatcaaggtgggacgggattacgtccagaaggcgcagactaaagagcaggctgactttgccatcgaggccttggccaaggcgacctatgagcggatgttccgctggctggtgctgcgcatcaacaaggctctggacaagaccaagaggcagggcgcctccttcatcgggatcctggacattgccggcttcgagatctttgatctgaactcgtttgagcagctgtgcatcaattacaccaatgagaagctgcagcagctcttcaaccacaccatgttcatcctggagcaggaggagtaccagcgcgagggcatcgagtggaacttcatcgactttggcctcgacctgcagccctgcatcgacctcattgagaagccagcaggccccccgggcattctggccctgctggacgaggagtgctggttccccaaagccaccgacaagagcttcgtggagaaggtgatgcaggagcagggcacccaccccaagttccagaagcccaagcagctgaaggacaaagctgatttctgcattatccactatgccggcaaggtggattacaaagctgacgagtggctgatgaagaacatggatcccctgaatgacaacatcgccacactgctccaccagtcctctgacaagtttgtctcggagctgtggaaggatgtggaccgcatcatcggcctggaccaggtggccggcatgtcggagaccgcactgcccggggccttcaagacgcggaagggcatgttccgcactgtggggcagctttacaaggagcagctggccaagctgatggctacgctgaggaacacgaaccccaactttgtccgctgcatcatccccaaccacgagaagaaggccggcaagctggacccgcatctcgtgctggaccagctgcgctgcaacggtgttctcgagggcatccgtatctgccgccagggcttccccaacagggtggtcttccaggagtttcggcagagatatgagatcctgactccaaactccattcccaagggtttcatggacgggaagcaggcgtgcgtgctcatgataaaagccctggagctcgacagcaatctgtaccgcattggccagagcaaagtcttcttccgtgccggtgtgctggcccacctggaggaggagcgagacctgaagatcaccgacgtcatcatagggttccaggcctgctgcaggggctacctggccaggaaagcatttgccaagcggcagcagcagcttaccgccatgaaggtcctccagcggaactgcgctgcctacctgaagctgcggaactggcagtggtggcggctcttcaccaaggtcaagccgctgctgcaggtgagccggcaggaggaggagatgatggccaaggaggaggagctggtgaaggtcagagagaagcagctggctgcggagaacaggctcacggagatggagacgctgcagtctcagctcatggcagagaaattgcagctgcaggagcagctccaggcagaaaccgagctgtgtgccgaggctgaggagctccgggcccgcctgaccgccaagaagcaggaattagaagagatctgccatgacctagaggccagggtggaggaggaggaggagcgctgccagcacctgcaggcggagaagaagaagatgcagcagaacatccaggagcttgaggagcagctggaggaggaggagagcgcccggcagaagctgcagctggagaaggtgaccaccgaggcgaagctgaaaaagctggaggaggagcagatcatcctggaggaccagaactgcaagctggccaaggaaaagaaactgctggaagacagaatagctgagttcaccaccaacctcacagaagaggaggagaaatctaagagcctcgccaagctcaagaacaagcatgaggcaatgatcactgacttggaagagcgcctccgcagggaggagaagcagcgacaggagctggagaagacccgccggaagctggagggagactccacagacctcagcgaccagatcgccgagctccaggcccagatcgcggagctcaagatgcagctggccaagaaagaggaggagctccaggccgccctggccagagtggaagaggaagctgcccagaagaacatggccctcaagaagatccgggagctggaatctcagatctctgaactccaggaagacctggagtctgagcgtgcttccaggaataaagctgagaagcagaaacgggaccttggggaagagctagaggcgctgaaaacagagttggaggacacgctggattccacagctgcccagcaggagctcaggtcaaaacgtgagcaggaggtgaacatcctgaagaagaccctggaggaggaggccaagacccacgaggcccagatccaggagatgaggcagaagcactcacaggccgtggaggagctggcggagcagctggagcagacgaagcgggtgaaagcaaacctcgagaaggcaaagcagactctggagaacgagcggggggagctggccaacgaggtgaaggtgctgctgcagggcaaaggggactcggagcacaagcgcaagaaagtggaggcgcagctgcaggagctgcaggtcaagttcaacgagggagagcgcgtgcgcacagagctggccgacaaggtcaccaagctgcaggtggagctggacaacgtgaccgggcttctcagccagtccgacagcaagtccagcaagctcaccaaggacttctccgcgctggagtcccagctgcaggacactcaggagctgctgcaggaggagaaccggcagaagctgagcctgagcaccaagctcaagcaggtggaggacgagaagaattccttccgggagcagctggaggaggaggaggaggccaagcacaacctggagaagcagatcgccaccctccatgcccaggtggccgacatgaaaaagaagatggaggacagtgtggggtgcctggaaactgctgaggaggtgaagaggaagctccagaaggacctggagggcctgagccagcggcacgaggagaaggtggccgcctacgacaagctggagaagaccaagacgcggctgcagcaggagctggacgacctgctggtggacctggaccaccagcgccagagcgcgtgcaacctggagaagaagcagaagaagtttgaccagctcctggcggaggagaagaccatctctgccaagtatgcagaggagcgcgaccgggctgaggcggaggcccgagagaaggagaccaaggctctgtcgctggcccgggccctggaggaagccatggagcagaaggcggagctggagcggctcaacaagcagttccgcacggagatggaggaccttatgagctccaaggatgatgtgggcaagagtgtccacgagctggagaagtccaagcgggccctagagcagcaggtggaggagatgaagacgcagctggaagagctggaggacgagctgcaggccaccgaagatgccaagctgcggttggaggtcaacctgcaggccatgaaggcccagttcgagcgggacctgcagggccgggacgagcagagcgaggagaagaagaagcagctggtcagacaggtgcgggagatggaggcagagctggaggacgagaggaagcagcgctcgatggcagtggccgcccggaagaagctggagatggacctgaaggacctggaggcgcacatcgactcggccaacaagaaccgggacgaagccatcaaacagctgcggaagctgcaggcccagatgaaggactgcatgcgcgagctggatgacacccgcgcctctcgtgaggagatcctggcccaggccaaagagaacgagaagaagctgaagagcatggaggccgagatgatccagttgcaggaggaactggcagccgcggagcgtgccaagcgccaggcccagcaggagcgggatgagctggctgacgagatcgccaacagcagcggcaaaggagccctggcgttagaggagaagcggcgtctggaggcccgcatcgcccagctggaggaggagctggaggaggagcagggcaacacggagctgatcaacgaccggctgaagaaggccaacctgcagatcgaccagatcaacaccgacctgaacctggagcgcagccacgcccagaagaacgagaatgctcggcagcagctggaacgccagaacaaggagcttaaggtcaagctgcaggagatggagggcactgtcaagtccaagtacaaggcctccatcaccgccctcgaggccaagattgcacagctggaggagcagctggacaacgagaccaaggagcgccaggcagcctgcaaacaggtgcgtcggaccgagaagaagctgaaggatgtgctgctgcaggtggatgacgagcggaggaacgccgagcagtacaaggaccaggccgacaaggcatctacccgcctgaagcagctcaagcggcagctggaggaggccgaagaggaggcccagcgggccaacgcctcccgccggaaactgcagcgcgagctggaggacgccactgagacggccgatgccatgaaccgcgaagtcagctccctaaagaacaagctcaggcgcggggacctgccgtttgtcgtgccccgccgaatggcccggaaaggcgccggggatggctccgacgaagaggtagatggcaaagcggatggggctgaggccaaacctgccgaataagcctcttctcctgcagcctgagatggatggacagacagacaccacagcctccccttcccagaccccgcagcacgcctctccccaccttcttgggactgctgtgaacatgcctcctcctgccctccgccccgtccccccatcccgtttccctccaggtgttgttgagggcatttggcttcctctgctgcatccccttccagctccctcccctgctcagaatctgataccaaagagacagggcccgggcccaggcagagagcgaccagcaggctcctcagccctctcttgccaaaaagcacaagatgttgaggcgagcagggcaggcccccggggaggggccagagttttctatgaatctatttttcttcagactgaggccttttggtagtcggagcccccgcagtcgtcagcctccctgacgtctgccaccagcgcccccactcctcctcctttctttgctgtttgcaatcacacgtggtgacctcacacacctctgccccttgggcctcccactcccatggctctgggcggtccagaaggagcaggccctgggcctccacctctgtgcagggcacagaaggctggggtggggggaggagtggattcctccccaccctgtcccaggcagcgccactgtccgctgtctccctcctgattctaaaatgtctcaagtgcaatgccccctcccctcctttaccgaggacagcctgcctctgccacagcaaggctgtcggggtcaagctggaaaggccagcagccttccagtggcttctcccaacactcttggggaccaaatatatttaatggttaagggacttgtcccaagtctgacagccagagcgttagaggggccagcggccctcccaggcgatcttgtgtctactctaggactgggcccgagggtggtttacctgcaccgttgactcagtatagtttaaaaatctgccacctgcacaggtatttttgaaagcaaaataaggttttcttttttcccctttcttgtaataaatgataaaattccgagtctttctcactgcctttgtttagaagagagtagctcgtcctcactggtctacactggttgccgaatttacttgtattcctaactgttttgtatatgctgcattgagacttacggcaagaaggcattttttttttttaaaggaaacaaactctcaaatcatgaagtgatataaaagctgcatatgcctacaaagctctgaattcaggtcccagttgctgtcacaaaggagtgagtgaaactcccaccctacccccttttttatataataaaagtgccttagcatgtgttgcagctgtcaccactacagtaagctggtttacagatgttttccactgagcatcacaataaagagaaccatgtgcta

SEQ ID NO: 314089 - DNA, 6751 bp, Homo sapiens
  misc_feature (6686)..(6686): n is a, c, g, or t
  misc_feature (6689)..(6690): n is a, c, g, or t
  misc_feature (6699)..(6699): n is a, c, g, or t
  misc_feature (6712)..(6712): n is a, c, g, or t
  misc_feature (6714)..(6714): n is a, c, g, or t
  misc_feature (6723)..(6723): n is a, c, g, or t
  misc_feature (6729)..(6730): n is a, c, g, or t
  misc_feature (6732)..(6732): n is a, c, g, or t
  misc_feature (6738)..(6738): n is a, c, g, or t
cccgatattcggtcagtgggtgatagcaaaacctcgggtacgccaagaccgtgaagaatgacgaactcctcccgcttcggcaaattcattcgcatcaactttgatgtcaatggctacattgttggagccaacattgagacttatcttttggagaaatctcgtgctatccgccaagccaaggaagaacggaccttccacatcttctattatctcctgtctggggctggagagcacctgaagaccgatctcctgttggagccgtacaacaaataccgcttcctgtccaatggacacgtcaccatccccgggcagcaggacaaggacatgttccaggagaccatggaggccatgaggattatgggcatcccagaagaggagcaaatgggcctgctgcgggtcatctcaggggttcttcagctcggcaacatcgtcttcaagaaggagcggaacactgaccaggcgtccatgcccgacaacacagctgcccaaaaggtgtcccatctcttgggtatcaatgtgaccgatttcaccagaggaatcctcaccccgcgcatcaaggtgggacgggattacgtccagaaggcgcagactaaagagcaggctgactttgccatcgaggccttggccaaggcgacctatgagcggatgttccgctggctggtgctgcgcatcaacaaggctctggacaagaccaagaggcagggcgcctccttcatcgggatcctggacattgccggcttcgagatctttgatctgaactcgtttgagcagctgtgcatcaattacaccaatgagaagctgcagcagctcttcaaccacaccatgttcatcctggagcaggaggagtaccagcgcgagggcatcgagtggaacttcatcgactttggcctcgacctgcagccctgcatcgacctcattgagaagccagcaggccccccgggcattctggccctgctggacgaggagtgctggttccccaaagccaccgacaagagcttcgtggagaaggtgatgcaggagcagggcacccaccccaagttccagaagcccaagcagctgaaggacaaagctgatttctgcattatccactatgccggcaaggtggattacaaagctgacgagtggctgatgaagaacatggatcccctgaatgacaacatcgccacactgctccaccagtcctctgacaagtttgtctcggagctgtggaaggatgtggaccgcatcatcggcctggaccaggtggccggcatgtcggagaccgcactgcccggggccttcaagacgcggaagggcatgttccgcactgtggggcagctttacaaggagcagctggccaagctgatggctacgctgaggaacacgaaccccaactttgtccgctgcatcatccccaaccacgagaagaaggccggcaagctggacccgcatctcgtgctggaccagctgcgctgcaacggtgttctcgagggcatccgtatctgccgccagggcttccccaacagggtggtcttccaggagtttcggcagagatatgagatcctgactccaaactccattcccaagggtttcatggacgggaagcaggcgtgcgtgctcatgataaaagccctggagctcgacagcaatctgtaccgcattggccagagcaaagtcttcttccgtgccggtgtgctggcccacctggaggaggagcgagacctgaagatcaccgacgtcatcatagggttccaggcctgctgcaggggctacctggccaggaaagcatttgccaagcggcagcagcagcttaccgccatgaaggtcctccagcggaactgcgctgcctacctgaagctgcggaactggcagtggtggcggctcttcaccaaggtcaagccgctgctgcaggtgagccggcaggaggaggagatgatggccaaggaggaggagctggtgaaggtcagagagaagcagctggctgcggagaacaggctcacggagatggagacgctgcagtctcagctcatggcagagaaattgcagctgcaggagcagctccaggcagaaaccgagctgtgtgccgaggctgaggagctccgggcccgcctgaccgccaagaagcaggaattagaagagatctgccatgacctagaggccagggtggaggaggaggaggagcgctgccagcacctgcaggcggagaagaagaagatgcagcagaacatccaggagcttgaggagcagctggaggaggaggagagcgcccggcagaagctgcagctggagaaggtgaccaccgaggcgaagctgaaaaagctggaggaggagcagatcatcctggaggaccagaactgcaagctggccaaggaaaagaaactgctggaagacagaatagctgagttcaccaccaacctcacagaagaggaggagaaatctaagagcctcgccaagctcaagaacaagcatgaggcaatgatcactgacttggaagagcgcctccgcagggaggagaagcagcgacaggagctggagaagacccgccggaagctggagggagactccacagacctcagcgaccagatcgccgagctccaggcccagatcgcggagctcaagatgcagctggccaagaaagaggaggagctccaggccgccctggccagagtggaagaggaagctgcccagaagaacatggccctcaagaagatccgggagctggaatctcagatctctgaactccaggaagacctggagtctgagcgtgcttccaggaataaagctgagaagcagaaacgggaccttggggaagagctagaggcgctgaaaacagagttggaggacacgctggattccacagctgcccagcaggagctcaggtcaaaacgtgagcaggaggtgaacatcctgaagaagaccctggaggaggaggccaagacccacgaggcccagatccaggagatgaggcagaagcactcacaggccgtggaggagctggcggagcagctggagcagacgaagcgggtgaaagcaaacctcgagaaggcaaagcagactctggagaacgagcggggggagctggccaacgaggtgaaggtgctgctgcagggcaaaggggactcggagcacaagcgcaagaaagtggaggcgcagctgcaggagctgcaggtcaagttcaacgagggagagcgcgtgcgcacagagctggccgacaaggtcaccaagctgcaggtggagctggacaacgtgaccgggcttctcagccagtccgacagcaagtccagcaagctcaccaaggacttctccgcgctggagtcccagctgcaggacactcaggagctgctgcaggaggagaaccggcagaagctgagcctgagcaccaagctcaagcaggtggaggacgagaagaattccttccgggagcagctggaggaggaggaggaggccaagcacaacctggagaagcagatcgccaccctccatgcccaggtggccgacatgaaaaagaagatggaggacagtgtggggtgcctggaaactgctgaggaggtgaagaggaagctccagaaggacctggagggcctgagccagcggcacgaggagaaggtggccgcctacgacaagctggagaagaccaagacgcggctgcagcaggagctggacgacctgctggtggacctggaccaccagcgccagagcgcgtgcaacctggagaagaagcagaagaagtttgaccagctcctggcggaggagaagaccatctctgccaagtatgcagaggagcgcgaccgggctgaggcggaggcccgagagaaggagaccaaggctctgtcgctggcccgggccctggaggaagccatggagcagaaggcggagctggagcggctcaacaagcagttccgcacggagatggaggaccttatgagctccaaggatgatgtgggcaagagtgtccacgagctggagaagtccaagcgggccctagagcagcaggtggaggagatgaagacgcagctggaagagctggaggacgagctgcaggccaccgaagatgccaagctgcggttggaggtcaacctgcaggccatgaaggcccagttcgagcgggacctgcagggccgggacgagcagagcgaggagaagaagaagcagctggtcagacaggtgcgggagatggaggcagagctggaggacgagaggaagcagcgctcgatggcagtggccgcccggaagaagctggagatggacctgaaggacctggaggcgcacatcgactcggccaacaagaaccgggacgaagccatcaaacagctgcggaagctgcaggcccagatgaaggactgcatgcgcgagctggatgacacccgcgcctctcgtgaggagatcctggcccaggccaaagagaacgagaagaagctgaagagcatggaggccgagatgatccagttgcaggaggaactggcagccgcggagcgtgccaagcgccaggcccagcaggagcgggatgagctggctgacgagatcgccaacagcagcggcaaaggagccctggcgttagaggagaagcggcgtctggaggcccgcatcgcccagctggaggaggagctggaggaggagcagggcaacacggagctgatcaacgaccggctgaagaaggccaacctgcagatcgaccagatcaacaccgacctgaacctggagcgcagccacgcccagaagaacgagaatgctcggcagcagctggaacgccagaacaaggagcttaaggtcaagctgcaggagatggagggcactgtcaagtccaagtacaaggcctccatcaccgccctcgaggccaagattgcacagctggaggagcagctggacaacgagaccaaggagcgccaggcagcctgcaaacaggtgcgtcggaccgagaagaagctgaaggatgtgctgctgcaggtggatgacgagcggaggaacgccgagcagtacaaggaccaggccgacaaggcatctacccgcctgaagcagctcaagcggcagctggaggaggccgaagaggaggcccagcgggccaacgcctcccgccggaaactgcagcgcgagctggaggacgccactgagacggccgatgccatgaaccgcgaagtcagctccctaaagaacaagctcaggcgcggggacctgccgtttgtcgtgccccgccgaatggcccggaaaggcgccggggatggctccgacgaagaggtagatggcaaagcggatggggctgaggccaaacctgccgaataagcctcttctcctgcagcctgagatggatggacagacagacaccacagcctccccttcccagaccccgcagcacgcctctccccaccttcttgggactgctgtgaacatgcctcctcctgccctccgccccgtccccccatcccgtttccctccaggtgttgttgagggcatttggcttcctctgctgcatccccttccagctccctcccctgctcagaatctgataccaaagagacagggcccgggcccaggcagagagcgaccagcaggctcctcagccctctcttgccaaaaagcacaagatgttgaggcgagcagggcaggcccccggggaggggccagagttttctatgaatctatttttcttcagactgaggccttttggtagtcggagcccccgcagtcgtcagcctccctgacgtctgccaccagcgcccccactcctcctcctttctttgctgtttgcaatcacacgtggtgacctcacacacctctgccccttgggcctcccactcccatggctctgggcggtccagaaggagcaggccctgggcctccacctctgtgcagggcacagaaggctggggtggggggaggagtggattcctccccaccctgtcccaggcagcgccactgtccgctgtctccctcctgattctaaaatgtctcaagtgcaatgccccctcccctcctttaccgaggacagcctgcctctgccacagcaaggctgtcggggtcaagctggaaaggccagcagccttccagtggcttctcccaacactcttggggaccaaatatatttaatggttaagggacttgtcccaagtctgacagccagagcgttagaggggccagcggccctcccaggcgatcttgtgtctactctaggactgggcccgagggtggtttacctgcaccgttgactcagtatagtttaaaaatctgccacctgcacaggtatttttgaaagcaaaataaggttttcttttttcccctttcttgtaataaatgataaaattccgagtctttctcactgcctttgtttagaagagagtagctcgtcctcactggtctacactggttgccgaatttacttgtattcctaactgttttgtatatgctgcattgagacttacggcaagaaggcattttttttttttaaaggaaacaaactctcaaatcatgaagtgatataaaagctgcatatgcctacaaagctctgaattcaggtcccagttgctgtcacaaaggagtgagtgaaactcccaccctacccccttttttatataataaaagtgccttagcatgtgttgcagctgtcaccactacagtaagctggtttacagatgttttccactgagcatcacaataaagagaaccatgtgctaaaaaaaaaaaaaaaaaaaaaaaaaaaaactgtgtgtgggggngcnncgggcccgnagaaaaagctttntnaacacccantcggtnngngggcgnggcgggggcccca

SEQ ID NO: 314090 - DNA, 5325 bp, Homo sapiens
cgccacagcttcgtccctcattcattcattcattcagtccacaactacttattgaattcttgccttatgccaggcactgaggagagatctgtgaacataccaggcaaaaatctcagcctttatggggtgcattgttgggcaatacagatcaccaaatgaatacaggcgccacagcttctccaacagggtggtcttccaggagtttcggcagagatatgagatcctgactccaaactccattcccaagggtttcatggacgggaagcaggcgtgcgtgctcatgataaaagccctggagctcgacagcaatctgtaccgcattggccagagcaaagtcttcttccgtgccggtgtgctggcccacctggaggaggagcgagacctgaagatcaccgacgtcatcatagggttccaggcctgctgcaggggctacctggccaggaaagcatttgccaagcggcagcagcagcttaccgccatgaaggtcctccagcggaactgcgctgcctacctgaagctgcggaactggcagtggtggcggctcttcaccaaggtcaagccgctgctgcaggtgagccggcaggaggaggagatgatggccaaggaggaggagctggtgaaggtcagagagaagcagctggctgcggagaacaggctcacggagatggagacgctgcagtctcagctcatggcagagaaattgcagctgcaggagcagctccaggcagaaaccgagctgtgtgccgaggctgaggagctccgggcccgcctgaccgccaagaagcaggaattagaagagatctgccatgacctagaggccagggtggaggaggaggaggagcgctgccagcacctgcaggcggagaagaagaagatgcagcagaacatccaggagcttgaggagcagctggaggaggaggagagcgcccggcagaagctgcagctggagaaggtgaccaccgaggcgaagctgaaaaagctggaggaggagcagatcatcctggaggaccagaactgcaagctggccaaggaaaagaaactgctggaagacagaatagctgagttcaccaccaacctcacagaagaggaggagaaatctaagagcctcgccaagctcaagaacaagcatgaggcaatgatcactgacttggaagagcgcctccgcagggaggagaagcagcgacaggagctggagaagacccgccggaagctggagggagactccacagacctcagcgaccagatcgccgagctccaggcccagatcgcggagctcaagatgcagctggccaagaaagaggaggagctccaggccgccctggccagagtggaagaggaagctgcccagaagaacatggccctcaagaagatccgggagctggaatctcagatctctgaactccaggaagacctggagtctgagcgtgcttccaggaataaagctgagaagcagaaacgggaccttggggaagagctagaggcgctgaaaacagagttggaggacacgctggattccacagctgcccagcaggagctcaggtcaaaacgtgagcaggaggtgaacatcctgaagaagaccctggaggaggaggccaagacccacgaggcccagatccaggagatgaggcagaagcactcacaggccgtggaggagctggcggagcagctggagcagacgaagcgggtgaaagcaaacctcgagaaggcaaagcagactctggagaacgagcggggggagctggccaacgaggtgaaggtgctgctgcagggcaaaggggactcggagcacaagcgcaagaaagtggaggcgcagctgcaggagctgcaggtcaagttcaacgagggagagcgcgtgcgcacagagctggccgacaaggtcaccaagctgcaggtggagctggacaacgtgaccgggcttctcagccagtccgacagcaagtccagcaagctcaccaaggacttctccgcgctggagtcccagctgcaggacactcaggagctgctgcaggaggagaaccggcagaagctgagcctgagcaccaagctcaagcaggtggaggacgagaagaattccttccgggagcagctggaggaggaggaggaggccaagcacaacctggagaagcagatcgccaccctccatgcccaggtggccgacatgaaaaagaagatggaggacagtgtggggtgcctggaaactgctgaggaggtgaagaggaagctccagaaggacctggagggcctgagccagcggcacgaggagaaggtggccgcctacgacaagctggagaagaccaagacgcggctgcagcaggagctggacgacctgctggtggacctggaccaccagcgccagagcgcgtgcaacctggagaagaagcagaagaagtttgaccagctcctggcggaggagaagaccatctctgccaagtatgcagaggagcgcgaccgggctgaggcggaggcccgagagaaggagaccaaggctctgtcgctggcccgggccctggaggaagccatggagcagaaggcggagctggagcggctcaacaagcagttccgcacggagatggaggaccttatgagctccaaggatgatgtgggcaagagtgtccacgagctggagaagtccaagcgggccctagagcagcaggtggaggagatgaagacgcagctggaagagctggaggacgagctgcaggccaccgaagatgccaagctgcggttggaggtcaacctgcaggccatgaaggcccagttcgagcgggacctgcagggccgggacgagcagagcgaggagaagaagaagcagctggtcagacaggtgcgggagatggaggcagagctggaggacgagaggaagcagcgctcgatggcagtggccgcccggaagaagctggagatggacctgaaggacctggaggcgcacatcgactcggccaacaagaaccgggacgaagccatcaaacagctgcggaagctgcaggcccagatgaaggactgcatgcgcgagctggatgacacccgcgcctctcgtgaggagatcctggcccaggccaaagagaacgagaagaagctgaagagcatggaggccgagatgatccagttgcaggaggaactggcagccgcggagcgtgccaagcgccaggcccagcaggagcgggatgagctggctgacgagatcgccaacagcagcggcaaaggagccctggcgttagaggagaagcggcgtctggaggcccgcatcgcccagctggaggaggagctggaggaggagcagggcaacacggagctgatcaacgaccggctgaagaaggccaacctgcagatcgaccagatcaacaccgacctgaacctggagcgcagccacgcccagaagaacgagaatgctcggcagcagctggaacgccagaacaaggagcttaaggtcaagctgcaggagatggagggcactgtcaagtccaagtacaaggcctccatcaccgccctcgaggccaagattgcacagctggaggagcagctggacaacgagaccaaggagcgccaggcagcctgcaaacaggtgcgtcggaccgagaagaagctgaaggatgtgctgctgcaggtggatgacgagcggaggaacgccgagcagtacaaggaccaggccgacaaggcatctacccgcctgaagcagctcaagcggcagctggaggaggccgaagaggaggcccagcgggccaacgcctcccgccggaaactgcagcgcgagctggaggacgccactgagacggccgatgccatgaaccgcgaagtcagctccctaaagaacaagctcaggcgcggggacctgccgtttgtcgtgccccgccgaatggcccggaaaggcgccggggatggctccgacgaagaggtagatggcaaagcggatggggctgaggccaaacctgccgaataagcctcttctcctgcagcctgagatggatggacagacagacaccacagcctccccttcccagaccccgcagcacgcctctccccaccttcttgggactgctgtgaacatgcctcctcctgccctccgccccgtccccccatcccgtttccctccaggtgttgttgagggcatttggcttcctctgctgcatccccttccagctccctcccctgctcagaatctgataccaaagagacagggcccgggcccaggcagagagcgaccagcaggctcctcagccctctcttgccaaaaagcacaagatgttgaggcgagcagggcaggcccccggggaggggccagagttttctatgaatctatttttcttcagactgaggccttttggtagtcggagcccccgcagtcgtcagcctccctgacgtctgccaccagcgcccccactcctcctcctttctttgctgtttgcaatcacacgtggtgacctcacacacctctgccccttgggcctcccactcccatggctctgggcggtccagaaggagcaggccctgggcctccacctctgtgcagggcacagaaggctggggtggggggaggagtggattcctccccaccctgtcccaggcagcgccactgtccgctgtctccctcctgattctaaaatgtctcaagtgcaatgccccctcccctcctttaccgaggacagcctgcctctgccacagcaaggctgtcggggtcaagctggaaaggccagcagccttccagtggcttctcccaacactcttggggaccaaatatatttaatggttaagggacttgtcccaagtctgacagccagagcgttagaggggccagcggccctcccaggcgatcttgtgtctactctaggactgggcccgagggtggtttacctgcaccgttgactcagtatagtttaaaaatctgccacctgcacaggtatttttgaaagcaaaataaggttttcttttttcccctttcttgtaataaatgataaaattccgagtctttctcactgcctttgtttagaagagagtagctcgtcctcactggtctacactggttgccgaatttacttgtattcctaactgttttgtatatgctgcattgagacttacggcaagaaggcattttttttttttaaaggaaacaaactctcaaatcatgaagtgatataaaagctgcatatgcctacaaagctctgaattcaggtcccagttgctgtcacaaaggagtgagtgaaactcccaccctacccccttttttatataataaaagtgccttagcatgtgttgcagctgtcaccactacagtaagctggtttacagatgttttccactgagcatcacaataaagagaaccatgtgcta

SEQ ID NO: 314091 - DNA, 6368 bp, Homo sapiens
cccgatattcggtcagtgggtgatagcaaaacctcgggtacgccaagaccgtgaagaatgacgaactcctcccgcttcggcaaattcattcgcatcaactttgatgtcaatggctacattgttggagccaacattgagacttatcttttggagaaatctcgtgctatccgccaagccaaggaagaacggaccttccacatcttctattatctcctgtctggggctggagagcacctgaagaccgatctcctgttggagccgtacaacaaataccgcttcctgtccaatggacacgtcaccatccccgggcagcaggacaaggacatgttccaggagaccatggaggccatgaggattatgggcatcccagaagaggagcaaatgggcctgctgcgggtcatctcaggggttcttcagctcggcaacatcgtcttcaagaaggagcggaacactgaccaggcgtccatgcccgacaacacagctgcccaaaaggtgtcccatctcttgggtatcaatgtgaccgatttcaccagaggaatcctcaccccgcgcatcaaggtgggacgggattacgtccagaaggcgcagactaaagagcaggctgactttgccatcgaggccttggccaaggcgacctatgagcggatgttccgctggctggtgctgcgcatcaacaaggctctggacaagaccaagaggcagggcgcctccttcatcgggatcctggacattgccggcttcgagatctttgatctgaactcgtttgagcagctgtgcatcaattacaccaatgagaagctgcagcagctcttcaaccacaccatgttcatcctggagcaggaggagtaccagcgcgagggcatcgagtggaacttcatcgactttggcctcgacctgcagccctgcatcgacctcattgagaagccagcaggccccccgggcattctggccctgctggacgaggagtgctggttccccaaagccaccgacaagagcttcgtggagaaggtgatgcaggagcagggcacccaccccaagttccagaagcccaagcagctgaaggacaaagctgatttctgcattatccactatgccggcaaggtggattacaaagctgacgagtggctgatgaagaacatggatcccctgaatgacaacatcgccacactgctccaccagtcctctgacaagtttgtctcggagctgtggaaggatgtggaccgcatcatcggcctggaccaggtggccggcatgtcggagaccgcactgcccggggccttcaagacgcggaagggcatgttccgcactgtggggcagctttacaaggagcagctggccaagctgatggctacgctgaggaacacgaaccccaactttgtccgctgcatcatccccaaccacgagaagaaggccggcaagctggacccgcatctcgtgctggaccagctgcgctgcaacggtgttctcgagggcatccgtatctgccgccagggcttccccaacagggtggtcttccaggagtttcggcagagatatgagatcctgactccaaactccattcccaagggtttcatggacgggaagcaggcgtgcgtgctcatgataaaagccctggagctcgacagcaatctgtaccgcattggccagagcaaagtcttcttccgtgccggtgtgctggcccacctggaggaggagcgagacctgaagatcaccgacgtcatcatagggttccaggcctgctgcaggggctacctggccaggaaagcatttgccaagcggcagcagcagcttaccgccatgaaggtcctccagcggaactgcgctgcctacctgaagctgcggaactggcagtggtggcggctcttcaccaaggtcaagccgctgctgcaggtgagccggcaggaggaggagatgatggccaaggaggaggagctggtgaaggtcagagagaagcagctggctgcggagaacaggctcacggagatggagacgctgcagtctcagctcatggcagagaaattgcagctgcaggagcagctccaggcagaaaccgagctgtgtgccgaggctgaggagctccgggcccgcctgaccgccaagaagcaggaattagaagagatctgccatgacctagaggccagggtggaggaggaggaggagcgctgccagcacctgcaggcggagaagaagaagatgcagcagaacatccaggagcttgaggagcagctggaggaggaggagagcgcccggcagaagctgcagctggagaaggtgaccaccgaggcgaagctgaaaaagctggaggaggagcagatcatcctggaggaccagaactgcaagctggccaaggaaaagaaactgctggaagacagaatagctgagttcaccaccaacctcacagaagaggaggagaaatctaagagcctcgccaagctcaagaacaagcatgaggcaatgatcactgacttggaagagcgcctccgcagggaggagaagcagcgacaggagctggagaagacccgccggaagctggagggagactccacagacctcagcgaccagatcgccgagctccaggcccagatcgcggagctcaagatgcagctggccaagaaagaggaggagctccaggccgccctggccagagtggaagaggaagctgcccagaagaacatggccctcaagaagatccgggagctggaatctcagatctctgaactccaggaagacctggagtctgagcgtgcttccaggaataaagctgagaagcagaaacgggaccttggggaagagctagaggcgctgaaaacagagttggaggacacgctggattccacagctgcccagcaggagctcaggtcaaaacgtgagcaggaggtgaacatcctgaagaagaccctggaggaggaggccaagacccacgaggcccagatccaggagatgaggcagaagcactcacaggccgtggaggagctggcggagcagctggagcagacgaagcgggtgaaagcaaacctcgagaaggcaaagcagactctggagctgctgcaggaggagaaccggcagaagctgagcctgagcaccaagctcaagcaggtggaggacgagaagaattccttccgggagcagctggaggaggaggaggaggccaagcacaacctggagaagcagatcgccaccctccatgcccaggtggccgacatgaaaaagaagatggaggacagtgtggggtgcctggaaactgctgaggaggtgaagaggaagctccagaaggacctggagggcctgagccagcggcacgaggagaaggtggccgcctacgacaagctggagaagaccaagacgcggctgcagcaggagctggacgacctgctggtggacctggaccaccagcgccagagcgcgtgcaacctggagaagaagcagaagaagtttgaccagctcctggcggaggagaagaccatctctgccaagtatgcagaggagcgcgaccgggctgaggcggaggcccgagagaaggagaccaaggctctgtcgctggcccgggccctggaggaagccatggagcagaaggcggagctggagcggctcaacaagcagttccgcacggagatggaggaccttatgagctccaaggatgatgtgggcaagagtgtccacgagctggagaagtccaagcgggccctagagcagcaggtggaggagatgaagacgcagctggaagagctggaggacgagctgcaggccaccgaagatgccaagctgcggttggaggtcaacctgcaggccatgaaggcccagttcgagcgggacctgcagggccgggacgagcagagcgaggagaagaagaagcagctggtcagacaggtgcgggagatggaggcagagctggaggacgagaggaagcagcgctcgatggcagtggccgcccggaagaagctggagatggacctgaaggacctggaggcgcacatcgactcggccaacaagaaccgggacgaagccatcaaacagctgcggaagctgcaggcccagatgaaggactgcatgcgcgagctggatgacacccgcgcctctcgtgaggagatcctggcccaggccaaagagaacgagaagaagctgaagagcatggaggccgagatgatccagttgcaggaggaactggcagccgcggagcgtgccaagcgccaggcccagcaggagcgggatgagctggctgacgagatcgccaacagcagcggcaaaggagccctggcgttagaggagaagcggcgtctggaggcccgcatcgcccagctggaggaggagctggaggaggagcagggcaacacggagctgatcaacgaccggctgaagaaggccaacctgcagatcgaccagatcaacaccgacctgaacctggagcgcagccacgcccagaagaacgagaatgctcggcagcagctggaacgccagaacaaggagcttaaggtcaagctgcaggagatggagggcactgtcaagtccaagtacaaggcctccatcaccgccctcgaggccaagattgcacagctggaggagcagctggacaacgagaccaaggagcgccaggcagcctgcaaacaggtgcgtcggaccgagaagaagctgaaggatgtgctgctgcaggtggatgacgagcggaggaacgccgagcagtacaaggaccaggccgacaaggcatctacccgcctgaagcagctcaagcggcagctggaggaggccgaagaggaggcccagcgggccaacgcctcccgccggaaactgcagcgcgagctggaggacgccactgagacggccgatgccatgaaccgcgaagtcagctccctaaagaacaagctcaggcgcggggacctgccgtttgtcgtgccccgccgaatggcccggaaaggcgccggggatggctccgacgaagaggtagatggcaaagcggatggggctgaggccaaacctgccgaataagcctcttctcctgcagcctgagatggatggacagacagacaccacagcctccccttcccagaccccgcagcacgcctctccccaccttcttgggactgctgtgaacatgcctcctcctgccctccgccccgtccccccatcccgtttccctccaggtgttgttgagggcatttggcttcctctgctgcatccccttccagctccctcccctgctcagaatctgataccaaagagacagggcccgggcccaggcagagagcgaccagcaggctcctcagccctctcttgccaaaaagcacaagatgttgaggcgagcagggcaggcccccggggaggggccagagttttctatgaatctatttttcttcagactgaggccttttggtagtcggagcccccgcagtcgtcagcctccctgacgtctgccaccagcgcccccactcctcctcctttctttgctgtttgcaatcacacgtggtgacctcacacacctctgccccttgggcctcccactcccatggctctgggcggtccagaaggagcaggccctgggcctccacctctgtgcagggcacagaaggctggggtggggggaggagtggattcctccccaccctgtcccaggcagcgccactgtccgctgtctccctcctgattctaaaatgtctcaagtgcaatgccccctcccctcctttaccgaggacagcctgcctctgccacagcaaggctgtcggggtcaagctggaaaggccagcagccttccagtggcttctcccaacactcttggggaccaaatatatttaatggttaagggacttgtcccaagtctgacagccagagcgttagaggggccagcggccctcccaggcgatcttgtgtctactctaggactgggcccgagggtggtttacctgcaccgttgactcagtatagtttaaaaatctgccacctgcacaggtatttttgaaagcaaaataaggttttcttttttcccctttcttgtaataaatgataaaattccgagtctttctcactgcctttgtttagaagagagtagctcgtcctcactggtctacactggttgccgaatttacttgtattcctaactgttttgtatatgctgcattgagacttacggcaagaaggcattttttttttttaaaggaaacaaactctcaaatcatgaagtgatataaaagctgcatatgcctacaaagctctgaattcaggtcccagttgctgtcacaaaggagtgagtgaaactcccaccctacccccttttttatataataaaagtgccttagcatgtgttgcagctgtcaccactacagtaagctggtttacagatgttttccactgagcatcacaataaagagaaccatgtgcta

SEQ ID NO: 314092 - DNA, 6569 bp, Homo sapiens
cccgatattcggtcagtgggtgatagcaaaacctcgggtacgccaagaccgtgaagaatgacgaactcctcccgcttcggcaaattcattcgcatcaactttgatgtcaatggctacattgttggagccaacattgagacttatcttttggagaaatctcgtgctatccgccaagccaaggaagaacggaccttccacatcttctattatctcctgtctggggctggagagcacctgaagaccgatctcctgttggagccgtacaacaaataccgcttcctgtccaatggacacgtcaccatccccgggcagcaggacaaggacatgttccaggagaccatggaggccatgaggattatgggcatcccagaagaggagcaaatgggcctgctgcgggtcatctcaggggttcttcagctcggcaacatcgtcttcaagaaggagcggaacactgaccaggcgtccatgcccgacaacacagctgcccaaaaggtgtcccatctcttgggtatcaatgtgaccgatttcaccagaggaatcctcaccccgcgcatcaaggtgggacgggattacgtccagaaggcgcagactaaagagcaggctgactttgccatcgaggccttggccaaggcgacctatgagcggatgttccgctggctggtgctgcgcatcaacaaggctctggacaagaccaagaggcagggcgcctccttcatcgggatcctggacattgccggcttcgagatctttgatctgaactcgtttgagcagctgtgcatcaattacaccaatgagaagctgcagcagctcttcaaccacaccatgttcatcctggagcaggaggagtaccagcgcgagggcatcgagtggaacttcatcgactttggcctcgacctgcagccctgcatcgacctcattgagaagccagcaggccccccgggcattctggccctgctggacgaggagtgctggttccccaaagccaccgacaagagcttcgtggagaaggtgatgcaggagcagggcacccaccccaagttccagaagcccaagcagctgaaggacaaagctgatttctgcattatccactatgccggcaaggtggattacaaagctgacgagtggctgatgaagaacatggatcccctgaatgacaacatcgccacactgctccaccagtcctctgacaagtttgtctcggagctgtggaaggatgtggaccgcatcatcggcctggaccaggtggccggcatgtcggagaccgcactgcccggggccttcaagacgcggaagggcatgttccgcactgtggggcagctttacaaggagcagctggccaagctgatggctacgctgaggaacacgaaccccaactttgtccgctgcatcatccccaaccacgagaagaaggccggcaagctggacccgcatctcgtgctggaccagctgcgctgcaacggtgttctcgagggcatccgtatctgccgccagggcttccccaacagggtggtcttccaggagtttcggcagagatatgagatcctgactccaaactccattcccaagggtttcatggacgggaagcaggcgtgcgtgctcatgataaaagccctggagctcgacagcaatctgtaccgcattggccagagcaaagtcttcttccgtgccggtgtgctggcccacctggaggaggagcgagacctgaagatcaccgacgtcatcatagggttccaggcctgctgcaggggctacctggccaggaaagcatttgccaagcggcagcagcagcttaccgccatgaaggtcctccagcggaactgcgctgcctacctgaagctgcggaactggcagtggtggcggctcttcaccaaggtcaagccgctgctgcaggtgagccggcaggaggaggagatgatggccaaggaggaggagctggtgaaggtcagagagaagcagctggctgcggagaacaggctcacggagatggagacgctgcagtctcagctcatggcagagaaattgcagctgcaggagcagctccaggcagaaaccgagctgtgtgccgaggctgaggagctccgggcccgcctgaccgccaagaagcaggaattagaagagatctgccatgacctagaggccagggtggaggaggaggaggagcgctgccagcacctgcaggcggagaagaagaagatgcagcagaacatccaggagcttgaggagcagctggaggaggaggagagcgcccggcagaagctgcagctggagaaggtgaccaccgaggcgaagctgaaaaagctggaggaggagcagatcatcctggaggaccagaactgcaagctggccaaggaaaagaaactgctggaagacagaatagctgagttcaccaccaacctcacagaagaggaggagaaatctaagagcctcgccaagctcaagaacaagcatgaggcaatgatcactgacttggaagagcgcctccgcagggaggagaagcagcgacaggagctggagaagacccgccggaagctggagggagactccacagacctcagcgaccagatcgccgagctccaggcccagatcgcggagctcaagatgcagctggccaagaaagaggaggagctccaggccgccctggccagagtggaagaggaagctgcccagaagaacatggccctcaagaagatccgggagctggaatctcagatctctgaactccaggaagacctggagtctgagcgtgcttccaggaataaagctgagaagcagaaacgggaccttggggaagagctagaggcgctgaaaacagagttggaggacacgctggattccacagctgcccagcaggagctcaggtcaaaacgtgagcaggaggtgaacatcctgaagaagaccctggaggaggaggccaagacccacgaggcccagatccaggagatgaggcagaagcactcacaggccgtggaggagctggcggagcagctggagcagacgaagcgggtgaaagcaaacctcgagaaggcaaagcagactctggagaacgagcggggggagctggccaacgaggtgaaggtgctgctgcagggcaaaggggactcggagcacaagcgcaagaaagtggaggcgcagctgcaggagctgcaggtcaagttcaacgagggagagcgcgtgcgcacagagctggccgacaaggtcaccaagctgcaggtggagctggacaacgtgaccgggcttctcagccagtccgacagcaagtccagcaagctcaccaaggacttctccgcgctggagtcccagctgcaggacactcaggagctgctgcaggaggagaaccggcagaagctgagcctgagcaccaagctcaagcaggtggaggacgagaagaattccttccgggagcagctggaggaggaggaggaggccaagcacaacctggagaagcagatcgccaccctccatgcccaggtggccgacatgaaaaagaagatggaggacagtgtggggtgcctggaaactgctgaggaggtgaagaggaagctccagaaggacctggagggcctgagccagcggcacgaggagaaggtggccgcctacgacaagctggagaagaccaagacgcggctgcagcaggagctggacgacctgctggtggacctggaccaccagcgccagagcgcgtgcaacctggagaagaagcagaagaagtttgaccagctcctggcggaggagaagaccatctctgccaagtatgcagaggagcgcgaccgggctgaggcggaggcccgagagaaggagaccaaggctctgtcgctggcccgggccctggaggaagccatggagcagaaggcggagctggagcggctcaacaagcagttccgcacggagatggaggaccttatgagctccaaggatgatgtgggcaagagtgtccacgagctggagaagtccaagcgggccctagagcagcaggtggaggagatgaagacgcagctggaagagctggaggacgagctgcaggccaccgaagatgccaagctgcggttggaggtcaacctgcaggccatgaaggcccagttcgagcgggacctgcagggccgggagaagcagcgctcgatggcagtggccgcccggaagaagctggagatggacctgaaggacctggaggcgcacatcgactcggccaacaagaaccgggacgaagccatcaaacagctgcggaagctgcaggcccagatgaaggactgcatgcgcgagctggatgacacccgcgcctctcgtgaggagatcctggcccaggccaaagagaacgagaagaagctgaagagcatggaggccgagatgatccagttgcaggaggaactggcagccgcggagcgtgccaagcgccaggcccagcaggagcgggatgagctggctgacgagatcgccaacagcagcggcaaaggagccctggcgttagaggagaagcggcgtctggaggcccgcatcgcccagctggaggaggagctggaggaggagcagggcaacacggagctgatcaacgaccggctgaagaaggccaacctgcagatcgaccagatcaacaccgacctgaacctggagcgcagccacgcccagaagaacgagaatgctcggcagcagctggaacgccagaacaaggagcttaaggtcaagctgcaggagatggagggcactgtcaagtccaagtacaaggcctccatcaccgccctcgaggccaagattgcacagctggaggagcagctggacaacgagaccaaggagcgccaggcagcctgcaaacaggtgcgtcggaccgagaagaagctgaaggatgtgctgctgcaggtggatgacgagcggaggaacgccgagcagtacaaggaccaggccgacaaggcatctacccgcctgaagcagctcaagcggcagctggaggaggccgaagaggaggcccagcgggccaacgcctcccgccggaaactgcagcgcgagctggaggacgccactgagacggccgatgccatgaaccgcgaagtcagctccctaaagaacaagctcaggcgcggggacctgccgtttgtcgtgccccgccgaatggcccggaaaggcgccggggatggctccgacgaagaggtagatggcaaagcggatggggctgaggccaaacctgccgaataagcctcttctcctgcagcctgagatggatggacagacagacaccacagcctccccttcccagaccccgcagcacgcctctccccaccttcttgggactgctgtgaacatgcctcctcctgccctccgccccgtccccccatcccgtttccctccaggtgttgttgagggcatttggcttcctctgctgcatccccttccagctccctcccctgctcagaatctgataccaaagagacagggcccgggcccaggcagagagcgaccagcaggctcctcagccctctcttgccaaaaagcacaagatgttgaggcgagcagggcaggcccccggggaggggccagagttttctatgaatctatttttcttcagactgaggccttttggtagtcggagcccccgcagtcgtcagcctccctgacgtctgccaccagcgcccccactcctcctcctttctttgctgtttgcaatcacacgtggtgacctcacacacctctgccccttgggcctcccactcccatggctctgggcggtccagaaggagcaggccctgggcctccacctctgtgcagggcacagaaggctggggtggggggaggagtggattcctccccaccctgtcccaggcagcgccactgtccgctgtctccctcctgattctaaaatgtctcaagtgcaatgccccctcccctcctttaccgaggacagcctgcctctgccacagcaaggctgtcggggtcaagctggaaaggccagcagccttccagtggcttctcccaacactcttggggaccaaatatatttaatggttaagggacttgtcccaagtctgacagccagagcgttagaggggccagcggccctcccaggcgatcttgtgtctactctaggactgggcccgagggtggtttacctgcaccgttgactcagtatagtttaaaaatctgccacctgcacaggtatttttgaaagcaaaataaggttttcttttttcccctttcttgtaataaatgataaaattccgagtctttctcactgcctttgtttagaagagagtagctcgtcctcactggtctacactggttgccgaatttacttgtattcctaactgttttgtatatgctgcattgagacttacggcaagaaggcattttttttttttaaaggaaacaaactctcaaatcatgaagtgatataaaagctgcatatgcctacaaagctctgaattcaggtcccagttgctgtcacaaaggagtgagtgaaactcccaccctacccccttttttatataataaaagtgccttagcatgtgttgcagctgtcaccactacagtaagctggtttacagatgttttccactgagcatcacaataaagagaaccatgtgcta

SEQ ID NO: 314093 - DNA, 4349 bp, Homo sapiens
accgcagccatggacgccatcaagatgaagatgcagatgctgaagctggacaaggaaaagaaactgctggaagacagaatagctgagttcaccaccaacctcacagaagaggaggagaaatctaagagcctcgccaagctcaagaacaagcatgaggcaatgatcactgacttggaagagcgcctccgcagggaggagaagcagcgacaggagctggagaagacccgccggaagctggagggagactccacagacctcagcgaccagatcgccgagctccaggcccagatcgcggagctcaagatgcagctggccaagaaagaggaggagctccaggccgccctggccagagtggaagaggaagctgcccagaagaacatggccctcaagaagatccgggagctggaatctcagatctctgaactccaggaagacctggagtctgagcgtgcttccaggaataaagctgagaagcagaaacgggaccttggggaagagctagaggcgctgaaaacagagttggaggacacgctggattccacagctgcccagcaggagctcaggtcaaaacgtgagcaggaggtgaacatcctgaagaagaccctggaggaggaggccaagacccacgaggcccagatccaggagatgaggcagaagcactcacaggccgtggaggagctggcggagcagctggagcagacgaagcgggtgaaagcaaacctcgagaaggcaaagcagactctggagaacgagcggggggagctggccaacgaggtgaaggtgctgctgcagggcaaaggggactcggagcacaagcgcaagaaagtggaggcgcagctgcaggagctgcaggtcaagttcaacgagggagagcgcgtgcgcacagagctggccgacaaggtcaccaagctgcaggtggagctggacaacgtgaccgggcttctcagccagtccgacagcaagtccagcaagctcaccaaggacttctccgcgctggagtcccagctgcaggacactcaggagctgctgcaggaggagaaccggcagaagctgagcctgagcaccaagctcaagcaggtggaggacgagaagaattccttccgggagcagctggaggaggaggaggaggccaagcacaacctggagaagcagatcgccaccctccatgcccaggtggccgacatgaaaaagaagatggaggacagtgtggggtgcctggaaactgctgaggaggtgaagaggaagctccagaaggacctggagggcctgagccagcggcacgaggagaaggtggccgcctacgacaagctggagaagaccaagacgcggctgcagcaggagctggacgacctgctggtggacctggaccaccagcgccagagcgcgtgcaacctggagaagaagcagaagaagtttgaccagctcctggcggaggagaagaccatctctgccaagtatgcagaggagcgcgaccgggctgaggcggaggcccgagagaaggagaccaaggctctgtcgctggcccgggccctggaggaagccatggagcagaaggcggagctggagcggctcaacaagcagttccgcacggagatggaggaccttatgagctccaaggatgatgtgggcaagagtgtccacgagctggagaagtccaagcgggccctagagcagcaggtggaggagatgaagacgcagctggaagagctggaggacgagctgcaggccaccgaagatgccaagctgcggttggaggtcaacctgcaggccatgaaggcccagttcgagcgggacctgcagggccgggacgagcagagcgaggagaagaagaagcagctggtcagacaggtgcgggagatggaggcagagctggaggacgagaggaagcagcgctcgatggcagtggccgcccggaagaagctggagatggacctgaaggacctggaggcgcacatcgactcggccaacaagaaccgggacgaagccatcaaacagctgcggaagctgcaggcccagatgaaggactgcatgcgcgagctggatgacacccgcgcctctcgtgaggagatcctggcccaggccaaagagaacgagaagaagctgaagagcatggaggccgagatgatccagttgcaggaggaactggcagccgcggagcgtgccaagcgccaggcccagcaggagcgggatgagctggctgacgagatcgccaacagcagcggcaaaggagccctggcgttagaggagaagcggcgtctggaggcccgcatcgcccagctggaggaggagctggaggaggagcagggcaacacggagctgatcaacgaccggctgaagaaggccaacctgcagatcgaccagatcaacaccgacctgaacctggagcgcagccacgcccagaagaacgagaatgctcggcagcagctggaacgccagaacaaggagcttaaggtcaagctgcaggagatggagggcactgtcaagtccaagtacaaggcctccatcaccgccctcgaggccaagattgcacagctggaggagcagctggacaacgagaccaaggagcgccaggcagcctgcaaacaggtgcgtcggaccgagaagaagctgaaggatgtgctgctgcaggtggatgacgagcggaggaacgccgagcagtacaaggaccaggccgacaaggcatctacccgcctgaagcagctcaagcggcagctggaggaggccgaagaggaggcccagcgggccaacgcctcccgccggaaactgcagcgcgagctggaggacgccactgagacggccgatgccatgaaccgcgaagtcagctccctaaagaacaagctcaggcgcggggacctgccgtttgtcgtgccccgccgaatggcccggaaaggcgccggggatggctccgacgaagaggtagatggcaaagcggatggggctgaggccaaacctgccgaataagcctcttctcctgcagcctgagatggatggacagacagacaccacagcctccccttcccagaccccgcagcacgcctctccccaccttcttgggactgctgtgaacatgcctcctcctgccctccgccccgtccccccatcccgtttccctccaggtgttgttgagggcatttggcttcctctgctgcatccccttccagctccctcccctgctcagaatctgataccaaagagacagggcccgggcccaggcagagagcgaccagcaggctcctcagccctctcttgccaaaaagcacaagatgttgaggcgagcagggcaggcccccggggaggggccagagttttctatgaatctatttttcttcagactgaggccttttggtagtcggagcccccgcagtcgtcagcctccctgacgtctgccaccagcgcccccactcctcctcctttctttgctgtttgcaatcacacgtggtgacctcacacacctctgccccttgggcctcccactcccatggctctgggcggtccagaaggagcaggccctgggcctccacctctgtgcagggcacagaaggctggggtggggggaggagtggattcctccccaccctgtcccaggcagcgccactgtccgctgtctccctcctgattctaaaatgtctcaagtgcaatgccccctcccctcctttaccgaggacagcctgcctctgccacagcaaggctgtcggggtcaagctggaaaggccagcagccttccagtggcttctcccaacactcttggggaccaaatatatttaatggttaagggacttgtcccaagtctgacagccagagcgttagaggggccagcggccctcccaggcgatcttgtgtctactctaggactgggcccgagggtggtttacctgcaccgttgactcagtatagtttaaaaatctgccacctgcacaggtatttttgaaagcaaaataaggttttcttttttcccctttcttgtaataaatgataaaattccgagtctttctcactgcctttgtttagaagagagtagctcgtcctcactggtctacactggttgccgaatttacttgtattcctaactgttttgtatatgctgcattgagacttacggcaagaaggcattttttttttttaaaggaaacaaactctcaaatcatgaagtgatataaaagctgcatatgcctacaaagctctgaattcaggtcccagttgctgtcacaaaggagtgagtgaaactcccaccctacccccttttttatataataaaagtgccttagcatgtgttgcagctgtcaccactacagtaagctggtttacagatgttttccactgagcatcacaataaagagaaccatgtgcta

SEQ ID NO: 314094 - DNA, 6035 bp, Homo sapiens
cccgatattcggtcagtgggtgatagcaaaacctcgggtacgccaagaccgtgaagaatgacgaactcctcccgcttcggcaaattcattcgcatcaactttgatgtcaatggctacattgttggagccaacattgagacttatcttttggagaaatctcgtgctatccgccaagccaaggaagaacggaccttccacatcttctattatctcctgtctggggctggagagcacctgaagaccgatctcctgttggagccgtacaacaaataccgcttcctgtccaatggacacgtcaccatccccgggcagcaggacaaggacatgttccaggagaccatggaggccatgaggattatgggcatcccagaagaggagcaaatgggcctgctgcgggtcatctcaggggttcttcagctcggcaacatcgtcttcaagaaggagcggaacactgaccaggcgtccatgcccgacaacacagctgcccaaaaggtgtcccatctcttgggtatcaatgtgaccgatttcaccagaggaatcctcaccccgcgcatcaaggtgggacgggattacgtccagaaggcgcagactaaagagcaggctgactttgccatcgaggccttggccaaggcgacctatgagcggatgttccgctggctggtgctgcgcatcaacaaggctctggacaagaccaagaggcagggcgcctccttcatcgggatcctggacattgccggcttcgagatctttgatctgaactcgtttgagcagctgtgcatcaattacaccaatgagaagctgcagcagctcttcaaccacaccatgttcatcctggagcaggaggagtaccagcgcgagggcatcgagtggaacttcatcgactttggcctcgacctgcagccctgcatcgacctcattgagaagccagcaggccccccgggcattctggccctgctggacgaggagtgctggttccccaaagccaccgacaagagcttcgtggagaaggtgatgcaggagcagggcacccaccccaagttccagaagcccaagcagctgaaggacaaagctgatttctgcattatccactatgccggcaaggtggattacaaagctgacgagtggctgatgaagaacatggatcccctgaatgacaacatcgccacactgctccaccagtcctctgacaagtttgtctcggagctgtggaaggatgtggaccgcatcatcggcctggaccaggtggccggcatgtcggagaccgcactgcccggggccttcaagacgcggaagggcatgttccgcactgtggggcagctttacaaggagcagctggccaagctgatggctacgctgaggaacacgaaccccaactttgtccgctgcatcatccccaaccacgagaagaaggccggcaagctggacccgcatctcgtgctggaccagctgcgctgcaacggtgttctcgagggcatccgtatctgccgccagggcttccccaacagggtggtcttccaggagtttcggcagagatatgagatcctgactccaaactccattcccaagggtttcatggacgggaagcaggcgtgcgtgctcatgataaaagccctggagctcgacagcaatctgtaccgcattggccagagcaaagtcttcttccgtgccggtgtgctggcccacctggaggaggagcgagacctgaagatcaccgacgtcatcatagggttccaggcctgctgcaggggctacctggccaggaaagcatttgccaagcggcagcagcagcttaccgccatgaaggtcctccagcggaactgcgctgcctacctgaagctgcggaactggcagtggtggcggctcttcaccaaggtcaagccgctgctgcaggtgagccggcaggaggaggagatgatggccaaggaggaggagctggtgaaggtcagagagaagcagctggctgcggagaacaggctcacggagatggagacgctgcagtctcagctcatggcagagaaattgcagctgcaggagcagctccaggcagaaaccgagctgtgtgccgaggctgaggagctccgggcccgcctgaccgccaagaagcaggaattagaagagatctgccatgacctagaggccagggtggaggaggaggaggagcgctgccagcacctgcaggcggagaagaagaagatgcagcagaacatccaggagcttgaggagcagctggaggaggaggagagcgcccggcagaagctgcagctggagaaggtgaccaccgaggcgaagctgaaaaagctggaggaggagcagatcatcctggaggaccagaactgcaagctggccaaggaaaagaaactgctggaagacagaatagctgagttcaccaccaacctcacagaagaggaggagaaatctaagagcctcgccaagctcaagaacaagcatgaggcaatgatcactgacttggaagagcgcctccgcagggaggagaagcagcgacaggagctggagaagacccgccggaagctggagggagactccacagacctcagcgaccagatcgccgagctccaggcccagatcgcggagctcaagatgcagctggccaagaaagaggaggagctccaggccgccctggccagagtggaagaggaagctgcccagaagaacatggccctcaagaagatccgggagctggaatctcagatctctgaactccaggaagacctggagtctgagcgtgcttccaggaataaagctgagaagcagaaacgggaccttggggaagagctagaggcgctgaaaacagagttggaggacacgctggattccacagctgcccagcaggagctcaggtcaaaacgtgagcaggaggtgaacatcctgaagaagaccctggaggaggaggccaagacccacgaggcccagatccaggagatgaggcagaagcactcacaggccgtggaggagctggcggagcagctggagcagacgaagcgggtgaaagcaaacctcgagaaggcaaagcagactctggagaacgagcggggggagctggccaacgaggtgaaggtgctgctgcagggcaaaggggactcggagcacaagcgcaagaaagtggaggcgcagctgcaggagctgcaggtcaagttcaacgagggagagcgcgtgcgcacagagctggccgacaaggtcaccaagctgcaggtggagctggacaacgtgaccgggcttctcagccagtccgacagcaagtccagcaagctcaccaaggacttctccgcgctggagtcccagctgcaggacactcaggagctgctgcaggaggagaaccggcagaagctgagcctgagcaccaagctcaagcaggtggaggacgagaagaattccttccgggagcagctggaggaggaggaggaggccaagcacaacttggaggtcaacctgcaggccatgaaggcccagttcgagcgggacctgcagggccgggacgagcagagcgaggagaagaagaagcagctggtcagacaggtgcgggagatggaggcagagctggaggacgagaggaagcagcgctcgatggcagtggccgcccggaagaagctggagatggacctgaaggacctggaggcgcacatcgactcggccaacaagaaccgggacgaagccatcaaacagctgcggaagctgcaggcccagatgaaggactgcatgcgcgagctggatgacacccgcgcctctcgtgaggagatcctggcccaggccaaagagaacgagaagaagctgaagagcatggaggccgagatgatccagttgcaggaggaactggcagccgcggagcgtgccaagcgccaggcccagcaggagcgggatgagctggctgacgagatcgccaacagcagcggcaaaggagccctggcgttagaggagaagcggcgtctggaggcccgcatcgcccagctggaggaggagctggaggaggagcagggcaacacggagctgatcaacgaccggctgaagaaggccaacctgcagatcgaccagatcaacaccgacctgaacctggagcgcagccacgcccagaagaacgagaatgctcggcagcagctggaacgccagaacaaggagcttaaggtcaagctgcaggagatggagggcactgtcaagtccaagtacaaggcctccatcaccgccctcgaggccaagattgcacagctggaggagcagctggacaacgagaccaaggagcgccaggcagcctgcaaacaggtgcgtcggaccgagaagaagctgaaggatgtgctgctgcaggtggatgacgagcggaggaacgccgagcagtacaaggaccaggccgacaaggcatctacccgcctgaagcagctcaagcggcagctggaggaggccgaagaggaggcccagcgggccaacgcctcccgccggaaactgcagcgcgagctggaggacgccactgagacggccgatgccatgaaccgcgaagtcagctccctaaagaacaagctcaggcgcggggacctgccgtttgtcgtgccccgccgaatggcccggaaaggcgccggggatggctccgacgaagaggtagatggcaaagcggatggggctgaggccaaacctgccgaataagcctcttctcctgcagcctgagatggatggacagacagacaccacagcctccccttcccagaccccgcagcacgcctctccccaccttcttgggactgctgtgaacatgcctcctcctgccctccgccccgtccccccatcccgtttccctccaggtgttgttgagggcatttggcttcctctgctgcatccccttccagctccctcccctgctcagaatctgataccaaagagacagggcccgggcccaggcagagagcgaccagcaggctcctcagccctctcttgccaaaaagcacaagatgttgaggcgagcagggcaggcccccggggaggggccagagttttctatgaatctatttttcttcagactgaggccttttggtagtcggagcccccgcagtcgtcagcctccctgacgtctgccaccagcgcccccactcctcctcctttctttgctgtttgcaatcacacgtggtgacctcacacacctctgccccttgggcctcccactcccatggctctgggcggtccagaaggagcaggccctgggcctccacctctgtgcagggcacagaaggctggggtggggggaggagtggattcctccccaccctgtcccaggcagcgccactgtccgctgtctccctcctgattctaaaatgtctcaagtgcaatgccccctcccctcctttaccgaggacagcctgcctctgccacagcaaggctgtcggggtcaagctggaaaggccagcagccttccagtggcttctcccaacactcttggggaccaaatatatttaatggttaagggacttgtcccaagtctgacagccagagcgttagaggggccagcggccctcccaggcgatcttgtgtctactctaggactgggcccgagggtggtttacctgcaccgttgactcagtatagtttaaaaatctgccacctgcacaggtatttttgaaagcaaaataaggttttcttttttcccctttcttgtaataaatgataaaattccgagtctttctcactgcctttgtttagaagagagtagctcgtcctcactggtctacactggttgccgaatttacttgtattcctaactgttttgtatatgctgcattgagacttacggcaagaaggcattttttttttttaaaggaaacaaactctcaaatcatgaagtgatataaaagctgcatatgcctacaaagctctgaattcaggtcccagttgctgtcacaaaggagtgagtgaaactcccaccctacccccttttttatataataaaagtgccttagcatgtgttgcagctgtcaccactacagtaagctggtttacagatgttttccactgagcatcacaataaagagaaccatgtgcta

SEQ ID NO: 314095 - DNA, 6497 bp, Homo sapiens
cccgatattcggtcagtgggtgatagcaaaacctcgggtacgccaagaccgtgaagaatgacgaactcctcccgcttcggcaaattcattcgcatcaactttgatgtcaatggctacattgttggagccaacattgagacttatcttttggagaaatctcgtgctatccgccaagccaaggaagaacggaccttccacatcttctattatctcctgtctggggctggagagcacctgaagaccgatctcctgttggagccgtacaacaaataccgcttcctgtccaatggacacgtcaccatccccgggcagcaggacaaggacatgttccaggagaccatggaggccatgaggattatgggcatcccagaagaggagcaaatgggcctgctgcgggtcatctcaggggttcttcagctcggcaacatcgtcttcaagaaggagcggaacactgaccaggcgtccatgcccgacaacacagctgcccaaaaggtgtcccatctcttgggtatcaatgtgaccgatttcaccagaggaatcctcaccccgcgcatcaaggtgggacgggattacgtccagaaggcgcagactaaagagcaggctgactttgccatcgaggccttggccaaggcgacctatgagcggatgttccgctggctggtgctgcgcatcaacaaggctctggacaagaccaagaggcagggcgcctccttcatcgggatcctggacattgccggcttcgagatctttgatctgaactcgtttgagcagctgtgcatcaattacaccaatgagaagctgcagcagctcttcaaccacaccatgttcatcctggagcaggaggagtaccagcgcgagggcatcgagtggaacttcatcgactttggcctcgacctgcagccctgcatcgacctcattgagaagccagcaggccccccgggcattctggccctgctggacgaggagtgctggttccccaaagccaccgacaagagcttcgtggagaaggtgatgcaggagcagggcacccaccccaagttccagaagcccaagcagctgaaggacaaagctgatttctgcattatccactatgccggcaaggtggattacaaagctgacgagtggctgatgaagaacatggatcccctgaatgacaacatcgccacactgctccaccagtcctctgacaagtttgtctcggagctgtggaaggatgtggaccgcatcatcggcctggaccaggtggccggcatgtcggagaccgcactgcccggggccttcaagacgcggaagggcatgttccgcactgtggggcagctttacaaggagcagctggccaagctgatggctacgctgaggaacacgaaccccaactttgtccgctgcatcatccccaaccacgagaagaaggccggcaagctggacccgcatctcgtgctggaccagctgcgctgcaacggtgttctcgagggcatccgtatctgccgccagggcttccccaacagggtggtcttccaggagtttcggcagagatatgagatcctgactccaaactccattcccaagggtttcatggacgggaagcaggcgtgcgtgctcatgataaaagccctggagctcgacagcaatctgtaccgcattggccagagcaaagtcttcttccgtgccggtgtgctggcccacctggaggaggagcgagacctgaagatcaccgacgtcatcatagggttccaggcctgctgcaggggctacctggccaggaaagcatttgccaagcggcagcagcagcttaccgccatgaaggtcctccagcggaactgcgctgcctacctgaagctgcggaactggcagtggtggcggctcttcaccaaggtcaagccgctgctgcaggtgagccggcaggaggaggagatgatggccaaggaggaggagctggtgaaggtcagagagaagcagctggctgcggagaacaggctcacggagatggagacgctgcagtctcagctcatggcagagaaattgcagctgcaggagcagctccaggcagaaaccgagctgtgtgccgaggctgaggagctccgggcccgcctgaccgccaagaagcaggaattagaagagatctgccatgacctagaggccagggtggaggaggaggaggagcgctgccagcacctgcaggcggagaagaagaagatgcagcagaacatccaggagcttgaggagcagctggaggaggaggagagcgcccggcagaagctgcagctggagaaggtgaccaccgaggcgaagctgaaaaagctggaggaggagcagatcatcctggaggaccagaactgcaagctggccaaggaaaagaaactgctggaagacagaatagctgagttcaccaccaacctcacagaagaggaggagaaatctaagagcctcgccaagctcaagaacaagcatgaggcaatgatcactgacttggaagagcgcctccgcagggaggagaagcagcgacaggagctggagaagacccgccggaagctggagggagactccacagacctcagcgaccagatcgccgagctccaggcccagatcgcggagctcaagatgcagctggccaagaaagaggaggagctccaggccgccctggccagagtggaagaggaagctgcccagaagaacatggccctcaagaagatccgggagctggaatctcagatctctgaactccaggaagacctggagtctgagcgtgcttccaggaataaagctgagaagcagaaacgggaccttggggaagagctagaggcgctgaaaacagagttggaggacacgctggattccacagctgcccagcaggagctcaggtcaaaacgtgagcaggaggtgaacatcctgaagaagaccctggaggaggaggccaagacccacgaggcccagatccaggagatgaggcagaagcactcacaggccgtggaggagctggcggagcagctggagcagacgaagcgggtgaaagcaaacctcgagaaggcaaagcagactctggagaacgagcggggggagctggccaacgaggtgaaggtgctgctgcagggcaaaggggactcggagcacaagcgcaagaaagtggaggcgcagctgcaggagctgcaggtcaagttcaacgagggagagcgcgtgcgcacagagctggccgacaaggtcaccaagctgcaggtggagctggacaacgtgaccgggcttctcagccagtccgacagcaagtccagcaagctcaccaaggacttctccgcgctggagtcccagctgcaggacactcaggagctgctgcaggaggagaaccggcagaagctgagcctgagcaccaagctcaagcaggtggaggacgagaagaattccttccgggagcagctggaggaggaggaggaggccaagcacaacctggagaagcagatcgccaccctccatgcccaggtggccgacatgaaaaagaagatggaggacagtgtggggtgcctggaaactgctgaggaggtgaagaggaagctccagaaggacctggagggcctgagccagcggcacgaggagaaggtggccgcctacgacaagctggagaagaccaagacgcggctgcagcaggagctggacgacctgctggtggacctggaccaccagcgccagagcgcgtgcaacctggagaagaagcagaagaagtttgaccagctcctggcggaggagaagaccatctctgccaagtatgcagaggagcgcgaccgggctgaggcggaggcccgagagaaggagaccaaggctctgtcgctggcccgggccctggaggaagccatggagcagaaggcggagctggagcggctcaacaagcagttccgcacggagatggaggaccttatgagctccaaggatgatgtgggcaagagtgtccacgagctggagaagtccaagcgggccctagagcagcaggtggaggagatgaagacgcagctggaagagctggaggacgagctgcaggccaccgaagatgccaagctgcggttggaggtcaacctgcaggccatgaaggcccagttcgagcgggacctgcagggccgggacgagcagagcgaggagaagaagaagcagctggtcagacaggtgcgggagatggaggcagagctggaggacgagaggaagcagcgctcgatggcagtggccgcccggaagaagctggagatggacctgaaggacctggaggcgcacatcgactcggccaacaagaaccgggacgaagccatcaaacagctgcggaagctgcaggcccagatgaaggactgcatgcgcgagctggatgacacccgcgcctctcgtgaggagatcctggcccaggccaaagagaacgagaagaagctgaagagcatggaggccgagatgatccagttgcaggaggaactggcagccgcggagcgtgccaagcgccaggcccagcaggagcgggatgagctggctgacgagatcgccaacagcagcggcaaaggagccctggcgttagaggagaagcggcgtctggaggcccgcatcgcccagctggaggaggagctggaggaggagcagggcaacacggagctgatcaacgaccggctgaagaaggccaacctgcagatcgaccagatcaacaccgacctgaacctggagcgcagccacgcccagaagaacgagaatgctcggcagcagctggaacgccagaacaaggagcttaaggtcaagctgcaggagatggagggcactgtcaagtccaagtacaaggcctccatcaccgccctcgaggccaagattgcacagctggaggagcagctggacaacgagaccaaggagcgccaggcagcctgcaaacaggtgcgtcggaccgagaagaagctgaaggatgtgctgctgcaggtggatgacgagcggaggaacgccgagcagtacaaggaccaggccgacaaggcatctacccgcctgaagcagctcaagcggcagctggaggaggccgaagaggaggcccagcgggccaacgcctcccgccggaaactgcagcgcgagctggaggacgccactgagacggccgatgccatgaaccgcgaagtcagctccctaaagaacaagctcaggcgcggggacctgccgtttgtcgtgccccgccgaatggcccggaaaggcgccggggatggctccgacgaagaggtagatggcaaagcggatggggctgaggccaaacctgccgaataagcctcttctcctgcagcctgagatggatggacagacagacaccacagcctccccttcccagaccccgcagcacgcctctccccaccttcttgggactgctgtgaacatgcctcctcctgccctccgccccgtccccccatcccgtttccctccaggtgttgttgagggcatttggcttcctctgctgcatccccttccagctccctcccctgctcagaatctgataccaaagagacagggcccgggcccaggcagagagcgaccagcaggctcctcagccctctcttgccaaaaagcacaagatgttgaggcgagcagggcaggcccccggggaggggccagagttttctatgaatctatttttcttcagactgaggccttttggtagtcggagcccccgcagtcgtcagcctccctgacgtctgccaccagcgcccccactcctcctcctttctttgctgtttgcaatcacacgtggtgacctcacacacctctgccccttgggcctcccactcccatggctctgggcggtccagaaggagcaggccctgggcctccacctctgtgcagggcacagaaggctggggtggggggaggagtggattcctccccaccctgtcccaggcagcgccactgtccgctgtctccctcctgattctaaaatgtctcaagtgcaatgccccctcccctcctttaccgaggacagcctgcctctgccacagcaaggctgtcggggtcaagctggaaaggccagcagccttccagtggcttctcccaacactcttggggaccaaatatatttaatggttaagggacttgtcccaagtctgacagccagagcgttagaggggccagcggccctcccaggcgatcttgtgtctactctaggactgggcccgagggtggtttacctgcaccgttgactcagtatagtttaaaaatctgccacctgcacaggtatttttgaaagcaaaataaggttttcttttttcccctttcttgtaataaatgataaaattccgagtctttctcactgcctttgtttagaagagagtagctcgtcctcactggtctacactggttgccgaatttacttgtattcctaactgttttgtatatgctgcattgagacttacggcaagaaggcattttttttttttaaaggaaacaaactctcaatgtgtgaaatgtgtattacgctagcagtatggctatcagagcgtatggggagtcctctagag

SEQ ID NO: 314096 - DNA, 6462 bp, Homo sapiens
cccgatattcggtcagtgggtgatagcaaaacctcgggtacgccaagaccgtgaagaatgacgaactcctcccgcttcggcaaattcattcgcatcaactttgatgtcaatggctacattgttggagccaacattgagacttatcttttggagaaatctcgtgctatccgccaagccaaggaagaacggaccttccacatcttctattatctcctgtctggggctggagagcacctgaagaccgatctcctgttggagccgtacaacaaataccgcttcctgtccaatggacacgtcaccatccccgggcagcaggacaaggacatgttccaggagaccatggaggccatgaggattatgggcatcccagaagaggagcaaatgggcctgctgcgggtcatctcaggggttcttcagctcggcaacatcgtcttcaagaaggagcggaacactgaccaggcgtccatgcccgacaacacagctgcccaaaaggtgtcccatctcttgggtatcaatgtgaccgatttcaccagaggaatcctcaccccgcgcatcaaggtgggacgggattacgtccagaaggcgcagactaaagagcaggctgactttgccatcgaggccttggccaaggcgacctatgagcggatgttccgctggctggtgctgcgcatcaacaaggctctggacaagaccaagaggcagggcgcctccttcatcgggatcctggacattgccggcttcgagatctttgatctgaactcgtttgagcagctgtgcatcaattacaccaatgagaagctgcagcagctcttcaaccacaccatgttcatcctggagcaggaggagtaccagcgcgagggcatcgagtggaacttcatcgactttggcctcgacctgcagccctgcatcgacctcattgagaagccagcaggccccccgggcattctggccctgctggacgaggagtgctggttccccaaagccaccgacaagagcttcgtggagaaggtgatgcaggagcagggcacccaccccaagttccagaagcccaagcagctgaaggacaaagctgatttctgcattatccactatgccggcaaggtggattacaaagctgacgagtggctgatgaagaacatggatcccctgaatgacaacatcgccacactgctccaccagtcctctgacaagtttgtctcggagctgtggaaggatgtggaccgcatcatcggcctggaccaggtggccggcatgtcggagaccgcactgcccggggccttcaagacgcggaagggcatgttccgcactgtggggcagctttacaaggagcagctggccaagctgatggctacgctgaggaacacgaaccccaactttgtccgctgcatcatccccaaccacgagaagaaggccggcaagctggacccgcatctcgtgctggaccagctgcgctgcaacggtgttctcgagggcatccgtatctgccgccagggcttccccaacagggtggtcttccaggagtttcggcagagatatgagatcctgactccaaactccattcccaagggtttcatggacgggaagcaggcgtgcgtgctcatgataaaagccctggagctcgacagcaatctgtaccgcattggccagagcaaagtcttcttccgtgccggtgtgctggcccacctggaggaggagcgagacctgaagatcaccgacgtcatcatagggttccaggcctgctgcaggggctacctggccaggaaagcatttgccaagcggcagcagcagcttaccgccatgaaggtcctccagcggaactgcgctgcctacctgaagctgcggaactggcagtggtggcggctcttcaccaaggtcaagccgctgctgcaggtgagccggcaggaggaggagatgatggccaaggaggaggagctggtgaaggtcagagagaagcagctggctgcggagaacaggctcacggagatggagacgctgcagtctcagctcatggcagagaaattgcagctgcaggagcagctccaggcagaaaccgagctgtgtgccgaggctgaggagctccgggcccgcctgaccgccaagaagcaggaattagaagagatctgccatgacctagaggccagggtggaggaggaggaggagcgctgccagcacctgcaggcggagaagaagaagatgcagcagaacatccaggagcttgaggagcagctggaggaggaggagagcgcccggcagaagctgcagctggagaaggtgaccaccgaggcgaagctgaaaaagctggaggaggagcagatcatcctggaggaccagaactgcaagctggccaaggaaaagaaactgctggaagacagaatagctgagttcaccaccaacctcacagaagaggaggagaaatctaagagcctcgccaagctcaagaacaagcatgaggcaatgatcactgacttggaagagcgcctccgcagggaggagaagcagcgacaggagctggagaagacccgccggaagctggagggagactccacagacctcagcgaccagatcgccgagctccaggcccagatcgcggagctcaagatgcagctggccaagaaagaggaggagctccaggccgccctggccagagtggaagaggaagctgcccagaagaacatggccctcaagaagatccgggagctggaatctcagatctctgaactccaggaagacctggagtctgagcgtgcttccaggaataaagctgagaagcagaaacgggaccttggggaagagctagaggcgctgaaaacagagttggaggacacgctggattccacagctgcccagcaggagctcaggtcaaaacgtgagcaggaggtgaacatcctgaagaagaccctggaggaggaggccaagacccacgaggcccagatccaggagatgaggcagaagcactcacaggccgtggaggagctggcggagcagctggagcagacgaagcgggtgaaagcaaacctcgagaaggcaaagcagactctggagaacgagcggggggagctggccaacgaggtgaaggtgctgctgcagggcaaaggggactcggagcacaagcgcaagaaagtggaggcgcagctgcaggagctgcaggtcaagttcaacgagggagagcgcgtgcgcacagagctggccgacaaggtcaccaagctgcaggtggagctggacaacgtgaccgggcttctcagccagtccgacagcaagtccagcaagctcaccaaggacttctccgcgctggagtcccagctgcaggacactcaggagctgctgcaggaggagaaccggcagaagctgagcctgagcaccaagctcaagcaggtggaggacgagaagaattccttccgggagcagctggaggaggaggaggaggccaagcacaacctggagaagcagatcgccaccctccatgcccaggtggccgacatgaaaaagaagatggaggacagtgtggggtgcctggaaactgctgaggaggtgaagaggaagctccagaaggacctggagggcctgagccagcggcacgaggagaaggtggccgcctacgacaagctggagaagaccaagacgcggctgcagcaggagctggacgacctgctggtggacctggaccaccagcgccagagcgcgtgcaacctggagaagaagcagaagaagtttgaccagctcctggcggaggagaagaccatctctgccaagtatgcagaggagcgcgaccgggctgaggcggaggcccgagagaaggagaccaaggctctgtcgctggcccgggccctggaggaagccatggagcagaaggcggagctggagcggctcaacaagcagttccgcacggagatggaggaccttatgagctccaaggatgatgtgggcaagagtgtccacgagctggagaagtccaagcgggccctagagcagcaggtggaggagatgaagacgcagctggaagagctggaggacgagctgcaggccaccgaagatgccaagctgcggttggaggtcaacctgcaggccatgaaggcccagttcgagcgggacctgcagggccgggacgagcagagcgaggagaagaagaagcagctggtcagacaggtgcgggagatggaggcagagctggaggacgagaggaagcagcgctcgatggcagtggccgcccggaagaagctggagatggacctgaaggacctggaggcgcacatcgactcggccaacaagaaccgggacgaagccatcaaacagctgcggaagctgcaggcccagatgaaggactgcatgcgcgagctggatgacacccgcgcctctcgtgaggagatcctggcccaggccaaagagaacgagaagaagctgaagagcatggaggccgagatgatccagttgcaggaggaactggcagccgcggagcgtgccaagcgccaggcccagcaggagcgggatgagctggctgacgagatcgccaacagcagcggcaaaggagccctggcgttagaggagaagcggcgtctggaggcccgcatcgcccagctggaggaggagctggaggaggagcagggcaacacggagctgatcaacgaccggctgaagaaggccaacctgcagatcgaccagatcaacaccgacctgaacctggagcgcagccacgcccagaagaacgagaatgctcggcagcagctggaacgccagaacaaggagcttaaggtcaagctgcaggagatggagggcactgtcaagtccaagtacaaggcctccatcaccgccctcgaggccaagattgcacagctggaggagcagctggacaacgagaccaaggagcgccaggcagcctgcaaacaggtgcgtcggaccgagaagaagctgaaggatgtgctgctgcaggtggatgacgagcggaggaacgccgagcagtacaaggaccaggccgacaaggcatctacccgcctgaagcagctcaagcggcagctggaggaggccgaagaggaggcccagcgggccaacgcctcccgccggaaactgcagcgcgagctggaggacgccactgagacggccgatgccatgaaccgcgaagtcagctccctaaagaacaagctcaggcgcggggacctgccgtttgtcgtgccccgccgaatggcccggaaaggcgccggggatggctccgacgaagaggtagatggcaaagcggatggggctgaggccaaacctgccgaataagcctcttctcctgcagcctgagatggatggacagacagacaccacagcctccccttcccagaccccgcagcacgcctctccccaccttcttgggactgctgtgaacatgcctcctcctgccctccgccccgtccccccatcccgtttccctccaggtgttgttgagggcatttggcttcctctgctgcatccccttccagctccctcccctgctcagaatctgataccaaagagacagggcccgggcccaggcagagagcgaccagcaggctcctcagccctctcttgccaaaaagcacaagatgttgaggcgagcagggcaggcccccggggaggggccagagttttctatgaatctatttttcttcagactgaggccttttggtagtcggagcccccgcagtcgtcagcctccctgacgtctgccaccagcgcccccactcctcctcctttctttgctgtttgcaatcacacgtggtgacctcacacacctctgccccttgggcctcccactcccatggctctgggcggtccagaaggagcaggccctgggcctccacctctgtgcagggcacagaaggctggggtggggggaggagtggattcctccccaccctgtcccaggcagcgccactgtccgctgtctccctcctgattctaaaatgtctcaagtgcaatgccccctcccctcctttaccgaggacagcctgcctctgccacagcaaggctgtcggggtcaagctggaaaggccagcagccttccagtggcttctcccaacactcttggggaccaaatatatttaatggttaagggacttgtcccaagtctgacagccagagcgttagaggggccagcggccctcccaggcgatcttgtgtctactctaggactgggcccgagggtggtttacctgcaccgttgactcagtatagtttaaaaatctgccacctgcacaggtatttttgaaagcaaaataaggttttcttttttcccctttcttgtaataaatgataaaattccgagtctttctcactgcctttgtttagaagagagtagctcgtcctcactggtctacactggttgccgaatttacttgtattcctaactgttttgtatatgctgcattgagacttacggcaagaaggcattttttttttttttttattttttttttttttttttgtgggggggggtggggggggggg

SEQ ID NO: 314097 - DNA, 6575 bp, Homo sapiens
cccgatattcggtcagtgggtgatagcaaaacctcgggtacgccaagaccgtgaagaatgacgaactcctcccgcttcggcaaattcattcgcatcaactttgatgtcaatggctacattgttggagccaacattgagacttatcttttggagaaatctcgtgctatccgccaagccaaggaagaacggaccttccacatcttctattatctcctgtctggggctggagagcacctgaagaccgatctcctgttggagccgtacaacaaataccgcttcctgtccaatggacacgtcaccatccccgggcagcaggacaaggacatgttccaggagaccatggaggccatgaggattatgggcatcccagaagaggagcaaatgggcctgctgcgggtcatctcaggggttcttcagctcggcaacatcgtcttcaagaaggagcggaacactgaccaggcgtccatgcccgacaacacagctgcccaaaaggtgtcccatctcttgggtatcaatgtgaccgatttcaccagaggaatcctcaccccgcgcatcaaggtgggacgggattacgtccagaaggcgcagactaaagagcaggctgactttgccatcgaggccttggccaaggcgacctatgagcggatgttccgctggctggtgctgcgcatcaacaaggctctggacaagaccaagaggcagggcgcctccttcatcgggatcctggacattgccggcttcgagatctttgatctgaactcgtttgagcagctgtgcatcaattacaccaatgagaagctgcagcagctcttcaaccacaccatgttcatcctggagcaggaggagtaccagcgcgagggcatcgagtggaacttcatcgactttggcctcgacctgcagccctgcatcgacctcattgagaagccagcaggccccccgggcattctggccctgctggacgaggagtgctggttccccaaagccaccgacaagagcttcgtggagaaggtgatgcaggagcagggcacccaccccaagttccagaagcccaagcagctgaaggacaaagctgatttctgcattatccactatgccggcaaggtggattacaaagctgacgagtggctgatgaagaacatggatcccctgaatgacaacatcgccacactgctccaccagtcctctgacaagtttgtctcggagctgtggaaggatgtggaccgcatcatcggcctggaccaggtggccggcatgtcggagaccgcactgcccggggccttcaagacgcggaagggcatgttccgcactgtggggcagctttacaaggagcagctggccaagctgatggctacgctgaggaacacgaaccccaactttgtccgctgcatcatccccaaccacgagaagaaggccggcaagctggacccgcatctcgtgctggaccagctgcgctgcaacggtgttctcgagggcatccgtatctgccgccagggcttccccaacagggtggtcttccaggagtttcggcagagatatgagatcctgactccaaactccattcccaagggtttcatggacgggaagcaggcgtgcgtgctcatgataaaagccctggagctcgacagcaatctgtaccgcattggccagagcaaagtcttcttccgtgccggtgtgctggcccacctggaggaggagcgagacctgaagatcaccgacgtcatcatagggttccaggcctgctgcaggggctacctggccaggaaagcatttgccaagcggcagcagcagcttaccgccatgaaggtcctccagcggaactgcgctgcctacctgaagctgcggaactggcagtggtggcggctcttcaccaaggtcaagccgctgctgcaggtgagccggcaggaggaggagatgatggccaaggaggaggagctggtgaaggtcagagagaagcagctggctgcggagaacaggctcacggagatggagacgctgcagtctcagctcatggcagagaaattgcagctgcaggagcagctccaggcagaaaccgagctgtgtgccgaggctgaggagctccgggcccgcctgaccgccaagaagcaggaattagaagagatctgccatgacctagaggccagggtggaggaggaggaggagcgctgccagcacctgcaggcggagaagaagaagatgcagcagaacatccaggagcttgaggagcagctggaggaggaggagagcgcccggcagaagctgcagctggagaaggtgaccaccgaggcgaagctgaaaaagctggaggaggagcagatcatcctggaggaccagaactgcaagctggccaaggaaaagaaactgctggaagacagaatagctgagttcaccaccaacctcacagaagaggaggagaaatctaagagcctcgccaagctcaagaacaagcatgaggcaatgatcactgacttggaagagcgcctccgcagggaggagaagcagcgacaggagctggagaagacccgccggaagctggagggagactccacagacctcagcgaccagatcgccgagctccaggcccagatcgcggagctcaagatgcagctggccaagaaagaggaggagctccaggccgccctggccagagtggaagaggaagctgcccagaagaacatggccctcaagaagatccgggagctggaatctcagatctctgaactccaggaagacctggagtctgagcgtgcttccaggaataaagctgagaagcagaaacgggaccttggggaagagctagaggcgctgaaaacagagttggaggacacgctggattccacagctgcccagcaggagctcaggtcaaaacgtgagcaggaggtgaacatcctgaagaagaccctggaggaggaggccaagacccacgaggcccagatccaggagatgaggcagaagcactcacaggccgtggaggagctggcggagcagctggagcagacgaagcgggtgaaagcaaacctcgagaaggcaaagcagactctggagaacgagcggggggagctggccaacgaggtgaaggtgctgctgcagggcaaaggggactcggagcacaagcgcaagaaagtggaggcgcagctgcaggagctgcaggtcaagttcaacgagggagagcgcgtgcgcacagagctggccgacaaggtcaccaagctgcaggtggagctggacaacgtgaccgggcttctcagccagtccgacagcaagtccagcaagctcaccaaggacttctccgcgctggagtcccagctgcaggacactcaggagctgctgcaggaggagaaccggcagaagctgagcctgagcaccaagctcaagcaggtggaggacgagaagaattccttccgggagcagctggaggaggaggaggaggccaagcacaacctggagaagcagatcgccaccctccatgcccaggtggccgacatgaaaaagaagatggaggacagtgtggggtgcctggaaactgctgaggaggtgaagaggaagctccagaaggacctggagggcctgagccagcggcacgaggagaaggtggccgcctacgacaagctggagaagaccaagacgcggctgcagcaggagctggacgacctgctggtggacctggaccaccagcgccagagcgcgtgcaacctggagaagaagcagaagaagtttgaccagctcctggcggaggagaagaccatctctgccaagtatgcagaggagcgcgaccgggctgaggcggaggcccgagagaaggagaccaaggctctgtcgctggcccgggccctggaggaagccatggagcagaaggcggagctggagcggctcaacaagcagttccgcacggagatggaggaccttatgagctccaaggatgatgtgggcaagagtgtccacgagctggagaagtccaagcgggccctagagcagcaggtggaggagatgaagacgcagctggaagagctggaggacgagctgcaggccaccgaagatgccaagctgcggttggaggtcaacctgcaggccatgaaggcccagttcgagcgggacctgcagggccgggacgagcagagcgaggagaagaagaagcagctggtcagacaggtgcgggagatggaggcagagctggaggacgagaggaagcagcgctcgatggcagtggccgcccggaagaagctggagatggacctgaaggacctggaggcgcacatcgactcggccaacaagaaccgggacgaagccatcaaacagctgcggaagctgcaggcccagatgaaggactgcatgcgcgagctggatgacacccgcgcctctcgtgaggagatcctggcccaggccaaagagaacgagaagaagctgaagagcatggaggccgagatgatccagttgcaggaggaactggcagccgcggagcgtgccaagcgccaggcccagcaggagcgggatgagctggctgacgagatcgccaacagcagcggcaaaggagccctggcgttagaggagaagcggcgtctggaggcccgcatcgcccagctggaggaggagctggaggaggagcagggcaacacggagctgatcaacgaccggctgaagaaggccaacctgcagatcgaccagatcaacaccgacctgaacctggagcgcagccacgcccagaagaacgagaatgctcggcagcagctggaacgccagaacaaggagcttaaggtcaagctgcaggagatggagggcactgtcaagtccaagtacaaggcctccatcaccgccctcgaggccaagattgcacagctggaggagcagctggacaacgagaccaaggagcgccaggcagcctgcaaacaggtgcgtcggaccgagaagaagctgaaggatgtgctgctgcaggtggatgacgagcggaggaacgccgagcagtacaaggaccaggccgacaaggcatctacccgcctgaagcagctcaagcggcagctggaggaggccgaagaggaggcccagcgggccaacgcctcccgccggaaactgcagcgcgagctggaggacgccactgagacggccgatgccatgaaccgcgaagtcagctccctaaagaacaagctcaggcgcggggacctgccgtttgtcgtgccccgccgaatggcccggaaaggcgccggggatggctccgacgaagaggtagatggcaaagcggatggggctgaggccaaacctgccgaataagcctcttctcctgcagcctgagatggatggacagacagacaccacagcctccccttcccagaccccgcagcacgcctctccccaccttcttgggactgctgtgaacatgcctcctcctgccctccgccccgtccccccatcccgtttccctccaggtgttgttgagggcatttggcttcctctgctgcatccccttccagctccctcccctgctcagaatctgataccaaagagacagggcccgggcccaggcagagagcgaccagcaggctcctcagccctctcttgccaaaaagcacaagatgttgaggcgagcagggcaggcccccggggaggggccagagttttctatgaatctatttttcttcagactgaggccttttggtagtcggagcccccgcagtcgtcagcctccctgacgtctgccaccagcgcccccactcctcctcctttctttgctgtttgcaatcacacgtggtgacctcacacacctctgtgcagggcacagaaggctggggtggggggaggagtggattcctccccaccctgtcccaggcagcgccactgtccgctgtctccctcctgattctaaaatgtctcaagtgcaatgccccctcccctcctttaccgaggacagcctgcctctgccacagcaaggctgtcggggtcaagctggaaaggccagcagccttccagtggcttctcccaacactcttggggaccaaatatatttaatggttaagggacttgtcccaagtctgacagccagagcgttagaggggccagcggccctcccaggcgatcttgtgtctactctaggactgggcccgagggtggtttacctgcaccgttgactcagtatagtttaaaaatctgccacctgcacaggtatttttgaaagcaaaataaggttttcttttttcccctttcttgtaataaatgataaaattccgagtctttctcactgcctttgtttagaagagagtagctcgtcctcactggtctacactggttgccgaatttacttgtattcctaactgttttgtatatgctgcattgagacttacggcaagaaggcattttttttttttaaaggaaacaaactctcaaatcatgaagtgatataaaagctgcatatgcctacaaagctctgaattcaggtcccagttgctgtcacaaaggagtgagtgaaactcccaccctacccccttttttatataataaaagtgccttagcatgtgttgcagctgtcaccactacagtaagctggtttacagatgttttccactgagcatcacaataaagagaaccatgtgcta

SEQ ID NO: 314098 - DNA, 3845 bp, Homo sapiens
  misc_feature (38)..(38): n is a, c, g, or t
tgctgcagtgtgacttagaggatccccaacgatggtcntcagctgcagcaggagctcaggtcaaaacgtgagcaggaggtgaacatcctgaagaagaccctggaggaggaggccaagacccacgaggcccagatccaggagatgaggcagaagcactcacaggccgtggaggagctggcggagcagctggagcagacgaagcgggtgaaagcaaacctcgagaaggcaaagcagactctggagaacgagcggggggagctggccaacgaggtgaaggtgctgctgcagggcaaaggggactcggagcacaagcgcaagaaagtggaggcgcagctgcaggagctgcaggtcaagttcaacgagggagagcgcgtgcgcacagagctggccgacaaggtcaccaagctgcaggtggagctggacaacgtgaccgggcttctcagccagtccgacagcaagtccagcaagctcaccaaggacttctccgcgctggagtcccagctgcaggacactcaggagctgctgcaggaggagaaccggcagaagctgagcctgagcaccaagctcaagcaggtggaggacgagaagaattccttccgggagcagctggaggaggaggaggaggccaagcacaacctggagaagcagatcgccaccctccatgcccaggtggccgacatgaaaaagaagatggaggacagtgtggggtgcctggaaactgctgaggaggtgaagaggaagctccagaaggacctggagggcctgagccagcggcacgaggagaaggtggccgcctacgacaagctggagaagaccaagacgcggctgcagcaggagctggacgacctgctggtggacctggaccaccagcgccagagcgcgtgcaacctggagaagaagcagaagaagtttgaccagctcctggcggaggagaagaccatctctgccaagtatgcagaggagcgcgaccgggctgaggcggaggcccgagagaaggagaccaaggctctgtcgctggcccgggccctggaggaagccatggagcagaaggcggagctggagcggctcaacaagcagttccgcacggagatggaggaccttatgagctccaaggatgatgtgggcaagagtgtccacgagctggagaagtccaagcgggccctagagcagcaggtggaggagatgaagacgcagctggaagagctggaggacgagctgcaggccaccgaagatgccaagctgcggttggaggtcaacctgcaggccatgaaggcccagttcgagcgggacctgcagggccgggacgagcagagcgaggagaagaagaagcagctggtcagacaggtgcgggagatggaggcagagctggaggacgagaggaagcagcgctcgatggcagtggccgcccggaagaagctggagatggacctgaaggacctggaggcgcacatcgactcggccaacaagaaccgggacgaagccatcaaacagctgcggaagctgcaggcccagatgaaggactgcatgcgcgagctggatgacacccgcgcctctcgtgaggagatcctggcccaggccaaagagaacgagaagaagctgaagagcatggaggccgagatgatccagttgcaggaggaactggcagccgcggagcgtgccaagcgccaggcccagcaggagcgggatgagctggctgacgagatcgccaacagcagcggcaaaggagccctggcgttagaggagaagcggcgtctggaggcccgcatcgcccagctggaggaggagctggaggaggagcagggcaacacggagctgatcaacgaccggctgaagaaggccaacctgcagatcgaccagatcaacaccgacctgaacctggagcgcagccacgcccagaagaacgagaatgctcggcagcagctggaacgccagaacaaggagcttaaggtcaagctgcaggagatggagggcactgtcaagtccaagtacaaggcctccatcaccgccctcgaggccaagattgcacagctggaggagcagctggacaacgagaccaaggagcgccaggcagcctgcaaacaggtgcgtcggaccgagaagaagctgaaggatgtgctgctgcaggtggatgacgagcggaggaacgccgagcagtacaaggaccaggccgacaaggcatctacccgcctgaagcagctcaagcggcagctggaggaggccgaagaggaggcccagcgggccaacgcctcccgccggaaactgcagcgcgagctggaggacgccactgagacggccgatgccatgaaccgcgaagtcagctccctaaagaacaagctcaggcgcggggacctgccgtttgtcgtgccccgccgaatggcccggaaaggcgccggggatggctccgacgaagaggtagatggcaaagcggatggggctgaggccaaacctgccgaataagcctcttctcctgcagcctgagatggatggacagacagacaccacagcctccccttcccagaccccgcagcacgcctctccccaccttcttgggactgctgtgaacatgcctcctcctgccctccgccccgtccccccatcccgtttccctccaggtgttgttgagggcatttggcttcctctgctgcatccccttccagctccctcccctgctcagaatctgataccaaagagacagggcccgggcccaggcagagagcgaccagcaggctcctcagccctctcttgccaaaaagcacaagatgttgaggcgagcagggcaggcccccggggaggggccagagttttctatgaatctatttttcttcagactgaggccttttggtagtcggagcccccgcagtcgtcagcctccctgacgtctgccaccagcgcccccactcctcctcctttctttgctgtttgcaatcacacgtggtgacctcacacacctctgccccttgggcctcccactcccatggctctgggcggtccagaaggagcaggccctgggcctccacctctgtgcagggcacagaaggctggggtggggggaggagtggattcctccccaccctgtcccaggcagcgccactgtccgctgtctccctcctgattctaaaatgtctcaagtgcaatgccccctcccctcctttaccgaggacagcctgcctctgccacagcaaggctgtcggggtcaagctggaaaggccagcagccttccagtggcttctcccaacactcttggggaccaaatatatttaatggttaagggacttgtcccaagtctgacagccagagcgttagaggggccagcggccctcccaggcgatcttgtgtctactctaggactgggcccgagggtggtttacctgcaccgttgactcagtatagtttaaaaatctgccacctgcacaggtatttttgaaagcaaaataaggttttcttttttcccctttcttgtaataaatgataaaattccgagtctttctcactgcctttgtttagaagagagtagctcgtcctcactggtctacactggttgccgaatttacttgtattcctaactgttttgtatatgctgcattgagacttacggcaagaaggcattttttttttttaaaggaaacaaactctcaaatcatgaagtgatataaaagctgcatatgcctacaaagctctgaattcaggtcccagttgctgtcacaaaggagtgagtgaaactcccaccctacccccttttttatataataaaagtgccttagcatgtgttgcagctgtcaccactacagtaagctggtttacagatgttttccactgagcatcacaataaagagaaccatgtgcta

SEQ ID NO: 314099 - DNA, 4282 bp, Homo sapiens
tcctgctgctgctgcagtgtacacgaaagaggaggagctccaggccgcctggcagagtggaagaggaagctgcccagaagaacatggccctcaagaagatccgggagctggaatctcagatctctgaactccaggaagacctggagtctgagcgtgcttccaggaataaagctgagaagcagaaacgggaccttggggaagagctagaggcgctgaaaacagagttggaggacacgctggattccacagctgcccagcaggagctcaggtcaaaacgtgagcaggaggtgaacatcctgaagaagaccctggaggaggaggccaagacccacgaggcccagatccaggagatgaggcagaagcactcacaggccgtggaggagctggcggagcagctggagcagacgaagcgggtgaaagcaaacctcgagaaggcaaagcagactctggagaacgagcggggggagctggccaacgaggtgaaggtgctgctgcagggcaaaggggactcggagcacaagcgcaagaaagtggaggcgcagctgcaggagctgcaggtcaagttcaacgagggagagcgcgtgcgcacagagctggccgacaaggtcaccaagctgcaggtgaggcctccgccaggaccctggtgcgggcagtgggccctagcagcagttgtggcccaggtccccaggtgcatgtgtgctctctgtctctctctcttctcaaactggctcgtcagaccctcatggttcagcttgtgactcaggtccagctttacctaaaggagatgaggtggggcaggagcagtgggggtgggtccatggtcctttgtgtctccccgcccggtgcaggtggagctggacaacgtgaccgggcttctcagccagtccgacagcaagtccagcaagctcaccaaggacttctccgcgctggagtcccagctgcaggacactcaggagctgctgcaggaggagaaccggcagaagctgagcctgagcaccaagctcaagcaggtggaggacgagaagaattccttccgggagcagctggaggaggaggaggaggccaagcacaacctggagaagcagatcgccaccctccatgcccaggtggccgacatgaaaaagaagatggaggacagtgtggggtgcctggaaactgctgaggaggtgaagaggaagctccagaaggacctggagggcctgagccagcggcacgaggagaaggtggccgcctacgacaagctggagaagaccaagacgcggctgcagcaggagctggacgacctgctggtggacctggaccaccagcgccagagcgcgtgcaacctggagaagaagcagaagaagtttgaccagctcctggcggaggagaagaccatctctgccaagtatgcagaggagcgcgaccgggctgaggcggaggcccgagagaaggagaccaaggctctgtcgctggcccgggccctggaggaagccatggagcagaaggcggagctggagcggctcaacaagcagttccgcacggagatggaggaccttatgagctccaaggatgatgtgggcaagagtgtccacgagctggagaagtccaagcgggccctagagcagcaggtggaggagatgaagacgcagctggaagagctggaggacgagctgcaggccaccgaagatgccaagctgcggttggaggtcaacctgcaggccatgaaggcccagttcgagcgggacctgcagggccgggacgagcagagcgaggagaagaagaagcagctggtcagacaggtgcgggagatggaggcagagctggaggacgagaggaagcagcgctcgatggcagtggccgcccggaagaagctggagatggacctgaaggacctggaggcgcacatcgactcggccaacaagaaccgggacgaagccatcaaacagctgcggaagctgcaggcccagatgaaggactgcatgcgcgagctggatgacacccgcgcctctcgtgaggagatcctggcccaggccaaagagaacgagaagaagctgaagagcatggaggccgagatgatccagttgcaggaggaactggcagccgcggagcgtgccaagcgccaggcccagcaggagcgggatgagctggctgacgagatcgccaacagcagcggcaaaggagccctggcgttagaggagaagcggcgtctggaggcccgcatcgcccagctggaggaggagctggaggaggagcagggcaacacggagctgatcaacgaccggctgaagaaggccaacctgcagatcgaccagatcaacaccgacctgaacctggagcgcagccacgcccagaagaacgagaatgctcggcagcagctggaacgccagaacaaggagcttaaggtcaagctgcaggagatggagggcactgtcaagtccaagtacaaggcctccatcaccgccctcgaggccaagattgcacagctggaggagcagctggacaacgagaccaaggagcgccaggcagcctgcaaacaggtgcgtcggaccgagaagaagctgaaggatgtgctgctgcaggtggatgacgagcggaggaacgccgagcagtacaaggaccaggccgacaaggcatctacccgcctgaagcagctcaagcggcagctggaggaggccgaagaggaggcccagcgggccaacgcctcccgccggaaactgcagcgcgagctggaggacgccactgagacggccgatgccatgaaccgcgaagtcagctccctaaagaacaagctcaggcgcggggacctgccgtttgtcgtgccccgccgaatggcccggaaaggcgccggggatggctccgacgaagaggtagatggcaaagcggatggggctgaggccaaacctgccgaataagcctcttctcctgcagcctgagatggatggacagacagacaccacagcctccccttcccagaccccgcagcacgcctctccccaccttcttgggactgctgtgaacatgcctcctcctgccctccgccccgtccccccatcccgtttccctccaggtgttgttgagggcatttggcttcctctgctgcatccccttccagctccctcccctgctcagaatctgataccaaagagacagggcccgggcccaggcagagagcgaccagcaggctcctcagccctctcttgccaaaaagcacaagatgttgaggcgagcagggcaggcccccggggaggggccagagttttctatgaatctatttttcttcagactgaggccttttggtagtcggagcccccgcagtcgtcagcctccctgacgtctgccaccagcgcccccactcctcctcctttctttgctgtttgcaatcacacgtggtgacctcacacacctctgccccttgggcctcccactcccatggctctgggcggtccagaaggagcaggccctgggcctccacctctgtgcagggcacagaaggctggggtggggggaggagtggattcctccccaccctgtcccaggcagcgccactgtccgctgtctccctcctgattctaaaatgtctcaagtgcaatgccccctcccctcctttaccgaggacagcctgcctctgccacagcaaggctgtcggggtcaagctggaaaggccagcagccttccagtggcttctcccaacactcttggggaccaaatatatttaatggttaagggacttgtcccaagtctgacagccagagcgttagaggggccagcggccctcccaggcgatcttgtgtctactctaggactgggcccgagggtggtttacctgcaccgttgactcagtatagtttaaaaatctgccacctgcacaggtatttttgaaagcaaaataaggttttcttttttcccctttcttgtaataaatgataaaattccgagtctttctcactgcctttgtttagaagagagtagctcgtcctcactggtctacactggttgccgaatttacttgtattcctaactgttttgtatatgctgcattgagacttacggcaagaaggcattttttttttttaaaggaaacaaactctcaaatcatgaagtgatataaaagctgcatatgcctacaaagctctgaattcaggtcccagttgctgtcacaaaggagtgagtgaaactcccaccctacccccttttttatataataaaagtgccttagcatgtgttgcagctgtcaccactacagtaagctggtttacagatgttttccactgagcatcacaataaagagaaccatgtgcta

SEQ ID NO: 314100 - DNA, 2928 bp, Homo sapiens
tggcctgcaggttgacctccaaccgcagcttggcatcttcggtggcctgcagctcgtcctccagctcttccagctgcgtcttaccaaggctctgtcgctggcccgggccctggaggaagccatggagcagaaggcggagctggagcggctcaacaagcagttccgcacggagatggaggaccttatgagctccaaggatgatgtgggcaagagtgtccacgagctggagaagtccaagcgggccctagagcagcaggtggaggagatgaagacgcagctggaagagctggaggacgagctgcaggccaccgaagatgccaagctgcggttggaggtcaacctgcaggccatgaaggcccagttcgagcgggacctgcagggccgggacgagcagagcgaggagaagaagaagcagctggtcagacaggtgcgggagatggaggcagagctggaggacgagaggaagcagcgctcgatggcagtggccgcccggaagaagctggagatggacctgaaggacctggaggcgcacatcgactcggccaacaagaaccgggacgaagccatcaaacagctgcggaagctgcaggcccagatgaaggactgcatgcgcgagctggatgacacccgcgcctctcgtgaggagatcctggcccaggccaaagagaacgagaagaagctgaagagcatggaggccgagatgatccagttgcaggaggaactggcagccgcggagcgtgccaagcgccaggcccagcaggagcgggatgagctggctgacgagatcgccaacagcagcggcaaaggagccctggcgttagaggagaagcggcgtctggaggcccgcatcgcccagctggaggaggagctggaggaggagcagggcaacacggagctgatcaacgaccggctgaagaaggccaacctgcagatcgaccagatcaacaccgacctgaacctggagcgcagccacgcccagaagaacgagaatgctcggcagcagctggaacgccagaacaaggagcttaaggtcaagctgcaggagatggagggcactgtcaagtccaagtacaaggcctccatcaccgccctcgaggccaagattgcacagctggaggagcagctggacaacgagaccaaggagcgccaggcagcctgcaaacaggtgcgtcggaccgagaagaagctgaaggatgtgctgctgcaggtggatgacgagcggaggaacgccgagcagtacaaggaccaggccgacaaggcatctacccgcctgaagcagctcaagcggcagctggaggaggccgaagaggaggcccagcgggccaacgcctcccgccggaaactgcagcgcgagctggaggacgccactgagacggccgatgccatgaaccgcgaagtcagctccctaaagaacaagctcaggcgcggggacctgccgtttgtcgtgccccgccgaatggcccggaaaggcgccggggatggctccgacgaagaggtagatggcaaagcggatggggctgaggccaaacctgccgaataagcctcttctcctgcagcctgagatggatggacagacagacaccacagcctccccttcccagaccccgcagcacgcctctccccaccttcttgggactgctgtgaacatgcctcctcctgccctccgccccgtccccccatcccgtttccctccaggtgttgttgagggcatttggcttcctctgctgcatccccttccagctccctcccctgctcagaatctgataccaaagagacagggcccgggcccaggcagagagcgaccagcaggctcctcagccctctcttgccaaaaagcacaagatgttgaggcgagcagggcaggcccccggggaggggccagagttttctatgaatctatttttcttcagactgaggccttttggtagtcggagcccccgcagtcgtcagcctccctgacgtctgccaccagcgcccccactcctcctcctttctttgctgtttgcaatcacacgtggtgacctcacacacctctgccccttgggcctcccactcccatggctctgggcggtccagaaggagcaggccctgggcctccacctctgtgcagggcacagaaggctggggtggggggaggagtggattcctccccaccctgtcccaggcagcgccactgtccgctgtctccctcctgattctaaaatgtctcaagtgcaatgccccctcccctcctttaccgaggacagcctgcctctgccacagcaaggctgtcggggtcaagctggaaaggccagcagccttccagtggcttctcccaacactcttggggaccaaatatatttaatggttaagggacttgtcccaagtctgacagccagagcgttagaggggccagcggccctcccaggcgatcttgtgtctactctaggactgggcccgagggtggtttacctgcaccgttgactcagtatagtttaaaaatctgccacctgcacaggtatttttgaaagcaaaataaggttttcttttttcccctttcttgtaataaatgataaaattccgagtctttctcactgcctttgtttagaagagagtagctcgtcctcactggtctacactggttgccgaatttacttgtattcctaactgttttgtatatgctgcattgagacttacggcaagaaggcattttttttttttaaaggaaacaaactctcaaatcatgaagtgatataaaagctgcatatgcctacaaagctctgaattcaggtcccagttgctgtcacaaaggagtgagtgaaactcccaccctacccccttttttatataataaaagtgccttagcatgtgttgcagctgtcaccactacagtaagctggtttacagatgttttccactgagcatcacaataaagagaaccatgtgcta

SEQ ID NO: 314101 - DNA, 6329 bp, Homo sapiens
cccgatattcggtcagtgggtgatagcaaaacctcgggtacgccaagaccgtgaagaatgacgaactcctcccgcttcggcaaattcattcgcatcaactttgatgtcaatggctacattgttggagccaacattgagacttatcttttggagaaatctcgtgctatccgccaagccaaggaagaacggaccttccacatcttctattatctcctgtctggggctggagagcacctgaagaccgatctcctgttggagccgtacaacaaataccgcttcctgtccaatggacacgtcaccatccccgggcagcaggacaaggacatgttccaggagaccatggaggccatgaggattatgggcatcccagaagaggagcaaatgggcctgctgcgggtcatctcaggggttcttcagctcggcaacatcgtcttcaagaaggagcggaacactgaccaggcgtccatgcccgacaacacagctgcccaaaaggtgtcccatctcttgggtatcaatgtgaccgatttcaccagaggaatcctcaccccgcgcatcaaggtgggacgggattacgtccagaaggcgcagactaaagagcaggctgactttgccatcgaggccttggccaaggcgacctatgagcggatgttccgctggctggtgctgcgcatcaacaaggctctggacaagaccaagaggcagggcgcctccttcatcgggatcctggacattgccggcttcgagatctttgatctgaactcgtttgagcagctgtgcatcaattacaccaatgagaagctgcagcagctcttcaaccacaccatgttcatcctggagcaggaggagtaccagcgcgagggcatcgagtggaacttcatcgactttggcctcgacctgcagccctgcatcgacctcattgagaagccagcaggccccccgggcattctggccctgctggacgaggagtgctggttccccaaagccaccgacaagagcttcgtggagaaggtgatgcaggagcagggcacccaccccaagttccagaagcccaagcagctgaaggacaaagctgatttctgcattatccactatgccggcaaggtggattacaaagctgacgagtggctgatgaagaacatggatcccctgaatgacaacatcgccacactgctccaccagtcctctgacaagtttgtctcggagctgtggaaggatgtggaccgcatcatcggcctggaccaggtggccggcatgtcggagaccgcactgcccggggccttcaagacgcggaagggcatgttccgcactgtggggcagctttacaaggagcagctggccaagctgatggctacgctgaggaacacgaaccccaactttgtccgctgcatcatccccaaccacgagaagaaggccggcaagctggacccgcatctcgtgctggaccagctgcgctgcaacggtgttctcgagggcatccgtatctgccgccagggcttccccaacagggtggtcttccaggagtttcggcagagatatgagatcctgactccaaactccattcccaagggtttcatggacgggaagcaggcgtgcgtgctcatgataaaagccctggagctcgacagcaatctgtaccgcattggccagagcaaagtcttcttccgtgccggtgtgctggcccacctggaggaggagcgagacctgaagatcaccgacgtcatcatagggttccaggcctgctgcaggggctacctggccaggaaagcatttgccaagcggcagcagcagcttaccgccatgaaggtcctccagcggaactgcgctgcctacctgaagctgcggaactggcagtggtggcggctcttcaccaaggtcaagccgctgctgcaggtgagccggcaggaggaggagatgatggccaaggaggaggagctggtgaaggtcagagagaagcagctggctgcggagaacaggctcacggagatggagacgctgcagtctcagctcatggcagagaaattgcagctgcaggagcagctccaggcagaaaccgagctgtgtgccgaggctgaggagctccgggcccgcctgaccgccaagaagcaggaattagaagagatctgccatgacctagaggccagggtggaggaggaggaggagcgctgccagcacctgcaggcggagaagaagaagatgcagcagaacatccaggagcttgaggagcagctggaggaggaggagagcgcccggcagaagctgcagctggagaaggtgaccaccgaggcgaagctgaaaaagctggaggaggagcagatcatcctggaggaccagaactgcaagctggccaaggaaaagaaactgctggaagacagaatagctgagttcaccaccaacctcacagaagaggaggagaaatctaagagcctcgccaagctcaagaacaagcatgaggcaatgatcactgacttggaagagcgcctccgcagggaggagaagcagcgacaggagctggagaagacccgccggaagctggagggagactccacagacctcagcgaccagatcgccgagctccaggcccagatcgcggagctcaagatgcagctggccaagaaagaggaggagctccaggccgccctggccagagtggaagaggaagctgcccagaagaacatggccctcaagaagatccgggagctggaatctcagatctctgaactccaggaagacctggagtctgagcgtgcttccaggaataaagctgagaagcagaaacgggaccttggggaagagctagaggcgctgaaaacagagttggaggacacgctggattccacagctgcccagcaggagctcaggtcaaaacgtgagcaggaggtgaacatcctgaagaagaccctggaggaggaggccaagacccacgaggcccagatccaggagatgaggcagaagcactcacaggccgtggaggagctggcggagcagctggagcagacgaagcgggtgaaagcaaacctcgagaaggcaaagcagactctggagaacgagcggggggagctggccaacgaggtgaaggtgctgctgcagggcaaaggggactcggagcacaagcgcaagaaagtggaggcgcagctgcaggagctgcaggtcaagttcaacgagggagagcgcgtgcgcacagagctggccgacaaggtcaccaagctgcaggtggagctggacaacgtgaccgggcttctcagccagtccgacagcaagtccagcaagctcaccaaggacttctccgcgctggagtcccagctgcaggacactcaggagctgctgcaggaggagaaccggcagaagctgagcctgagcaccaagctcaagcaggtggaggacgagaagaattccttccgggagcagctggaggaggaggaggaggccaagcacaacctggagaagcagatcgccaccctccatgcccaggtggccgacatgaaaaagaagatggaggacagtgtggggtgcctggaaactgctgaggaggtgaagaggaagctccagaaggacctggagggcctgagccagcggcacgaggagaaggtggccgcctacgacaagctggagaagaccaagacgcggctgcagcaggagctggacgacctgctggtggacctggaccaccagcgccagagcgcgtgcaacctggagaagaagcagaagaagtttgaccagctcctggcggaggagaagaccatctctgccaagtatgcagaggagcgcgaccgggctgaggcggaggcccgagagaaggagaccaaggctctgtcgctggcccgggccctggaggaagccatggagcagaaggcggagctggagcggctcaacaagcagttccgcacggagatggaggaccttatgagctccaaggatgatgtgggcaagagtgtccacgagctggagaagtccaagcgggccctagagcagcaggtggaggagatgaagacgcagctggaagagctggaggacgagctgcaggccaccgaagatgccaagctgcggttggaggtcaacctgcaggccatgaaggcccagttcgagcgggacctgcagggccgggacgagcagagcgaggagaagaagaagcagctggtcagacaggtgcgggagatggaggcagagctggaggacgagaggaagcagcgctcgatggcagtggccgcccggaagaagctggagatggacctgaaggacctggaggcgcacatcgactcggccaacaagaaccgggacgaagccatcaaacagctgcggaagctgcaggcccagatgaaggactgcatgcgcgagctggatgacacccgcgcctctcgtgaggagatcctggcccaggccaaagagaacgagaagaagctgaagagcatggaggccgagatgatccagttgcaggaggaactggcagccgcggagcgtgccaagcgccaggcccagcaggagcgggatgagctggctgacgagatcgccaacagcagcggcaaaggagccctggcgttagaggagaagcggcgtctggaggcccgcatcgcccagctggaggaggagctggaggaggagcagggcaacacggagctgatcaacgaccggctgaagaaggccaacctgcagatcgaccagatcaacaccgacctgaacctggagcgcagccacgcccagaagaacgagaatgctcggcagcagctggaacgccagaacaaggagcttaaggtcaagctgcaggagatggagggcactgtcaagtccaagtacaaggcctccatcaccgccctcgaggccaagattgcacagctggaggagcagctggacaacgagaccaaggagcgccaggcagcctgcaaacaggtgcgtcggaccgagaagaagctgaaggatgtgctgctgcaggtggatgacgagcggaggaacgccgagcagtacaaggaccaggccgacaaggcatctacccgcctgaagcagctcaagcggcagctggaggaggccgaagaggaggcccagcgggccaacgcctcccgccggaaactgcagcgcgagctggaggacgccactgagacggccgatgccatgaaccgcgaagtcagctccctaaagaacaagctcaggcgcggggacctgccgtttgtcgtgccccgccgaatggcccggaaaggcgccggggatggctccgacgaagaggtagatggcaaagcggatggggctgaggccaaacctgccgaataagcctcttctcctgcagcctgagatggatggacagacagacaccacagcctccccttcccagaccccgcagcacgcctctccccaccttcttgggactgctgtgaacatgcctcctcctgccctccgccccgtccccccatcccgtttccctccaggtgttgttgagggcatttggcttcctctgctgcatccccttccagctccctcccctgctcagaatctgataccaaagagacagggcccgggcccaggcagagagcgaccagcaggctcctcagccctctcttgccaaaaagcacaagatgttgaggcgagcagggcaggcccccggggaggggccagagttttctatgaatctatttttcttcagactgaggccttttggtagtcggagcccccgcagtcgtcagcctccctgacgtctgccaccagcgcccccactcctcctcctttctttgctgtttgcaatcacacgtggtgacctcacacacctctgccccttgggcctcccactcccatggctctgggcggtccagaaggagcaggccctgggcctccacctctgtgcagggcacagaaggctggggtggggggaggagtggattcctccccaccctgtcccaggcagcgccactgtccgctgtctccctcctgattctaaaatgtctcaagtgcaatgccccctcccctcctttaccgaggacagcctgcctctgccacagcaaggctgtcggggtcaagctggaaaggccagcagccttccagtggcttctcccaacactcttggggaccaaatatatttaatggttaagggacttgtcccaagtctgacagccagagcgttagaggggccagcggccctcccaggcgatcttgtgtctactctaggactgggcccgagggtggtttacctgcaccgttgactcagtatagtttaaaaatctgccacctgcacaggtatttttgaaagcaaaataaggttttcttttttcccctttcttgtaataaatgataaaattccaaaaaaaaagtcgaccggccgcgaatttagtagtagtagtagtagtagtagc

SEQ ID NO: 314102 - DNA, 5749 bp, Homo sapiens
cccgatattcggtcagtgggtgatagcaaaacctcgggtacgccaagaccgtgaagaatgacgaactcctcccgcttcggcaaattcattcgcatcaactttgatgtcaatggctacattgttggagccaacattgagacttatcttttggagaaatctcgtgctatccgccaagccaaggaagaacggaccttccacatcttctattatctcctgtctggggctggagagcacctgaagaccgatctcctgttggagccgtacaacaaataccgcttcctgtccaatggacacgtcaccatccccgggcagcaggacaaggacatgttccaggagaccatggaggccatgaggattatgggcatcccagaagaggagcaaatgggcctgctgcgggtcatctcaggggttcttcagctcggcaacatcgtcttcaagaaggagcggaacactgaccaggcgtccatgcccgacaacacagctgcccaaaaggtgtcccatctcttgggtatcaatgtgaccgatttcaccagaggaatcctcaccccgcgcatcaaggtgggacgggattacgtccagaaggcgcagactaaagagcaggctgactttgccatcgaggccttggccaaggcgacctatgagcggatgttccgctggctggtgctgcgcatcaacaaggctctggacaagaccaagaggcagggcgcctccttcatcgggatcctggacattgccggcttcgagatctttgatctgaactcgtttgagcagctgtgcatcaattacaccaatgagaagctgcagcagctcttcaaccacaccatgttcatcctggagcaggaggagtaccagcgcgagggcatcgagtggaacttcatcgactttggcctcgacctgcagccctgcatcgacctcattgagaagccagcaggccccccgggcattctggccctgctggacgaggagtgctggttccccaaagccaccgacaagagcttcgtggagaaggtgatgcaggagcagggcacccaccccaagttccagaagcccaagcagctgaaggacaaagctgatttctgcattatccactatgccggcaaggtggattacaaagctgacgagtggctgatgaagaacatggatcccctgaatgacaacatcgccacactgctccaccagtcctctgacaagtttgtctcggagctgtggaaggatgtggaccgcatcatcggcctggaccaggtggccggcatgtcggagaccgcactgcccggggccttcaagacgcggaagggcatgttccgcactgtggggcagctttacaaggagcagctggccaagctgatggctacgctgaggaacacgaaccccaactttgtccgctgcatcatccccaaccacgagaagaaggccggcaagctggacccgcatctcgtgctggaccagctgcgctgcaacggtgttctcgagggcatccgtatctgccgccagggcttccccaacagggtggtcttccaggagtttcggcagagatatgagatcctgactccaaactccattcccaagggtttcatggacgggaagcaggcgtgcgtgctcatgataaaagccctggagctcgacagcaatctgtaccgcattggccagagcaaagtcttcttccgtgccggtgtgctggcccacctggaggaggagcgagacctgaagatcaccgacgtcatcatagggttccaggcctgctgcaggggctacctggccaggaaagcatttgccaagcggcagcagcagcttaccgccatgaaggtcctccagcggaactgcgctgcctacctgaagctgcggaactggcagtggtggcggctcttcaccaaggtcaagccgctgctgcaggtgagccggcaggaggaggagatgatggccaaggaggaggagctggtgaaggtcagagagaagcagctggctgcggagaacaggctcacggagatggagacgctgcagtctcagctcatggcagagaaattgcagctgcaggagcagctccaggcagaaaccgagctgtgtgccgaggctgaggagctccgggcccgcctgaccgccaagaagcaggaattagaagagatctgccatgacctagaggccagggtggaggaggaggaggagcgctgccagcacctgcaggcggagaagaagaagatgcagcagaacatccaggagcttgaggagcagctggaggaggaggagagcgcccggcagaagctgcagctggagaaggtgaccaccgaggcgaagctgaaaaagctggaggaggagcagatcatcctggaggaccagaactgcaagctggccaaggaaaagaaactgctggaagacagaatagctgagttcaccaccaacctcacagaagaggaggagaaatctaagagcctcgccaagctcaagaacaagcatgaggcaatgatcactgacttggaagagcgcctccgcagggaggagaagcagcgacaggagctggagaagacccgccggaagctggagggagactccacagacctcagcgaccagatcgccgagctccaggcccagatcgcggagctcaagatgcagctggccaagaaagaggaggagctccaggccgccctggccagagtggaagaggaagctgcccagaagaacatggccctcaagaagatccgggagctggaatctcagatctctgaactccaggaagacctggagtctgagcgtgcttccaggaataaagctgagaagcagaaacgggaccttggggaagagctagaggcgctgaaaacagagttggaggacacgctggattccacagctgcccagcaggagctcaggtcaaaacgtgagcaggaggtgaacatcctgaagaagaccctggaggaggaggccaagacccacgaggcccagatccaggagatgaggcagaagcactcacaggccgtggaggagctggcggagcagctggagcagacgaagcgggtgaaagcaaacctcgagaaggcaaagcagactctggagaacgagcggggggagctggccaacgaggtgaaggtgctgctgcagggcaaaggggactcggagcacaagcgcaagaaagtggaggcgcagctgcaggagctgcaggtcaagttcaacgagggagagcgcgtgcgcacagagctggccgacaaggtcaccaagctgcaggtggagctggacaacgtgaccgggcttctcagccagtccgacagcaagtccagcaagctcaccaaggacttctccgcgctggagtcccagctgcaggacactcaggagctgctgcaggaggagaaccggcagaagctgagcctgagcaccaagctcaagcaggtggaggacgagaagaattccttccgggagcagctggaggaggaggaggaggccaagcacaacctggagaagcagatcgccaccctccatgcccaggtggccgacatgaaaaagaagatggaggacagtgtggggtgcctggaaactgctgaggaggtgaagaggaagctccagaaggacctggagggcctgagccagcggcacgaggagaaggtggccgcctacgacaagctggagaagaccaagacgcggctgcagcaggagctggacgacctgctggtggacctggaccaccagcgccagagcgcgtgcaacctggagaagaagcagaagaagtttgaccagctcctggcggaggagaagaccatctctgccaagtatgcagaggagcgcgaccgggctgaggcggaggcccgagagaaggagaccaaggctctgtcgctggcccgggccctggaggaagccatggagcagaaggcggagctggagcggctcaacaagcagttccgcacggagatggaggaccttatgagctccaaggatgatgtgggcaagagtgtccacgagctggagaagtccaagcgggccctagagcagcaggtggaggagatgaagacgcagctggaagagctggaggacgagctgcaggccaccgaagatgccaagctgcggttggaggtcaacctgcaggccatgaaggcccagttcgagcgggacctgcagggccgggacgagcagagcgaggagaagaagaagcagctggtcagacaggtgcgggagatggaggcagagctggaggacgagaggaagcagcgctcgatggcagtggccgcccggaagaagctggagatggacctgaaggacctggaggcgcacatcgactcggccaacaagaaccgggacgaagccatcaaacagctgcggaagctgcaggcccagatgaaggactgcatgcgcgagctggatgacacccgcgcctctcgtgaggagatcctggcccaggccaaagagaacgagaagaagctgaagagcatggaggccgagatgatccagttgcaggaggaactggcagccgcggagcgtgccaagcgccaggcccagcaggagcgggatgagctggctgacgagatcgccaacagcagcggcaaaggagccctggcgttagaggagaagcggcgtctggaggcccgcatcgcccctgctcagaatctgataccaaagagacagggcccgggcccaggcagagagcgaccagcaggctcctcagccctctcttgccaaaaagcacaagatgttgaggcgagcagggcaggcccccggggaggggccagagttttctatgaatctatttttcttcagactgaggccttttggtagtcggagcccccgcagtcgtcagcctccctgacgtctgccaccagcgcccccactcctcctcctttctttgctgtttgcaatcacacgtggtgacctcacacacctctgccccttgggcctcccactcccatggctctgggcggtccagaaggagcaggccctgggcctccacctctgtgcagggcacagaaggctggggtggggggaggagtggattcctccccaccctgtcccaggcagcgccactgtccgctgtctccctcctgattctaaaatgtctcaagtgcaatgccccctcccctcctttaccgaggacagcctgcctctgccacagcaaggctgtcggggtcaagctggaaaggccagcagccttccagtggcttctcccaacactcttggggaccaaatatatttaatggttaagggacttgtcccaagtctgacagccagagcgttagaggggccagcggccctcccaggcgatcttgtgtctactctaggactgggcccgagggtggtttacctgcaccgttgactcagtatagtttaaaaatctgccacctgcacaggtatttttgaaagcaaaataaggttttcttttttcccctttcttgtaataaatgataaaattccgagtctttctcactgcctttgtttagaagagagtagctcgtcctcactggtctacactggttgccgaatttacttgtattcctaactgttttgtatatgctgcattgagacttacggcaagaaggcattttttttttttaaaggaaacaaactctcaaatcatgaagtgatataaaagctgcatatgcctacaaagctctgaattcaggtcccagttgctgtcacaaaggagtgagtgaaactcccaccctacccccttttttatataataaaagtgccttagcatgtgttgcagctgtcaccactacagtaagctggtttacagatgttttccactgagcatcacaataaagagaaccatgtgcta

SEQ ID NO: 314103 - DNA, 6234 bp, Homo sapiens
  misc_feature (6205)..(6205): n is a, c, g, or t
  misc_feature (6231)..(6231): n is a, c, g, or t
cccgatattcggtcagtgggtgatagcaaaacctcgggtacgccaagaccgtgaagaatgacgaactcctcccgcttcggcaaattcattcgcatcaactttgatgtcaatggctacattgttggagccaacattgagacttatcttttggagaaatctcgtgctatccgccaagccaaggaagaacggaccttccacatcttctattatctcctgtctggggctggagagcacctgaagaccgatctcctgttggagccgtacaacaaataccgcttcctgtccaatggacacgtcaccatccccgggcagcaggacaaggacatgttccaggagaccatggaggccatgaggattatgggcatcccagaagaggagcaaatgggcctgctgcgggtcatctcaggggttcttcagctcggcaacatcgtcttcaagaaggagcggaacactgaccaggcgtccatgcccgacaacacagctgcccaaaaggtgtcccatctcttgggtatcaatgtgaccgatttcaccagaggaatcctcaccccgcgcatcaaggtgggacgggattacgtccagaaggcgcagactaaagagcaggctgactttgccatcgaggccttggccaaggcgacctatgagcggatgttccgctggctggtgctgcgcatcaacaaggctctggacaagaccaagaggcagggcgcctccttcatcgggatcctggacattgccggcttcgagatctttgatctgaactcgtttgagcagctgtgcatcaattacaccaatgagaagctgcagcagctcttcaaccacaccatgttcatcctggagcaggaggagtaccagcgcgagggcatcgagtggaacttcatcgactttggcctcgacctgcagccctgcatcgacctcattgagaagccagcaggccccccgggcattctggccctgctggacgaggagtgctggttccccaaagccaccgacaagagcttcgtggagaaggtgatgcaggagcagggcacccaccccaagttccagaagcccaagcagctgaaggacaaagctgatttctgcattatccactatgccggcaaggtggattacaaagctgacgagtggctgatgaagaacatggatcccctgaatgacaacatcgccacactgctccaccagtcctctgacaagtttgtctcggagctgtggaaggatgtggaccgcatcatcggcctggaccaggtggccggcatgtcggagaccgcactgcccggggccttcaagacgcggaagggcatgttccgcactgtggggcagctttacaaggagcagctggccaagctgatggctacgctgaggaacacgaaccccaactttgtccgctgcatcatccccaaccacgagaagaaggccggcaagctggacccgcatctcgtgctggaccagctgcgctgcaacggtgttctcgagggcatccgtatctgccgccagggcttccccaacagggtggtcttccaggagtttcggcagagatatgagatcctgactccaaactccattcccaagggtttcatggacgggaagcaggcgtgcgtgctcatgataaaagccctggagctcgacagcaatctgtaccgcattggccagagcaaagtcttcttccgtgccggtgtgctggcccacctggaggaggagcgagacctgaagatcaccgacgtcatcatagggttccaggcctgctgcaggggctacctggccaggaaagcatttgccaagcggcagcagcagcttaccgccatgaaggtcctccagcggaactgcgctgcctacctgaagctgcggaactggcagtggtggcggctcttcaccaaggtcaagccgctgctgcaggtgagccggcaggaggaggagatgatggccaaggaggaggagctggtgaaggtcagagagaagcagctggctgcggagaacaggctcacggagatggagacgctgcagtctcagctcatggcagagaaattgcagctgcaggagcagctccaggcagaaaccgagctgtgtgccgaggctgaggagctccgggcccgcctgaccgccaagaagcaggaattagaagagatctgccatgacctagaggccagggtggaggaggaggaggagcgctgccagcacctgcaggcggagaagaagaagatgcagcagaacatccaggagcttgaggagcagctggaggaggaggagagcgcccggcagaagctgcagctggagaaggtgaccaccgaggcgaagctgaaaaagctggaggaggagcagatcatcctggaggaccagaactgcaagctggccaaggaaaagaaactgctggaagacagaatagctgagttcaccaccaacctcacagaagaggaggagaaatctaagagcctcgccaagctcaagaacaagcatgaggcaatgatcactgacttggaagagcgcctccgcagggaggagaagcagcgacaggagctggagaagacccgccggaagctggagggagactccacagacctcagcgaccagatcgccgagctccaggcccagatcgcggagctcaagatgcagctggccaagaaagaggaggagctccaggccgccctggccagagtggaagaggaagctgcccagaagaacatggccctcaagaagatccgggagctggaatctcagatctctgaactccaggaagacctggagtctgagcgtgcttccaggaataaagctgagaagcagaaacgggaccttggggaagagctagaggcgctgaaaacagagttggaggacacgctggattccacagctgcccagcaggagctcaggtcaaaacgtgagcaggaggtgaacatcctgaagaagaccctggaggaggaggccaagacccacgaggcccagatccaggagatgaggcagaagcactcacaggccgtggaggagctggcggagcagctggagcagacgaagcgggtgaaagcaaacctcgagaaggcaaagcagactctggagaacgagcggggggagctggccaacgaggtgaaggtgctgctgcagggcaaaggggactcggagcacaagcgcaagaaagtggaggcgcagctgcaggagctgcaggtcaagttcaacgagggagagcgcgtgcgcacagagctggccgacaaggtcaccaagctgcaggtggagctggacaacgtgaccgggcttctcagccagtccgacagcaagtccagcaagctcaccaaggacttctccgcgctggagtcccagctgcaggacactcaggagctgctgcaggaggagaaccggcagaagctgagcctgagcaccaagctcaagcaggtggaggacgagaagaattccttccgggagcagctggaggaggaggaggaggccaagcacaacctggagaagcagatcgccaccctccatgcccaggtggccgacatgaaaaagaagatggaggacagtgtggggtgcctggaaactgctgaggaggtgaagaggaagctccagaaggacctggagggcctgagccagcggcacgaggagaaggtggccgcctacgacaagctggagaagaccaagacgcggctgcagcaggagctggacgacctgctggtggacctggaccaccagcgccagagcgcgtgcaacctggagaagaagcagaagaagtttgaccagctcctggcggaggagaagaccatctctgccaagtatgcagaggagcgcgaccgggctgaggcggaggcccgagagaaggagaccaaggctctgtcgctggcccgggccctggaggaagccatggagcagaaggcggagctggagcggctcaacaagcagttccgcacggagatggaggaccttatgagctccaaggatgatgtgggcaagagtgtccacgagctggagaagtccaagcgggccctagagcagcaggtggaggagatgaagacgcagctggaagagctggaggacgagctgcaggccaccgaagatgccaagctgcggttggaggtcaacctgcaggccatgaaggcccagttcgagcgggacctgcagggccgggacgagcagagcgaggagaagaagaagcagctggtcagacaggtgcgggagatggaggcagagctggaggacgagaggaagcagcgctcgatggcagtggccgcccggaagaagctggagatggacctgaaggacctggaggcgcacatcgactcggccaacaagaaccgggacgaagccatcaaacagctgcggaagctgcaggcccagatgaaggactgcatgcgcgagctggatgacacccgcgcctctcgtgaggagatcctggcccaggccaaagagaacgagaagaagctgaagagcatggaggccgagatgatccagttgcaggaggaactggcagccgcggagcgtgccaagcgccaggcccagcaggagcgggatgagctggctgacgagatcgccaacagcagcggcaaaggagccctggcgttagaggagaagcggcgtctggaggcccgcatcgcccagctggaggaggagctggaggaggagcagggcaacacggagctgatcaacgaccggctgaagaaggccaacctgcagatcgaccagatcaacaccgacctgaacctggagcgcagccacgcccagaagaacgagaatgctcggcagcagctggaacgccagaacaaggagcttaaggtcaagctgcaggagatggagggcactgtcaagtccaagtacaaggcctccatcaccgccctcgaggccaagattgcacagctggaggagcagctggacaacgagaccaaggagcgccaggcagcctgcaaacaggtgcgtcggaccgagaagaagctgaaggatgtgctgctgcaggtggatgacgagcggaggaacgccgagcagtacaaggaccaggccgacaaggcatctacccgcctgaagcagctcaagcggcagctggaggaggccgaagaggaggcccagcgggccaacgcctcccgccggaaactgcagcgcgagctggaggacgccactgagacggccgatgccatgaaccgcgaagtcagctccctaaagaacaagctcaggcgcggggacctgccgtttgtcgtgccccgccgaatggcccggaaaggcgccggggatggctccgacgaagaggtagatggcaaagcggatggggctgaggccaaacctgccgaataagcctcttctcctgcagcctgagatggatggacagacagacaccacagcctccccttcccagaccccgcagcacgcctctccccaccttcttgggactgctgtgaacatgcctcctcctgccctccgccccgtccccccatcccgtttccctccaggtgttgttgagggcatttggcttcctctgctgcatccccttccagctccctcccctgctcagaatctgataccaaagagacagggcccgggcccaggcagagagcgaccagcaggctcctcagccctctcttgccaaaaagcacaagatgttgaggcgagcagggcaggcccccggggaggggccagagttttctatgaatctatttttcttcagactgaggccttttggtagtcggagcccccgcagtcgtcagcctccctgacgtctgccaccagcgcccccactcctcctcctttctttgctgtttgcaatcacacgtggtgacctcacacacctctgccccttgggcctcccactcccatggctctgggcggtccagaaggagcaggccctgggcctccacctctgtgcagggcacagaaggctggggtggggggaggagtggattcctccccaccctgtcccaggcagcgccactgtccgctgtctccctcctgattctaaaatgtctcaagtgcaatgccccctcccctcctttaccgaggacagcctgcctctgccacagcaaggctgtcggggtcaagctggaaaggccagcagccttccagtggcttctcccaacactcttggggaccaaatatatttaatggttaagggacttgtcccaagtctgacagccagagcgttagaggggccagcggccctcccaggcgatcttgtgtctactctaggactgggcccgagggtggtttacctgcaccgttgactcagtatagtttaaaaatccttatnttgctttcaaaaatacctgtgcagtngac

SEQ ID NO: 314104 - DNA, 5925 bp, Homo sapiens
cccgatattcggtcagtgggtgatagcaaaacctcgggtacgccaagaccgtgaagaatgacgaactcctcccgcttcggcaaattcattcgcatcaactttgatgtcaatggctacattgttggagccaacattgagacttatcttttggagaaatctcgtgctatccgccaagccaaggaagaacggaccttccacatcttctattatctcctgtctggggctggagagcacctgaagaccgatctcctgttggagccgtacaacaaataccgcttcctgtccaatggacacgtcaccatccccgggcagcaggacaaggacatgttccaggagaccatggaggccatgaggattatgggcatcccagaagaggagcaaatgggcctgctgcgggtcatctcaggggttcttcagctcggcaacatcgtcttcaagaaggagcggaacactgaccaggcgtccatgcccgacaacacagctgcccaaaaggtgtcccatctcttgggtatcaatgtgaccgatttcaccagaggaatcctcaccccgcgcatcaaggtgggacgggattacgtccagaaggcgcagactaaagagcaggctgactttgccatcgaggccttggccaaggcgacctatgagcggatgttccgctggctggtgctgcgcatcaacaaggctctggacaagaccaagaggcagggcgcctccttcatcgggatcctggacattgccggcttcgagatctttgatctgaactcgtttgagcagctgtgcatcaattacaccaatgagaagctgcagcagctcttcaaccacaccatgttcatcctggagcaggaggagtaccagcgcgagggcatcgagtggaacttcatcgactttggcctcgacctgcagccctgcatcgacctcattgagaagccagcaggccccccgggcattctggccctgctggacgaggagtgctggttccccaaagccaccgacaagagcttcgtggagaaggtgatgcaggagcagggcacccaccccaagttccagaagcccaagcagctgaaggacaaagctgatttctgcattatccactatgccggcaaggtggattacaaagctgacgagtggctgatgaagaacatggatcccctgaatgacaacatcgccacactgctccaccagtcctctgacaagtttgtctcggagctgtggaaggatgtggaccgcatcatcggcctggaccaggtggccggcatgtcggagaccgcactgcccggggccttcaagacgcggaagggcatgttccgcactgtggggcagctttacaaggagcagctggccaagctgatggctacgctgaggaacacgaaccccaactttgtccgctgcatcatccccaaccacgagaagaaggccggcaagctggacccgcatctcgtgctggaccagctgcgctgcaacggtgttctcgagggcatccgtatctgccgccagggcttccccaacagggtggtcttccaggagtttcggcagagatatgagatcctgactccaaactccattcccaagggtttcatggacgggaagcaggcgtgcgtgctcatgataaaagccctggagctcgacagcaatctgtaccgcattggccagagcaaagtcttcttccgtgccggtgtgctggcccacctggaggaggagcgagacctgaagatcaccgacgtcatcatagggttccaggcctgctgcaggggctacctggccaggaaagcatttgccaagcggcagcagcagcttaccgccatgaaggtcctccagcggaactgcgctgcctacctgaagctgcggaactggcagtggtggcggctcttcaccaaggtcaagccgctgctgcaggtgagccggcaggaggaggagatgatggccaaggaggaggagctggtgaaggtcagagagaagcagctggctgcggagaacaggctcacggagatggagacgctgcagtctcagctcatggcagagaaattgcagctgcaggagcagctccaggcagaaaccgagctgtgtgccgaggctgaggagctccgggcccgcctgaccgccaagaagcaggaattagaagagatctgccatgacctagaggccagggtggaggaggaggaggagcgctgccagcacctgcaggcggagaagaagaagatgcagcagaacatccaggagcttgaggagcagctggaggaggaggagagcgcccggcagaagctgcagctggagaaggtgaccaccgaggcgaagctgaaaaagctggaggaggagcagatcatcctggaggaccagaactgcaagctggccaaggaaaagaaactgctggaagacagaatagctgagttcaccaccaacctcacagaagaggaggagaaatctaagagcctcgccaagctcaagaacaagcatgaggcaatgatcactgacttggaagagcgcctccgcagggaggagaagcagcgacaggagctggagaagacccgccggaagctggagggagactccacagacctcagcgaccagatcgccgagctccaggcccagatcgcggagctcaagatgcagctggccaagaaagaggaggagctccaggccgccctggccagagtggaagaggaagctgcccagaagaacatggccctcaagaagatccgggagctggaatctcagatctctgaactccaggaagacctggagtctgagcgtgcttccaggaataaagctgagaagcagaaacgggaccttggggaagagctagaggcgctgaaaacagagttggaggacacgctggattccacagctgcccagcaggagctcaggtcaaaacgtgagcaggaggtgaacatcctgaagaagaccctggaggaggaggccaagacccacgaggcccagatccaggagatgaggcagaagcactcacaggccgtggaggagctggcggagcagctggagcagacgaagcgggtgaaagcaaacctcgagaaggcaaagcagactctggagaacgagcggggggagctggccaacgaggtgaaggtgctgctgcagggcaaaggggactcggagcacaagcgcaagaaagtggaggcgcagctgcaggagctgcaggtcaagttcaacgagggagagcgcgtgcgcacagagctggccgacaaggtcaccaagctgcaggtggagctggacaacgtgaccgggcttctcagccagtccgacagcaagtccagcaagctcaccaaggacttctccgcgctggagtcccagctgcaggacactcaggagctgctgcaggaggagaaccggcagaagctgagcctgagcaccaagctcaagcaggtggaggacgagaagaattccttccgggagcagctggaggaggaggaggaggccaagcacaacctggagaagcagatcgccaccctccatgcccaggtggccgacatgaaaaagaagatggaggacagtgtggggtgcctggaaactgctgaggaggtgaagaggaagctccagaaggacctggagggcctgagccagcggcacgaggagaaggtggccgcctacgacaagctggagaagaccaagacgcggctgcagcaggagctggacgacctgctggtggacctggaccaccagcgccagagcgcgtgcaacctggagaagaagcagaagaagtttgaccagctcctggcggaggagaagaccatctctgccaagtatgcagaggagcgcgaccgggctgaggcggaggcccgagagaaggagaccaaggctctgtcgctggcccgggccctggaggaagccatggagcagaaggcggagctggagcggctcaacaagcagttccgcacggagatggaggaccttatgagctccaaggatgatgtgggcaagagtgtccacgagctggagaagtccaagcgggccctagagcagcaggtggaggagatgaagacgcagctggaagagctggaggacgagctgcaggccaccgaagatgccaagctgcggttggaggtcaacctgcaggccatgaaggcccagttcgagcgggacctgcagggccgggacgagcagagcgaggagaagaagaagcagctggtcagacaggtgcgggagatggaggcagagctggaggacgagaggaagcagcgctcgatggcagtggccgcccggaagaagctggagatggacctgaaggacctggaggcgcacatcgactcggccaacaagaaccgggacgaagccatcaaacagctgcggaagctgcaggcccagatgaaggactgcatgcgcgagctggatgacacccgcgcctctcgtgaggagatcctggcccaggccaaagagaacgagaagaagctgaagagcatggaggccgagatgatccagttgcaggaggaactggcagccgcggagcgtgccaagcgccaggcccagcaggagcgggatgagctggctgacgagatcgccaacagcagcggcaaaggagccctggcgttagaggagaagcggcgtctggaggcccgcatcgcccagctggaggaggagctggaggaggagcagggcaacacggagctgatcaacgaccggctgaagaaggccaacctgcagatcgaccagatcaacaccgacctgaacctggagcgcagccacgcccagaagaacgagaatgctcggcagcagctggaacgccagaacaaggagcttaaggtcaagctgcaggagatggagggcactgtcaagtccaagtacaaggcctccatcaccgccctcgaggccaagattgcacagctggaggagcagctggacaacgagaccaaggagcgccaggcagcctgcaaacaggtgcgtcggaccgagaagaagctgaaggatgtgctgctgcaggtggatgacgagcggaggaacgccgagcagtacaaggaccaggccgacaaggcatctacccgcctgaagcagctcaagcggcagctggaggaggccgaagaggaggcccagcgggccaacgcctcccgccggaaactgcagcgcgagctggaggacgccactgagacggccgatgccatgaaccgcgaagtcagctccctaaagaacaagctcaggcgcggggacctgccgtttgtcgtgccccgccgaatggcccggaaaggcgccggggatggctccgacgaagaggtagatggcaaagcggatggggctgaggccaaacctgccgaataagcctcttctcctgcagcctgagatggaaaggccagcagccttccagtggcttctcccaacactcttggggaccaaatatatttaatggttaagggacttgtcccaagtctgacagccagagcgttagaggggccagcggccctcccaggcgatcttgtgtctactctaggactgggcccgagggtggtttacctgcaccgttgactcagtatagtttaaaaatctgccacctgcacaggtatttttgaaagcaaaataaggttttcttttttcccctttcttgtaataaatgataaaattccgagtctttctcactgcctttgtttagaagagagtagctcgtcctcactggtctacactggttgccgaatttacttgtattcctaactgttttgtatatgctgcattgagacttacggcaagaaggcattttttttttttaaaggaaacaaactctcaaatcatgaagtgatataaaagctgcatatgcctacaaagctctgaattcaggtcccagttgctgtcacaaaggagtgagtgaaactcccaccctacccccttttttatataataaaagtgccttagcatgtgttgcagctgtcaccactacagtaagctggtttacagatgttttccactgagcatcacaataaagagaaccatgtgcta

SEQ ID NO: 314105 - DNA, 5396 bp, Homo sapiens
cccgatattcggtcagtgggtgatagcaaaacctcgggtacgccaagaccgtgaagaatgacgaactcctcccgcttcggcaaattcattcgcatcaactttgatgtcaatggctacattgttggagccaacattgagacttatcttttggagaaatctcgtgctatccgccaagccaaggaagaacggaccttccacatcttctattatctcctgtctggggctggagagcacctgaagaccgatctcctgttggagccgtacaacaaataccgcttcctgtccaatggacacgtcaccatccccgggcagcaggacaaggacatgttccaggagaccatggaggccatgaggattatgggcatcccagaagaggagcaaatgggcctgctgcgggtcatctcaggggttcttcagctcggcaacatcgtcttcaagaaggagcggaacactgaccaggcgtccatgcccgacaacacagctgcccaaaaggtgtcccatctcttgggtatcaatgtgaccgatttcaccagaggaatcctcaccccgcgcatcaaggtgggacgggattacgtccagaaggcgcagactaaagagcaggctgactttgccatcgaggccttggccaaggcgacctatgagcggatgttccgctggctggtgctgcgcatcaacaaggctctggacaagaccaagaggcagggcgcctccttcatcgggatcctggacattgccggcttcgagatctttgatctgaactcgtttgagcagctgtgcatcaattacaccaatgagaagctgcagcagctcttcaaccacaccatgttcatcctggagcaggaggagtaccagcgcgagggcatcgagtggaacttcatcgactttggcctcgacctgcagccctgcatcgacctcattgagaagccagcaggccccccgggcattctggccctgctggacgaggagtgctggttccccaaagccaccgacaagagcttcgtggagaaggtgatgcaggagcagggcacccaccccaagttccagaagcccaagcagctgaaggacaaagctgatttctgcattatccactatgccggcaaggtggattacaaagctgacgagtggctgatgaagaacatggatcccctgaatgacaacatcgccacactgctccaccagtcctctgacaagtttgtctcggagctgtggaaggatgtggaccgcatcatcggcctggaccaggtggccggcatgtcggagaccgcactgcccggggccttcaagacgcggaagggcatgttccgcactgtggggcagctttacaaggagcagctggccaagctgatggctacgctgaggaacacgaaccccaactttgtccgctgcatcatccccaaccacgagaagaaggccggcaagctggacccgcatctcgtgctggaccagctgcgctgcaacggtgttctcgagggcatccgtatctgccgccagggcttccccaacagggtggtcttccaggagtttcggcagagatatgagatcctgactccaaactccattcccaagggtttcatggacgggaagcaggcgtgcgtgctcatgataaaagccctggagctcgacagcaatctgtaccgcattggccagagcaaagtcttcttccgtgccggtgtgctggcccacctggaggaggagcgagacctgaagatcaccgacgtcatcatagggttccaggcctgctgcaggggctacctggccaggaaagcatttgccaagcggcagcagcagcttaccgccatgaaggtcctccagcggaactgcgctgcctacctgaagctgcggaactggcagtggtggcggctcttcaccaaggtcaagccgctgctgcaggtgagccggcaggaggaggagatgatggccaaggaggaggagctggtgaaggtcagagagaagcagctggctgcggagaacaggctcacggagatggagacgctgcagtctcagctcatggcagagaaattgcagctgcaggagcagctccaggcagaaaccgagctgtgtgccgaggctgaggagctccgggcccgcctgaccgccaagaagcaggaattagaagagatctgccatgacctagaggccagggtggaggaggaggaggagcgctgccagcacctgcaggcggagaagaagaagatgcagcagaacatccaggagcttgaggagcagctggaggaggaggagagcgcccggcagaagctgcagctggagaaggtgaccaccgaggcgaagctgaaaaagctggaggaggagcagatcatcctggaggaccagaactgcaagctggccaaggaaaagaaactgctggaagacagaatagctgagttcaccaccaacctcacagaagaggaggagaaatctaagagcctcgccaagctcaagaacaagcatgaggcaatgatcactgacttggaagagcgcctccgcagggaggagaagcagcgacaggagctggagaagacccgccggaagctggagggagactccacagacctcagcgaccagatcgccgagctccaggcccagatcgcggagctcaagatgcagctggccaagaaagaggaggagctccaggccgccctggccagagtggaagaggaagctgcccagaagaacatggccctcaagaagatccgggagctggaatctcagatctctgaactccaggaagacctggagtctgagcgtgcttccaggaataaagctgagaagcagaaacgggaccttggggaagagctagaggcgctgaaaacagagttggaggacacgctggattccacagctgcccagcaggagctcaggtcaaaacgtgagcaggaggtgaacatcctgaagaagaccctggaggaggaggccaagacccacgaggcccagatccaggagatgaggcagaagcactcacaggccgtggaggagctggcggagcagctggagcagacgaagcgggtgaaagcaaacctcgagaaggcaaagcagactctggagaacgagcggggggagctggccaacgaggtgaaggtgctgctgcagggcaaaggggactcggagcacaagcgcaagaaagtggaggcgcagctgcaggagctgcaggtcaagttcaacgagggagagcgcgtgcgcacagagctggccgacaaggtcaccaagctgcaggtggagctggacaacgtgaccgggcttctcagccagtccgacagcaagtccagcaagctcaccaaggacttctccgcgctggagtcccagctgcaggacactcaggagctgctgcaggaggagaaccggcagaagctgagcctgagcaccaagctcaagcaggtggaggacgagaagaattccttccgggagcagctggaggaggaggaggaggccaagcacaacctggagaagcagatcgccaccctccatgcccaggtggccgacatgaaaaagaagatggaggacagtgtggggtgcctggaaactgctgaggaggtgaagaggaagctccagaaggacctggagggcctgagccagcggcacgaggagaaggtggccgcctacgacaagctggagaagaccaagacgcggctgcagcaggagctggacgacctgctggtggacctggaccaccagcgccagagcgcgtgcaacctggagaagaagcagaagaagtttgaccagctcctggcggaggagaagaccatctctgccaagtatgcagaggagcgcgaccgggctgaggcggaggcccgagagaaggagaccaaggctctgtcgctggcccgggccctggaggaagccatggagcagaaggcggagctggagcggctcaacaagcagttccgcacggagatggaggaccttatgagctccaaggatgatgtgggcaagagtgtccacgagctggagaagtccaagcgggccctagagcagcaggtggaggagatgaagacgcagctggaagagctggaggacgagctgcaggccaccgaagatgccaagctgcggttggaggtcaacctgcaggccatgaaggcccagttcgagcgggacctgcagggccgggacgagcagagcgaggagaagaagaagcagctggtcagacaggtgcgggagatggaggcagagctggaggacgagaggaagcagcgctcgatggcagtggccgcccggaagaagctggagatggacctgaaggacctggaggcgcacatcgactcggccaacaagaaccgggacgaagccatcaaacagctgcggaagctgcaggcccagatgaaggactgcatgcgcgagctggatgacacccgcgcctctcgtgaggagatcctggcccaggccaaagagaacgagaagaagctgaagagcatggaggccgagatgatccagttgcaggaggaactggcagccgcggagcgtgccaagcgccaggcccagcaggagcgggatgagctggctgacgagatcgccaacagcagcggcaaaggagccctggcgttagaggagaagcggcgtctggaggcccgcatcgcccagctggaggaggagctggaggaggagcagggcaacacggagctgatcaacgaccggctgaagaaggccaacctgcagatcgaccagatcaacaccgacctgaacctggagcgcagccacgcccagaagaacgagaatgctcggcagcagctggaacgccagaacaaggagcttaaggtcaagctgcaggagatggagggcactgtcaagtccaagtacaaggcctccatcaccgccctcgaggccaagattgcacagctggaggagcagctggacaacgagaccaagggccagcggccctcccaggcgatcttgtgtctactctaggactgggcccgagggtggtttacctgcaccgttgactcagtatagtttaaaaatctgccacctgcacaggtatttttgaaagcaaaataaggttttcttttttcccctttcttgtaataaatgataaaattccgagtctttctcactgcctttgtttagaagagagtagctcgtcctcactggtctacactggttgccgaatttacttgtattcctaactgttttgtatatgctgcattgagacttacggcaagaaggcattttttttttttaaaggaaacaaactctcaaatcatgaagtgatataaaagctgcatatgcctacaaagctctgaattcaggtcccagttgctgtcacaaaggagtgagtgaaactcccaccctacccccttttttatataataaaagtgccttagcatgtgttgcagctgtcaccactacagtaagctggtttacagatgttttccactgagcatcacaataaagagaaccatgtgcta

SEQ ID NO: 314106 - DNA, 4942 bp, Homo sapiens
cccgatattcggtcagtgggtgatagcaaaacctcgggtacgccaagaccgtgaagaatgacgaactcctcccgcttcggcaaattcattcgcatcaactttgatgtcaatggctacattgttggagccaacattgagacttatcttttggagaaatctcgtgctatccgccaagccaaggaagaacggaccttccacatcttctattatctcctgtctggggctggagagcacctgaagaccgatctcctgttggagccgtacaacaaataccgcttcctgtccaatggacacgtcaccatccccgggcagcaggacaaggacatgttccaggagaccatggaggccatgaggattatgggcatcccagaagaggagcaaatgggcctgctgcgggtcatctcaggggttcttcagctcggcaacatcgtcttcaagaaggagcggaacactgaccaggcgtccatgcccgacaacacagctgcccaaaaggtgtcccatctcttgggtatcaatgtgaccgatttcaccagaggaatcctcaccccgcgcatcaaggtgggacgggattacgtccagaaggcgcagactaaagagcaggctgactttgccatcgaggccttggccaaggcgacctatgagcggatgttccgctggctggtgctgcgcatcaacaaggctctggacaagaccaagaggcagggcgcctccttcatcgggatcctggacattgccggcttcgagatctttgatctgaactcgtttgagcagctgtgcatcaattacaccaatgagaagctgcagcagctcttcaaccacaccatgttcatcctggagcaggaggagtaccagcgcgagggcatcgagtggaacttcatcgactttggcctcgacctgcagccctgcatcgacctcattgagaagccagcaggccccccgggcattctggccctgctggacgaggagtgctggttccccaaagccaccgacaagagcttcgtggagaaggtgatgcaggagcagggcacccaccccaagttccagaagcccaagcagctgaaggacaaagctgatttctgcattatccactatgccggcaaggtggattacaaagctgacgagtggctgatgaagaacatggatcccctgaatgacaacatcgccacactgctccaccagtcctctgacaagtttgtctcggagctgtggaaggatgtggaccgcatcatcggcctggaccaggtggccggcatgtcggagaccgcactgcccggggccttcaagacgcggaagggcatgttccgcactgtggggcagctttacaaggagcagctggccaagctgatggctacgctgaggaacacgaaccccaactttgtccgctgcatcatccccaaccacgagaagaaggccggcaagctggacccgcatctcgtgctggaccagctgcgctgcaacggtgttctcgagggcatccgtatctgccgccagggcttccccaacagggtggtcttccaggagtttcggcagagatatgagatcctgactccaaactccattcccaagggtttcatggacgggaagcaggcgtgcgtgctcatgataaaagccctggagctcgacagcaatctgtaccgcattggccagagcaaagtcttcttccgtgccggtgtgctggcccacctggaggaggagcgagacctgaagatcaccgacgtcatcatagggttccaggcctgctgcaggggctacctggccaggaaagcatttgccaagcggcagcagcagcttaccgccatgaaggtcctccagcggaactgcgctgcctacctgaagctgcggaactggcagtggtggcggctcttcaccaaggtcaagccgctgctgcaggtgagccggcaggaggaggagatgatggccaaggaggaggagctggtgaaggtcagagagaagcagctggctgcggagaacaggctcacggagatggagacgctgcagtctcagctcatggcagagaaattgcagctgcaggagcagctccaggcagaaaccgagctgtgtgccgaggctgaggagctccgggcccgcctgaccgccaagaagcaggaattagaagagatctgccatgacctagaggccagggtggaggaggaggaggagcgctgccagcacctgcaggcggagaagaagaagatgcagcagaacatccaggagcttgaggagcagctggaggaggaggagagcgcccggcagaagctgcagctggagaaggtgaccaccgaggcgaagctgaaaaagctggaggaggagcagatcatcctggaggaccagaactgcaagctggccaaggaaaagaaactgctggaagacagaatagctgagttcaccaccaacctcacagaagaggaggagaaatctaagagcctcgccaagctcaagaacaagcatgaggcaatgatcactgacttggaagagcgcctccgcagggaggagaagcagcgacaggagctggagaagacccgccggaagctggagggagactccacagacctcagcgaccagatcgccgagctccaggcccagatcgcggagctcaagatgcagctggccaagaaagaggaggagctccaggccgccctggccagagtggaagaggaagctgcccagaagaacatggccctcaagaagatccgggagctggaatctcagatctctgaactccaggaagacctggagtctgagcgtgcttccaggaataaagctgagaagcagaaacgggaccttggggaagagctagaggcgctgaaaacagagttggaggacacgctggattccacagctgcccagcaggagctcaggtcaaaacgtgagcaggaggtgaacatcctgaagaagaccctggaggaggaggccaagacccacgaggcccagatccaggagatgaggcagaagcactcacaggccgtggaggagctggcggagcagctggagcagacgaagcgggtgaaagcaaacctcgagaaggcaaagcagactctggagaacgagcggggggagctggccaacgaggtgaaggtgctgctgcagggcaaaggggactcggagcacaagcgcaagaaagtggaggcgcagctgcaggagctgcaggtcaagttcaacgagggagagcgcgtgcgcacagagctggccgacaaggtcaccaagctgcaggtggagctggacaacgtgaccgggcttctcagccagtccgacagcaagtccagcaagctcaccaaggacttctccgcgctggagtcccagctgcaggacactcaggagctgctgcaggaggagaaccggcagaagctgagcctgagcaccaagctcaagcaggtggaggacgagaagaattccttccgggagcagctggaggaggaggaggaggccaagcacaacctggagaagcagatcgccaccctccatgcccaggtggccgacatgaaaaagaagatggaggacagtgtggggtgcctggaaactgctgaggaggtgaagaggaagctccagaaggacctggagggcctgagccagcggcacgaggagaaggtggccgcctacgacaagctggagaagaccaagacgcggctgcagcaggagctggacgacctgctggtggacctggaccaccagcgccagagcgcgtgcaacctggagaagaagcagaagaagtttgaccagctcctggcggaggagaagaccatctctgccaagtatgcagaggagcgcgaccgggctgaggcggaggcccgagagaaggagaccaaggctctgtcgctggcccgggccctggaggaagccatggagcagaaggcggagctggagcggctcaacaagcagttccgcacggagatggaggaccttatgagctccaaggatgatgtgggcaagagtgtccacgagctggagaagtccaagcgggccctagagcagcaggtggaggagatgaagacgcagctggaagagctggaggacgagctgcaggccaccgaagatgccaagctgcggttggaggtcaacctgcaggccatgaaggcccagttcgagcgggacctgcagggccgggacgagcagagcgaggagaagaagaagcagctggtcagacaggtgcgggagatggaggcagagctggaggacgagaggcagcgccactgtccgctgtctccctcctgattctaaaatgtctcaagtgcaatgccccctcccctcctttaccgaggacagcctgcctctgccacagcaaggctgtcggggtcaagctggaaaggccagcagccttccagtggcttctcccaacactcttggggaccaaatatatttaatggttaagggacttgtcccaagtctgacagccagagcgttagaggggccagcggccctcccaggcgatcttgtgtctactctaggactgggcccgagggtggtttacctgcaccgttgactcagtatagtttaaaaatctgccacctgcacaggtatttttgaaagcaaaataaggttttcttttttcccctttcttgtaataaatgataaaattccgagtctttctcactgcctttgtttagaagagagtagctcgtcctcactggtctacactggttgccgaatttacttgtattcctaactgttttgtatatgctgcattgagacttacggcaagaaggcattttttttttttaaaggaaacaaactctcaaatcatgaagtgatataaaagctgcatatgcctacaaagctctgaattcaggtcccagttgctgtcacaaaggagtgagtgaaactcccaccctacccccttttttatataataaaagtgccttagcatgtgttgcagctgtcaccactacagtaagctggtttacagatgttttccactgagcatcacaataaagagaaccatgtgcta

SEQ ID NO: 314107 - DNA, 1747 bp, Homo sapiens
gactagttctaggactagttctagatcgcgagctaagaactagtaacgccgagcagtacaaggaccaggccgacaaggcatctacccgcctgaagcagctcaagcggcagctggaggaggccgaagaggaggcccagcgggccaacgcctcccgccggaaactgcagcgcgagctggaggacgccactgagacggccgatgccatgaaccgcgaagtcagctccctaaagaacaagctcaggcgcggggacctgccgtttgtcgtgccccgccgaatggcccggaaaggcgccggggatggctccgacgaagaggtagatggcaaagcggatggggctgaggccaaacctgccgaataagcctcttctcctgcagcctgagatggatggacagacagacaccacagcctccccttcccagaccccgcagcacgcctctccccaccttcttgggactgctgtgaacatgcctcctcctgccctccgccccgtccccccatcccgtttccctccaggtgttgttgagggcatttggcttcctctgctgcatccccttccagctccctcccctgctcagaatctgataccaaagagacagggcccgggcccaggcagagagcgaccagcaggctcctcagccctctcttgccaaaaagcacaagatgttgaggcgagcagggcaggcccccggggaggggccagagttttctatgaatctatttttcttcagactgaggccttttggtagtcggagcccccgcagtcgtcagcctccctgacgtctgccaccagcgcccccactcctcctcctttctttgctgtttgcaatcacacgtggtgacctcacacacctctgccccttgggcctcccactcccatggctctgggcggtccagaaggagcaggccctgggcctccacctctgtgcagggcacagaaggctggggtggggggaggagtggattcctccccaccctgtcccaggcagcgccactgtccgctgtctccctcctgattctaaaatgtctcaagtgcaatgccccctcccctcctttaccgaggacagcctgcctctgccacagcaaggctgtcggggtcaagctggaaaggccagcagccttccagtggcttctcccaacactcttggggaccaaatatatttaatggttaagggacttgtcccaagtctgacagccagagcgttagaggggccagcggccctcccaggcgatcttgtgtctactctaggactgggcccgagggtggtttacctgcaccgttgactcagtatagtttaaaaatctgccacctgcacaggtatttttgaaagcaaaataaggttttcttttttcccctttcttgtaataaatgataaaattccgagtctttctcactgcctttgtttagaagagagtagctcgtcctcactggtctacactggttgccgaatttacttgtattcctaactgttttgtatatgctgcattgagacttacggcaagaaggcattttttttttttaaaggaaacaaactctcaaatcatgaagtgatataaaagctgcatatgcctacaaagctctgaattcaggtcccagttgctgtcacaaaggagtgagtgaaactcccaccctacccccttttttatataataaaagtgccttagcatgtgttgcagctgtcaccactacagtaagctggtttacagatgttttccactgagcatcacaataaagagaaccatgtgcta

SEQ ID NO: 314108 - DNA, 5333 bp, Homo sapiens
cccgatattcggtcagtgggtgatagcaaaacctcgggtacgccaagaccgtgaagaatgacgaactcctcccgcttcggcaaattcattcgcatcaactttgatgtcaatggctacattgttggagccaacattgagacttatcttttggagaaatctcgtgctatccgccaagccaaggaagaacggaccttccacatcttctattatctcctgtctggggctggagagcacctgaagaccgatctcctgttggagccgtacaacaaataccgcttcctgtccaatggacacgtcaccatccccgggcagcaggacaaggacatgttccaggagaccatggaggccatgaggattatgggcatcccagaagaggagcaaatgggcctgctgcgggtcatctcaggggttcttcagctcggcaacatcgtcttcaagaaggagcggaacactgaccaggcgtccatgcccgacaacacagctgcccaaaaggtgtcccatctcttgggtatcaatgtgaccgatttcaccagaggaatcctcaccccgcgcatcaaggtgggacgggattacgtccagaaggcgcagactaaagagcaggctgactttgccatcgaggccttggccaaggcgacctatgagcggatgttccgctggctggtgctgcgcatcaacaaggctctggacaagaccaagaggcagggcgcctccttcatcgggatcctggacattgccggcttcgagatctttgatctgaactcgtttgagcagctgtgcatcaattacaccaatgagaagctgcagcagctcttcaaccacaccatgttcatcctggagcaggaggagtaccagcgcgagggcatcgagtggaacttcatcgactttggcctcgacctgcagccctgcatcgacctcattgagaagccagcaggccccccgggcattctggccctgctggacgaggagtgctggttccccaaagccaccgacaagagcttcgtggagaaggtgatgcaggagcagggcacccaccccaagttccagaagcccaagcagctgaaggacaaagctgatttctgcattatccactatgccggcaaggtggattacaaagctgacgagtggctgatgaagaacatggatcccctgaatgacaacatcgccacactgctccaccagtcctctgacaagtttgtctcggagctgtggaaggatgtggaccgcatcatcggcctggaccaggtggccggcatgtcggagaccgcactgcccggggccttcaagacgcggaagggcatgttccgcactgtggggcagctttacaaggagcagctggccaagctgatggctacgctgaggaacacgaaccccaactttgtccgctgcatcatccccaaccacgagaagaaggccggcaagctggacccgcatctcgtgctggaccagctgcgctgcaacggtgttctcgagggcatccgtatctgccgccagggcttccccaacagggtggtcttccaggagtttcggcagagatatgagatcctgactccaaactccattcccaagggtttcatggacgggaagcaggcgtgcgtgctcatgataaaagccctggagctcgacagcaatctgtaccgcattggccagagcaaagtcttcttccgtgccggtgtgctggcccacctggaggaggagcgagacctgaagatcaccgacgtcatcatagggttccaggcctgctgcaggggctacctggccaggaaagcatttgccaagcggcagcagcagcttaccgccatgaaggtcctccagcggaactgcgctgcctacctgaagctgcggaactggcagtggtggcggctcttcaccaaggtcaagccgctgctgcaggtgagccggcaggaggaggagatgatggccaaggaggaggagctggtgaaggtcagagagaagcagctggctgcggagaacaggctcacggagatggagacgctgcagtctcagctcatggcagagaaattgcagctgcaggagcagctccaggcagaaaccgagctgtgtgccgaggctgaggagctccgggcccgcctgaccgccaagaagcaggaattagaagagatctgccatgacctagaggccagggtggaggaggaggaggagcgctgccagcacctgcaggcggagaagaagaagatgcagcagaacatccaggagcttgaggagcagctggaggaggaggagagcgcccggcagaagctgcagctggagaaggtgaccaccgaggcgaagctgaaaaagctggaggaggagcagatcatcctggaggaccagaactgcaagctggccaaggaaaagaaactgctggaagacagaatagctgagttcaccaccaacctcacagaagaggaggagaaatctaagagcctcgccaagctcaagaacaagcatgaggcaatgatcactgacttggaagagcgcctccgcagggaggagaagcagcgacaggagctggagaagacccgccggaagctggagggagactccacagacctcagcgaccagatcgccgagctccaggcccagatcgcggagctcaagatgcagctggccaagaaagaggaggagctccaggccgccctggccagagtggaagaggaagctgcccagaagaacatggccctcaagaagatccgggagctggaatctcagatctctgaactccaggaagacctggagtctgagcgtgcttccaggaataaagctgagaagcagaaacgggaccttggggaagagctagaggcgctgaaaacagagttggaggacacgctggattccacagctgcccagcaggagctcaggtcaaaacgtgagcaggaggtgaacatcctgaagaagaccctggaggaggaggccaagacccacgaggcccagatccaggagatgaggcagaagcactcacaggccgtggaggagctggcggagcagctggagcagacgaagcgggtgaaagcaaacctcgagaaggcaaagcagactctggagaacgagcggggggagctggccaacgaggtgaaggtgctgctgcagggcaaaggggactcggagcacaagcgcaagaaagtggaggcgcagctgcaggagctgcaggtcaagttcaacgagggagagcgcgtgcgcacagagctggccgacaaggtcaccaagctgcaggtggagctggacaacgtgaccgggcttctcagccagtccgacagcaagtccagcaagctcaccaaggacttctccgcgctggagtcccagctgcaggacactcaggagctgctgcaggaggagaaccggcagaagctgagcctgagcaccaagctcaagcaggtggaggacgagaagaattccttccgggagcagctggaggaggaggaggaggccaagcacaacctggagaagcagatcgccaccctccatgcccaggtggccgacatgaaaaagaagatggaggacagtgtggggtgcctggaaactgctgaggaggtgaagaggaagctccagaaggacctggagggcctgagccagcggcacgaggagaaggtggccgcctacgacaagctggagaagaccaagacgcggctgcagcaggagctggacgacctgctggtggacctggaccaccagcgccagagcgcgtgcaacctggagaagaagcagaagaagtttgaccagctcctggcggaggagaagaccatctctgccaagtatgcagaggagcgcgaccgggctgaggcggaggcccgagagaaggagaccaaggctctgtcgctggcccgggccctggaggaagccatggagcagaaggcggagctggagcggctcaacaagcagttccgcacggagatggaggaccttatgagctccaaggatgatgtgggcaagagtgtccacgagctggagaagtccaagcgggccctagagcagcaggtggaggagatgaagacgcagctggaagagctggaggacgagctgcaggccaccgaagatgccaagctgcggttggaggtcaacctgcaggccatgaaggcccagttcgagcgggacctgcagggccgggacgagcagagcgaggagaagaagaagcagctggtcagacaggtgcgggagatggaggcagagctggaggacgagaggaagcagcgctcgatggcagtggccgcccggaagaagctggagatggacctgaaggacctggaggcgcacatcgactcggccaacaagaaccgggacgaagccatcaaacagctgcggaagctgcaggcccagatgaaggactgcatgcgcgagctggatgacacccgcgcctctcgtgaggagatcctggcccaggccaaagagaacgagaagaagctgaagagcatggaggccgagatgatccagttgcaggaggaactggcagccgcggagcgtgccaagcgccaggcccagcaggagcgggatgagctggctgacgagatcgccaacagcagcggcaaaggagccctggcgttagaggagaagcggcgtctggaggcccgcatcgcccagctggaggaggagctggaggaggagcagggcaacacggagctgatcaacgaccggctgaagaaggccaacctgcagatcgaccagatcaacaccgacctgaacctggagcgcagccacgcccagaagaacgagaatgctcggcagcagctggaacgccagaacaaggagcttaaggtcaagctgcaggagatggagggcactgtcaagtccaagtacaaggcctccatcaccgccctcgaggccaagattgcacagctggaggagcagctggacaacgagaccaaggagcgccaggcagcctgcaaacaggtgcgtcggaccgagaagaagctgaaggatgtgctgctgcaggtggatgacgagcggaggaacgccgagcagtacaaggaccaggccgacaaggcatctacccgcctgaagcagctcaagcggcagctggaggaggccgaagaggaggcccagcgggccaacgcctcccgccggaaactgcagcgcgagctggaggacgccactgagacggccgatgccatgaaccgcgaagtcagctccctaaagaacaagctcagtccacagaaattgggcctcagccaaccccacgctcaacagtgccagccctgcccagagcccaagggatcgcctcgctgacagaccccagaccccggccacgccaccccctccttctaggtacctgtgcccccagtctcaagcatcactcccgttctccctcacatgcctccctgatgcctctggaggatcctcta

SEQ ID NO: 314109 - DNA, 4858 bp, Homo sapiens
cccgatattcggtcagtgggtgatagcaaaacctcgggtacgccaagaccgtgaagaatgacgaactcctcccgcttcggcaaattcattcgcatcaactttgatgtcaatggctacattgttggagccaacattgagacttatcttttggagaaatctcgtgctatccgccaagccaaggaagaacggaccttccacatcttctattatctcctgtctggggctggagagcacctgaagaccgatctcctgttggagccgtacaacaaataccgcttcctgtccaatggacacgtcaccatccccgggcagcaggacaaggacatgttccaggagaccatggaggccatgaggattatgggcatcccagaagaggagcaaatgggcctgctgcgggtcatctcaggggttcttcagctcggcaacatcgtcttcaagaaggagcggaacactgaccaggcgtccatgcccgacaacacagctgcccaaaaggtgtcccatctcttgggtatcaatgtgaccgatttcaccagaggaatcctcaccccgcgcatcaaggtgggacgggattacgtccagaaggcgcagactaaagagcaggctgactttgccatcgaggccttggccaaggcgacctatgagcggatgttccgctggctggtgctgcgcatcaacaaggctctggacaagaccaagaggcagggcgcctccttcatcgggatcctggacattgccggcttcgagatctttgatctgaactcgtttgagcagctgtgcatcaattacaccaatgagaagctgcagcagctcttcaaccacaccatgttcatcctggagcaggaggagtaccagcgcgagggcatcgagtggaacttcatcgactttggcctcgacctgcagccctgcatcgacctcattgagaagccagcaggccccccgggcattctggccctgctggacgaggagtgctggttccccaaagccaccgacaagagcttcgtggagaaggtgatgcaggagcagggcacccaccccaagttccagaagcccaagcagctgaaggacaaagctgatttctgcattatccactatgccggcaaggtggattacaaagctgacgagtggctgatgaagaacatggatcccctgaatgacaacatcgccacactgctccaccagtcctctgacaagtttgtctcggagctgtggaaggatgtggaccgcatcatcggcctggaccaggtggccggcatgtcggagaccgcactgcccggggccttcaagacgcggaagggcatgttccgcactgtggggcagctttacaaggagcagctggccaagctgatggctacgctgaggaacacgaaccccaactttgtccgctgcatcatccccaaccacgagaagaaggccggcaagctggacccgcatctcgtgctggaccagctgcgctgcaacggtgttctcgagggcatccgtatctgccgccagggcttccccaacagggtggtcttccaggagtttcggcagagatatgagatcctgactccaaactccattcccaagggtttcatggacgggaagcaggcgtgcgtgctcatgataaaagccctggagctcgacagcaatctgtaccgcattggccagagcaaagtcttcttccgtgccggtgtgctggcccacctggaggaggagcgagacctgaagatcaccgacgtcatcatagggttccaggcctgctgcaggggctacctggccaggaaagcatttgccaagcggcagcagcagcttaccgccatgaaggtcctccagcggaactgcgctgcctacctgaagctgcggaactggcagtggtggcggctcttcaccaaggtcaagccgctgctgcaggtgagccggcaggaggaggagatgatggccaaggaggaggagctggtgaaggtcagagagaagcagctggctgcggagaacaggctcacggagatggagacgctgcagtctcagctcatggcagagaaattgcagctgcaggagcagctccaggcagaaaccgagctgtgtgccgaggctgaggagctccgggcccgcctgaccgccaagaagcaggaattagaagagatctgccatgacctagaggccagggtggaggaggaggaggagcgctgccagcacctgcaggcggagaagaagaagatgcagcagaacatccaggagcttgaggagcagctggaggaggaggagagcgcccggcagaagctgcagctggagaaggtgaccaccgaggcgaagctgaaaaagctggaggaggagcagatcatcctggaggaccagaactgcaagctggccaaggaaaagaaactgctggaagacagaatagctgagttcaccaccaacctcacagaagaggaggagaaatctaagagcctcgccaagctcaagaacaagcatgaggcaatgatcactgacttggaagagcgcctccgcagggaggagaagcagcgacaggagctggagaagacccgccggaagctggagggagactccacagacctcagcgaccagatcgccgagctccaggcccagatcgcggagctcaagatgcagctggccaagaaagaggaggagctccaggccgccctggccagagtggaagaggaagctgcccagaagaacatggccctcaagaagatccgggagctggaatctcagatctctgaactccaggaagacctggagtctgagcgtgcttccaggaataaagctgagaagcagaaacgggaccttggggaagagctagaggcgctgaaaacagagttggaggacacgctggattccacagctgcccagcaggagctcaggtcaaaacgtgagcaggaggtgaacatcctgaagaagaccctggaggaggaggccaagacccacgaggcccagatccaggagatgaggcagaagcactcacaggccgtggaggagctggcggagcagctggagcagacgaagcgggtgaaagcaaacctcgagaaggcaaagcagactctggagaacgagcggggggagctggccaacgaggtgaaggtgctgctgcagggcaaaggggactcggagcacaagcgcaagaaagtggaggcgcagctgcaggagctgcaggtcaagttcaacgagggagagcgcgtgcgcacagagctggccgacaaggtcaccaagctgcaggtggagctggacaacgtgaccgggcttctcagccagtccgacagcaagtccagcaagctcaccaaggacttctccgcgctggagtcccagctgcaggacactcaggagctgctgcaggaggagaaccggcagaagctgagcctgagcaccaagctcaagcaggtggaggacgagaagaattccttccgggagcagctggaggaggaggaggaggccaagcacaacctggagaagcagatcgccaccctccatgcccaggtggccgacatgaaaaagaagatggaggacagtgtggggtgcctggaaactgctgaggaggtgaagaggaagctccagaaggacctggagggcctgagccagcggcacgaggagaaggtggccgcctacgacaagctggagaagaccaagacgcggctgcagcaggagctggacgacctgctggtggacctggaccaccagcgccagagcgcgtgcaacctggagaagaagcagaagaagtttgaccagctcctggcggaggagaagaccatctctgccaagtatgcagaggagcgcgaccgggctgaggcggaggcccgagagaaggagaccaaggctctgtcgctggcccgggccctggaggaagccatggagcagaaggcggagctggagcggctcaacaagcagttccgcacggagatggaggaccttatgagctccaaggatgatgtgggcaagagtgtccacgagctggagaagtccaagcgggccctagagcagcaggtggaggagatgaagacgcagctggaagagctggaggacgagctgcaggccaccgaagatgccaagctgcggttggaggtcaacctgcaggccatgaaggcccagttcgagcgggacctgcagggccgggacgagcagagcgaggagaagaagaagcagctggtcagacaggtgcgggagatggaggcagagctggaggacgagaggaagcagcgctcgatggcagtggccgcccggaagaagctggagatggacctgaaggacctggaggcgcacatcgactcggccaacaagaaccgggacgaagccatcaaacagctgcggaagctgcaggcccagatgaaggactgcatgcgcgagctggatgacacccgcgcctctcgtgaggagatcctggcccaggccaaagagaacgagaagaagctgaagagcatggaggccgagatgatccagttgcaggaggaactggcagccgcggagcgtgccaagcgccaggcccagcaggagcgggatgagctggctgacgagatcgccaacagcagcggcaaaggagccctggcgttagaggagaagcggcgtctggaggcccgcatcgcccagctggaggaggagctggaggaggagcagggcaacacggagctgatcaacgaccggctgaagaaggccaacctgcagatcgaccagatcaacaccgacctgaacctggagcgcagccacgcccagaagaacgagaatgctcggcagcagctggaacgccagggagctctggtagcctggcctttcctggacagactgaagagctgagcagggcactgccagcctgtccctcattacccaaggcaagggcagacagcccccagaagcagcagcagcagaatctctcgtg

SEQ ID NO: 314110 - DNA, 4390 bp, Homo sapiens
cccgatattcggtcagtgggtgatagcaaaacctcgggtacgccaagaccgtgaagaatgacgaactcctcccgcttcggcaaattcattcgcatcaactttgatgtcaatggctacattgttggagccaacattgagacttatcttttggagaaatctcgtgctatccgccaagccaaggaagaacggaccttccacatcttctattatctcctgtctggggctggagagcacctgaagaccgatctcctgttggagccgtacaacaaataccgcttcctgtccaatggacacgtcaccatccccgggcagcaggacaaggacatgttccaggagaccatggaggccatgaggattatgggcatcccagaagaggagcaaatgggcctgctgcgggtcatctcaggggttcttcagctcggcaacatcgtcttcaagaaggagcggaacactgaccaggcgtccatgcccgacaacacagctgcccaaaaggtgtcccatctcttgggtatcaatgtgaccgatttcaccagaggaatcctcaccccgcgcatcaaggtgggacgggattacgtccagaaggcgcagactaaagagcaggctgactttgccatcgaggccttggccaaggcgacctatgagcggatgttccgctggctggtgctgcgcatcaacaaggctctggacaagaccaagaggcagggcgcctccttcatcgggatcctggacattgccggcttcgagatctttgatctgaactcgtttgagcagctgtgcatcaattacaccaatgagaagctgcagcagctcttcaaccacaccatgttcatcctggagcaggaggagtaccagcgcgagggcatcgagtggaacttcatcgactttggcctcgacctgcagccctgcatcgacctcattgagaagccagcaggccccccgggcattctggccctgctggacgaggagtgctggttccccaaagccaccgacaagagcttcgtggagaaggtgatgcaggagcagggcacccaccccaagttccagaagcccaagcagctgaaggacaaagctgatttctgcattatccactatgccggcaaggtggattacaaagctgacgagtggctgatgaagaacatggatcccctgaatgacaacatcgccacactgctccaccagtcctctgacaagtttgtctcggagctgtggaaggatgtggaccgcatcatcggcctggaccaggtggccggcatgtcggagaccgcactgcccggggccttcaagacgcggaagggcatgttccgcactgtggggcagctttacaaggagcagctggccaagctgatggctacgctgaggaacacgaaccccaactttgtccgctgcatcatccccaaccacgagaagaaggccggcaagctggacccgcatctcgtgctggaccagctgcgctgcaacggtgttctcgagggcatccgtatctgccgccagggcttccccaacagggtggtcttccaggagtttcggcagagatatgagatcctgactccaaactccattcccaagggtttcatggacgggaagcaggcgtgcgtgctcatgataaaagccctggagctcgacagcaatctgtaccgcattggccagagcaaagtcttcttccgtgccggtgtgctggcccacctggaggaggagcgagacctgaagatcaccgacgtcatcatagggttccaggcctgctgcaggggctacctggccaggaaagcatttgccaagcggcagcagcagcttaccgccatgaaggtcctccagcggaactgcgctgcctacctgaagctgcggaactggcagtggtggcggctcttcaccaaggtcaagccgctgctgcaggtgagccggcaggaggaggagatgatggccaaggaggaggagctggtgaaggtcagagagaagcagctggctgcggagaacaggctcacggagatggagacgctgcagtctcagctcatggcagagaaattgcagctgcaggagcagctccaggcagaaaccgagctgtgtgccgaggctgaggagctccgggcccgcctgaccgccaagaagcaggaattagaagagatctgccatgacctagaggccagggtggaggaggaggaggagcgctgccagcacctgcaggcggagaagaagaagatgcagcagaacatccaggagcttgaggagcagctggaggaggaggagagcgcccggcagaagctgcagctggagaaggtgaccaccgaggcgaagctgaaaaagctggaggaggagcagatcatcctggaggaccagaactgcaagctggccaaggaaaagaaactgctggaagacagaatagctgagttcaccaccaacctcacagaagaggaggagaaatctaagagcctcgccaagctcaagaacaagcatgaggcaatgatcactgacttggaagagcgcctccgcagggaggagaagcagcgacaggagctggagaagacccgccggaagctggagggagactccacagacctcagcgaccagatcgccgagctccaggcccagatcgcggagctcaagatgcagctggccaagaaagaggaggagctccaggccgccctggccagagtggaagaggaagctgcccagaagaacatggccctcaagaagatccgggagctggaatctcagatctctgaactccaggaagacctggagtctgagcgtgcttccaggaataaagctgagaagcagaaacgggaccttggggaagagctagaggcgctgaaaacagagttggaggacacgctggattccacagctgcccagcaggagctcaggtcaaaacgtgagcaggaggtgaacatcctgaagaagaccctggaggaggaggccaagacccacgaggcccagatccaggagatgaggcagaagcactcacaggccgtggaggagctggcggagcagctggagcagacgaagcgggtgaaagcaaacctcgagaaggcaaagcagactctggagaacgagcggggggagctggccaacgaggtgaaggtgctgctgcagggcaaaggggactcggagcacaagcgcaagaaagtggaggcgcagctgcaggagctgcaggtcaagttcaacgagggagagcgcgtgcgcacagagctggccgacaaggtcaccaagctgcaggtggagctggacaacgtgaccgggcttctcagccagtccgacagcaagtccagcaagctcaccaaggacttctccgcgctggagtcccagctgcaggacactcaggagctgctgcaggaggagaaccggcagaagctgagcctgagcaccaagctcaagcaggtggaggacgagaagaattccttccgggagcagctggaggaggaggaggaggccaagcacaacctggagaagcagatcgccaccctccatgcccaggtggccgacatgaaaaagaagatggaggacagtgtggggtgcctggaaactgctgaggaggtgaagaggaagctccagaaggacctggagggcctgagccagcggcacgaggagaaggtggccgcctacgacaagctggagaagaccaagacgcggctgcagcaggagctggacgacctgctggtggacctggaccaccagcgccagagcgcgtgcaacctggagaagaagcagaagaagtttgaccagctcctggcggaggagaagaccatctctgccaagtatgcagaggagcgcgaccgggctgaggcggaggcccgagagaaggagaccaaggctctgtcgctggcccgggccctggaggaagccatggagcagaaggcggagctggagcggctcaacaagcagttccgcacggagatggaggaccttatgagctccaaggatgatgtgggcaagagtgtccacgagctggagaagtccaagcgggccctagagcagcaggtggaggagatgaagacgcagctggaagagctggaggacgagctgcaggccaccgaagatgccaagctgcggttggaggtcaacctgcaggccatgaaggcccagttcgagcgggacctgcagggccgggacgagcagagcgaggagaagaagaagcagctggtcagacaggtgcgggagatggaggcagagctggaggacgagaggaagcagcgctcgatggcagtggccgcccggaagaagctggagatggacctgaaggacctggaggcgcacatcgactcggccaacaagaaccgggacgaagccatcaaacagctgcggaagctgcaggcaccagatgataggacgtgcatgcgcgagtctcgtgattgaaacctgctcttctggtgatagcgtgtttcctgtatgcttttcc

SEQ ID NO: 314111 - DNA, 4177 bp, Homo sapiens
cccgatattcggtcagtgggtgatagcaaaacctcgggtacgccaagaccgtgaagaatgacgaactcctcccgcttcggcaaattcattcgcatcaactttgatgtcaatggctacattgttggagccaacattgagacttatcttttggagaaatctcgtgctatccgccaagccaaggaagaacggaccttccacatcttctattatctcctgtctggggctggagagcacctgaagaccgatctcctgttggagccgtacaacaaataccgcttcctgtccaatggacacgtcaccatccccgggcagcaggacaaggacatgttccaggagaccatggaggccatgaggattatgggcatcccagaagaggagcaaatgggcctgctgcgggtcatctcaggggttcttcagctcggcaacatcgtcttcaagaaggagcggaacactgaccaggcgtccatgcccgacaacacagctgcccaaaaggtgtcccatctcttgggtatcaatgtgaccgatttcaccagaggaatcctcaccccgcgcatcaaggtgggacgggattacgtccagaaggcgcagactaaagagcaggctgactttgccatcgaggccttggccaaggcgacctatgagcggatgttccgctggctggtgctgcgcatcaacaaggctctggacaagaccaagaggcagggcgcctccttcatcgggatcctggacattgccggcttcgagatctttgatctgaactcgtttgagcagctgtgcatcaattacaccaatgagaagctgcagcagctcttcaaccacaccatgttcatcctggagcaggaggagtaccagcgcgagggcatcgagtggaacttcatcgactttggcctcgacctgcagccctgcatcgacctcattgagaagccagcaggccccccgggcattctggccctgctggacgaggagtgctggttccccaaagccaccgacaagagcttcgtggagaaggtgatgcaggagcagggcacccaccccaagttccagaagcccaagcagctgaaggacaaagctgatttctgcattatccactatgccggcaaggtggattacaaagctgacgagtggctgatgaagaacatggatcccctgaatgacaacatcgccacactgctccaccagtcctctgacaagtttgtctcggagctgtggaaggatgtggaccgcatcatcggcctggaccaggtggccggcatgtcggagaccgcactgcccggggccttcaagacgcggaagggcatgttccgcactgtggggcagctttacaaggagcagctggccaagctgatggctacgctgaggaacacgaaccccaactttgtccgctgcatcatccccaaccacgagaagaaggccggcaagctggacccgcatctcgtgctggaccagctgcgctgcaacggtgttctcgagggcatccgtatctgccgccagggcttccccaacagggtggtcttccaggagtttcggcagagatatgagatcctgactccaaactccattcccaagggtttcatggacgggaagcaggcgtgcgtgctcatgataaaagccctggagctcgacagcaatctgtaccgcattggccagagcaaagtcttcttccgtgccggtgtgctggcccacctggaggaggagcgagacctgaagatcaccgacgtcatcatagggttccaggcctgctgcaggggctacctggccaggaaagcatttgccaagcggcagcagcagcttaccgccatgaaggtcctccagcggaactgcgctgcctacctgaagctgcggaactggcagtggtggcggctcttcaccaaggtcaagccgctgctgcaggtgagccggcaggaggaggagatgatggccaaggaggaggagctggtgaaggtcagagagaagcagctggctgcggagaacaggctcacggagatggagacgctgcagtctcagctcatggcagagaaattgcagctgcaggagcagctccaggcagaaaccgagctgtgtgccgaggctgaggagctccgggcccgcctgaccgccaagaagcaggaattagaagagatctgccatgacctagaggccagggtggaggaggaggaggagcgctgccagcacctgcaggcggagaagaagaagatgcagcagaacatccaggagcttgaggagcagctggaggaggaggagagcgcccggcagaagctgcagctggagaaggtgaccaccgaggcgaagctgaaaaagctggaggaggagcagatcatcctggaggaccagaactgcaagctggccaaggaaaagaaactgctggaagacagaatagctgagttcaccaccaacctcacagaagaggaggagaaatctaagagcctcgccaagctcaagaacaagcatgaggcaatgatcactgacttggaagagcgcctccgcagggaggagaagcagcgacaggagctggagaagacccgccggaagctggagggagactccacagacctcagcgaccagatcgccgagctccaggcccagatcgcggagctcaagatgcagctggccaagaaagaggaggagctccaggccgccctggccagagtggaagaggaagctgcccagaagaacatggccctcaagaagatccgggagctggaatctcagatctctgaactccaggaagacctggagtctgagcgtgcttccaggaataaagctgagaagcagaaacgggaccttggggaagagctagaggcgctgaaaacagagttggaggacacgctggattccacagctgcccagcaggagctcaggtcaaaacgtgagcaggaggtgaacatcctgaagaagaccctggaggaggaggccaagacccacgaggcccagatccaggagatgaggcagaagcactcacaggccgtggaggagctggcggagcagctggagcagacgaagcgggtgaaagcaaacctcgagaaggcaaagcagactctggagaacgagcggggggagctggccaacgaggtgaaggtgctgctgcagggcaaaggggactcggagcacaagcgcaagaaagtggaggcgcagctgcaggagctgcaggtcaagttcaacgagggagagcgcgtgcgcacagagctggccgacaaggtcaccaagctgcaggtggagctggacaacgtgaccgggcttctcagccagtccgacagcaagtccagcaagctcaccaaggacttctccgcgctggagtcccagctgcaggacactcaggagctgctgcaggaggagaaccggcagaagctgagcctgagcaccaagctcaagcaggtggaggacgagaagaattccttccgggagcagctggaggaggaggaggaggccaagcacaacctggagaagcagatcgccaccctccatgcccaggtggccgacatgaaaaagaagatggaggacagtgtggggtgcctggaaactgctgaggaggtgaagaggaagctccagaaggacctggagggcctgagccagcggcacgaggagaaggtggccgcctacgacaagctggagaagaccaagacgcggctgcagcaggagctggacgacctgctggtggacctggaccaccagcgccagagcgcgtgcaacctggagaagaagcagaagaagtttgaccagctcctggcggaggagaagaccatctctgccaagtatgcagaggagcgcgaccgggctgaggcggaggcccgagagaaggagaccaaggctctgtcgctggcccgggccctggaggaagccatggagcagaaggcggagctggagcggctcaacaagcagttccgcacggagatggaggaccttatgagctccaaggatgatgtgggcaagagtgtccacgagctggagaagtccaagcgggccctagagcagcaggtggaggagatgaagacgcagctggaagagctggaggacgagctgcaggccaccgaagatgccaagctgcggttggaggtcaacctgcaggccatgaaggcccagttcgagcgggacctgcagggccgggatgcatgctgacagcaatgggtactactaaacctgccttacgtggtcctaccaagcctacggtcaactacaagct

SEQ ID NO: 314112 - DNA, 1358 bp, Homo sapiens
gactagttctaggactagttctagatcgcgagctaagaactagtaacgccgagcagtacaaggaccaggccgacaaggcatctacccgcctgaagcagctcaagcggcagctggaggaggccgaagaggaggcccagcgggccaacgcctcccgccggaaactgcagcgcgagctggaggacgccactgagacggccgatgccatgaaccgcgaagtcagctccctaaagaacaagctcaggcgcggggacctgccgtttgtcgtgccccgccgaatggcccggaaaggcgccggggatggctccgacgaagaggtagatggcaaagcggatggggctgaggccaaacctgccgaataagcctcttctcctgcagcctgagatggatggacagacagacaccacagcctccccttcccagaccccgcagcacgcctctccccaccttcttgggactgctgtgaacatgcctcctcctgccctctcccatggctctgggcggtccagaaggagcaggccctgggcctccacctctgtgcagggcacagaaggctggggtggggggaggagtggattcctccccaccctgtcccaggcagcgccactgtccgctgtctccctcctgattctaaaatgtctcaagtgcaatgccccctcccctcctttaccgaggacagcctgcctctgccacagcaaggctgtcggggtcaagctggaaaggccagcagccttccagtggcttctcccaacactcttggggaccaaatatatttaatggttaagggacttgtcccaagtctgacagccagagcgttagaggggccagcggccctcccaggcgatcttgtgtctactctaggactgggcccgagggtggtttacctgcaccgttgactcagtatagtttaaaaatctgccacctgcacaggtatttttgaaagcaaaataaggttttcttttttcccctttcttgtaataaatgataaaattccgagtctttctcactgcctttgtttagaagagagtagctcgtcctcactggtctacactggttgccgaatttacttgtattcctaactgttttgtatatgctgcattgagacttacggcaagaaggcattttttttttttaaaggaaacaaactctcaaatcatgaagtgatataaaagctgcatatgcctacaaagctctgaattcaggtcccagttgctgtcacaaaggagtgagtgaaactcccaccctacccccttttttatataataaaagtgccttagcatgtgttgcagctgtcaccactacagtaagctggtttacagatgttttccactgagcatcacaataaagagaaccatgtgcta

SEQ ID NO: 314113 - DNA, 3589 bp, Homo sapiens
cccgatattcggtcagtgggtgatagcaaaacctcgggtacgccaagaccgtgaagaatgacgaactcctcccgcttcggcaaattcattcgcatcaactttgatgtcaatggctacattgttggagccaacattgagacttatcttttggagaaatctcgtgctatccgccaagccaaggaagaacggaccttccacatcttctattatctcctgtctggggctggagagcacctgaagaccgatctcctgttggagccgtacaacaaataccgcttcctgtccaatggacacgtcaccatccccgggcagcaggacaaggacatgttccaggagaccatggaggccatgaggattatgggcatcccagaagaggagcaaatgggcctgctgcgggtcatctcaggggttcttcagctcggcaacatcgtcttcaagaaggagcggaacactgaccaggcgtccatgcccgacaacacagctgcccaaaaggtgtcccatctcttgggtatcaatgtgaccgatttcaccagaggaatcctcaccccgcgcatcaaggtgggacgggattacgtccagaaggcgcagactaaagagcaggctgactttgccatcgaggccttggccaaggcgacctatgagcggatgttccgctggctggtgctgcgcatcaacaaggctctggacaagaccaagaggcagggcgcctccttcatcgggatcctggacattgccggcttcgagatctttgatctgaactcgtttgagcagctgtgcatcaattacaccaatgagaagctgcagcagctcttcaaccacaccatgttcatcctggagcaggaggagtaccagcgcgagggcatcgagtggaacttcatcgactttggcctcgacctgcagccctgcatcgacctcattgagaagccagcaggccccccgggcattctggccctgctggacgaggagtgctggttccccaaagccaccgacaagagcttcgtggagaaggtgatgcaggagcagggcacccaccccaagttccagaagcccaagcagctgaaggacaaagctgatttctgcattatccactatgccggcaaggtggattacaaagctgacgagtggctgatgaagaacatggatcccctgaatgacaacatcgccacactgctccaccagtcctctgacaagtttgtctcggagctgtggaaggatgtggaccgcatcatcggcctggaccaggtggccggcatgtcggagaccgcactgcccggggccttcaagacgcggaagggcatgttccgcactgtggggcagctttacaaggagcagctggccaagctgatggctacgctgaggaacacgaaccccaactttgtccgctgcatcatccccaaccacgagaagaaggccggcaagctggacccgcatctcgtgctggaccagctgcgctgcaacggtgttctcgagggcatccgtatctgccgccagggcttccccaacagggtggtcttccaggagtttcggcagagatatgagatcctgactccaaactccattcccaagggtttcatggacgggaagcaggcgtgcgtgctcatgataaaagccctggagctcgacagcaatctgtaccgcattggccagagcaaagtcttcttccgtgccggtgtgctggcccacctggaggaggagcgagacctgaagatcaccgacgtcatcatagggttccaggcctgctgcaggggctacctggccaggaaagcatttgccaagcggcagcagcagcttaccgccatgaaggtcctccagcggaactgcgctgcctacctgaagctgcggaactggcagtggtggcggctcttcaccaaggtcaagccgctgctgcaggtgagccggcaggaggaggagatgatggccaaggaggaggagctggtgaaggtcagagagaagcagctggctgcggagaacaggctcacggagatggagacgctgcagtctcagctcatggcagagaaattgcagctgcaggagcagctccaggcagaaaccgagctgtgtgccgaggctgaggagctccgggcccgcctgaccgccaagaagcaggaattagaagagatctgccatgacctagaggccagggtggaggaggaggaggagcgctgccagcacctgcaggcggagaagaagaagatgcagcagaacatccaggagcttgaggagcagctggaggaggaggagagcgcccggcagaagctgcagctggagaaggtgaccaccgaggcgaagctgaaaaagctggaggaggagcagatcatcctggaggaccagaactgcaagctggccaaggaaaagaaactgctggaagacagaatagctgagttcaccaccaacctcacagaagaggaggagaaatctaagagcctcgccaagctcaagaacaagcatgaggcaatgatcactgacttggaagagcgcctccgcagggaggagaagcagcgacaggagctggagaagacccgccggaagctggagggagactccacagacctcagcgaccagatcgccgagctccaggcccagatcgcggagctcaagatgcagctggccaagaaagaggaggagctccaggccgccctggccagagtggaagaggaagctgcccagaagaacatggccctcaagaagatccgggagctggaatctcagatctctgaactccaggaagacctggagtctgagcgtgcttccaggaataaagctgagaagcagaaacgggaccttggggaagagctagaggcgctgaaaacagagttggaggacacgctggattccacagctgcccagcaggagctcaggtcaaaacgtgagcaggaggtgaacatcctgaagaagaccctggaggaggaggccaagacccacgaggcccagatccaggagatgaggcagaagcactcacaggccgtggaggagctggcggagcagctggagcagacgaagcgggtgaaagcaaacctcgagaaggcaaagcagactctggagaacgagcggggggagctggccaacgaggtgaaggtgctgctgcagggcaaaggggactcggagcacaagcgcaagaaagtggaggcgcagctgcaggagctgcaggtcaagttcaacgagggagagcgcgtgcgcacagagctggccgacaaggtcaccaagctgcaggtggagctggacaacgtgaccgggcttctcagccagtccgacagcaagtccagcaagctcaccaaggacttctccgcgctggagtcccagctgcaggacactcaggagctgctgcaggaggagaaccggcagaagctgagcctgagcaccaagctcaagcaggtggaggacgagaagaattccttccgggagcagctggaggaggaggaggaggccaagcacaacctggagaagcagatcgccaccctccatgcccaggtggcgacttggacaagacgttggcggacgtgtgggtgccgggacctgctgggagggaagcaggaactcccacggcgggggcctgaccgggcgaggcagggggcgctgaaaggggagacag

SEQ ID NO: 314114 - DNA, 2987 bp, Homo sapiens
cccgatattcggtcagtgggtgatagcaaaacctcgggtacgccaagaccgtgaagaatgacgaactcctcccgcttcggcaaattcattcgcatcaactttgatgtcaatggctacattgttggagccaacattgagacttatcttttggagaaatctcgtgctatccgccaagccaaggaagaacggaccttccacatcttctattatctcctgtctggggctggagagcacctgaagaccgatctcctgttggagccgtacaacaaataccgcttcctgtccaatggacacgtcaccatccccgggcagcaggacaaggacatgttccaggagaccatggaggccatgaggattatgggcatcccagaagaggagcaaatgggcctgctgcgggtcatctcaggggttcttcagctcggcaacatcgtcttcaagaaggagcggaacactgaccaggcgtccatgcccgacaacacagctgcccaaaaggtgtcccatctcttgggtatcaatgtgaccgatttcaccagaggaatcctcaccccgcgcatcaaggtgggacgggattacgtccagaaggcgcagactaaagagcaggctgactttgccatcgaggccttggccaaggcgacctatgagcggatgttccgctggctggtgctgcgcatcaacaaggctctggacaagaccaagaggcagggcgcctccttcatcgggatcctggacattgccggcttcgagatctttgatctgaactcgtttgagcagctgtgcatcaattacaccaatgagaagctgcagcagctcttcaaccacaccatgttcatcctggagcaggaggagtaccagcgcgagggcatcgagtggaacttcatcgactttggcctcgacctgcagccctgcatcgacctcattgagaagccagcaggccccccgggcattctggccctgctggacgaggagtgctggttccccaaagccaccgacaagagcttcgtggagaaggtgatgcaggagcagggcacccaccccaagttccagaagcccaagcagctgaaggacaaagctgatttctgcattatccactatgccggcaaggtggattacaaagctgacgagtggctgatgaagaacatggatcccctgaatgacaacatcgccacactgctccaccagtcctctgacaagtttgtctcggagctgtggaaggatgtggaccgcatcatcggcctggaccaggtggccggcatgtcggagaccgcactgcccggggccttcaagacgcggaagggcatgttccgcactgtggggcagctttacaaggagcagctggccaagctgatggctacgctgaggaacacgaaccccaactttgtccgctgcatcatccccaaccacgagaagaaggccggcaagctggacccgcatctcgtgctggaccagctgcgctgcaacggtgttctcgagggcatccgtatctgccgccagggcttccccaacagggtggtcttccaggagtttcggcagagatatgagatcctgactccaaactccattcccaagggtttcatggacgggaagcaggcgtgcgtgctcatgataaaagccctggagctcgacagcaatctgtaccgcattggccagagcaaagtcttcttccgtgccggtgtgctggcccacctggaggaggagcgagacctgaagatcaccgacgtcatcatagggttccaggcctgctgcaggggctacctggccaggaaagcatttgccaagcggcagcagcagcttaccgccatgaaggtcctccagcggaactgcgctgcctacctgaagctgcggaactggcagtggtggcggctcttcaccaaggtcaagccgctgctgcaggtgagccggcaggaggaggagatgatggccaaggaggaggagctggtgaaggtcagagagaagcagctggctgcggagaacaggctcacggagatggagacgctgcagtctcagctcatggcagagaaattgcagctgcaggagcagctccaggcagaaaccgagctgtgtgccgaggctgaggagctccgggcccgcctgaccgccaagaagcaggaattagaagagatctgccatgacctagaggccagggtggaggaggaggaggagcgctgccagcacctgcaggcggagaagaagaagatgcagcagaacatccaggagcttgaggagcagctggaggaggaggagagcgcccggcagaagctgcagctggagaaggtgaccaccgaggcgaagctgaaaaagctggaggaggagcagatcatcctggaggaccagaactgcaagctggccaaggaaaagaaactgctggaagacagaatagctgagttcaccaccaacctcacagaagaggaggagaaatctaagagcctcgccaagctcaagaacaagcatgaggcaatgatcactgacttggaagagcgcctccgcagggaggagaagcagcgacaggagctggagaagacccgccggaagctggagggagactccacagacctcagcgaccagatcgccgagctccaggcccagatcgcggagctcaagatgcagctggccaagaaagaggaggagctccaggccgccctggccagagtggaagaggaagctgcccagaagaacatggccctcaagaagatccgggagctggaatctcagatctctgaactccaggaagacctggagtctgagcgtgcttccaggaataaagctgagaagcagaaacgggaccttggggaagagctagaggcgctgaaaacagagttggaggacacgctggattccacagctgcccagcaggagctcaggtcaaaacgtgagcaggaggtgaacatcctgatccctggatctccatcagatcccctcttctcagacagcgccaggccggggtggggccggggttggccgagccccacagctgcccccctcccctccct

SEQ ID NO: 314115 - DNA, 2139 bp, Homo sapiens
cccgatattcggtcagtgggtgatagcaaaacctcgggtacgccaagaccgtgaagaatgacgaactcctcccgcttcggcaaattcattcgcatcaactttgatgtcaatggctacattgttggagccaacattgagacttatcttttggagaaatctcgtgctatccgccaagccaaggaagaacggaccttccacatcttctattatctcctgtctggggctggagagcacctgaagaccgatctcctgttggagccgtacaacaaataccgcttcctgtccaatggacacgtcaccatccccgggcagcaggacaaggacatgttccaggagaccatggaggccatgaggattatgggcatcccagaagaggagcaaatgggcctgctgcgggtcatctcaggggttcttcagctcggcaacatcgtcttcaagaaggagcggaacactgaccaggcgtccatgcccgacaacacagctgcccaaaaggtgtcccatctcttgggtatcaatgtgaccgatttcaccagaggaatcctcaccccgcgcatcaaggtgggacgggattacgtccagaaggcgcagactaaagagcaggctgactttgccatcgaggccttggccaaggcgacctatgagcggatgttccgctggctggtgctgcgcatcaacaaggctctggacaagaccaagaggcagggcgcctccttcatcgggatcctggacattgccggcttcgagatctttgatctgaactcgtttgagcagctgtgcatcaattacaccaatgagaagctgcagcagctcttcaaccacaccatgttcatcctggagcaggaggagtaccagcgcgagggcatcgagtggaacttcatcgactttggcctcgacctgcagccctgcatcgacctcattgagaagccagcaggccccccgggcattctggccctgctggacgaggagtgctggttccccaaagccaccgacaagagcttcgtggagaaggtgatgcaggagcagggcacccaccccaagttccagaagcccaagcagctgaaggacaaagctgatttctgcattatccactatgccggcaaggtggattacaaagctgacgagtggctgatgaagaacatggatcccctgaatgacaacatcgccacactgctccaccagtcctctgacaagtttgtctcggagctgtggaaggatgtggaccgcatcatcggcctggaccaggtggccggcatgtcggagaccgcactgcccggggccttcaagacgcggaagggcatgttccgcactgtggggcagctttacaaggagcagctggccaagctgatggctacgctgaggaacacgaaccccaactttgtccgctgcatcatccccaaccacgagaagaaggccggcaagctggacccgcatctcgtgctggaccagctgcgctgcaacggtgttctcgagggcatccgtatctgccgccagggcttccccaacagggtggtcttccaggagtttcggcagagatatgagatcctgactccaaactccattcccaagggtttcatggacgggaagcaggcgtgcgtgctcatgataaaagccctggagctcgacagcaatctgtaccgcattggccagagcaaagtcttcttccgtgccggtgtgctggcccacctggaggaggagcgagacctgaagatcaccgacgtcatcatagggttccaggcctgctgcaggggctacctggccaggaaagcatttgccaagcggcagcagcagcttaccgccatgaaggtcctccagcggaactgcgctgcctacctgaagctgcggaactggcagtggtggcggctcttcaccaaggtgcgtgctagaagggcctcctgagtagctgggactacgggtgcacaccaccatacatacctgggctaattgtttgtattttttgtagaggtgtggtctcaccatgtcgcccaggttggtcacaaactcttgggctccagcaatcctcctacctcagcctcccaaagtgctgggaattacaggcatgagccactgtgcccggccctttttgatttttagtagagacaaggtcttcactattcttgcccaggctgaccttcctggcct

SEQ ID NO: 314116 - DNA, 1957 bp, Homo sapiens
cccgatattcggtcagtgggtgatagcaaaacctcgggtacgccaagaccgtgaagaatgacgaactcctcccgcttcggcaaattcattcgcatcaactttgatgtcaatggctacattgttggagccaacattgagacttatcttttggagaaatctcgtgctatccgccaagccaaggaagaacggaccttccacatcttctattatctcctgtctggggctggagagcacctgaagaccgatctcctgttggagccgtacaacaaataccgcttcctgtccaatggacacgtcaccatccccgggcagcaggacaaggacatgttccaggagaccatggaggccatgaggattatgggcatcccagaagaggagcaaatgggcctgctgcgggtcatctcaggggttcttcagctcggcaacatcgtcttcaagaaggagcggaacactgaccaggcgtccatgcccgacaacacagctgcccaaaaggtgtcccatctcttgggtatcaatgtgaccgatttcaccagaggaatcctcaccccgcgcatcaaggtgggacgggattacgtccagaaggcgcagactaaagagcaggctgactttgccatcgaggccttggccaaggcgacctatgagcggatgttccgctggctggtgctgcgcatcaacaaggctctggacaagaccaagaggcagggcgcctccttcatcgggatcctggacattgccggcttcgagatctttgatctgaactcgtttgagcagctgtgcatcaattacaccaatgagaagctgcagcagctcttcaaccacaccatgttcatcctggagcaggaggagtaccagcgcgagggcatcgagtggaacttcatcgactttggcctcgacctgcagccctgcatcgacctcattgagaagccagcaggccccccgggcattctggccctgctggacgaggagtgctggttccccaaagccaccgacaagagcttcgtggagaaggtgatgcaggagcagggcacccaccccaagttccagaagcccaagcagctgaaggacaaagctgatttctgcattatccactatgccggcaaggtggattacaaagctgacgagtggctgatgaagaacatggatcccctgaatgacaacatcgccacactgctccaccagtcctctgacaagtttgtctcggagctgtggaaggatgtggaccgcatcatcggcctggaccaggtggccggcatgtcggagaccgcactgcccggggccttcaagacgcggaagggcatgttccgcactgtggggcagctttacaaggagcagctggccaagctgatggctacgctgaggaacacgaaccccaactttgtccgctgcatcatccccaaccacgagaagaaggccggcaagctggacccgcatctcgtgctggaccagctgcgctgcaacggtgttctcgagggcatccgtatctgccgccagggcttccccaacagggtggtcttccaggagtttcggcagagatatgagatcctgactccaaactccattcccaagggtttcatggacgggaagcaggcgtgcgtgctcatgataaaagccctggagctcgacagcaatctgtaccgcattggccagagcaaagtcttcttccgtgccggtgtgctggcccacctggaggaggagcgagacctgaagatcaccgacgtcatcatagggttccaggcctgctgcaggggctacctggccaggaagtgagtcccgggagatactcctgccccgcatgccaggccttgccacgcccttctgttgccaaagggcacttagcaggccaccccgctgcagccagtcacatgcctgtcagggaggcccaggtggctcttcctacccctgttcctggatttctacctttgaggagtagaatcgggcagttcttttttttttcttt

SEQ ID NO: 314117 - DNA, 1171 bp, Homo sapiens
cccgatattcggtcagtgggtgatagcaaaacctcgggtacgccaagaccgtgaagaatgacgaactcctcccgcttcggcaaattcattcgcatcaactttgatgtcaatggctacattgttggagccaacattgagacttatcttttggagaaatctcgtgctatccgccaagccaaggaagaacggaccttccacatcttctattatctcctgtctggggctggagagcacctgaagaccgatctcctgttggagccgtacaacaaataccgcttcctgtccaatggacacgtcaccatccccgggcagcaggacaaggacatgttccaggagaccatggaggccatgaggattatgggcatcccagaagaggagcaaatgggcctgctgcgggtcatctcaggggttcttcagctcggcaacatcgtcttcaagaaggagcggaacactgaccaggcgtccatgcccgacaacacagctgcccaaaaggtgtcccatctcttgggtatcaatgtgaccgatttcaccagaggaatcctcaccccgcgcatcaaggtgggacgggattacgtccagaaggcgcagactaaagagcaggctgactttgccatcgaggccttggccaaggcgacctatgagcggatgttccgctggctggtgctgcgcatcaacaaggctctggacaagaccaagaggcagggcgcctccttcatcgggatcctggacattgccggcttcgagatctttgatctgaactcgtttgagcagctgtgcatcaattacaccaatgagaagctgcagcagctcttcaaccacaccatgttcatcctggagcaggaggagtaccagcgcgagggcatcgagtggaacttcatcgactttggcctcgacctgcagccctgcatcgacctcattgagaagccagcaggccccccgggcattctggccctgctggacgaggagtgctggttccccaaagccaccgacaagagcttcgtggagaaggtgatgcaggagcagggcacccaccccaagttccagaagcccaagcagctgaaggacaaagctgatttctgcattatccactatgccggcaaggtgaggagcactcacggggaggtgctggccagatcttcacaggagaggtggagtcgagccaattgttgga

SEQ ID NO: 314118 - DNA, 1046 bp, Homo sapiens
cccgatattcggtcagtgggtgatagcaaaacctcgggtacgccaagaccgtgaagaatgacgaactcctcccgcttcggcaaattcattcgcatcaactttgatgtcaatggctacattgttggagccaacattgagacttatcttttggagaaatctcgtgctatccgccaagccaaggaagaacggaccttccacatcttctattatctcctgtctggggctggagagcacctgaagaccgatctcctgttggagccgtacaacaaataccgcttcctgtccaatggacacgtcaccatccccgggcagcaggacaaggacatgttccaggagaccatggaggccatgaggattatgggcatcccagaagaggagcaaatgggcctgctgcgggtcatctcaggggttcttcagctcggcaacatcgtcttcaagaaggagcggaacactgaccaggcgtccatgcccgacaacacagctgcccaaaaggtgtcccatctcttgggtatcaatgtgaccgatttcaccagaggaatcctcaccccgcgcatcaaggtgggacgggattacgtccagaaggcgcagactaaagagcaggctgactttgccatcgaggccttggccaaggcgacctatgagcggatgttccgctggctggtgctgcgcatcaacaaggctctggacaagaccaagaggcagggcgcctccttcatcgggatcctggacattgccggcttcgagatctttgatctgaactcgtttgagcagctgtgcatcaattacaccaatgagaagctgcagcagctcttcaaccacaccatgttcatcctggagcaggaggagtaccagcgcgagggcatcgagtggaacttcatcgactttggcctcgacctgcagccctgcatcgacctcattgagaagccagcacgaattcccttagcaccagcacgaattcccttagcaccagcacgaattcccttagcaccagcacgaattcccttagcaccagcacgaattcccttagcaccagcacgaattccctt

SEQ ID NO: 314119 - DNA, 295 bp, Homo sapiens
cccgatattcggtcagtgggtgatagcaaaacctcgggtacgccaagaccgtgaagaatgacgaactcctcccgcttcggcaaattcattcgcatcaactttgatgtcaatggctacattgttggagccaacattgagacttatcttttggagaaatctcgtgctatccgccaagccaaggaagaacggaccttccacatcttctattatctcctgtctggggctggagagcacctgaagaccgatctcctgtgtggagcctgcgtagtcatgatcgagccgcgtagtcagatcg

SEQ ID NO: 314120 - DNA, 356 bp, Homo sapiens
tgctttcacatgggtcgtccagggccaggttcctagagctgagggagcttcctgcctgccgtttccagggccatggaagtaagttcaaactgaccaaggtttccaaagcctggcgggaaggccgcacttggatgataccggggcctggccttggttggagtcgcacactggagcccacccggaaacctctgttcctggcacgttggacatgctgacacggctctgccatcgtcccccttccaggcagggcaggctcggcagcccaggtcgctgcccggccttcactgcgtccctgggttccttgcagggcgagctggagcggcagctgctgcaggccaaccccatcctggaggcct

SEQ ID NO: 314121 - DNA, 323 bp, Homo sapiens
tattccaggcatgtggaatcgaggcaatgggtaaaatgaccaggcttctctttccttcctcagatatgagatcctgactccaaactccattcccaagggtttcatggacgggaagcaggcgtgcgtgctcatggtgagttgagctgctgtccctgcctctctggatgggcagccccttgtctggggagtgcccacgtggccagggcccaccttgctatatcagtggtcggtggatgcccaggctgtgtcccttctgatgctccgcgtctgactctgccgggcgccctttgcagtagcccctaggcctcagatagccagggatg

SEQ ID NO: 314122 - DNA, 128 bp, Homo sapiens
aggaataaagctgagaagcagaaacgggaccttggggaagagctagaggcgctgaaaacagagttggaggacacgctggattccacagctgcccagcaggagctcaggtgtgccctgggaccaagtcc

SEQ ID NO: 314123 - DNA, 1946 bp, Homo sapiens
  misc_feature (440)..(440): n is a, c, g, or t
agtcagtattgtatatgaattttctgccatgtggtagaaagagggtgcctgtctttgtactctgtgtgaacaggcacacctgtttacctgtcttggtttcaccggttttataggagttgcaacagaggatggcattttacacttacttttgtgcctttcctgttgtaattggtcctgtttgcctgagctgtttttgtgctactgttgtgtgtgaagatgtccgacacctaaacattttgcgggaagctttgcctgctttcctgagagtggtcctgtctagctcagctgtggctcccaagactccactttgcttctttctggtgggagcagccaggcacctggtttccctctcgaattcactttgagatgtgtgggctgtgctgtggccgcccctggcctggccgggcccgctgaccctctgcttctacctctgcccccangcgcggggacctgccgtttgtcgtgccccgccgaatggcccggaaaggcgccggggatggctccgacgaagaggtagatggcaaagcggatggggctgaggccaaacctgccgaataagcctcttctcctgcagcctgagatggatggacagacagacaccacagcctccccttcccagaccccgcagcacgcctctccccaccttcttgggactgctgtgaacatgcctcctcctgccctccgccccgtccccccatcccgtttccctccaggtgttgttgagggcatttggcttcctctgctgcatccccttccagctccctcccctgctcagaatctgataccaaagagacagggcccgggcccaggcagagagcgaccagcaggctcctcagccctctcttgccaaaaagcacaagatgttgaggcgagcagggcaggcccccggggaggggccagagttttctatgaatctatttttcttcagactgaggccttttggtagtcggagcccccgcagtcgtcagcctccctgacgtctgccaccagcgcccccactcctcctcctttctttgctgtttgcaatcacacgtggtgacctcacacacctctgccccttgggcctcccactcccatggctctgggcggtccagaaggagcaggccctgggcctccacctctgtgcagggcacagaaggctggggtggggggaggagtggattcctccccaccctgtcccaggcagcgccactgtccgctgtctccctcctgattctaaaatgtctcaagtgcaatgccccctcccctcctttaccgaggacagcctgcctctgccacagcaaggctgtcggggtcaagctggaaaggccagcagccttccagtggcttctcccaacactcttggggaccaaatatatttaatggttaagggacttgtcccaagtctgacagccagagcgttagaggggccagcggccctcccaggcgatcttgtgtctactctaggactgggcccgagggtggtttacctgcaccgttgactcagtatagtttaaaaatctgccacctgcacaggtatttttgaaagcaaaataaggttttcttttttcccctttcttgtaataaatgataaaattccgagtctttctcactgcctttgtttagaagagagtagctcgtcctcactggtctacactggttgccgaatttacttgtattcctaactgttttgtatatgctgcattgagacttacggcaagaaggcattttttttttttaaaggaaacaaactctcaaatcatgaagtgatataaaagctgcatatgcctacaaagctctgaattcaggtcccagttgctgtcacaaaggagtgagtgaaactcccaccctacccccttttttatataataaaagtgccttagcatgtgttgcagctgtcaccactacagtaagctggtttacagatgttttccactgagcatcacaataaagagaaccatgtgcta

SEQ ID NO: 314124 - DNA, 231 bp, Homo sapiens
gagagtaatttgattgtctgaagccttcttctctcaactcgtcaaagtcattctccatccagctttgttctgttgctggtgaggaactgcgttagaagaccctggaggaggaggccaagacccacgaggcccagatccaggagatgaggcagaagcactcacaggccgtggaggagctggcggagcagctggagcagacgaagcgggtgcggagcctccctgagaccgcag

SEQ ID NO: 314125 - DNA, 6644 bp, Homo sapiens
cccgatattcggtcagtgggtgatagcaaaacctcgggtacgccaagaccgtgaagaatgacgaactcctcccgcttcggcaaattcattcgcatcaactttgatgtcaatggctacattgttggagccaacattgagacttatcttttggagaaatctcgtgctatccgccaagccaaggaagaacggaccttccacatcttctattatctcctgtctggggctggagagcacctgaagaccgatctcctgttggagccgtacaacaaataccgcttcctgtccaatggacacgtcaccatccccgggcagcaggacaaggacatgttccaggagaccatggaggccatgaggattatgggcatcccagaagaggagcaaatgggcctgctgcgggtcatctcaggggttcttcagctcggcaacatcgtcttcaagaaggagcggaacactgaccaggcgtccatgcccgacaacacagctgcccaaaaggtgtcccatctcttgggtatcaatgtgaccgatttcaccagaggaatcctcaccccgcgcatcaaggtgggacgggattacgtccagaaggcgcagactaaagagcaggctgactttgccatcgaggccttggccaaggcgacctatgagcggatgttccgctggctggtgctgcgcatcaacaaggctctggacaagaccaagaggcagggcgcctccttcatcgggatcctggacattgccggcttcgagatctttgatctgaactcgtttgagcagctgtgcatcaattacaccaatgagaagctgcagcagctcttcaaccacaccatgttcatcctggagcaggaggagtaccagcgcgagggcatcgagtggaacttcatcgactttggcctcgacctgcagccctgcatcgacctcattgagaagccagcaggccccccgggcattctggccctgctggacgaggagtgctggttccccaaagccaccgacaagagcttcgtggagaaggtgatgcaggagcagggcacccaccccaagttccagaagcccaagcagctgaaggacaaagctgatttctgcattatccactatgccggcaaggtggattacaaagctgacgagtggctgatgaagaacatggatcccctgaatgacaacatcgccacactgctccaccagtcctctgacaagtttgtctcggagctgtggaaggatgtggaccgcatcatcggcctggaccaggtggccggcatgtcggagaccgcactgcccggggccttcaagacgcggaagggcatgttccgcactgtggggcagctttacaaggagcagctggccaagctgatggctacgctgaggaacacgaaccccaactttgtccgctgcatcatccccaaccacgagaagaaggccggcaagctggacccgcatctcgtgctggaccagctgcgctgcaacggtgttctcgagggcatccgtatctgccgccagggcttccccaacagggtggtcttccaggagtttcggcagagatatgagatcctgactccaaactccattcccaagggtttcatggacgggaagcaggcgtgcgtgctcatgataaaagccctggagctcgacagcaatctgtaccgcattggccagagcaaagtcttcttccgtgccggtgtgctggcccacctggaggaggagcgagacctgaagatcaccgacgtcatcatagggttccaggcctgctgcaggggctacctggccaggaaagcatttgccaagcggcagcagcagcttaccgccatgaaggtcctccagcggaactgcgctgcctacctgaagctgcggaactggcagtggtggcggctcttcaccaaggtcaagccgctgctgcaggtgagccggcaggaggaggagatgatggccaaggaggaggagctggtgaaggtcagagagaagcagctggctgcggagaacaggctcacggagatggagacgctgcagtctcagctcatggcagagaaattgcagctgcaggagcagctccaggcagaaaccgagctgtgtgccgaggctgaggagctccgggcccgcctgaccgccaagaagcaggaattagaagagatctgccatgacctagaggccagggtggaggaggaggaggagcgctgccagcacctgcaggcggagaagaagaagatgcagcagaacatccaggagcttgaggagcagctggaggaggaggagagcgcccggcagaagctgcagctggagaaggtgaccaccgaggcgaagctgaaaaagctggaggaggagcagatcatcctggaggaccagaactgcaagctggccaaggaaaagaaactgctggaagacagaatagctgagttcaccaccaacctcacagaagaggaggagaaatctaagagcctcgccaagctcaagaacaagcatgaggcaatgatcactgacttggaagagcgcctccgcagggaggagaagcagcgacaggagctggagaagacccgccggaagctggagggagactccacagacctcagcgaccagatcgccgagctccaggcccagatcgcggagctcaagatgcagctggccaagaaagaggaggagctccaggccgccctggccagagtggaagaggaagctgcccagaagaacatggccctcaagaagatccgggagctggaatctcagatctctgaactccaggaagacctggagtctgagcgtgcttccaggaataaagctgagaagcagaaacgggaccttggggaagagctagaggcgctgaaaacagagttggaggacacgctggattccacagctgcccagcaggagctcaggtcaaaacgtgagcaggaggtgaacatcctgaagaagaccctggaggaggaggccaagacccacgaggcccagatccaggagatgaggcagaagcactcacaggccgtggaggagctggcggagcagctggagcagacgaagcgggtgaaagcaaacctcgagaaggcaaagcagactctggagaacgagcggggggagctggccaacgaggtgaaggtgctgctgcagggcaaaggggactcggagcacaagcgcaagaaagtggaggcgcagctgcaggagctgcaggtcaagttcaacgagggagagcgcgtgcgcacagagctggccgacaaggtcaccaagctgcaggtggagctggacaacgtgaccgggcttctcagccagtccgacagcaagtccagcaagctcaccaaggacttctccgcgctggagtcccagctgcaggacactcaggagctgctgcaggaggagaaccggcagaagctgagcctgagcaccaagctcaagcaggtggaggacgagaagaattccttccgggagcagctggaggaggaggaggaggccaagcacaacctggagaagcagatcgccaccctccatgcccaggtggccgacatgaaaaagaagatggaggacagtgtggggtgcctggaaactgctgaggaggtgaagaggaagctccagaaggacctggagggcctgagccagcggcacgaggagaaggtggccgcctacgacaagctggagaagaccaagacgcggctgcagcaggagctggacgacctgctggtggacctggaccaccagcgccagagcgcgtgcaacctggagaagaagcagaagaagtttgaccagctcctggcggaggagaagaccatctctgccaagtatgcagaggagcgcgaccgggctgaggcggaggcccgagagaaggagaccaaggctctgtcgctggcccgggccctggaggaagccatggagcagaaggcggagctggagcggctcaacaagcagttccgcacggagatggaggaccttatgagctccaaggatgatgtgggcaagagtgtccacgagctggagaagtccaagcgggccctagagcagcaggtggaggagatgaagacgcagctggaagagctggaggacgagctgcaggccaccgaagatgccaagctgcggttggaggtcaacctgcaggccatgaaggcccagttcgagcgggacctgcagggccgggacgagcagagcgaggagaagaagaagcagctggtcagacaggtgcgggagatggaggcagagctggaggacgagaggaagcagcgctcgatggcagtggccgcccggaagaagctggagatggacctgaaggacctggaggcgcacatcgactcggccaacaagaaccgggacgaagccatcaaacagctgcggaagctgcaggcccagatgaaggactgcatgcgcgagctggatgacacccgcgcctctcgtgaggagatcctggcccaggccaaagagaacgagaagaagctgaagagcatggaggccgagatgatccagttgcaggaggaactggcagccgcggagcgtgccaagcgccaggcccagcaggagcgggatgagctggctgacgagatcgccaacagcagcggcaaaggagccctggcgttagaggagaagcggcgtctggaggcccgcatcgcccagctggaggaggagctggaggaggagcagggcaacacggagctgatcaacgaccggctgaagaaggccaacctgcagatcgaccagatcaacaccgacctgaacctggagcgcagccacgcccagaagaacgagaatgctcggcagcagctggaacgccagaacaaggagcttaaggtcaagctgcaggagatggagggcactgtcaagtccaagtacaaggcctccatcaccgccctcgaggccaagattgcacagctggaggagcagctggacaacgagaccaaggagcgccaggcagcctgcaaacaggtgcgtcggaccgagaagaagctgaaggatgtgctgctgcaggtggatgacgagcggaggaacgccgagcagtacaaggaccaggccgacaaggcatctacccgcctgaagcagctcaagcggcagctggaggaggccgaagaggaggcccagcgggccaacgcctcccgccggaaactgcagcgcgagctggaggacgccactgagacggccgatgccatgaaccgcgaagtcagctccctaaagaacaagctcaggcgcggggacctgccgtttgtcgtgccccgccgaatggcccggaaaggcgccggggatggctccgacgaagaggtagatggcaaagcggatggggctgaggccaaacctgccgaataagcctcttctcctgcagcctgagatggatggacagacagacaccacagcctccccttcccagaccccgcagcacgcctctccccaccttcttgggactgctgtgaacatgcctcctcctgccctccgccccgtccccccatcccgtttccctccaggtgttgttgagggcatttggcttcctctgctgcatccccttccagctccctcccctgctcagaatctgataccaaagagacagggcccgggcccaggcagagagcgaccagcaggctcctcagccctctcttgccaaaaagcacaagatgttgaggcgagcagggcaggcccccggggaggggccagagttttctatgaatctatttttcttcagactgaggccttttggtagtcggagcccccgcagtcgtcagcctccctgacgtctgccaccagcgcccccactcctcctcctttctttgctgtttgcaatcacacgtggtgacctcacacacctctgccccttgggcctcccactcccatggctctgggcggtccagaaggagcaggccctgggcctccacctctgtgcagggcacagaaggctggggtggggggaggagtggattcctccccaccctgtcccaggcagcgccactgtccgctgtctccctcctgattctaaaatgtctcaagtgcaatgccccctcccctcctttaccgaggacagcctgcctctgccacagcaaggctgtcggggtcaagctggaaaggccagcagccttccagtggcttctcccaacactcttggggaccaaatatatttaatggttaagggacttgtcccaagtctgacagccagagcgttagaggggccagcggccctcccaggcgatcttgtgtctactctaggactgggcccgagggtggtttacctgcaccgttgactcagtatagtttaaaaatctgccacctgcacaggtatttttgaaagcaaaataaggttttcttttttcccctttcttgtaataaatgataaaattccgagtctttctcactgcctttgtttagaagagagtagctcgtcctcactggtctacactggttgccgaatttacttgtattcctaactgttttgtatatgctgcattgagacttacggcaagaaggcattttttttttttaaaggaaacaaactctcaaatcatgaagtgatataaaagctgcatatgcctacaaagctctgaattcaggtcccagttgctgtcacaaaggagtgagtgaaactcccaccctacccccttttttatataataaaagtgccttagcatgtgttgcagctgtcaccactacagtaagctggtttacagatgttttccactgagcatcacaataaagagaaccatgtgcta

SEQ ID NO: 314126 - DNA, 7522 bp, Homo sapiens
cccgatattcggtcagtgggtgatagcaaaacctcgggtacgccaagaccgtgaagaatgacgaactcctcccgcttcggcaaattcattcgcatcaactttgatgtcaatggctacattgttggagccaacattgagacttatcttttggagaaatctcgtgctatccgccaagccaaggaagaacggaccttccacatcttctattatctcctgtctggggctggagagcacctgaagaccgatctcctgttggagccgtacaacaaataccgcttcctgtccaatggacacgtcaccatccccgggcagcaggacaaggacatgttccaggagaccatggaggccatgaggattatgggcatcccagaagaggagcaaatgggcctgctgcgggtcatctcaggggttcttcagctcggcaacatcgtcttcaagaaggagcggaacactgaccaggcgtccatgcccgacaacacagctgcccaaaaggtgtcccatctcttgggtatcaatgtgaccgatttcaccagaggaatcctcaccccgcgcatcaaggtgggacgggattacgtccagaaggcgcagactaaagagcaggctgactttgccatcgaggccttggccaaggcgacctatgagcggatgttccgctggctggtgctgcgcatcaacaaggctctggacaagaccaagaggcagggcgcctccttcatcgggatcctggacattgccggcttcgagatctttgatctgaactcgtttgagcagctgtgcatcaattacaccaatgagaagctgcagcagctcttcaaccacaccatgttcatcctggagcaggaggagtaccagcgcgagggcatcgagtggaacttcatcgactttggcctcgacctgcagccctgcatcgacctcattgagaagccagcaggccccccgggcattctggccctgctggacgaggagtgctggttccccaaagccaccgacaagagcttcgtggagaaggtgatgcaggagcagggcacccaccccaagttccagaagcccaagcagctgaaggacaaagctgatttctgcattatccactatgccggcaaggtggattacaaagctgacgagtggctgatgaagaacatggatcccctgaatgacaacatcgccacactgctccaccagtcctctgacaagtttgtctcggagctgtggaaggatgtggaccgcatcatcggcctggaccaggtggccggcatgtcggagaccgcactgcccggggccttcaagacgcggaagggcatgttccgcactgtggggcagctttacaaggagcagctggccaagctgatggctacgctgaggaacacgaaccccaactttgtccgctgcatcatccccaaccacgagaagaaggccggcaagctggacccgcatctcgtgctggaccagctgcgctgcaacggtgttctcgagggcatccgtatctgccgccagggcttccccaacagggtggtcttccaggagtttcggcagagatatgagatcctgactccaaactccattcccaagggtttcatggacgggaagcaggcgtgcgtgctcatgataaaagccctggagctcgacagcaatctgtaccgcattggccagagcaaagtcttcttccgtgccggtgtgctggcccacctggaggaggagcgagacctgaagatcaccgacgtcatcatagggttccaggcctgctgcaggggctacctggccaggaaagcatttgccaagcggcagcagcagcttaccgccatgaaggtcctccagcggaactgcgctgcctacctgaagctgcggaactggcagtggtggcggctcttcaccaaggtcaagccgctgctgcaggtgagccggcaggaggaggagatgatggccaaggaggaggagctggtgaaggtcagagagaagcagctggctgcggagaacaggctcacggagatggagacgctgcagtctcagctcatggcagagaaattgcagctgcaggagcagctccaggcagaaaccgagctgtgtgccgaggctgaggagctccgggcccgcctgaccgccaagaagcaggaattagaagagatctgccatgacctagaggccagggtggaggaggaggaggagcgctgccagcacctgcaggcggagaagaagaagatgcagcagaacatccaggagcttgaggagcagctggaggaggaggagagcgcccggcagaagctgcagctggagaaggtgaccaccgaggcgaagctgaaaaagctggaggaggagcagatcatcctggaggaccagaactgcaagctggccaaggaaaagaaactgctggaagacagaatagctgagttcaccaccaacctcacagaagaggaggagaaatctaagagcctcgccaagctcaagaacaagcatgaggcaatgatcactgacttggaagagcgcctccgcagggaggagaagcagcgacaggagctggagaagacccgccggaagctggagggagactccacagacctcagcgaccagatcgccgagctccaggcccagatcgcggagctcaagatgcagctggccaagaaagaggaggagctccaggccgccctggccagagtggaagaggaagctgcccagaagaacatggccctcaagaagatccgggagctggaatctcagatctctgaactccaggaagacctggagtctgagcgtgcttccaggaataaagctgagaagcagaaacgggaccttggggaagagctagaggcgctgaaaacagagttggaggacacgctggattccacagctgcccagcaggagctcaggtcaaaacgtgagcaggaggtgaacatcctgaagaagaccctggaggaggaggccaagacccacgaggcccagatccaggagatgaggcagaagcactcacaggccgtggaggagctggcggagcagctggagcagacgaagcgggtgaaagcaaacctcgagaaggcaaagcagactctggagaacgagcggggggagctggccaacgaggtgaaggtgctgctgcagggcaaaggggactcggagcacaagcgcaagaaagtggaggcgcagctgcaggagctgcaggtcaagttcaacgagggagagcgcgtgcgcacagagctggccgacaaggtcaccaagctgcaggtggagctggacaacgtgaccgggcttctcagccagtccgacagcaagtccagcaagctcaccaaggacttctccgcgctggagtcccagctgcaggacactcaggagctgctgcaggaggagaaccggcagaagctgagcctgagcaccaagctcaagcaggtggaggacgagaagaattccttccgggagcagctggaggaggaggaggaggccaagcacaacctggagaagcagatcgccaccctccatgcccaggtggccgacatgaaaaagaagatggaggacagtgtggggtgcctggaaactgctgaggaggtgaagaggaagctccagaaggacctggagggcctgagccagcggcacgaggagaaggtggccgcctacgacaagctggagaagaccaagacgcggctgcagcaggagctggacgacctgctggtggacctggaccaccagcgccagagcgcgtgcaacctggagaagaagcagaagaagtttgaccagctcctggcggaggagaagaccatctctgccaagtatgcagaggagcgcgaccgggctgaggcggaggcccgagagaaggagaccaaggctctgtcgctggcccgggccctggaggaagccatggagcagaaggcggagctggagcggctcaacaagcagttccgcacggagatggaggaccttatgagctccaaggatgatgtgggcaagagtgtccacgagctggagaagtccaagcgggccctagagcagcaggtggaggagatgaagacgcagctggaagagctggaggacgagctgcaggccaccgaagatgccaagctgcggttggaggtcaacctgcaggccatgaaggcccagttcgagcgggacctgcagggccgggacgagcagagcgaggagaagaagaagcagctggtcagacaggtgcgggagatggaggcagagctggaggacgagaggaagcagcgctcgatggcagtggccgcccggaagaagctggagatggacctgaaggacctggaggcgcacatcgactcggccaacaagaaccgggacgaagccatcaaacagctgcggaagctgcaggcccagatgaaggactgcatgcgcgagctggatgacacccgcgcctctcgtgaggagatcctggcccaggccaaagagaacgagaagaagctgaagagcatggaggccgagatgatccagttgcaggaggaactggcagccgcggagcgtgccaagcgccaggcccagcaggagcgggatgagctggctgacgagatcgccaacagcagcggcaaaggagccctggcgttagaggagaagcggcgtctggaggcccgcatcgcccagctggaggaggagctggaggaggagcagggcaacacggagctgatcaacgaccggctgaagaaggccaacctgcagatcgaccagatcaacaccgacctgaacctggagcgcagccacgcccagaagaacgagaatgctcggcagcagctggaacgccagaacaaggagcttaaggtcaagctgcaggagatggagggcactgtcaagtccaagtacaaggcctccatcaccgccctcgaggccaagattgcacagctggaggagcagctggacaacgagaccaaggagcgccaggcagcctgcaaacaggtgcgtcggaccgagaagaagctgaaggatgtgctgctgcaggtggatgacgagcggaggaacgccgagcagtacaaggaccaggccgacaaggcatctacccgcctgaagcagctcaagcggcagctggaggaggccgaagaggaggcccagcgggccaacgcctcccgccggaaactgcagcgcgagctggaggacgccactgagacggccgatgccatgaaccgcgaagtcagctccctaaagaacaagctcaggcgcggggacctgccgtttgtcgtgccccgccgaatggcccggaaaggcgccggggatggctccgacgaagaggtagatggcaaagcggatggggctgaggccaaacctgccgaataagcctcttctcctgcagcctgagatggatggacagacagacaccacagcctccccttcccagaccccgcagcacgcctctccccaccttcttgggactgctgtgaacatgcctcctcctgccctccgccccgtccccccatcccgtttccctccaggtgttgttgagggcatttggcttcctctgctgcatccccttccagctccctcccctgctcagaatctgataccaaagagacagggcccgggcccaggcagagagcgaccagcaggctcctcagccctctcttgccaaaaagcacaagatgttgaggcgagcagggcaggcccccggggaggggccagagttttctatgaatctatttttcttcagactgaggccttttggtagtcggagcccccgcagtcgtcagcctccctgacgtctgccaccagcgcccccactcctcctcctttctttgctgtttgcaatcacacgtggtgacctcacacacctctgccccttgggcctcccactcccatggctctgggcggtccagaaggagcaggccctgggcctccacctctgtgcagggcacagaaggctggggtggggggaggagtggattcctccccaccctgtcccaggcagcgccactgtccgctgtctccctcctgattctaaaatgtctcaagtgcaatgccccctcccctcctttaccgaggacagcctgcctctgccacagcaaggctgtcggggtcaagctggaaaggccagcagccttccagtggcttctcccaacactcttggggaccaaatatatttaatggttaagggacttgtcccaagtctgacagccagagcgttagaggggccagcggccctcccaggcgatcttgtgtctactctaggactgggcccgagggtggtttacctgcaccgttgactcagtatagtttaaaaatctgccacctgcacaggtatttttgaaagcaaaataaggttttcttttttcccctttcttgtaataaatgataaaattccgagtctttctcactgcctttgtttagaagagagtagctcgtcctcactggtctacactggttgccgaatttacttgtattcctaactgttttgtatatgctgcattgagacttacggcaagaaggcattttttttttttaaaggaaacaaactctcaaatcatgaagtgatataaaagctgcatatgcctacaaagctctgaattcaggtcccagttgctgtcacaaaggagtgagtgaaactcccaccctacccccttttttatataataaaagtgccttagcatgtgttgcagctgtcaccactacagtaagctggtttacagatgttttccactgagcatcacaataaagagaaccatgtgctaaaaaaaaaaaaaaaaaaaaaaaaaaaaactcgaaaaaatttccgccccgggaaagcacacaagaagcctcagccatttggcgcgagatctcgccggcacaggtcaaaaacccggcggcgacagcgttccacacatggggatagaatagaaatccgccggcagctacagtcagtcgagacaaaacggggtctccgggacaattgtggcaagcggccgaggtttacgcaggggcaagaaagattttgaccccaccgaggggcacacgtatatatcacccctgctccagatagtcagtgggaggagcccgcccccaaagcgcaaccatagaggaggcgtatataaaatcgtgttggcgaccattagtggggtcacaacaaaagaggcggataccccataaattgctgcgaggacacaaaacacaagggcgcacaattaaagtccaaagtaacgatagggatcataccactgacacgcccctgaagaaacaagtacacacccaacatttagcgaagaccacagaggaagtatacatgataaacaacaaaagcaggtggggagccaaacgcagaccaaggtgtgtggcaaacaaacaacacttcctcgtgtgggacgccacaacaggaaccacctgtgacgcattcaagagcagtaagtagagacagttggaagtgtagtagtgggtactctccggaacgagggaaggcacacacccaccggagagtggtacgatgatagtagcacacaaccggagagcgagcagccaccgcgctgtgtgagtacgcccccaacgagtacggtcgccaacaacagcgcgcgagcaacgacacaagtgagagagacgcccacgcgaggacaaatcagcagtgctgtgagtgaga

SEQ ID NO: 314127 - DNA, 6872 bp, Homo sapiens
cccgatattcggtcagtgggtgatagcaaaacctcgggtacgccaagaccgtgaagaatgacgaactcctcccgcttcggcaaattcattcgcatcaactttgatgtcaatggctacattgttggagccaacattgagacttatcttttggagaaatctcgtgctatccgccaagccaaggaagaacggaccttccacatcttctattatctcctgtctggggctggagagcacctgaagaccgatctcctgttggagccgtacaacaaataccgcttcctgtccaatggacacgtcaccatccccgggcagcaggacaaggacatgttccaggagaccatggaggccatgaggattatgggcatcccagaagaggagcaaatgggcctgctgcgggtcatctcaggggttcttcagctcggcaacatcgtcttcaagaaggagcggaacactgaccaggcgtccatgcccgacaacacagctgcccaaaaggtgtcccatctcttgggtatcaatgtgaccgatttcaccagaggaatcctcaccccgcgcatcaaggtgggacgggattacgtccagaaggcgcagactaaagagcaggctgactttgccatcgaggccttggccaaggcgacctatgagcggatgttccgctggctggtgctgcgcatcaacaaggctctggacaagaccaagaggcagggcgcctccttcatcgggatcctggacattgccggcttcgagatctttgatctgaactcgtttgagcagctgtgcatcaattacaccaatgagaagctgcagcagctcttcaaccacaccatgttcatcctggagcaggaggagtaccagcgcgagggcatcgagtggaacttcatcgactttggcctcgacctgcagccctgcatcgacctcattgagaagccagcaggccccccgggcattctggccctgctggacgaggagtgctggttccccaaagccaccgacaagagcttcgtggagaaggtgatgcaggagcagggcacccaccccaagttccagaagcccaagcagctgaaggacaaagctgatttctgcattatccactatgccggcaaggtggattacaaagctgacgagtggctgatgaagaacatggatcccctgaatgacaacatcgccacactgctccaccagtcctctgacaagtttgtctcggagctgtggaaggatgtggaccgcatcatcggcctggaccaggtggccggcatgtcggagaccgcactgcccggggccttcaagacgcggaagggcatgttccgcactgtggggcagctttacaaggagcagctggccaagctgatggctacgctgaggaacacgaaccccaactttgtccgctgcatcatccccaaccacgagaagaaggccggcaagctggacccgcatctcgtgctggaccagctgcgctgcaacggtgttctcgagggcatccgtatctgccgccagggcttccccaacagggtggtcttccaggagtttcggcagagatatgagatcctgactccaaactccattcccaagggtttcatggacgggaagcaggcgtgcgtgctcatgataaaagccctggagctcgacagcaatctgtaccgcattggccagagcaaagtcttcttccgtgccggtgtgctggcccacctggaggaggagcgagacctgaagatcaccgacgtcatcatagggttccaggcctgctgcaggggctacctggccaggaaagcatttgccaagcggcagcagcagcttaccgccatgaaggtcctccagcggaactgcgctgcctacctgaagctgcggaactggcagtggtggcggctcttcaccaaggtcaagccgctgctgcaggtgagccggcaggaggaggagatgatggccaaggaggaggagctggtgaaggtcagagagaagcagctggctgcggagaacaggctcacggagatggagacgctgcagtctcagctcatggcagagaaattgcagctgcaggagcagctccaggcagaaaccgagctgtgtgccgaggctgaggagctccgggcccgcctgaccgccaagaagcaggaattagaagagatctgccatgacctagaggccagggtggaggaggaggaggagcgctgccagcacctgcaggcggagaagaagaagatgcagcagaacatccaggagcttgaggagcagctggaggaggaggagagcgcccggcagaagctgcagctggagaaggtgaccaccgaggcgaagctgaaaaagctggaggaggagcagatcatcctggaggaccagaactgcaagctggccaaggaaaagaaactgctggaagacagaatagctgagttcaccaccaacctcacagaagaggaggagaaatctaagagcctcgccaagctcaagaacaagcatgaggcaatgatcactgacttggaagagcgcctccgcagggaggagaagcagcgacaggagctggagaagacccgccggaagctggagggagactccacagacctcagcgaccagatcgccgagctccaggcccagatcgcggagctcaagatgcagctggccaagaaagaggaggagctccaggccgccctggccagagtggaagaggaagctgcccagaagaacatggccctcaagaagatccgggagctggaatctcagatctctgaactccaggaagacctggagtctgagcgtgcttccaggaataaagctgagaagcagaaacgggaccttggggaagagctagaggcgctgaaaacagagttggaggacacgctggattccacagctgcccagcaggagctcaggtcaaaacgtgagcaggaggtgaacatcctgaagaagaccctggaggaggaggccaagacccacgaggcccagatccaggagatgaggcagaagcactcacaggccgtggaggagctggcggagcagctggagcagacgaagcgggtgaaagcaaacctcgagaaggcaaagcagactctggagaacgagcggggggagctggccaacgaggtgaaggtgctgctgcagggcaaaggggactcggagcacaagcgcaagaaagtggaggcgcagctgcaggagctgcaggtcaagttcaacgagggagagcgcgtgcgcacagagctggccgacaaggtcaccaagctgcaggtgaggcctccgccaggaccctggtgcgggcagtgggccctagcagcagttgtggcccaggtccccaggtgcatgtgtgctctctgtctctctctcttctcaaactggctcgtcagaccctcatggttcagcttgtgactcaggtccagctttacctaaaggagatgaggtggggcaggagcagtgggggtgggtccatggtcctttgtgtctccccgcccggtgcaggtggagctggacaacgtgaccgggcttctcagccagtccgacagcaagtccagcaagctcaccaaggacttctccgcgctggagtcccagctgcaggacactcaggagctgctgcaggaggagaaccggcagaagctgagcctgagcaccaagctcaagcaggtggaggacgagaagaattccttccgggagcagctggaggaggaggaggaggccaagcacaacctggagaagcagatcgccaccctccatgcccaggtggccgacatgaaaaagaagatggaggacagtgtggggtgcctggaaactgctgaggaggtgaagaggaagctccagaaggacctggagggcctgagccagcggcacgaggagaaggtggccgcctacgacaagctggagaagaccaagacgcggctgcagcaggagctggacgacctgctggtggacctggaccaccagcgccagagcgcgtgcaacctggagaagaagcagaagaagtttgaccagctcctggcggaggagaagaccatctctgccaagtatgcagaggagcgcgaccgggctgaggcggaggcccgagagaaggagaccaaggctctgtcgctggcccgggccctggaggaagccatggagcagaaggcggagctggagcggctcaacaagcagttccgcacggagatggaggaccttatgagctccaaggatgatgtgggcaagagtgtccacgagctggagaagtccaagcgggccctagagcagcaggtggaggagatgaagacgcagctggaagagctggaggacgagctgcaggccaccgaagatgccaagctgcggttggaggtcaacctgcaggccatgaaggcccagttcgagcgggacctgcagggccgggacgagcagagcgaggagaagaagaagcagctggtcagacaggtgcgggagatggaggcagagctggaggacgagaggaagcagcgctcgatggcagtggccgcccggaagaagctggagatggacctgaaggacctggaggcgcacatcgactcggccaacaagaaccgggacgaagccatcaaacagctgcggaagctgcaggcccagatgaaggactgcatgcgcgagctggatgacacccgcgcctctcgtgaggagatcctggcccaggccaaagagaacgagaagaagctgaagagcatggaggccgagatgatccagttgcaggaggaactggcagccgcggagcgtgccaagcgccaggcccagcaggagcgggatgagctggctgacgagatcgccaacagcagcggcaaaggagccctggcgttagaggagaagcggcgtctggaggcccgcatcgcccagctggaggaggagctggaggaggagcagggcaacacggagctgatcaacgaccggctgaagaaggccaacctgcagatcgaccagatcaacaccgacctgaacctggagcgcagccacgcccagaagaacgagaatgctcggcagcagctggaacgccagaacaaggagcttaaggtcaagctgcaggagatggagggcactgtcaagtccaagtacaaggcctccatcaccgccctcgaggccaagattgcacagctggaggagcagctggacaacgagaccaaggagcgccaggcagcctgcaaacaggtgcgtcggaccgagaagaagctgaaggatgtgctgctgcaggtggatgacgagcggaggaacgccgagcagtacaaggaccaggccgacaaggcatctacccgcctgaagcagctcaagcggcagctggaggaggccgaagaggaggcccagcgggccaacgcctcccgccggaaactgcagcgcgagctggaggacgccactgagacggccgatgccatgaaccgcgaagtcagctccctaaagaacaagctcaggcgcggggacctgccgtttgtcgtgccccgccgaatggcccggaaaggcgccggggatggctccgacgaagaggtagatggcaaagcggatggggctgaggccaaacctgccgaataagcctcttctcctgcagcctgagatggatggacagacagacaccacagcctccccttcccagaccccgcagcacgcctctccccaccttcttgggactgctgtgaacatgcctcctcctgccctccgccccgtccccccatcccgtttccctccaggtgttgttgagggcatttggcttcctctgctgcatccccttccagctccctcccctgctcagaatctgataccaaagagacagggcccgggcccaggcagagagcgaccagcaggctcctcagccctctcttgccaaaaagcacaagatgttgaggcgagcagggcaggcccccggggaggggccagagttttctatgaatctatttttcttcagactgaggccttttggtagtcggagcccccgcagtcgtcagcctccctgacgtctgccaccagcgcccccactcctcctcctttctttgctgtttgcaatcacacgtggtgacctcacacacctctgccccttgggcctcccactcccatggctctgggcggtccagaaggagcaggccctgggcctccacctctgtgcagggcacagaaggctggggtggggggaggagtggattcctccccaccctgtcccaggcagcgccactgtccgctgtctccctcctgattctaaaatgtctcaagtgcaatgccccctcccctcctttaccgaggacagcctgcctctgccacagcaaggctgtcggggtcaagctggaaaggccagcagccttccagtggcttctcccaacactcttggggaccaaatatatttaatggttaagggacttgtcccaagtctgacagccagagcgttagaggggccagcggccctcccaggcgatcttgtgtctactctaggactgggcccgagggtggtttacctgcaccgttgactcagtatagtttaaaaatctgccacctgcacaggtatttttgaaagcaaaataaggttttcttttttcccctttcttgtaataaatgataaaattccgagtctttctcactgcctttgtttagaagagagtagctcgtcctcactggtctacactggttgccgaatttacttgtattcctaactgttttgtatatgctgcattgagacttacggcaagaaggcattttttttttttaaaggaaacaaactctcaaatcatgaagtgatataaaagctgcatatgcctacaaagctctgaattcaggtcccagttgctgtcacaaaggagtgagtgaaactcccaccctacccccttttttatataataaaagtgccttagcatgtgttgcagctgtcaccactacagtaagctggtttacagatgttttccactgagcatcacaataaagagaaccatgtgcta

SEQ ID NO: 314128 - DNA, 6647 bp, Homo sapiens
cccgatattcggtcagtgggtgatagcaaaacctcgggtacgccaagaccgtgaagaatgacgaactcctcccgcttcggcaaattcattcgcatcaactttgatgtcaatggctacattgttggagccaacattgagacttatcttttggagaaatctcgtgctatccgccaagccaaggaagaacggaccttccacatcttctattatctcctgtctggggctggagagcacctgaagaccgatctcctgttggagccgtacaacaaataccgcttcctgtccaatggacacgtcaccatccccgggcagcaggacaaggacatgttccaggagaccatggaggccatgaggattatgggcatcccagaagaggagcaaatgggcctgctgcgggtcatctcaggggttcttcagctcggcaacatcgtcttcaagaaggagcggaacactgaccaggcgtccatgcccgacaacacagctgcccaaaaggtgtcccatctcttgggtatcaatgtgaccgatttcaccagaggaatcctcaccccgcgcatcaaggtgggacgggattacgtccagaaggcgcagactaaagagcaggctgactttgccatcgaggccttggccaaggcgacctatgagcggatgttccgctggctggtgctgcgcatcaacaaggctctggacaagaccaagaggcagggcgcctccttcatcgggatcctggacattgccggcttcgagatctttgatctgaactcgtttgagcagctgtgcatcaattacaccaatgagaagctgcagcagctcttcaaccacaccatgttcatcctggagcaggaggagtaccagcgcgagggcatcgagtggaacttcatcgactttggcctcgacctgcagccctgcatcgacctcattgagaagccagcaggccccccgggcattctggccctgctggacgaggagtgctggttccccaaagccaccgacaagagcttcgtggagaaggtgatgcaggagcagggcacccaccccaagttccagaagcccaagcagctgaaggacaaagctgatttctgcattatccactatgccggcaaggtggattacaaagctgacgagtggctgatgaagaacatggatcccctgaatgacaacatcgccacactgctccaccagtcctctgacaagtttgtctcggagctgtggaaggatgtggaccgcatcatcggcctggaccaggtggccggcatgtcggagaccgcactgcccggggccttcaagacgcggaagggcatgttccgcactgtggggcagctttacaaggagcagctggccaagctgatggctacgctgaggaacacgaaccccaactttgtccgctgcatcatccccaaccacgagaagaaggccggcaagctggacccgcatctcgtgctggaccagctgcgctgcaacggtgttctcgagggcatccgtatctgccgccagggcttccccaacagggtggtcttccaggagtttcggcagagatatgagatcctgactccaaactccattcccaagggtttcatggacgggaagcaggcgtgcgtgctcatgataaaagccctggagctcgacagcaatctgtaccgcattggccagagcaaagtcttcttccgtgccggtgtgctggcccacctggaggaggagcgagacctgaagatcaccgacgtcatcatagggttccaggcctgctgcaggggctacctggccaggaaagcatttgccaagcggcagcagcagcttaccgccatgaaggtcctccagcggaactgcgctgcctacctgaagctgcggaactggcagtggtggcggctcttcaccaaggtcaagccgctgctgcaggtgagccggcaggaggaggagatgatggccaaggaggaggagctggtgaaggtcagagagaagcagctggctgcggagaacaggctcacggagatggagacgctgcagtctcagctcatggcagagaaattgcagctgcaggagcagctccaggcagaaaccgagctgtgtgccgaggctgaggagctccgggcccgcctgaccgccaagaagcaggaattagaagagatctgccatgacctagaggccagggtggaggaggaggaggagcgctgccagcacctgcaggcggagaagaagaagatgcagcagaacatccaggagcttgaggagcagctggaggaggaggagagcgcccggcagaagctgcagctggagaaggtgaccaccgaggcgaagctgaaaaagctggaggaggagcagatcatcctggaggaccagaactgcaagctggccaaggaaaagaaactgctggaagacagaatagctgagttcaccaccaacctcacagaagaggaggagaaatctaagagcctcgccaagctcaagaacaagcatgaggcaatgatcactgacttggaagagcgcctccgcagggaggagaagcagcgacaggagctggagaagacccgccggaagctggagggagactccacagacctcagcgaccagatcgccgagctccaggcccagatcgcggagctcaagatgcagctggccaagaaagaggaggagctccaggccgccctggccagagtggaagaggaagctgcccagaagaacatggccctcaagaagatccgggagctggaatctcagatctctgaactccaggaagacctggagtctgagcgtgcttccaggaataaagctgagaagcagaaacgggaccttggggaagagctagaggcgctgaaaacagagttggaggacacgctggattccacagctgcccagcaggagctcaggtcaaaacgtgagcaggaggtgaacatcctgaagaagaccctggaggaggaggccaagacccacgaggcccagatccaggagatgaggcagaagcactcacaggccgtggaggagctggcggagcagctggagcagacgaagcgggtgaaagcaaacctcgagaaggcaaagcagactctggagaacgagcggggggagctggccaacgaggtgaaggtgctgctgcagggcaaaggggactcggagcacaagcgcaagaaagtggaggcgcagctgcaggagctgcaggtcaagttcaacgagggagagcgcgtgcgcacagagctggccgacaaggtcaccaagctgcaggtggagctggacaacgtgaccgggcttctcagccagtccgacagcaagtccagcaagctcaccaaggacttctccgcgctggagtcccagctgcaggacactcaggagctgctgcaggaggagaaccggcagaagctgagcctgagcaccaagctcaagcaggtggaggacgagaagaattccttccgggagcagctggaggaggaggaggaggccaagcacaacctggagaagcagatcgccaccctccatgcccaggtggccgacatgaaaaagaagatggaggacagtgtggggtgcctggaaactgctgaggaggtgaagaggaagctccagaaggacctggagggcctgagccagcggcacgaggagaaggtggccgcctacgacaagctggagaagaccaagacgcggctgcagcaggagctggacgacctgctggtggacctggaccaccagcgccagagcgcgtgcaacctggagaagaagcagaagaagtttgaccagctcctggcggaggagaagaccatctctgccaagtatgcagaggagcgcgaccgggctgaggcggaggcccgagagaaggagaccaaggctctgtcgctggcccgggccctggaggaagccatggagcagaaggcggagctggagcggctcaacaagcagttccgcacggagatggaggaccttatgagctccaaggatgatgtgggcaagagtgtccacgagctggagaagtccaagcgggccctagagcagcaggtggaggagatgaagacgcagctggaagagctggaggacgagctgcaggccaccgaagatgccaagctgcggttggaggtcaacctgcaggccatgaaggcccagttcgagcgggacctgcagggccgggacgagcagagcgaggagaagaagaagcagctggtcagacaggtgcgggagatggaggcagagctggaggacgagaggaagcagcgctcgatggcagtggccgcccggaagaagctggagatggacctgaaggacctggaggcgcacatcgactcggccaacaagaaccgggacgaagccatcaaacagctgcggaagctgcaggcccagatgaaggactgcatgcgcgagctggatgacacccgcgcctctcgtgaggagatcctggcccaggccaaagagaacgagaagaagctgaagagcatggaggccgagatgatccagttgcaggaggaactggcagccgcggagcgtgccaagcgccaggcccagcaggagcgggatgagctggctgacgagatcgccaacagcagcggcaaaggagccctggcgttagaggagaagcggcgtctggaggcccgcatcgcccagctggaggaggagctggaggaggagcagggcaacacggagctgatcaacgaccggctgaagaaggccaacctgcagatcgaccagatcaacaccgacctgaacctggagcgcagccacgcccagaagaacgagaatgctcggcagcagctggaacgccagaacaaggagcttaaggtcaagctgcaggagatggagggcactgtcaagtccaagtacaaggcctccatcaccgccctcgaggccaagattgcacagctggaggagcagctggacaacgagaccaaggagcgccaggcagcctgcaaacaggtgcgtcggaccgagaagaagctgaaggatgtgctgctgcaggtggatgacgagcggaggaacgccgagcagtacaaggaccaggccgacaaggcatctacccgcctgaagcagctcaagcggcagctggaggaggccgaagaggaggcccagcgggccaacgcctcccgccggaaactgcagcgcgagctggaggacgccactgagacggccgatgccatgaaccgcgaagtcagctccctaaagaacaagctcaggcgcggggacctgccgtttgtcgtgccccgccgaatggcccggaaaggcgccggggatggctccgacgaagaggtagatggcaaagcggatggggctgaggccaaacctgccgaataagcctcttctcctgcagcctgagatggatggacagacagacaccacagcctccccttcccagaccccgcagcacgcctctccccaccttcttgggactgctgtgaacatgcctcctcctgccctccgccccgtccccccatcccgtttccctccaggtgttgttgagggcatttggcttcctctgctgcatccccttccagctccctcccctgctcagaatctgataccaaagagacagggcccgggcccaggcagagagcgaccagcaggctcctcagccctctcttgccaaaaagcacaagatgttgaggcgagcagggcaggcccccggggaggggccagagttttctatgaatctatttttcttcagactgaggccttttggtagtcggagcccccgcagtcgtcagcctccctgacgtctgccaccagcgcccccactcctcctcctttctttgctgtttgcaatcacacgtggtgacctcacacacctctgccccttgggcctcccactcccatggctctgggcggtccagaaggagcaggccctgggcctccacctctgtgcagggcacagaaggctggggtggggggaggagtggattcctccccaccctgtcccaggcagcgccactgtccgctgtctccctcctgattctaaaatgtctcaagtgcaatgccccctcccctcctttaccgaggacagcctgcctctgccacagcaaggctgtcggggtcaagctggaaaggccagcagccttccagtggcttctcccaacactcttggggaccaaatatatttaatggttaagggacttgtcccaagtctgacagccagagcgttagaggggccagcggccctcccaggcgatcttgtgtctactctaggactgggcccgagggtggtttacctgcaccgttgactcagtatagtttaaaaatctgccacctgcacaggtatttttgaaagcaaaataaggttttcttttttcccctttcttgtaataaatgataaaattccgagtctttctcactgcctttgtttagaagagagtagctcgtcctcactggtctacactggttgccgaatttacttgtattcctaactgttttgtatatgctgcattgagacttacggcaagaaggcattttttttttttaaaggaaacaaactctcaaatcatgaagtgatataaaagctgcatatgcctacaaagctctgaattcaggtcccagttgctgtcacaaaggagtgagtgaaactcccaccctacccccttttttatataataaaagtgccttagcatgtgttgcagctgtcaccactacagtaagctggttagcacatggttctctttattgtgatgctcagtggaactcgtgctgtaaac

SEQ ID NO: 314129 - DNA, 4223 bp, Homo sapiens
cacgaggcccagatccaggagatgaggcagaagcactcacaggccgtggaggagcgcctccgcagggaggagaagcagcgacaggagctggagaagacccgccggaagctggagggagactccacagacctcagcgaccagatcgccgagctccaggcccagatcgcggagctcaagatgcagctggccaagaaagaggaggagctccaggccgccctggccagagtggaagaggaagctgcccagaagaacatggccctcaagaagatccgggagctggaatctcagatctctgaactccaggaagacctggagtctgagcgtgcttccaggaataaagctgagaagcagaaacgggaccttggggaagagctagaggcgctgaaaacagagttggaggacacgctggattccacagctgcccagcaggagctcaggtcaaaacgtgagcaggaggtgaacatcctgaagaagaccctggaggaggaggccaagacccacgaggcccagatccaggagatgaggcagaagcactcacaggccgtggaggagctggcggagcagctggagcagacgaagcgggtgaaagcaaacctcgagaaggcaaagcagactctggagaacgagcggggggagctggccaacgaggtgaaggtgctgctgcagggcaaaggggactcggagcacaagcgcaagaaagtggaggcgcagctgcaggagctgcaggtcaagttcaacgagggagagcgcgtgcgcacagagctggccgacaaggtcaccaagctgcaggtggagctggacaacgtgaccgggcttctcagccagtccgacagcaagtccagcaagctcaccaaggacttctccgcgctggagtcccagctgcaggacactcaggagctgctgcaggaggagaaccggcagaagctgagcctgagcaccaagctcaagcaggtggaggacgagaagaattccttccgggagcagctggaggaggaggaggaggccaagcacaacctggagaagcagatcgccaccctccatgcccaggtggccgacatgaaaaagaagatggaggacagtgtggggtgcctggaaactgctgaggaggtgaagaggaagctccagaaggacctggagggcctgagccagcggcacgaggagaaggtggccgcctacgacaagctggagaagaccaagacgcggctgcagcaggagctggacgacctgctggtggacctggaccaccagcgccagagcgcgtgcaacctggagaagaagcagaagaagtttgaccagctcctggcggaggagaagaccatctctgccaagtatgcagaggagcgcgaccgggctgaggcggaggcccgagagaaggagaccaaggctctgtcgctggcccgggccctggaggaagccatggagcagaaggcggagctggagcggctcaacaagcagttccgcacggagatggaggaccttatgagctccaaggatgatgtgggcaagagtgtccacgagctggagaagtccaagcgggccctagagcagcaggtggaggagatgaagacgcagctggaagagctggaggacgagctgcaggccaccgaagatgccaagctgcggttggaggtcaacctgcaggccatgaaggcccagttcgagcgggacctgcagggccgggacgagcagagcgaggagaagaagaagcagctggtcagacaggtgcgggagatggaggcagagctggaggacgagaggaagcagcgctcgatggcagtggccgcccggaagaagctggagatggacctgaaggacctggaggcgcacatcgactcggccaacaagaaccgggacgaagccatcaaacagctgcggaagctgcaggcccagatgaaggactgcatgcgcgagctggatgacacccgcgcctctcgtgaggagatcctggcccaggccaaagagaacgagaagaagctgaagagcatggaggccgagatgatccagttgcaggaggaactggcagccgcggagcgtgccaagcgccaggcccagcaggagcgggatgagctggctgacgagatcgccaacagcagcggcaaaggagccctggcgttagaggagaagcggcgtctggaggcccgcatcgcccagctggaggaggagctggaggaggagcagggcaacacggagctgatcaacgaccggctgaagaaggccaacctgcagatcgaccagatcaacaccgacctgaacctggagcgcagccacgcccagaagaacgagaatgctcggcagcagctggaacgccagaacaaggagcttaaggtcaagctgcaggagatggagggcactgtcaagtccaagtacaaggcctccatcaccgccctcgaggccaagattgcacagctggaggagcagctggacaacgagaccaaggagcgccaggcagcctgcaaacaggtgcgtcggaccgagaagaagctgaaggatgtgctgctgcaggtggatgacgagcggaggaacgccgagcagtacaaggaccaggccgacaaggcatctacccgcctgaagcagctcaagcggcagctggaggaggccgaagaggaggcccagcgggccaacgcctcccgccggaaactgcagcgcgagctggaggacgccactgagacggccgatgccatgaaccgcgaagtcagctccctaaagaacaagctcaggcgcggggacctgccgtttgtcgtgccccgccgaatggcccggaaaggcgccggggatggctccgacgaagaggtagatggcaaagcggatggggctgaggccaaacctgccgaataagcctcttctcctgcagcctgagatggatggacagacagacaccacagcctccccttcccagaccccgcagcacgcctctccccaccttcttgggactgctgtgaacatgcctcctcctgccctccgccccgtccccccatcccgtttccctccaggtgttgttgagggcatttggcttcctctgctgcatccccttccagctccctcccctgctcagaatctgataccaaagagacagggcccgggcccaggcagagagcgaccagcaggctcctcagccctctcttgccaaaaagcacaagatgttgaggcgagcagggcaggcccccggggaggggccagagttttctatgaatctatttttcttcagactgaggccttttggtagtcggagcccccgcagtcgtcagcctccctgacgtctgccaccagcgcccccactcctcctcctttctttgctgtttgcaatcacacgtggtgacctcacacacctctgccccttgggcctcccactcccatggctctgggcggtccagaaggagcaggccctgggcctccacctctgtgcagggcacagaaggctggggtggggggaggagtggattcctccccaccctgtcccaggcagcgccactgtccgctgtctccctcctgattctaaaatgtctcaagtgcaatgccccctcccctcctttaccgaggacagcctgcctctgccacagcaaggctgtcggggtcaagctggaaaggccagcagccttccagtggcttctcccaacactcttggggaccaaatatatttaatggttaagggacttgtcccaagtctgacagccagagcgttagaggggccagcggccctcccaggcgatcttgtgtctactctaggactgggcccgagggtggtttacctgcaccgttgactcagtatagtttaaaaatctgccacctgcacaggtatttttgaaagcaaaataaggttttcttttttcccctttcttgtaataaatgataaaattccgagtctttctcactgcctttgtttagaagagagtagctcgtcctcactggtctacactggttgccgaatttacttgtattcctaactgttttgtatatgctgcattgagacttacggcaagaaggcattttttttttttaaaggaaacaaactctcaaatcatgaagtgatataaaagctgcatatgcctacaaagctctgaattcaggtcccagttgctgtcacaaaggagtgagtgaaactcccaccctacccccttttttatataataaaagtgccttagcatgtgttgcagctgtcaccactacagtaagctggtttacagatgttttccactgagcatcacaataaagagaaccatgtgcta

SEQ ID NO: 314130 - DNA, 2989 bp, Homo sapiens
tggcctgcaggttgacctccaaccgcagcttggcatcttcggtggcctgcagctcgtcctccagctcttccagctgcgtcttcatctctgccaagtatgcagaggagcgcgaccgggctgaggcggaggcccgagagaaggagaccaaggctctgtcgctggcccgggccctggaggaagccatggagcagaaggcggagctggagcggctcaacaagcagttccgcacggagatggaggaccttatgagctccaaggatgatgtgggcaagagtgtccacgagctggagaagtccaagcgggccctagagcagcaggtggaggagatgaagacgcagctggaagagctggaggacgagctgcaggccaccgaagatgccaagctgcggttggaggtcaacctgcaggccatgaaggcccagttcgagcgggacctgcagggccgggacgagcagagcgaggagaagaagaagcagctggtcagacaggtgcgggagatggaggcagagctggaggacgagaggaagcagcgctcgatggcagtggccgcccggaagaagctggagatggacctgaaggacctggaggcgcacatcgactcggccaacaagaaccgggacgaagccatcaaacagctgcggaagctgcaggcccagatgaaggactgcatgcgcgagctggatgacacccgcgcctctcgtgaggagatcctggcccaggccaaagagaacgagaagaagctgaagagcatggaggccgagatgatccagttgcaggaggaactggcagccgcggagcgtgccaagcgccaggcccagcaggagcgggatgagctggctgacgagatcgccaacagcagcggcaaaggagccctggcgttagaggagaagcggcgtctggaggcccgcatcgcccagctggaggaggagctggaggaggagcagggcaacacggagctgatcaacgaccggctgaagaaggccaacctgcagatcgaccagatcaacaccgacctgaacctggagcgcagccacgcccagaagaacgagaatgctcggcagcagctggaacgccagaacaaggagcttaaggtcaagctgcaggagatggagggcactgtcaagtccaagtacaaggcctccatcaccgccctcgaggccaagattgcacagctggaggagcagctggacaacgagaccaaggagcgccaggcagcctgcaaacaggtgcgtcggaccgagaagaagctgaaggatgtgctgctgcaggtggatgacgagcggaggaacgccgagcagtacaaggaccaggccgacaaggcatctacccgcctgaagcagctcaagcggcagctggaggaggccgaagaggaggcccagcgggccaacgcctcccgccggaaactgcagcgcgagctggaggacgccactgagacggccgatgccatgaaccgcgaagtcagctccctaaagaacaagctcaggcgcggggacctgccgtttgtcgtgccccgccgaatggcccggaaaggcgccggggatggctccgacgaagaggtagatggcaaagcggatggggctgaggccaaacctgccgaataagcctcttctcctgcagcctgagatggatggacagacagacaccacagcctccccttcccagaccccgcagcacgcctctccccaccttcttgggactgctgtgaacatgcctcctcctgccctccgccccgtccccccatcccgtttccctccaggtgttgttgagggcatttggcttcctctgctgcatccccttccagctccctcccctgctcagaatctgataccaaagagacagggcccgggcccaggcagagagcgaccagcaggctcctcagccctctcttgccaaaaagcacaagatgttgaggcgagcagggcaggcccccggggaggggccagagttttctatgaatctatttttcttcagactgaggccttttggtagtcggagcccccgcagtcgtcagcctccctgacgtctgccaccagcgcccccactcctcctcctttctttgctgtttgcaatcacacgtggtgacctcacacacctctgccccttgggcctcccactcccatggctctgggcggtccagaaggagcaggccctgggcctccacctctgtgcagggcacagaaggctggggtggggggaggagtggattcctccccaccctgtcccaggcagcgccactgtccgctgtctccctcctgattctaaaatgtctcaagtgcaatgccccctcccctcctttaccgaggacagcctgcctctgccacagcaaggctgtcggggtcaagctggaaaggccagcagccttccagtggcttctcccaacactcttggggaccaaatatatttaatggttaagggacttgtcccaagtctgacagccagagcgttagaggggccagcggccctcccaggcgatcttgtgtctactctaggactgggcccgagggtggtttacctgcaccgttgactcagtatagtttaaaaatctgccacctgcacaggtatttttgaaagcaaaataaggttttcttttttcccctttcttgtaataaatgataaaattccgagtctttctcactgcctttgtttagaagagagtagctcgtcctcactggtctacactggttgccgaatttacttgtattcctaactgttttgtatatgctgcattgagacttacggcaagaaggcattttttttttttaaaggaaacaaactctcaaatcatgaagtgatataaaagctgcatatgcctacaaagctctgaattcaggtcccagttgctgtcacaaaggagtgagtgaaactcccaccctacccccttttttatataataaaagtgccttagcatgtgttgcagctgtcaccactacagtaagctggtttacagatgttttccactgagcatcacaataaagagaaccatgtgcta

SEQ ID NO: 314131 - DNA, 6384 bp, Homo sapiens
  misc_feature (6319)..(6319): n is a, c, g, or t
  misc_feature (6322)..(6323): n is a, c, g, or t
  misc_feature (6332)..(6332): n is a, c, g, or t
  misc_feature (6345)..(6345): n is a, c, g, or t
  misc_feature (6347)..(6347): n is a, c, g, or t
  misc_feature (6356)..(6356): n is a, c, g, or t
  misc_feature (6362)..(6363): n is a, c, g, or t
  misc_feature (6365)..(6365): n is a, c, g, or t
  misc_feature (6371)..(6371): n is a, c, g, or t
cccgatattcggtcagtgggtgatagcaaaacctcgggtacgccaagaccgtgaagaatgacgaactcctcccgcttcggcaaattcattcgcatcaactttgatgtcaatggctacattgttggagccaacattgagacttatcttttggagaaatctcgtgctatccgccaagccaaggaagaacggaccttccacatcttctattatctcctgtctggggctggagagcacctgaagaccgatctcctgttggagccgtacaacaaataccgcttcctgtccaatggacacgtcaccatccccgggcagcaggacaaggacatgttccaggagaccatggaggccatgaggattatgggcatcccagaagaggagcaaatgggcctgctgcgggtcatctcaggggttcttcagctcggcaacatcgtcttcaagaaggagcggaacactgaccaggcgtccatgcccgacaacacagctgcccaaaaggtgtcccatctcttgggtatcaatgtgaccgatttcaccagaggaatcctcaccccgcgcatcaaggtgggacgggattacgtccagaaggcgcagactaaagagcaggctgactttgccatcgaggccttggccaaggcgacctatgagcggatgttccgctggctggtgctgcgcatcaacaaggctctggacaagaccaagaggcagggcgcctccttcatcgggatcctggacattgccggcttcgagatctttgatctgaactcgtttgagcagctgtgcatcaattacaccaatgagaagctgcagcagctcttcaaccacaccatgttcatcctggagcaggaggagtaccagcgcgagggcatcgagtggaacttcatcgactttggcctcgacctgcagccctgcatcgacctcattgagaagccagcaggccccccgggcattctggccctgctggacgaggagtgctggttccccaaagccaccgacaagagcttcgtggagaaggtgatgcaggagcagggcacccaccccaagttccagaagcccaagcagctgaaggacaaagctgatttctgcattatccactatgccggcaaggtggattacaaagctgacgagtggctgatgaagaacatggatcccctgaatgacaacatcgccacactgctccaccagtcctctgacaagtttgtctcggagctgtggaaggatgtggaccgcatcatcggcctggaccaggtggccggcatgtcggagaccgcactgcccggggccttcaagacgcggaagggcatgttccgcactgtggggcagctttacaaggagcagctggccaagctgatggctacgctgaggaacacgaaccccaactttgtccgctgcatcatccccaaccacgagaagaaggccggcaagctggacccgcatctcgtgctggaccagctgcgctgcaacggtgttctcgagggcatccgtatctgccgccagggcttccccaacagggtggtcttccaggagtttcggcagagatatgagatcctgactccaaactccattcccaagggtttcatggacgggaagcaggcgtgcgtgctcatgataaaagccctggagctcgacagcaatctgtaccgcattggccagagcaaagtcttcttccgtgccggtgtgctggcccacctggaggaggagcgagacctgaagatcaccgacgtcatcatagggttccaggcctgctgcaggggctacctggccaggaaagcatttgccaagcggcagcagcagcttaccgccatgaaggtcctccagcggaactgcgctgcctacctgaagctgcggaactggcagtggtggcggctcttcaccaaggtcaagccgctgctgcaggtgagccggcaggaggaggagatgatggccaaggaggaggagctggtgaaggtcagagagaagcagctggctgcggagaacaggctcacggagatggagacgctgcagtctcagctcatggcagagaaattgcagctgcaggagcagctccaggcagaaaccgagctgtgtgccgaggctgaggagctccgggcccgcctgaccgccaagaagcaggaattagaagagatctgccatgacctagaggccagggtggaggaggaggaggagcgctgccagcacctgcaggcggagaagaagaagatgcagcagaacatccaggagcttgaggagcagctggaggaggaggagagcgcccggcagaagctgcagctggagaaggtgaccaccgaggcgaagctgaaaaagctggaggaggagcagatcatcctggaggaccagaactgcaagctggccaaggaaaagaaactgctggaagacagaatagctgagttcaccaccaacctcacagaagaggaggagaaatctaagagcctcgccaagctcaagaacaagcatgaggcaatgatcactgacttggaagagcgcctccgcagggaggagaagcagcgacaggagctggagaagacccgccggaagctggagggagactccacagacctcagcgaccagatcgccgagctccaggcccagatcgcggagctcaagatgcagctggccaagaaagaggaggagctccaggccgccctggccagagtggaagaggaagctgcccagaagaacatggccctcaagaagatccgggagctggaatctcagatctctgaactccaggaagacctggagtctgagcgtgcttccaggaataaagctgagaagcagaaacgggaccttggggaagagctagaggcgctgaaaacagagttggaggacacgctggattccacagctgcccagcaggagctcaggtcaaaacgtgagcaggaggtgaacatcctgaagaagaccctggaggaggaggccaagacccacgaggcccagatccaggagatgaggcagaagcactcacaggccgtggaggagctggcggagcagctggagcagacgaagcgggtgaaagcaaacctcgagaaggcaaagcagactctggagaacgagcggggggagctggccaacgaggtgaaggtgctgctgcagggcaaaggggactcggagcacaagcgcaagaaagtggaggcgcagctgcaggagctgcaggtcaagttcaacgagggagagcgcgtgcgcacagagctggccgacaaggtcaccaagctgcaggtggagctggacaacgtgaccgggcttctcagccagtccgacagcaagtccagcaagctcaccaaggacttctccgcgctggagtcccagctgcaggacactcaggagctgctgcaggaggagaaccggcagaagctgagcctgagcaccaagctcaagcaggtggaggacgagaagaattccttccgggagcagctggaggaggaggaggaggccaagcacaacctggagaagcagatcgccaccctccatgcccaggtggccgacatgaaaaagaagatggaggacagtgtggggtgcctggaaactgctgaggaggtgaagaggaagctccagaaggacctggagggcctgagccagcggcacgaggagaaggtggccgcctacgacaagctggagaagaccaagacgcggctgcagcaggagctggacgacctgctggtggacctggaccaccagcgccagagcgcgtgcaacctggagaagaagcagaagaagtttgaccagctcctggcggaggagaagaccatctctgccaagtatgcagaggagcgcgaccgggctgaggcggaggcccgagagaaggagaccaaggctctgtcgctggcccgggccctggaggaagccatggagcagaaggcggagctggagcggctcaacaagcagttccgcacggagatggaggaccttatgagctccaaggatgatgtgggcaagagtgtccacgagctggagaagtccaagcgggccctagagcagcaggtggaggagatgaagacgcagctggaagagctggaggacgagctgcaggccaccgaagatgccaagctgcggttggaggtcaacctgcaggccatgaaggcccagttcgagcgggacctgcagggccgggacgagcagagcgaggagaagaagaagcagctggtcagacaggtgcgggagatggaggcagagctggaggacgagaggaagcagcgctcgatggcagtggccgcccggaagaagctggagatggacctgaaggacctggaggcgcacatcgactcggccaacaagaaccgggacgaagccatcaaacagctgcggaagctgcaggcccagatgaaggactgcatgcgcgagctggatgacacccgcgcctctcgtgaggagatcctggcccaggccaaagagaacgagaagaagctgaagagcatggaggccgagatgatccagttgcaggaggaactggcagccgcggagcgtgccaagcgccaggcccagcaggagcgggatgagctggctgacgagatcgccaacagcagcggcaaaggagccctggcgttagaggagaagcggcgtctggaggcccgcatcgcccagctggaggaggagctggaggaggagcagggcaacacggagctgatcaacgaccggctgaagaaggccaacctgcagatcgaccagatcaacaccgacctgaacctggagcgcagccacgcccagaagaacgagaatgctcggcagcagctggaacgccagaacaaggagcttaaggtcaagctgcaggagatggagggcactgtcaagtccaagtacaaggcctccatcaccgccctcgaggccaagattgcacagctggaggagcagctggacaacgagaccaaggagcgccaggcagcctgcaaacaggtgcgtcggaccgagaagaagctgaaggatgtgctgctgcaggtggatgacgagcggaggaacgccgagcagtacaaggaccaggccgacaaggcatctacccgcctgaagcagctcaagcggcagctggaggaggccgaagaggaggcccagcgggccaacgcctcccgccggaaactgcagcgcgagctggaggacgccactgagacggccgatgccatgaaccgcgaagtcagctccctaaagaacaagctcaggcgcggggacctgccgtttgtcgtgccccgccgaatggcccggaaaggcgccggggatggctccgacgaagaggtagatggcaaagcggatggggctgaggccaaacctgccgaataagcctcttctcctgcagcctgagatggatggacagacagacaccacagcctccccttcccagaccccgcagcacgcctctccccaccttcttgggactgctgtgaacatgcctcctcctgccctccgccccgtccccccatcccgtttccctccaggtgttgttgagggcatttggcttcctctgctgcatccccttccagctccctcccctgctcagaatctgataccaaagagacagggcccgggcccaggcagagagcgaccagcaggctcctcagccctctcttgccaaaaagcacaagatgttgaggcgagcagggcaggcccccggggaggggccagagttttctatgaatctatttttcttcagactgaggccttttggtagtcggagcccccgcagtcgtcagcctccctgacgtctgccaccagcgcccccactcctcctcctttctttgctgtttgcaatcacacgtggtgacctcacacacctctgccccttgggcctcccactcccatggctctgggcggtccagaaggagcaggccctgggcctccacctctgtgcagggcacagaaggctggggtggggggaggagtggattcctccccaccctgtcccaggcagcgccactgtccgctgtctccctcctgattctaaaatgtctcaagtgcaatgccccctcccctcctttaccgaggacagcctgcctctgccacagcaaggctgtcggggtcaagctggaaaggccagcagccttccagtggcttctcccaacactcttggggaccaaatatatttaatggttaagggacttgtcccaagtctgacagccagagcgttagaggggccagcggccctcccaggcgatcttgtgtctactctaggactgggcccgagggtggtttacctgcaccgttgactcagtatagtttaaaaatctgccacctgcacaggtatttttgaaagcaaaataaggttttcttttttcccctttcttgtaataaatgataaaattccaaaaaaaaaaaaaaaaaaaaaaaaaaaactgtgtgtgggggngcnncgggcccgnagaaaaagctttntnaacacccantcggtnngngggcgnggcgggggcccca

SEQ ID NO: 314132 - DNA, 6313 bp, Homo sapiens
  misc_feature (6284)..(6284): n is a, c, g, or t
  misc_feature (6310)..(6310): n is a, c, g, or t
cccgatattcggtcagtgggtgatagcaaaacctcgggtacgccaagaccgtgaagaatgacgaactcctcccgcttcggcaaattcattcgcatcaactttgatgtcaatggctacattgttggagccaacattgagacttatcttttggagaaatctcgtgctatccgccaagccaaggaagaacggaccttccacatcttctattatctcctgtctggggctggagagcacctgaagaccgatctcctgttggagccgtacaacaaataccgcttcctgtccaatggacacgtcaccatccccgggcagcaggacaaggacatgttccaggagaccatggaggccatgaggattatgggcatcccagaagaggagcaaatgggcctgctgcgggtcatctcaggggttcttcagctcggcaacatcgtcttcaagaaggagcggaacactgaccaggcgtccatgcccgacaacacagctgcccaaaaggtgtcccatctcttgggtatcaatgtgaccgatttcaccagaggaatcctcaccccgcgcatcaaggtgggacgggattacgtccagaaggcgcagactaaagagcaggctgactttgccatcgaggccttggccaaggcgacctatgagcggatgttccgctggctggtgctgcgcatcaacaaggctctggacaagaccaagaggcagggcgcctccttcatcgggatcctggacattgccggcttcgagatctttgatctgaactcgtttgagcagctgtgcatcaattacaccaatgagaagctgcagcagctcttcaaccacaccatgttcatcctggagcaggaggagtaccagcgcgagggcatcgagtggaacttcatcgactttggcctcgacctgcagccctgcatcgacctcattgagaagccagcaggccccccgggcattctggccctgctggacgaggagtgctggttccccaaagccaccgacaagagcttcgtggagaaggtgatgcaggagcagggcacccaccccaagttccagaagcccaagcagctgaaggacaaagctgatttctgcattatccactatgccggcaaggtggattacaaagctgacgagtggctgatgaagaacatggatcccctgaatgacaacatcgccacactgctccaccagtcctctgacaagtttgtctcggagctgtggaaggatgtggaccgcatcatcggcctggaccaggtggccggcatgtcggagaccgcactgcccggggccttcaagacgcggaagggcatgttccgcactgtggggcagctttacaaggagcagctggccaagctgatggctacgctgaggaacacgaaccccaactttgtccgctgcatcatccccaaccacgagaagaaggccggcaagctggacccgcatctcgtgctggaccagctgcgctgcaacggtgttctcgagggcatccgtatctgccgccagggcttccccaacagggtggtcttccaggagtttcggcagagatatgagatcctgactccaaactccattcccaagggtttcatggacgggaagcaggcgtgcgtgctcatgataaaagccctggagctcgacagcaatctgtaccgcattggccagagcaaagtcttcttccgtgccggtgtgctggcccacctggaggaggagcgagacctgaagatcaccgacgtcatcatagggttccaggcctgctgcaggggctacctggccaggaaagcatttgccaagcggcagcagcagcttaccgccatgaaggtcctccagcggaactgcgctgcctacctgaagctgcggaactggcagtggtggcggctcttcaccaaggtcaagccgctgctgcaggtgagccggcaggaggaggagatgatggccaaggaggaggagctggtgaaggtcagagagaagcagctggctgcggagaacaggctcacggagatggagacgctgcagtctcagctcatggcagagaaattgcagctgcaggagcagctccaggcagaaaccgagctgtgtgccgaggctgaggagctccgggcccgcctgaccgccaagaagcaggaattagaagagatctgccatgacctagaggccagggtggaggaggaggaggagcgctgccagcacctgcaggcggagaagaagaagatgcagcagaacatccaggagcttgaggagcagctggaggaggaggagagcgcccggcagaagctgcagctggagaaggtgaccaccgaggcgaagctgaaaaagctggaggaggagcagatcatcctggaggaccagaactgcaagctggccaaggaaaagaaactgctggaagacagaatagctgagttcaccaccaacctcacagaagaggaggagaaatctaagagcctcgccaagctcaagaacaagcatgaggcaatgatcactgacttggaagagcgcctccgcagggaggagaagcagcgacaggagctggagaagacccgccggaagctggagggagactccacagacctcagcgaccagatcgccgagctccaggcccagatcgcggagctcaagatgcagctggccaagaaagaggaggagctccaggccgccctggccagagtggaagaggaagctgcccagaagaacatggccctcaagaagatccgggagctggaatctcagatctctgaactccaggaagacctggagtctgagcgtgcttccaggaataaagctgagaagcagaaacgggaccttggggaagagctagaggcgctgaaaacagagttggaggacacgctggattccacagctgcccagcaggagctcaggtcaaaacgtgagcaggaggtgaacatcctgaagaagaccctggaggaggaggccaagacccacgaggcccagatccaggagatgaggcagaagcactcacaggccgtggaggagctggcggagcagctggagcagacgaagcgggtgaaagcaaacctcgagaaggcaaagcagactctggagaacgagcggggggagctggccaacgaggtgaaggtgctgctgcagggcaaaggggactcggagcacaagcgcaagaaagtggaggcgcagctgcaggagctgcaggtcaagttcaacgagggagagcgcgtgcgcacagagctggccgacaaggtcaccaagctgcaggtggagctggacaacgtgaccgggcttctcagccagtccgacagcaagtccagcaagctcaccaaggacttctccgcgctggagtcccagctgcaggacactcaggagctgctgcaggaggagaaccggcagaagctgagcctgagcaccaagctcaagcaggtggaggacgagaagaattccttccgggagcagctggaggaggaggaggaggccaagcacaacctggagaagcagatcgccaccctccatgcccaggtggccgacatgaaaaagaagatggaggacagtgtggggtgcctggaaactgctgaggaggtgaagaggaagctccagaaggacctggagggcctgagccagcggcacgaggagaaggtggccgcctacgacaagctggagaagaccaagacgcggctgcagcaggagctggacgacctgctggtggacctggaccaccagcgccagagcgcgtgcaacctggagaagaagcagaagaagtttgaccagctcctggcggaggagaagaccatctctgccaagtatgcagaggagcgcgaccgggctgaggcggaggcccgagagaaggagaccaaggctctgtcgctggcccgggccctggaggaagccatggagcagaaggcggagctggagcggctcaacaagcagttccgcacggagatggaggaccttatgagctccaaggatgatgtgggcaagagtgtccacgagctggagaagtccaagcgggccctagagcagcaggtggaggagatgaagacgcagctggaagagctggaggacgagctgcaggccaccgaagatgccaagctgcggttggaggtcaacctgcaggccatgaaggcccagttcgagcgggacctgcagggccgggacgagcagagcgaggagaagaagaagcagctggtcagacaggtgcgggagatggaggcagagctggaggacgagaggaagcagcgctcgatggcagtggccgcccggaagaagctggagatggacctgaaggacctggaggcgcacatcgactcggccaacaagaaccgggacgaagccatcaaacagctgcggaagctgcaggcccagatgaaggactgcatgcgcgagctggatgacacccgcgcctctcgtgaggagatcctggcccaggccaaagagaacgagaagaagctgaagagcatggaggccgagatgatccagttgcaggaggaactggcagccgcggagcgtgccaagcgccaggcccagcaggagcgggatgagctggctgacgagatcgccaacagcagcggcaaaggagccctggcgttagaggagaagcggcgtctggaggcccgcatcgcccagctggaggaggagctggaggaggagcagggcaacacggagctgatcaacgaccggctgaagaaggccaacctgcagatcgaccagatcaacaccgacctgaacctggagcgcagccacgcccagaagaacgagaatgctcggcagcagctggaacgccagaacaaggagcttaaggtcaagctgcaggagatggagggcactgtcaagtccaagtacaaggcctccatcaccgccctcgaggccaagattgcacagctggaggagcagctggacaacgagaccaaggagcgccaggcagcctgcaaacaggtgcgtcggaccgagaagaagctgaaggatgtgctgctgcaggtggatgacgagcggaggaacgccgagcagtacaaggaccaggccgacaaggcatctacccgcctgaagcagctcaagcggcagctggaggaggccgaagaggaggcccagcgggccaacgcctcccgccggaaactgcagcgcgagctggaggacgccactgagacggccgatgccatgaaccgcgaagtcagctccctaaagaacaagctcaggcgcggggacctgccgtttgtcgtgccccgccgaatggcccggaaaggcgccggggatggctccgacgaagaggtagatggcaaagcggatggggctgaggccaaacctgccgaataagcctcttctcctgcagcctgagatggatggacagacagacaccacagcctccccttcccagaccccgcagcacgcctctccccaccttcttgggactgctgtgaacatgcctcctcctgccctccgccccgtccccccatcccgtttccctccaggtgttgttgagggcatttggcttcctctgctgcatccccttccagctccctcccctgctcagaatctgataccaaagagacagggcccgggcccaggcagagagcgaccagcaggctcctcagccctctcttgccaaaaagcacaagatgttgaggcgagcagggcaggcccccggggaggggccagagttttctatgaatctatttttcttcagactgaggccttttggtagtcggagcccccgcagtcgtcagcctccctgacgtctgccaccagcgcccccactcctcctcctttctttgctgtttgcaatcacacgtggtgacctcacacacctctgccccttgggcctcccactcccatggctctgggcggtccagaaggagcaggccctgggcctccacctctgtgcagggcacagaaggctggggtggggggaggagtggattcctccccaccctgtcccaggcagcgccactgtccgctgtctccctcctgattctaaaatgtctcaagtgcaatgccccctcccctcctttaccgaggacagcctgcctctgccacagcaaggctgtcggggtcaagctggaaaggccagcagccttccagtggcttctcccaacactcttggggaccaaatatatttaatggttaagggacttgtcccaagtctgacagccagagcgttagaggggccagcggccctcccaggcgatcttgtgtctactctaggactgggcccgagggtggtttacctgcaccgttgactcagtatagtttaaaaatctgccacctgcacaggtatttttgaaagcaaaataaggttttcttttttcccctttcttgtaataaatgataaaattccccttatnttgctttcaaaaatacctgtgcagtngac

SEQ ID NO: 314133 - DNA, 5253 bp, Homo sapiens
cccgatattcggtcagtgggtgatagcaaaacctcgggtacgccaagaccgtgaagaatgacgaactcctcccgcttcggcaaattcattcgcatcaactttgatgtcaatggctacattgttggagccaacattgagacttatcttttggagaaatctcgtgctatccgccaagccaaggaagaacggaccttccacatcttctattatctcctgtctggggctggagagcacctgaagaccgatctcctgttggagccgtacaacaaataccgcttcctgtccaatggacacgtcaccatccccgggcagcaggacaaggacatgttccaggagaccatggaggccatgaggattatgggcatcccagaagaggagcaaatgggcctgctgcgggtcatctcaggggttcttcagctcggcaacatcgtcttcaagaaggagcggaacactgaccaggcgtccatgcccgacaacacagctgcccaaaaggtgtcccatctcttgggtatcaatgtgaccgatttcaccagaggaatcctcaccccgcgcatcaaggtgggacgggattacgtccagaaggcgcagactaaagagcaggctgactttgccatcgaggccttggccaaggcgacctatgagcggatgttccgctggctggtgctgcgcatcaacaaggctctggacaagaccaagaggcagggcgcctccttcatcgggatcctggacattgccggcttcgagatctttgatctgaactcgtttgagcagctgtgcatcaattacaccaatgagaagctgcagcagctcttcaaccacaccatgttcatcctggagcaggaggagtaccagcgcgagggcatcgagtggaacttcatcgactttggcctcgacctgcagccctgcatcgacctcattgagaagccagcaggccccccgggcattctggccctgctggacgaggagtgctggttccccaaagccaccgacaagagcttcgtggagaaggtgatgcaggagcagggcacccaccccaagttccagaagcccaagcagctgaaggacaaagctgatttctgcattatccactatgccggcaaggtggattacaaagctgacgagtggctgatgaagaacatggatcccctgaatgacaacatcgccacactgctccaccagtcctctgacaagtttgtctcggagctgtggaaggatgtggaccgcatcatcggcctggaccaggtggccggcatgtcggagaccgcactgcccggggccttcaagacgcggaagggcatgttccgcactgtggggcagctttacaaggagcagctggccaagctgatggctacgctgaggaacacgaaccccaactttgtccgctgcatcatccccaaccacgagaagaaggccggcaagctggacccgcatctcgtgctggaccagctgcgctgcaacggtgttctcgagggcatccgtatctgccgccagggcttccccaacagggtggtcttccaggagtttcggcagagatatgagatcctgactccaaactccattcccaagggtttcatggacgggaagcaggcgtgcgtgctcatgataaaagccctggagctcgacagcaatctgtaccgcattggccagagcaaagtcttcttccgtgccggtgtgctggcccacctggaggaggagcgagacctgaagatcaccgacgtcatcatagggttccaggcctgctgcaggggctacctggccaggaaagcatttgccaagcggcagcagcagcttaccgccatgaaggtcctccagcggaactgcgctgcctacctgaagctgcggaactggcagtggtggcggctcttcaccaaggtcaagccgctgctgcaggtgagccggcaggaggaggagatgatggccaaggaggaggagctggtgaaggtcagagagaagcagctggctgcggagaacaggctcacggagatggagacgctgcagtctcagctcatggcagagaaattgcagctgcaggagcagctccaggcagaaaccgagctgtgtgccgaggctgaggagctccgggcccgcctgaccgccaagaagcaggaattagaagagatctgccatgacctagaggccagggtggaggaggaggaggagcgctgccagcacctgcaggcggagaagaagaagatgcagcagaacatccaggagcttgaggagcagctggaggaggaggagagcgcccggcagaagctgcagctggagaaggtgaccaccgaggcgaagctgaaaaagctggaggaggagcagatcatcctggaggaccagaactgcaagctggccaaggaaaagaaactgctggaagacagaatagctgagttcaccaccaacctcacagaagaggaggagaaatctaagagcctcgccaagctcaagaacaagcatgaggcaatgatcactgacttggaagagcgcctccgcagggaggagaagcagcgacaggagctggagaagacccgccggaagctggagggagactccacagacctcagcgaccagatcgccgagctccaggcccagatcgcggagctcaagatgcagctggccaagaaagaggaggagctccaggccgccctggccagagtggaagaggaagctgcccagaagaacatggccctcaagaagatccgggagctggaatctcagatctctgaactccaggaagacctggagtctgagcgtgcttccaggaataaagctgagaagcagaaacgggaccttggggaagagctagaggcgctgaaaacagagttggaggacacgctggattccacagctgcccagcaggagctcaggtcaaaacgtgagcaggaggtgaacatcctgaagaagaccctggaggaggaggccaagacccacgaggcccagatccaggagatgaggcagaagcactcacaggccgtggaggagctggcggagcagctggagcagacgaagcgggtgaaagcaaacctcgagaaggcaaagcagactctggagaacgagcggggggagctggccaacgaggtgaaggtgctgctgcagggcaaaggggactcggagcacaagcgcaagaaagtggaggcgcagctgcaggagctgcaggtcaagttcaacgagggagagcgcgtgcgcacagagctggccgacaaggtcaccaagctgcaggtggagctggacaacgtgaccgggcttctcagccagtccgacagcaagtccagcaagctcaccaaggacttctccgcgctggagtcccagctgcaggacactcaggagctgctgcaggaggagaaccggcagaagctgagcctgagcaccaagctcaagcaggtggaggacgagaagaattccttccgggagcagctggaggaggaggaggaggccaagcacaacctggagaagcagatcgccaccctccatgcccaggtggccgacatgaaaaagaagatggaggacagtgtggggtgcctggaaactgctgaggaggtgaagaggaagctccagaaggacctggagggcctgagccagcggcacgaggagaaggtggccgcctacgacaagctggagaagaccaagacgcggctgcagcaggagctggacgacctgctggtggacctggaccaccagcgccagagcgcgtgcaacctggagaagaagcagaagaagtttgaccagctcctggcggaggagaagaccatctctgccaagtatgcagaggagcgcgaccgggctgaggcggaggcccgagagaaggagaccaaggctctgtcgctggcccgggccctggaggaagccatggagcagaaggcggagctggagcggctcaacaagcagttccgcacggagatggaggaccttatgagctccaaggatgatgtgggcaagagtgtccacgagctggagaagtccaagcgggccctagagcagcaggtggaggagatgaagaccgccccgtccccccatcccgtttccctccaggtgttgttgagggcatttggcttcctctgctgcatccccttccagctccctcccctgctcagaatctgataccaaagagacagggcccgggcccaggcagagagcgaccagcaggctcctcagccctctcttgccaaaaagcacaagatgttgaggcgagcagggcaggcccccggggaggggccagagttttctatgaatctatttttcttcagactgaggccttttggtagtcggagcccccgcagtcgtcagcctccctgacgtctgccaccagcgcccccactcctcctcctttctttgctgtttgcaatcacacgtggtgacctcacacacctctgccccttgggcctcccactcccatggctctgggcggtccagaaggagcaggccctgggcctccacctctgtgcagggcacagaaggctggggtggggggaggagtggattcctccccaccctgtcccaggcagcgccactgtccgctgtctccctcctgattctaaaatgtctcaagtgcaatgccccctcccctcctttaccgaggacagcctgcctctgccacagcaaggctgtcggggtcaagctggaaaggccagcagccttccagtggcttctcccaacactcttggggaccaaatatatttaatggttaagggacttgtcccaagtctgacagccagagcgttagaggggccagcggccctcccaggcgatcttgtgtctactctaggactgggcccgagggtggtttacctgcaccgttgactcagtatagtttaaaaatctgccacctgcacaggtatttttgaaagcaaaataaggttttcttttttcccctttcttgtaataaatgataaaattccgagtctttctcactgcctttgtttagaagagagtagctcgtcctcactggtctacactggttgccgaatttacttgtattcctaactgttttgtatatgctgcattgagacttacggcaagaaggcattttttttttttaaaggaaacaaactctcaaatcatgaagtgatataaaagctgcatatgcctacaaagctctgaattcaggtcccagttgctgtcacaaaggagtgagtgaaactcccaccctacccccttttttatataataaaagtgccttagcatgtgttgcagctgtcaccactacagtaagctggtttacagatgttttccactgagcatcacaataaagagaaccatgtgcta

SEQ ID NO: 314134 - DNA, 2057 bp, Homo sapiens
ccacgcgtccggacttgtcccaagtctgacagccagagcgttagaggggccagcctgcagatcgaccagatcaacaccgacctgaacctggagcgcagccacgcccagaagaacgagaatgctcggcagcagctggaacgccagaacaaggagcttaaggtcaagctgcaggagatggagggcactgtcaagtccaagtacaaggcctccatcaccgccctcgaggccaagattgcacagctggaggagcagctggacaacgagaccaaggagcgccaggcagcctgcaaacaggtgcgtcggaccgagaagaagctgaaggatgtgctgctgcaggtggatgacgagcggaggaacgccgagcagtacaaggaccaggccgacaaggcatctacccgcctgaagcagctcaagcggcagctggaggaggccgaagaggaggcccagcgggccaacgcctcccgccggaaactgcagcgcgagctggaggacgccactgagacggccgatgccatgaaccgcgaagtcagctccctaaagaacaagctcaggcgcggggacctgccgtttgtcgtgccccgccgaatggcccggaaaggcgccggggatggctccgacgaagaggtagatggcaaagcggatggggctgaggccaaacctgccgaataagcctcttctcctgcagcctgagatggatggacagacagacaccacagcctccccttcccagaccccgcagcacgcctctccccaccttcttgggactgctgtgaacatgcctcctcctgccctccgccccgtccccccatcccgtttccctccaggtgttgttgagggcatttggcttcctctgctgcatccccttccagctccctcccctgctcagaatctgataccaaagagacagggcccgggcccaggcagagagcgaccagcaggctcctcagccctctcttgccaaaaagcacaagatgttgaggcgagcagggcaggcccccggggaggggccagagttttctatgaatctatttttcttcagactgaggccttttggtagtcggagcccccgcagtcgtcagcctccctgacgtctgccaccagcgcccccactcctcctcctttctttgctgtttgcaatcacacgtggtgacctcacacacctctgccccttgggcctcccactcccatggctctgggcggtccagaaggagcaggccctgggcctccacctctgtgcagggcacagaaggctggggtggggggaggagtggattcctccccaccctgtcccaggcagcgccactgtccgctgtctccctcctgattctaaaatgtctcaagtgcaatgccccctcccctcctttaccgaggacagcctgcctctgccacagcaaggctgtcggggtcaagctggaaaggccagcagccttccagtggcttctcccaacactcttggggaccaaatatatttaatggttaagggacttgtcccaagtctgacagccagagcgttagaggggccagcggccctcccaggcgatcttgtgtctactctaggactgggcccgagggtggtttacctgcaccgttgactcagtatagtttaaaaatctgccacctgcacaggtatttttgaaagcaaaataaggttttcttttttcccctttcttgtaataaatgataaaattccgagtctttctcactgcctttgtttagaagagagtagctcgtcctcactggtctacactggttgccgaatttacttgtattcctaactgttttgtatatgctgcattgagacttacggcaagaaggcattttttttttttaaaggaaacaaactctcaaatcatgaagtgatataaaagctgcatatgcctacaaagctctgaattcaggtcccagttgctgtcacaaaggagtgagtgaaactcccaccctacccccttttttatataataaaagtgccttagcatgtgttgcagctgtcaccactacagtaagctggtttacagatgttttccactgagcatcacaataaagagaaccatgtgcta

SEQ ID NO: 314135 - DNA, 1817 bp, Homo sapiens
tgggtattagaggatccctagaggcacaaggagcgccaggcagcctgcaaacaggtgcgtcggaccgagaagaagctgaaggatgtgctgctgcaggtggatgacgagcggaggaacgccgagcagtacaaggaccaggccgacaaggcatctacccgcctgaagcagctcaagcggcagctggaggaggccgaagaggaggcccagcgggccaacgcctcccgccggaaactgcagcgcgagctggaggacgccactgagacggccgatgccatgaaccgcgaagtcagctccctaaagaacaagctcaggcgcggggacctgccgtttgtcgtgccccgccgaatggcccggaaaggcgccggggatggctccgacgaagaggtagatggcaaagcggatggggctgaggccaaacctgccgaataagcctcttctcctgcagcctgagatggatggacagacagacaccacagcctccccttcccagaccccgcagcacgcctctccccaccttcttgggactgctgtgaacatgcctcctcctgccctccgccccgtccccccatcccgtttccctccaggtgttgttgagggcatttggcttcctctgctgcatccccttccagctccctcccctgctcagaatctgataccaaagagacagggcccgggcccaggcagagagcgaccagcaggctcctcagccctctcttgccaaaaagcacaagatgttgaggcgagcagggcaggcccccggggaggggccagagttttctatgaatctatttttcttcagactgaggccttttggtagtcggagcccccgcagtcgtcagcctccctgacgtctgccaccagcgcccccactcctcctcctttctttgctgtttgcaatcacacgtggtgacctcacacacctctgccccttgggcctcccactcccatggctctgggcggtccagaaggagcaggccctgggcctccacctctgtgcagggcacagaaggctggggtggggggaggagtggattcctccccaccctgtcccaggcagcgccactgtccgctgtctccctcctgattctaaaatgtctcaagtgcaatgccccctcccctcctttaccgaggacagcctgcctctgccacagcaaggctgtcggggtcaagctggaaaggccagcagccttccagtggcttctcccaacactcttggggaccaaatatatttaatggttaagggacttgtcccaagtctgacagccagagcgttagaggggccagcggccctcccaggcgatcttgtgtctactctaggactgggcccgagggtggtttacctgcaccgttgactcagtatagtttaaaaatctgccacctgcacaggtatttttgaaagcaaaataaggttttcttttttcccctttcttgtaataaatgataaaattccgagtctttctcactgcctttgtttagaagagagtagctcgtcctcactggtctacactggttgccgaatttacttgtattcctaactgttttgtatatgctgcattgagacttacggcaagaaggcattttttttttttaaaggaaacaaactctcaaatcatgaagtgatataaaagctgcatatgcctacaaagctctgaattcaggtcccagttgctgtcacaaaggagtgagtgaaactcccaccctacccccttttttatataataaaagtgccttagcatgtgttgcagctgtcaccactacagtaagctggtttacagatgttttccactgagcatcacaataaagagaaccatgtgcta

SEQ ID NO: 314136 - DNA, 5379 bp, Homo sapiens
cccgatattcggtcagtgggtgatagcaaaacctcgggtacgccaagaccgtgaagaatgacgaactcctcccgcttcggcaaattcattcgcatcaactttgatgtcaatggctacattgttggagccaacattgagacttatcttttggagaaatctcgtgctatccgccaagccaaggaagaacggaccttccacatcttctattatctcctgtctggggctggagagcacctgaagaccgatctcctgttggagccgtacaacaaataccgcttcctgtccaatggacacgtcaccatccccgggcagcaggacaaggacatgttccaggagaccatggaggccatgaggattatgggcatcccagaagaggagcaaatgggcctgctgcgggtcatctcaggggttcttcagctcggcaacatcgtcttcaagaaggagcggaacactgaccaggcgtccatgcccgacaacacagctgcccaaaaggtgtcccatctcttgggtatcaatgtgaccgatttcaccagaggaatcctcaccccgcgcatcaaggtgggacgggattacgtccagaaggcgcagactaaagagcaggctgactttgccatcgaggccttggccaaggcgacctatgagcggatgttccgctggctggtgctgcgcatcaacaaggctctggacaagaccaagaggcagggcgcctccttcatcgggatcctggacattgccggcttcgagatctttgatctgaactcgtttgagcagctgtgcatcaattacaccaatgagaagctgcagcagctcttcaaccacaccatgttcatcctggagcaggaggagtaccagcgcgagggcatcgagtggaacttcatcgactttggcctcgacctgcagccctgcatcgacctcattgagaagccagcaggccccccgggcattctggccctgctggacgaggagtgctggttccccaaagccaccgacaagagcttcgtggagaaggtgatgcaggagcagggcacccaccccaagttccagaagcccaagcagctgaaggacaaagctgatttctgcattatccactatgccggcaaggtggattacaaagctgacgagtggctgatgaagaacatggatcccctgaatgacaacatcgccacactgctccaccagtcctctgacaagtttgtctcggagctgtggaaggatgtggaccgcatcatcggcctggaccaggtggccggcatgtcggagaccgcactgcccggggccttcaagacgcggaagggcatgttccgcactgtggggcagctttacaaggagcagctggccaagctgatggctacgctgaggaacacgaaccccaactttgtccgctgcatcatccccaaccacgagaagaaggccggcaagctggacccgcatctcgtgctggaccagctgcgctgcaacggtgttctcgagggcatccgtatctgccgccagggcttccccaacagggtggtcttccaggagtttcggcagagatatgagatcctgactccaaactccattcccaagggtttcatggacgggaagcaggcgtgcgtgctcatgataaaagccctggagctcgacagcaatctgtaccgcattggccagagcaaagtcttcttccgtgccggtgtgctggcccacctggaggaggagcgagacctgaagatcaccgacgtcatcatagggttccaggcctgctgcaggggctacctggccaggaaagcatttgccaagcggcagcagcagcttaccgccatgaaggtcctccagcggaactgcgctgcctacctgaagctgcggaactggcagtggtggcggctcttcaccaaggtcaagccgctgctgcaggtgagccggcaggaggaggagatgatggccaaggaggaggagctggtgaaggtcagagagaagcagctggctgcggagaacaggctcacggagatggagacgctgcagtctcagctcatggcagagaaattgcagctgcaggagcagctccaggcagaaaccgagctgtgtgccgaggctgaggagctccgggcccgcctgaccgccaagaagcaggaattagaagagatctgccatgacctagaggccagggtggaggaggaggaggagcgctgccagcacctgcaggcggagaagaagaagatgcagcagaacatccaggagcttgaggagcagctggaggaggaggagagcgcccggcagaagctgcagctggagaaggtgaccaccgaggcgaagctgaaaaagctggaggaggagcagatcatcctggaggaccagaactgcaagctggccaaggaaaagaaactgctggaagacagaatagctgagttcaccaccaacctcacagaagaggaggagaaatctaagagcctcgccaagctcaagaacaagcatgaggcaatgatcactgacttggaagagcgcctccgcagggaggagaagcagcgacaggagctggagaagacccgccggaagctggagggagactccacagacctcagcgaccagatcgccgagctccaggcccagatcgcggagctcaagatgcagctggccaagaaagaggaggagctccaggccgccctggccagagtggaagaggaagctgcccagaagaacatggccctcaagaagatccgggagctggaatctcagatctctgaactccaggaagacctggagtctgagcgtgcttccaggaataaagctgagaagcagaaacgggaccttggggaagagctagaggcgctgaaaacagagttggaggacacgctggattccacagctgcccagcaggagctcaggtcaaaacgtgagcaggaggtgaacatcctgaagaagaccctggaggaggaggccaagacccacgaggcccagatccaggagatgaggcagaagcactcacaggccgtggaggagctggcggagcagctggagcagacgaagcgggtgaaagcaaacctcgagaaggcaaagcagactctggagaacgagcggggggagctggccaacgaggtgaaggtgctgctgcagggcaaaggggactcggagcacaagcgcaagaaagtggaggcgcagctgcaggagctgcaggtcaagttcaacgagggagagcgcgtgcgcacagagctggccgacaaggtcaccaagctgcaggtggagctggacaacgtgaccgggcttctcagccagtccgacagcaagtccagcaagctcaccaaggacttctccgcgctggagtcccagctgcaggacactcaggagctgctgcaggaggagaaccggcagaagctgagcctgagcaccaagctcaagcaggtggaggacgagaagaattccttccgggagcagctggaggaggaggaggaggccaagcacaacctggagaagcagatcgccaccctccatgcccaggtggccgacatgaaaaagaagatggaggacagtgtggggtgcctggaaactgctgaggaggtgaagaggaagctccagaaggacctggagggcctgagccagcggcacgaggagaaggtggccgcctacgacaagctggagaagaccaagacgcggctgcagcaggagctggacgacctgctggtggacctggaccaccagcgccagagcgcgtgcaacctggagaagaagcagaagaagtttgaccagctcctggcggaggagaagaccatctctgccaagtatgcagaggagcgcgaccgggctgaggcggaggcccgagagaaggagaccaaggctctgtcgctggcccgggccctggaggaagccatggagcagaaggcggagctggagcggctcaacaagcagttccgcacggagatggaggaccttatgagctccaaggatgatgtgggcaagagtgtccacgagctggagaagtccaagcgggccctagagcagcaggtggaggagatgaagacgcagctggaagagctggaggacgagctgcaggccaccgaagatgccaagctgcggttggaggtcaacctgcaggccatgaaggcccagttcgagcgggacctgcagggccgggacgagcagagcgaggagaagaagaagcagctggtcagacaggtgcgggagatggaggcagagctggaggacgagaggaagcagcgctcgatggcagtggccgcccggaagaagctggagatggacctgaaggacctggaggcgcacatcgactcggccaacaagaaccgggacgaagccatcaaacagctgcggaagctgcaggcccagatgaaggactgcatgcgcgagctggatgacacccgcgcctctcgtgaggagatcctggcccaggccaaagagaacgagaagaagctgaagagcatggaggccgagatgatccagttgcaggaggaactggcagccgcggagcgtgccaagcgccaggcccagcaggagcgggatgagctggctgacgagatcgccaacagcagcggcaaaggagccctggcgttagaggagaagcggcgtctggaggcccgcatcgcccagctggaggaggagctggaggaggagcagggcaacacggagctgatcaacgaccggctgaagaaggccaacctgcagatcgaccagatcaacaccgacctgaacctggagcgcagccacgcccagaagaacgagaatgctcggcagcagctggaacgccagaacaaggagcttaaggtcaagctgcaggagatggagggcactgtcaagtccaagtacaaggcctccatcaccgccctcgaggccaagattgcacagctggaggagcagctggacaacgagaccaaggagcgccaggcagcctgcaaacaggtgcgtcggaccgagaagaagctgaaggatgtgctgctgcaggtggatgacgagcggaggaacgccgagcagtacaaggaccaggccgacaaggcatctacccgcctgaagcagctcaagcggcagctggaggaggccgaagaggaggcccagcgggccaacgcctcccgccggaaactgcagcgcgagctggaggacgccactgagacggccgatgccatgaaccgcgaagtcagctccctaaagaacaagctcaggcgcggggacctgccgtttgtcgtgccccgccgaatggcccggaaaggcgccggggatggctccgacgaagaggtagatggcaaagcggatggggctgaggccaaacctgccgaataagcctcttctcctgcagcctgagatggatggacagacagacaccacagcctccccttcccagaccccgcagttttccgccgatgacaccgtgcgtctgtggtgtgtgtacctttgctccacggt

SEQ ID NO: 314137 - DNA, 4982 bp, Homo sapiens
cccgatattcggtcagtgggtgatagcaaaacctcgggtacgccaagaccgtgaagaatgacgaactcctcccgcttcggcaaattcattcgcatcaactttgatgtcaatggctacattgttggagccaacattgagacttatcttttggagaaatctcgtgctatccgccaagccaaggaagaacggaccttccacatcttctattatctcctgtctggggctggagagcacctgaagaccgatctcctgttggagccgtacaacaaataccgcttcctgtccaatggacacgtcaccatccccgggcagcaggacaaggacatgttccaggagaccatggaggccatgaggattatgggcatcccagaagaggagcaaatgggcctgctgcgggtcatctcaggggttcttcagctcggcaacatcgtcttcaagaaggagcggaacactgaccaggcgtccatgcccgacaacacagctgcccaaaaggtgtcccatctcttgggtatcaatgtgaccgatttcaccagaggaatcctcaccccgcgcatcaaggtgggacgggattacgtccagaaggcgcagactaaagagcaggctgactttgccatcgaggccttggccaaggcgacctatgagcggatgttccgctggctggtgctgcgcatcaacaaggctctggacaagaccaagaggcagggcgcctccttcatcgggatcctggacattgccggcttcgagatctttgatctgaactcgtttgagcagctgtgcatcaattacaccaatgagaagctgcagcagctcttcaaccacaccatgttcatcctggagcaggaggagtaccagcgcgagggcatcgagtggaacttcatcgactttggcctcgacctgcagccctgcatcgacctcattgagaagccagcaggccccccgggcattctggccctgctggacgaggagtgctggttccccaaagccaccgacaagagcttcgtggagaaggtgatgcaggagcagggcacccaccccaagttccagaagcccaagcagctgaaggacaaagctgatttctgcattatccactatgccggcaaggtggattacaaagctgacgagtggctgatgaagaacatggatcccctgaatgacaacatcgccacactgctccaccagtcctctgacaagtttgtctcggagctgtggaaggatgtggaccgcatcatcggcctggaccaggtggccggcatgtcggagaccgcactgcccggggccttcaagacgcggaagggcatgttccgcactgtggggcagctttacaaggagcagctggccaagctgatggctacgctgaggaacacgaaccccaactttgtccgctgcatcatccccaaccacgagaagaaggccggcaagctggacccgcatctcgtgctggaccagctgcgctgcaacggtgttctcgagggcatccgtatctgccgccagggcttccccaacagggtggtcttccaggagtttcggcagagatatgagatcctgactccaaactccattcccaagggtttcatggacgggaagcaggcgtgcgtgctcatgataaaagccctggagctcgacagcaatctgtaccgcattggccagagcaaagtcttcttccgtgccggtgtgctggcccacctggaggaggagcgagacctgaagatcaccgacgtcatcatagggttccaggcctgctgcaggggctacctggccaggaaagcatttgccaagcggcagcagcagcttaccgccatgaaggtcctccagcggaactgcgctgcctacctgaagctgcggaactggcagtggtggcggctcttcaccaaggtcaagccgctgctgcaggtgagccggcaggaggaggagatgatggccaaggaggaggagctggtgaaggtcagagagaagcagctggctgcggagaacaggctcacggagatggagacgctgcagtctcagctcatggcagagaaattgcagctgcaggagcagctccaggcagaaaccgagctgtgtgccgaggctgaggagctccgggcccgcctgaccgccaagaagcaggaattagaagagatctgccatgacctagaggccagggtggaggaggaggaggagcgctgccagcacctgcaggcggagaagaagaagatgcagcagaacatccaggagcttgaggagcagctggaggaggaggagagcgcccggcagaagctgcagctggagaaggtgaccaccgaggcgaagctgaaaaagctggaggaggagcagatcatcctggaggaccagaactgcaagctggccaaggaaaagaaactgctggaagacagaatagctgagttcaccaccaacctcacagaagaggaggagaaatctaagagcctcgccaagctcaagaacaagcatgaggcaatgatcactgacttggaagagcgcctccgcagggaggagaagcagcgacaggagctggagaagacccgccggaagctggagggagactccacagacctcagcgaccagatcgccgagctccaggcccagatcgcggagctcaagatgcagctggccaagaaagaggaggagctccaggccgccctggccagagtggaagaggaagctgcccagaagaacatggccctcaagaagatccgggagctggaatctcagatctctgaactccaggaagacctggagtctgagcgtgcttccaggaataaagctgagaagcagaaacgggaccttggggaagagctagaggcgctgaaaacagagttggaggacacgctggattccacagctgcccagcaggagctcaggtcaaaacgtgagcaggaggtgaacatcctgaagaagaccctggaggaggaggccaagacccacgaggcccagatccaggagatgaggcagaagcactcacaggccgtggaggagctggcggagcagctggagcagacgaagcgggtgaaagcaaacctcgagaaggcaaagcagactctggagaacgagcggggggagctggccaacgaggtgaaggtgctgctgcagggcaaaggggactcggagcacaagcgcaagaaagtggaggcgcagctgcaggagctgcaggtcaagttcaacgagggagagcgcgtgcgcacagagctggccgacaaggtcaccaagctgcaggtggagctggacaacgtgaccgggcttctcagccagtccgacagcaagtccagcaagctcaccaaggacttctccgcgctggagtcccagctgcaggacactcaggagctgctgcaggaggagaaccggcagaagctgagcctgagcaccaagctcaagcaggtggaggacgagaagaattccttccgggagcagctggaggaggaggaggaggccaagcacaacctggagaagcagatcgccaccctccatgcccaggtggccgacatgaaaaagaagatggaggacagtgtggggtgcctggaaactgctgaggaggtgaagaggaagctccagaaggacctggagggcctgagccagcggcacgaggagaaggtggccgcctacgacaagctggagaagaccaagacgcggctgcagcaggagctggacgacctgctggtggacctggaccaccagcgccagagcgcgtgcaacctggagaagaagcagaagaagtttgaccagctcctggcggaggagaagaccatctctgccaagtatgcagaggagcgcgaccgggctgaggcggaggcccgagagaaggagaccaaggctctgtcgctggcccgggccctggaggaagccatggagcagaaggcggagctggagcggctcaacaagcagttccgcacggagatggaggaccttatgagctccaaggatgatgtgggcaagagtgtccacgagctggagaagtccaagcgggccctagagcagcaggtggaggagatgaagacgcagctggaagagctggaggacgagctgcaggccaccgaagatgccaagctgcggttggaggtcaacctgcaggccatgaaggcccagttcgagcgggacctgcagggccgggacgagcagagcgaggagaagaagaagcagctggtcagacaggtgcgggagatggaggcagagctggaggacgagaggaagcagcgctcgatggcagtggccgcccggaagaagctggagatggacctgaaggacctggaggcgcacatcgactcggccaacaagaaccgggacgaagccatcaaacagctgcggaagctgcaggcccagatgaaggactgcatgcgcgagctggatgacacccgcgcctctcgtgaggagatcctggcccaggccaaagagaacgagaagaagctgaagagcatggaggccgagatgatccagttgcaggaggaactggcagccgcggagcgtgccaagcgccaggcccagcaggagcgggatgagctggctgacgagatcgccaacagcagcggcaaaggagccctggcgttagaggagaagcggcgtctggaggcccgcatcgcccagctggaggaggagctggaggaggagcagggcaacacggagctgatcaacgaccggctgaagaaggccaacctgcagatcgaccagatcaacaccgacctgaacctggagcgcagccacgcccagaagaacgagaatgctcggcagcagctggaacgccagaacaaggagcttaaggtcaagctgcaggagatggagggcactgtcaagtccaagtacaaggcctccatcaccgccctcgaggccaagattgcacagctggaggagcagctggacaacgagaccaaggagcgccaggcagcctgcaaacaggtgcgtcggaccgagaagaagctgaaggatgtgctgctgcaggtggatgacgagcggaggaacgccgagcagtacaaggaccaggtgtgggcgctggtggg

SEQ ID NO: 314138 - DNA, 3643 bp, Homo sapiens
cccgatattcggtcagtgggtgatagcaaaacctcgggtacgccaagaccgtgaagaatgacgaactcctcccgcttcggcaaattcattcgcatcaactttgatgtcaatggctacattgttggagccaacattgagacttatcttttggagaaatctcgtgctatccgccaagccaaggaagaacggaccttccacatcttctattatctcctgtctggggctggagagcacctgaagaccgatctcctgttggagccgtacaacaaataccgcttcctgtccaatggacacgtcaccatccccgggcagcaggacaaggacatgttccaggagaccatggaggccatgaggattatgggcatcccagaagaggagcaaatgggcctgctgcgggtcatctcaggggttcttcagctcggcaacatcgtcttcaagaaggagcggaacactgaccaggcgtccatgcccgacaacacagctgcccaaaaggtgtcccatctcttgggtatcaatgtgaccgatttcaccagaggaatcctcaccccgcgcatcaaggtgggacgggattacgtccagaaggcgcagactaaagagcaggctgactttgccatcgaggccttggccaaggcgacctatgagcggatgttccgctggctggtgctgcgcatcaacaaggctctggacaagaccaagaggcagggcgcctccttcatcgggatcctggacattgccggcttcgagatctttgatctgaactcgtttgagcagctgtgcatcaattacaccaatgagaagctgcagcagctcttcaaccacaccatgttcatcctggagcaggaggagtaccagcgcgagggcatcgagtggaacttcatcgactttggcctcgacctgcagccctgcatcgacctcattgagaagccagcaggccccccgggcattctggccctgctggacgaggagtgctggttccccaaagccaccgacaagagcttcgtggagaaggtgatgcaggagcagggcacccaccccaagttccagaagcccaagcagctgaaggacaaagctgatttctgcattatccactatgccggcaaggtggattacaaagctgacgagtggctgatgaagaacatggatcccctgaatgacaacatcgccacactgctccaccagtcctctgacaagtttgtctcggagctgtggaaggatgtggaccgcatcatcggcctggaccaggtggccggcatgtcggagaccgcactgcccggggccttcaagacgcggaagggcatgttccgcactgtggggcagctttacaaggagcagctggccaagctgatggctacgctgaggaacacgaaccccaactttgtccgctgcatcatccccaaccacgagaagaaggccggcaagctggacccgcatctcgtgctggaccagctgcgctgcaacggtgttctcgagggcatccgtatctgccgccagggcttccccaacagggtggtcttccaggagtttcggcagagatatgagatcctgactccaaactccattcccaagggtttcatggacgggaagcaggcgtgcgtgctcatgataaaagccctggagctcgacagcaatctgtaccgcattggccagagcaaagtcttcttccgtgccggtgtgctggcccacctggaggaggagcgagacctgaagatcaccgacgtcatcatagggttccaggcctgctgcaggggctacctggccaggaaagcatttgccaagcggcagcagcagcttaccgccatgaaggtcctccagcggaactgcgctgcctacctgaagctgcggaactggcagtggtggcggctcttcaccaaggtcaagccgctgctgcaggtgagccggcaggaggaggagatgatggccaaggaggaggagctggtgaaggtcagagagaagcagctggctgcggagaacaggctcacggagatggagacgctgcagtctcagctcatggcagagaaattgcagctgcaggagcagctccaggcagaaaccgagctgtgtgccgaggctgaggagctccgggcccgcctgaccgccaagaagcaggaattagaagagatctgccatgacctagaggccagggtggaggaggaggaggagcgctgccagcacctgcaggcggagaagaagaagatgcagcagaacatccaggagcttgaggagcagctggaggaggaggagagcgcccggcagaagctgcagctggagaaggtgaccaccgaggcgaagctgaaaaagctggaggaggagcagatcatcctggaggaccagaactgcaagctggccaaggaaaagaaactgctggaagacagaatagctgagttcaccaccaacctcacagaagaggaggagaaatctaagagcctcgccaagctcaagaacaagcatgaggcaatgatcactgacttggaagagcgcctccgcagggaggagaagcagcgacaggagctggagaagacccgccggaagctggagggagactccacagacctcagcgaccagatcgccgagctccaggcccagatcgcggagctcaagatgcagctggccaagaaagaggaggagctccaggccgccctggccagagtggaagaggaagctgcccagaagaacatggccctcaagaagatccgggagctggaatctcagatctctgaactccaggaagacctggagtctgagcgtgcttccaggaataaagctgagaagcagaaacgggaccttggggaagagctagaggcgctgaaaacagagttggaggacacgctggattccacagctgcccagcaggagctcaggtcaaaacgtgagcaggaggtgaacatcctgaagaagaccctggaggaggaggccaagacccacgaggcccagatccaggagatgaggcagaagcactcacagcctgcctctgccacagcaaggctgtcggggtcaagctggaaaggccagcagccttccagtggcttctcccaacactcttggggaccaaatatatttaatggttaagggacttgtcccaagtctgacagccagagcgttagaggggccagcggccctcccaggcgatcttgtgtctactctaggactgggcccgagggtggtttacctgcaccgttgactcagtatagtttaaaaatctgccacctgcacaggtatttttgaaagcaaaataaggttttcttttttcccctttcttgtaataaatgataaaattccgagtctttctcactgcctttgtttagaagagagtagctcgtcctcactggtctacactggttgccgaatttacttgtattcctaactgttttgtatatgctgcattgagacttacggcaagaaggcattttttttttttaaaggaaacaaactctcaaatcatgaagtgatataaaagctgcatatgcctacaaagctctgaattcaggtcccagttgctgtcacaaaggagtgagtgaaactcccaccctacccccttttttatataataaaagtgccttagcatgtgttgcagctgtcaccactacagtaagctggtttacagatgttttccactgagcatcacaataaagagaaccatgtgcta

SEQ ID NO: 314139 - DNA, 4248 bp, Homo sapiens
cccgatattcggtcagtgggtgatagcaaaacctcgggtacgccaagaccgtgaagaatgacgaactcctcccgcttcggcaaattcattcgcatcaactttgatgtcaatggctacattgttggagccaacattgagacttatcttttggagaaatctcgtgctatccgccaagccaaggaagaacggaccttccacatcttctattatctcctgtctggggctggagagcacctgaagaccgatctcctgttggagccgtacaacaaataccgcttcctgtccaatggacacgtcaccatccccgggcagcaggacaaggacatgttccaggagaccatggaggccatgaggattatgggcatcccagaagaggagcaaatgggcctgctgcgggtcatctcaggggttcttcagctcggcaacatcgtcttcaagaaggagcggaacactgaccaggcgtccatgcccgacaacacagctgcccaaaaggtgtcccatctcttgggtatcaatgtgaccgatttcaccagaggaatcctcaccccgcgcatcaaggtgggacgggattacgtccagaaggcgcagactaaagagcaggctgactttgccatcgaggccttggccaaggcgacctatgagcggatgttccgctggctggtgctgcgcatcaacaaggctctggacaagaccaagaggcagggcgcctccttcatcgggatcctggacattgccggcttcgagatctttgatctgaactcgtttgagcagctgtgcatcaattacaccaatgagaagctgcagcagctcttcaaccacaccatgttcatcctggagcaggaggagtaccagcgcgagggcatcgagtggaacttcatcgactttggcctcgacctgcagccctgcatcgacctcattgagaagccagcaggccccccgggcattctggccctgctggacgaggagtgctggttccccaaagccaccgacaagagcttcgtggagaaggtgatgcaggagcagggcacccaccccaagttccagaagcccaagcagctgaaggacaaagctgatttctgcattatccactatgccggcaaggtggattacaaagctgacgagtggctgatgaagaacatggatcccctgaatgacaacatcgccacactgctccaccagtcctctgacaagtttgtctcggagctgtggaaggatgtggaccgcatcatcggcctggaccaggtggccggcatgtcggagaccgcactgcccggggccttcaagacgcggaagggcatgttccgcactgtggggcagctttacaaggagcagctggccaagctgatggctacgctgaggaacacgaaccccaactttgtccgctgcatcatccccaaccacgagaagaaggccggcaagctggacccgcatctcgtgctggaccagctgcgctgcaacggtgttctcgagggcatccgtatctgccgccagggcttccccaacagggtggtcttccaggagtttcggcagagatatgagatcctgactccaaactccattcccaagggtttcatggacgggaagcaggcgtgcgtgctcatgataaaagccctggagctcgacagcaatctgtaccgcattggccagagcaaagtcttcttccgtgccggtgtgctggcccacctggaggaggagcgagacctgaagatcaccgacgtcatcatagggttccaggcctgctgcaggggctacctggccaggaaagcatttgccaagcggcagcagcagcttaccgccatgaaggtcctccagcggaactgcgctgcctacctgaagctgcggaactggcagtggtggcggctcttcaccaaggtcaagccgctgctgcaggtgagccggcaggaggaggagatgatggccaaggaggaggagctggtgaaggtcagagagaagcagctggctgcggagaacaggctcacggagatggagacgctgcagtctcagctcatggcagagaaattgcagctgcaggagcagctccaggcagaaaccgagctgtgtgccgaggctgaggagctccgggcccgcctgaccgccaagaagcaggaattagaagagatctgccatgacctagaggccagggtggaggaggaggaggagcgctgccagcacctgcaggcggagaagaagaagatgcagcagaacatccaggagcttgaggagcagctggaggaggaggagagcgcccggcagaagctgcagctggagaaggtgaccaccgaggcgaagctgaaaaagctggaggaggagcagatcatcctggaggaccagaactgcaagctggccaaggaaaagaaactgctggaagacagaatagctgagttcaccaccaacctcacagaagaggaggagaaatctaagagcctcgccaagctcaagaacaagcatgaggcaatgatcactgacttggaagagcgcctccgcagggaggagaagcagcgacaggagctggagaagacccgccggaagctggagggagactccacagacctcagcgaccagatcgccgagctccaggcccagatcgcggagctcaagatgcagctggccaagaaagaggaggagctccaggccgccctggccagagtggaagaggaagctgcccagaagaacatggccctcaagaagatccgggagctggaatctcagatctctgaactccaggaagacctggagtctgagcgtgcttccaggaataaagctgagaagcagaaacgggaccttggggaagagctagaggcgctgaaaacagagttggaggacacgctggattccacagctgcccagcaggagctcaggtcaaaacgtgagcaggaggtgaacatcctgaagaagaccctggaggaggaggccaagacccacgaggcccagatccaggagatgaggcagaagcactcacaggccgtggaggagctggcggagcagctggagcagacgaagcgggtgaaagcaaacctcgagaaggcaaagcagactctggagaacgagcggggggagctggccaacgaggtgaaggtgctgctgcagggcaaaggggactcggagcacaagcgcaagaaagtggaggcgcagctgcaggagctgcaggtcaagttcaacgagggagagcgcgtgcgcacagagctggccgacaaggtcaccaagctgcaggtggagctggacaacgtgaccgggcttctcagccagtccgacagcaagtccagcaagctcaccaaggacttctccgcgctggagtcccagctgcaggacactcaggagctgctgcaggaggagaaccggcagaagctgagcctgagcaccaagctcaagcaggtggaggacgagaagaattccttccgggagcagctggaggaggaggaggaggccaagcacaacctggagaagcagatcgccaccctccatgcccaggtggccgacatgaaaaagaagatggaggacagtgtggggtgcctggaaactgctgaggaggtgaagaggaagctccagaaggacctggagggcctgagccagcggcacgaggagaaggtggccgcctacgacaagctggagaagaccaagacgcggctgcagcaggagctggacgacctgctggtggacctggaccaccagcgccagagcgcgtgcaacctggagaagaagcagaagaagtttgaccagctcctggcggaggagaagaccatctctgccaagtatgcagaggagcgcgaccgggctgaggcggaggcccgagagaaggagaccaaggctctgtcgctggcccgggccctggaggaagccatggagcagaaggcggagctggagcggctcaacaagcagttccgcacggagatggaggaccttatgagctccaaggatgatgtgggcaagagtgtccacgagctggagaagtccaagcgggccctagagcagcaggtggaggagatgaagacgcagctggaagagctggaggacgagctgcaggccaccgaagatgccaagctgcggttggaggtcaacctgcaggccatgaaggcccagttcgagcgggacctgcagggccgggatgaaagcaaacctcgagaaggcaaagcagactctggagaacgagcggggggagctggccaacgaggtgaaggtgctgctgcagggcaaaggggactcggagcacagcacaataaagtggaggccgggatcctctagatcacctgc

SEQ ID NO: 314140 - DNA, 1232 bp, Homo sapiens
cccgatattcggtcagtgggtgatagcaaaacctcgggtacgccaagaccgtgaagaatgacgaactcctcccgcttcggcaaattcattcgcatcaactttgatgtcaatggctacattgttggagccaacattgagacttatcttttggagaaatctcgtgctatccgccaagccaaggaagaacggaccttccacatcttctattatctcctgtctggggctggagagcacctgaagaccgatctcctgttggagccgtacaacaaataccgcttcctgtccaatggacacgtcaccatccccgggcagcaggacaaggacatgttccaggagaccatggaggccatgaggattatgggcatcccagaagaggagcaaatgggcctgctgcgggtcatctcaggggttcttcagctcggcaacatcgtcttcaagaaggatggattcctccccaccctgtcccaggcagcgccactgtccgctgtctccctcctgattctaaaatgtctcaagtgcaatgccccctcccctcctttaccgaggacagcctgcctctgccacagcaaggctgtcggggtcaagctggaaaggccagcagccttccagtggcttctcccaacactcttggggaccaaatatatttaatggttaagggacttgtcccaagtctgacagccagagcgttagaggggccagcggccctcccaggcgatcttgtgtctactctaggactgggcccgagggtggtttacctgcaccgttgactcagtatagtttaaaaatctgccacctgcacaggtatttttgaaagcaaaataaggttttcttttttcccctttcttgtaataaatgataaaattccgagtctttctcactgcctttgtttagaagagagtagctcgtcctcactggtctacactggttgccgaatttacttgtattcctaactgttttgtatatgctgcattgagacttacggcaagaaggcattttttttttttaaaggaaacaaactctcaaatcatgaagtgatataaaagctgcatatgcctacaaagctctgaattcaggtcccagttgctgtcacaaaggagtgagtgaaactcccaccctacccccttttttatataataaaagtgccttagcatgtgttgcagctgtcaccactacagtaagctggtttacagatgttttccactgagcatcacaataaagagaaccatgtgcta

SEQ ID NO: 314141 - DNA, 3640 bp, Homo sapiens
cccgatattcggtcagtgggtgatagcaaaacctcgggtacgccaagaccgtgaagaatgacgaactcctcccgcttcggcaaattcattcgcatcaactttgatgtcaatggctacattgttggagccaacattgagacttatcttttggagaaatctcgtgctatccgccaagccaaggaagaacggaccttccacatcttctattatctcctgtctggggctggagagcacctgaagaccgatctcctgttggagccgtacaacaaataccgcttcctgtccaatggacacgtcaccatccccgggcagcaggacaaggacatgttccaggagaccatggaggccatgaggattatgggcatcccagaagaggagcaaatgggcctgctgcgggtcatctcaggggttcttcagctcggcaacatcgtcttcaagaaggagcggaacactgaccaggcgtccatgcccgacaacacagctgcccaaaaggtgtcccatctcttgggtatcaatgtgaccgatttcaccagaggaatcctcaccccgcgcatcaaggtgggacgggattacgtccagaaggcgcagactaaagagcaggctgactttgccatcgaggccttggccaaggcgacctatgagcggatgttccgctggctggtgctgcgcatcaacaaggctctggacaagaccaagaggcagggcgcctccttcatcgggatcctggacattgccggcttcgagatctttgatctgaactcgtttgagcagctgtgcatcaattacaccaatgagaagctgcagcagctcttcaaccacaccatgttcatcctggagcaggaggagtaccagcgcgagggcatcgagtggaacttcatcgactttggcctcgacctgcagccctgcatcgacctcattgagaagccagcaggccccccgggcattctggccctgctggacgaggagtgctggttccccaaagccaccgacaagagcttcgtggagaaggtgatgcaggagcagggcacccaccccaagttccagaagcccaagcagctgaaggacaaagctgatttctgcattatccactatgccggcaaggtggattacaaagctgacgagtggctgatgaagaacatggatcccctgaatgacaacatcgccacactgctccaccagtcctctgacaagtttgtctcggagctgtggaaggatgtggaccgcatcatcggcctggaccaggtggccggcatgtcggagaccgcactgcccggggccttcaagacgcggaagggcatgttccgcactgtggggcagctttacaaggagcagctggccaagctgatggctacgctgaggaacacgaaccccaactttgtccgctgcatcatccccaaccacgagaagaaggccggcaagctggacccgcatctcgtgctggaccagctgcgctgcaacggtgttctcgagggcatccgtatctgccgccagggcttccccaacagggtggtcttccaggagtttcggcagagatatgagatcctgactccaaactccattcccaagggtttcatggacgggaagcaggcgtgcgtgctcatgataaaagccctggagctcgacagcaatctgtaccgcattggccagagcaaagtcttcttccgtgccggtgtgctggcccacctggaggaggagcgagacctgaagatcaccgacgtcatcatagggttccaggcctgctgcaggggctacctggccaggaaagcatttgccaagcggcagcagcagcttaccgccatgaaggtcctccagcggaactgcgctgcctacctgaagctgcggaactggcagtggtggcggctcttcaccaaggtcaagccgctgctgcaggtgagccggcaggaggaggagatgatggccaaggaggaggagctggtgaaggtcagagagaagcagctggctgcggagaacaggctcacggagatggagacgctgcagtctcagctcatggcagagaaattgcagctgcaggagcagctccaggcagaaaccgagctgtgtgccgaggctgaggagctccgggcccgcctgaccgccaagaagcaggaattagaagagatctgccatgacctagaggccagggtggaggaggaggaggagcgctgccagcacctgcaggcggagaagaagaagatgcagcagaacatccaggagcttgaggagcagctggaggaggaggagagcgcccggcagaagctgcagctggagaaggtgaccaccgaggcgaagctgaaaaagctggaggaggagcagatcatcctggaggaccagaactgcaagctggccaaggaaaagaaactgctggaagacagaatagctgagttcaccaccaacctcacagaagaggaggagaaatctaagagcctcgccaagctcaagaacaagcatgaggcaatgatcactgacttggaagagcgcctccgcagggaggagaagcagcgacaggagctggagaagacccgccggaagctggagggagactccacagacctcagcgaccagatcgccgagctccaggcccagatcgcggagctcaagatgcagctggccaagaaagaggaggagctccaggccgccctggccagagtggaagaggaagctgcccagaagaacatggccctcaagaagatccgggagctggaatctcagatctctgaactccaggaagacctggagtctgagcgtgcttccaggaataaagctgagaagcagaaacgggaccttggggaagagctagaggcgctgaaaacagagttggaggacacgctggattccacagctgcccagcaggagctcaggtcaaaacgtgagcaggaggtgaacatcctgaagaagaccctggaggaggaggccaagacccacgaggcccagatccaggagatgaggcagaagcactcacaggccgtggaggagctggcggagcagctggagcagacgaagcgggtgaaagcaaacctcgagaaggcaaagcagactctggagaacgagcggggggagctggccaacgaggtgaaggtgctgctgcagggcaaaggggactcggagcacaagcgcaagaaagtggaggcgcagctgcaggagctgcaggtcaagttcaacgagggagagcgcgtgcgcacagagctggccgacaaggtcaccaagctgcaggtggagctggacaacgtgaccgggcttctcagccagtccgacagcaagtccagcaagctcaccaaggacttctccgcgctggagtcccagctgcaggacactcaggagctgctgcaggaggagaaccggcagaagctgagcctgagcaccaagctcaagcaggtggaggacgagaagaattccttccgggagcagctggaggaggaggaggaggccaagcacaacctggagaagcagatcgccaccctccatgcccaggtttggaggcctgggggaccggccggactctgcaggctggggagctgctggccgggcactggcctgggcactgcaggacagccctgcccgctgggccggcccattgctgctctccccctgggaagccaaccgtgctctcccacatcagtgctctcaaggaaaggaatccagg

SEQ ID NO: 314142 - DNA, 2361 bp, Homo sapiens
cccgatattcggtcagtgggtgatagcaaaacctcgggtacgccaagaccgtgaagaatgacgaactcctcccgcttcggcaaattcattcgcatcaactttgatgtcaatggctacattgttggagccaacattgagacttatcttttggagaaatctcgtgctatccgccaagccaaggaagaacggaccttccacatcttctattatctcctgtctggggctggagagcacctgaagaccgatctcctgttggagccgtacaacaaataccgcttcctgtccaatggacacgtcaccatccccgggcagcaggacaaggacatgttccaggagaccatggaggccatgaggattatgggcatcccagaagaggagcaaatgggcctgctgcgggtcatctcaggggttcttcagctcggcaacatcgtcttcaagaaggagcggaacactgaccaggcgtccatgcccgacaacacagctgcccaaaaggtgtcccatctcttgggtatcaatgtgaccgatttcaccagaggaatcctcaccccgcgcatcaaggtgggacgggattacgtccagaaggcgcagactaaagagcaggctgactttgccatcgaggccttggccaaggcgacctatgagcggatgttccgctggctggtgctgcgcatcaacaaggctctggacaagaccaagaggcagggcgcctccttcatcgggatcctggacattgccggcttcgagatctttgatctgaactcgtttgagcagctgtgcatcaattacaccaatgagaagctgcagcagctcttcaaccacaccatgttcatcctggagcaggaggagtaccagcgcgagggcatcgagtggaacttcatcgactttggcctcgacctgcagccctgcatcgacctcattgagaagccagcaggccccccgggcattctggccctgctggacgaggagtgctggttccccaaagccaccgacaagagcttcgtggagaaggtgatgcaggagcagggcacccaccccaagttccagaagcccaagcagctgaaggacaaagctgatttctgcattatccactatgccggcaaggtggattacaaagctgacgagtggctgatgaagaacatggatcccctgaatgacaacatcgccacactgctccaccagtcctctgacaagtttgtctcggagctgtggaaggatgtggaccgcatcatcggcctggaccaggtggccggcatgtcggagaccgcactgcccggggccttcaagacgcggaagggcatgttccgcactgtggggcagctttacaaggagcagctggccaagctgatggctacgctgaggaacacgaaccccaactttgtccgctgcatcatccccaaccacgagaagaaggccggcaagctggacccgcatctcgtgctggaccagctgcgctgcaacggtgttctcgagggcatccgtatctgccgccagggcttccccaacagggtggtcttccaggagtttcggcagagatatgagatcctgactccaaactccattcccaagggtttcatggacgggaagcaggcgtgcgtgctcatgataaaagccctggagctcgacagcaatctgtaccgcattggccagagcaaagtcttcttccgtgccggtgtgctggcccacctggaggaggagcgagacctgaagatcaccgacgtcatcatagggttccaggcctgctgcaggggctacctggccaggaaagcatttgccaagcggcagcagcagcttaccgccatgaaggtcctccagcggaactgcgctgcctacctgaagctgcggaactggcagtggtggcggctcttcaccaaggtcaagccgctgctgcaggtgagccggcaggaggaggagatgatggccaaggaggaggagctggtgaaggtcagagagaagcagctggctgcggagaacaggctcacggagatggagacgctgcagtctcagctcatggcagagaaattgcagctgcaggagcagctccaggcagaaaccgagctgtgtgccgaggctgaggagctccgggcccgcctgaccgccaagaagcaggaattagaagagatctgccatgacctagaggccagggtggaggaggaggaggagcgctgccagcacctgcaggcaaacttctgcaagcacaaaggaaaacgaattaggcctagcaagagcatgaacgcatttatcaccccttccgctaacaatacatacaacacagctggcacccccttgtggacaaatccattatgactttcccaaaatctcactgaaagcctactttcttaaacgccttcacttagtttcttt

SEQ ID NO: 314143 - DNA, 1838 bp, Homo sapiens
cccgatattcggtcagtgggtgatagcaaaacctcgggtacgccaagaccgtgaagaatgacgaactcctcccgcttcggcaaattcattcgcatcaactttgatgtcaatggctacattgttggagccaacattgagacttatcttttggagaaatctcgtgctatccgccaagccaaggaagaacggaccttccacatcttctattatctcctgtctggggctggagagcacctgaagaccgatctcctgttggagccgtacaacaaataccgcttcctgtccaatggacacgtcaccatccccgggcagcaggacaaggacatgttccaggagaccatggaggccatgaggattatgggcatcccagaagaggagcaaatgggcctgctgcgggtcatctcaggggttcttcagctcggcaacatcgtcttcaagaaggagcggaacactgaccaggcgtccatgcccgacaacacagctgcccaaaaggtgtcccatctcttgggtatcaatgtgaccgatttcaccagaggaatcctcaccccgcgcatcaaggtgggacgggattacgtccagaaggcgcagactaaagagcaggctgactttgccatcgaggccttggccaaggcgacctatgagcggatgttccgctggctggtgctgcgcatcaacaaggctctggacaagaccaagaggcagggcgcctccttcatcgggatcctggacattgccggcttcgagatctttgatctgaactcgtttgagcagctgtgcatcaattacaccaatgagaagctgcagcagctcttcaaccacaccatgttcatcctggagcaggaggagtaccagcgcgagggcatcgagtggaacttcatcgactttggcctcgacctgcagccctgcatcgacctcattgagaagccagcaggccccccgggcattctggccctgctggacgaggagtgctggttccccaaagccaccgacaagagcttcgtggagaaggtgatgcaggagcagggcacccaccccaagttccagaagcccaagcagctgaaggacaaagctgatttctgcattatccactatgccggcaaggtggattacaaagctgacgagtggctgatgaagaacatggatcccctgaatgacaacatcgccacactgctccaccagtcctctgacaagtttgtctcggagctgtggaaggatgtggaccgcatcatcggcctggaccaggtggccggcatgtcggagaccgcactgcccggggccttcaagacgcggaagggcatgttccgcactgtggggcagctttacaaggagcagctggccaagctgatggctacgctgaggaacacgaaccccaactttgtccgctgcatcatccccaaccacgagaagaaggccggcaagctggacccgcatctcgtgctggaccagctgcgctgcaacggtgttctcgagggcatccgtatctgccgccagggcttccccaacagggtggtcttccaggagtttcggcagagatatgagatcctgactccaaactccattcccaagggtttcatggacgggaagcaggcgtgcgtgctcatgataaaagccctggagctcgacagcaatctgtaccgcattggccagagcaaagtcttcttccgtgccggtgtgctggcccacctgcagcagcggcttgaccttggtgaagagccgccaccactgccagttccgcagcttcaggtaggcagcgcagttccgctggaggaccttcatggcggtaagctgctgctgccgctgggcaaatgctttcctggccaggtagccccggcagcagg

SEQ ID NO: 314144 - DNA, 1182 bp, Homo sapiens
  misc_feature (1119)..(1119): n is a, c, g, or t
cccgatattcggtcagtgggtgatagcaaaacctcgggtacgccaagaccgtgaagaatgacgaactcctcccgcttcggcaaattcattcgcatcaactttgatgtcaatggctacattgttggagccaacattgagacttatcttttggagaaatctcgtgctatccgccaagccaaggaagaacggaccttccacatcttctattatctcctgtctggggctggagagcacctgaagaccgatctcctgttggagccgtacaacaaataccgcttcctgtccaatggacacgtcaccatccccgggcagcaggacaaggacatgttccaggagaccatggaggccatgaggattatgggcatcccagaagaggagcaaatgggcctgctgcgggtcatctcaggggttcttcagctcggcaacatcgtcttcaagaaggagcggaacactgaccaggcgtccatgcccgacaacacagctgcccaaaaggtgtcccatctcttgggtatcaatgtgaccgatttcaccagaggaatcctcaccccgcgcatcaaggtgggacgggattacgtccagaaggcgcagactaaagagcaggctgactttgccatcgaggccttggccaaggcgacctatgagcggatgttccgctggctggtgctgcgcatcaacaaggctctggacaagaccaagaggcagggcgcctccttcatcgggatcctggacattgccggcttcgagatctttgatctgaactcgtttgagcagctgtgcatcaattacaccaatgagaagctgcagcagctcttcaaccacaccatgttcatcctggagcaggaggagtaccagcgcgagggcatcgagtggaacttcatcgactttggcctcgacctgcagccctgcatcgacctcattgagaagccagcaggccccccggcattcctcattacagaaatcttctattgaatgggaaaggtttaaatgctaaccaaagcaatttatttttaattaatatttttagactctgtgctgtcatactggactcactgctagctaagagacctatcagagatttagatattttctccaggtttcttgtgggttttctttgttgtngttgttgttctagccatgtgacagaggctctttctaaaagtatgtagttcgctgtgtattccg

SEQ ID NO: 314145 - DNA, 679 bp, Homo sapiens
cccgatattcggtcagtgggtgatagcaaaacctcgggtacgccaagaccgtgaagaatgacgaactcctcccgcttcggcaaattcattcgcatcaactttgatgtcaatggctacattgttggagccaacattgagacttatcttttggagaaatctcgtgctatccgccaagccaaggaagaacggaccttccacatcttctattatctcctgtctggggctggagagcacctgaagaccgatctcctgttggagccgtacaacaaataccgcttcctgtccaatggacacgtcaccatccccgggcagcaggacaaggacatgttccaggagaccatggaggccatgaggattatgggcatcccagaagaggagcaaatgggcctgctgcgggtcatctcaggggttcttcagctcggcaacatcgtcttcaagaaggagcggaacactgaccaggcgtccatgcccgacaacacaggtaacacccggggcctctcgctggaaataatggggcaggtgcttggccatggatttgctcaggagggaaggtcttgcggaaattccggacactattctttttaatgttagtatctgtcggtattttctatacagatgtaaaacacacgtaaacatgaccctgcttttttttctcaccaagtaagcatttcagaataac

SEQ ID NO: 314146 - DNA, 411 bp, Homo sapiens
cgccaggaccctggtgcgggcagtgggccctagcagcagttgtggcccaggtccccaggtgcatgtgtgctctctgtctctctctcttctcaaactggctcgtcagaccctcatggttcagcttgtgactcaggtccagctttacctaaaggagatgaggtggggcaggagcagtgggggtgggtccatggtcctttgtgtctccccgcccggtgcaggtggagctggacaacgtgaccgggcttctcagccagtccgacagcaagtccagcaagctcaccaaggacttctccgcgctggagtcccagctgcaggacactcaggtaggggtggcgccaggttcccagaaggtggacccctccagaaaggcctctgtgtccacgcaacattagcttcagagcccatcggatt

SEQ ID NO: 314147 - DNA, 778 bp, Homo sapiens
agctcctggactttttaaaattcctggaattgtgtctctctatcatggggctggtactattaccatacgtttcagaaaacagcatctgtttacaaagcgttttattatacaacacagaaatacatttcaccccaaatgataacagtgaacttcagcccccagaatctccttctccccttcgtgaaacagagctgggatgatggcagaggactccagaacgcactgagattgttccttggcgtgacaaatggcaaaggactctagaacgcacagagattgttccttggtgtgacgggccagacagcacacctttcttcaagccattctcacatcaaataaaacgttgataaatcattgtttctctaagcttgaaaaatgctactaactcaagacaaggtgaaagtgagtttgttgaaatcaacgtgaaggatcgagggtaccaacttggaatgtaaaaccatagaaaataccatctgggaacacggaaatcatctgtcttatctggaagcctgtctccagagtggcaaacttagggactggtttgaggacagagtgtgccctgtgtgctggggaggggtgtaaaggactgggatggaggagggggggctccagatgttcttttacccataaatacactgtacatcaccgtctgccactgaagcttaaggattgaaaaccttggggatgtttcactggttttgcttccgcctctgcaatgtttgaacttgcattttctgagccacgtatgcaactaaaagccttacatgcattacccacc

SEQ ID NO: 314148 - DNA, 3267 bp, Homo sapiens
ttagtagagtactgaaacattccaaaatgtattctttaagatagaattgtatttggaatacaccagttgtatacttgtattagtttgttttcatgctgttgataaagacatacctgagactgggtaatttataaaggaaagaggcttcattgactcatagttccacatggctgaagaggcctcacagtcatggtggaagatgaaggaagagcaacgggacatcttacatggtggccagcaaagagagagcttgtgtagggaaacttccctttataaaaccatcagatctcgtgagacttattcactatcacaagaatagcacaagaaagacccaccctcatgattcagttacctcccaccaggtccctcccatgacatgtgggaatcatgggagctttgattcaagatttgggaggggacatagccaaaccgtatgaatactttcatctggttcatggaaactgtaattatagctgcatgctctggagacaaaatgcctgggttcaaattttcatgtgtctagttcttagctgtgtgaccttacccatcagatttcccctaatctctaatcagcacctgtaaactagaaataataccagtaataacctcatagggattttagaaataccaaatgggagaatccataaaaagtgtttagctcaatacctggcccagaataagcattcataatgtattctagtaattgtagaatagcagcaggaggagtaaaagaataaagcaagatgtcaggcagaaataaactactctcgaatcctttctttaaaataagagtgttcatgttgtggagatcgggtttttcactgtggttctcaaaccctgtgtgccagggtccctgtagggcttggagcccactctcacagtgtctcattcagtaggtctaggctggggccagaggatttgcatttcttacaggttcccaggtgatgctcatgctgcacatctcaccacactctgaaaaccactggcctcaagtatttatttaaattgtgcaccaaaaatatcactgattgatatgaaaataacagtaataattgcttgacatttataaagtctccatctttcaagaagccagagacctctaataaatgtaaccttaaaatacatgatttgtcttcaattgggatggggaaatgggggaggcataggtctctgcccagcacccatttaagggactgatctgaagtcaagcatcaagttccaatgaaactctagggttaggatcaggtatcctggagccacacctaacactttctcccccagaaagtggtctctcccccatttctataaagtcatccattcatagactggtcatacaggtcactgaagatctgctgatcgaccctaatgatgttccacacgttttccttacacacacacacccaggcattcagtttttaaatgccctgaaaacagtcataaaatacatttgaaagtgacaaattcccttttcttagctgcctctcagcagcagaaagatatctcaaactgatgtttcagtaaaatatgtgcgcattaaaaactgatttttttattgaaaatgacgacaacagcagagtttaaggatacaaatccttgccatgagccaccacagaaaggcatatactcaacctttatttatacgtacaaaaaacttctgccacagacttctatacataacctttatgatgtgtaatgtatatgaaatagtaattaaaccacccatctttgctgccttttatacttttctagtgttctccaaaaagcaatacaaattatacatttttgttcttgcatagtatatcattctatcattttgagatttaacattttaacactatcaccattaagtatgaccctgtgaaatttcatctaacaccaaagaagacaatagcataaactgtcctggttctgttgattttgtacatgtcttcaggttttatatgtgtgttattaagacattttgtactgtagatttactgactctcaattctggtattgactagagccaaactccctatagtacttgggagcatggttctattcagttctcaccccagttttcatggttttctgtttgttctgttctgccatctgatctagagtcgcctggcactgccagtgttccgcttagagttcagaactcttggcgacgatcccagtttttctcccagtcaggtaaactgcatactgggtagctgtatttcttttgtgcgaaaatccatgttggggcgatcaatgatgtgtggcacttgtcttcatttctgatttctggggaaaaaattatttcttatgcacagttagcaaagagctagttcttttatattactaccagttatgctaaaattgggggtaggaggagaggaatcacacaactttatgttgatttcaagaattcaaagaaataataatattcatcattttcttgagagtcccctgcctttaaaaaaaaaaaaaaagattaaaagcatttaccagaaactgatcatagttctcttgttaactgtgtcactgtgtttgcttcctgggtgacatctggcctctgtttgtatggtacttctccatgccagacagtgaggggactgctcagtcaagccacaatgcaaggtgcactaagaatcagtactaataggaacagtttttgcttcctgtagtctagtacctggtgttaattgatgtgatcaatcatttgatagtagtttaaacttcttttggtgatgggtgcaacctgctacaggggttgtctgctttattatgattttctaatgttcttgacttaccaaacacacacacacacacacacacacacacacacacacacacacaaaattggtttaaagctgatgtaggaactatactccactgataggtcaaaaacaaagacaattagaaaatactcacattcatatcttttttttctttcttttttttctgtgcagtggattctccaagcagtgagaagtcacctgttatgacacctgtaagtcactcattttaaggaataagattatgagttagtgtgattttaatttataacatttgattggctcaaagagtattcaggccgggtgcaggcggtggctcacgcctgtaatcccaacactttgggagggtgaggcgggtggatcacgaggtcaggtgttcaagatcaggctgactaacatggtgaaacactgtctcttactaaaaatacaaaaattaggcaggtgtggtggcaccgagatcgtgtcactgcactccagtctgggtgacagagcgagacttcgtctc

SEQ ID NO: 314149 - DNA, 5410 bp, Homo sapiens
cgctctcggcagacgccttcaccagatgtagtcctcaggggaagcagcgatgggagaggaagcgactctgaatccgacttgcctcatcggaagctgccagatgtgaagaaggatgacatgtctgcacggcggacttcccatggtgagccgaaatcagcagtgccttttaaccagtacctcccgaacaaaagcaatcagacggcctacgtccccgcgcctctgagaaagaagaaagcagagagagaggaataccgcaagagctggagtaccgccacctccccgctgggtggggagaggcccttcagatacggtccgagaactcctgtgtctgatgacgcagagagcaccagcatgtttgacatgcggtgtgaggaggaggccgcggtgcagccgcacagcagggcccgccaggagcagctgcagctgataaataaccagctgagggaagaggacgacaaatggcaagatgacctggctcgttggaagagtcgtagaagaagtgtttctcaggacttaatcaagaaagaggaagaaaggaaaaaaatggagaagttactggctggagaagatgggacaagtgaacgaaggaaaagcatcaaaacctacagagaaattgttcaagaaaaagagcggagagagagagagctgcatgaagcatataagaacgctcggtcccaggaggaggcagaggggatccttcaacagtacattgagaggttcaccatcagtgaggctgttctcgaacgcttggagatgccaaaaattctggaaagaagccattcaacagagccaaatttatcctccttcctgaatgaccccaatcccatgaaatacctgcggcaacagtcactgcctccacccaaattcactgccactgttgaaaccaccattgctcgtgccagtgttctggataccagcatgtcagcaggcagtgggtctccaagcaaaactgtcactcccaaagcagtgcctatgctgacacccaagccttactcccagcccaaaaattctcaagatgttctgaagacctttaaggtagacgggaaagtcagtgtgaatggagagacggttcatagagaggaggagaaggaaagagagtgtcccacggtggcacctgcccactccttaaccaaatcccagatgtttgaaggtgtggccagagtgcacgggtctccactggagctgaaacaagacaacggtagcatcgagatcaacataaagaagccaaactctgttccccaagagctcgcagcaaccactgagaaaacggaaccgaatagtcaagaggacaagaatgatggtggaaaatcaagaaaagggaatatagaacttgcctcatcagaaccacagcattttacaacaactgtgactcgatgcagcccgaccgtggcctttgtggaatttccctccagcccccagctgaagaatgatgtgtcggaagaaaaagaccagaagaaaccagaaaatgaaatgagtggaaaggtggagttggtgctgtcacaaaaggtggtaaagccaaaatctccagaacccgaagcaacgctgacatttccatttctggacaaaatgcctgaagccaaccaactacatttgccaaatctcaattctcaagtggattctccaagcagtgagaagtcacctgttatgacaccttttaagttctgggcatgggacccagaagaggagcgcaggcgacaggaaaaatggcaacaggaacaggaacgtttgctccaggagagataccagaaggagcaggacaagctgaaagaagagtgggaaaaggcccaaaaggaggtggaagaggaagaacgcagatactatgaggaggagcgtaagataattgaagacactgtggttccatttactgtttcttcaagttccgctgaccagctgtctacctcttcctccatgactgaaggcagtgggacaatgaataagatagacctgggaaactgtcaagatgaaaaacaagacagaagatggaagaaatcattccagggagatgacagtgacttattgctgaagactagggaaagtgatcgactggaggagaagggcagcctaactgaaggggccttggctcattctgggaaccctgtatcaaaaggagtccatgaagaccatcagctggataccgaggctggggccccacactgtggaacaaacccacagcttgctcaggatccatcccagaatcagcagacatcaaatccaacgcacagttcagaagatgtgaagccaaaaaccctcccgctggataaaagcattaaccatcagatcgagtctcccagtgaaaggcggaagtctataagtggaaagaagctgtgctcttcctgtgggcttcctttgggtaaaggagctgcaatgatcatcgagaccctcaatctctattttcacatccagtgtttcaggtgtggaatttgtaaaggccagcttggagatgcagtgagtgggacggatgttaggattcgaaatggtctcctgaactgtaatgattgctacatgcgatccagaagtgccgggcagcctacaacattgtgacacggctttcaagcttccggatcactcaccatttctttactgagagtgtcccctggcaactgcttaacaaaatcccaagctcaggggcttctcagcatttacctaatttctgaaaggctcttctgaaaggtggtatctgttctttcgtagcacagtgtttatgtttttcctgtttattgttttggttttttttttttttttgcatttgcacagtatacacaaaagaatatggggttgtaatgatcctgaatagctcaaaaaaggttttagcatggtcaaacaggcttatggtttaaaatgtgttattctcttctttgggaattagctaaatgatgcaataaacctgttttgttttagaatgtctaggaattaaacactttatgtttacagaattgagctgcagaaagtgcaagacatgccaatttgagacacacggtcttctaagactgaaggataaatttaatgcatttcagaaactaaacatcacagcaagctctatctctgagctataatttgtttttaatgcaaagacactagtttgataatatatactgtaatcctgaaacatttgtgttacttacctttggaggtagaaattataccaataaattattgcaccgttagtattagattctgtgtaccttggaagttatgtcattaatataggctggttcatcaaataaagcaaaaccttgcaatatcagctagatttacactccgggacgttgcccaaaggtaggaagaaagcagagggaaatatttcagtcatcatttccaaagtcattatcaaaatctgtgaggaagtttaatcttccaaagagtcaatgtcagacatcaggcctctgttgcctgcttctctcgaggcactagattaggagtcttcaataagagacttaacatgaggtatatggaagatgaggcaccgagataagttcatcattaggtgtgagcactgctcacccttgctggcaagttctccttaagggcctgaagcacaggtgtccaaagaaaagcgttaagtccatcttaatagaatctatgtggtatatgatgtggtcagcccctggtctgtgatcagcaagaacctacagcacagattatgccctgcccacttcaatgaatacctactctcctccattctccatcactttttttgctatcaagaactccggaccttgcccatggagaagtttagagaggaactcttgtggagagctggtttattttctgccctgtgcgacgagtttcagctggccaagaaaggagtcaagttattaaaaagcatcacaatgtagatctccaggctggttttttgttttttgttgttaagactggggaaagggggactatttattctgccttaaatcaatggcaaataagtcaagatgacattttgtgaatgtagactatggatacactcctaatagattgatgtagtcataaaagggggtcaagtagatgtttttctgttatgtaagcaataatttttccgtgtcttattgagtatggctagcgattatttattacatgctagatgggttctttgcatgtgggttccatataggtgcagaaatttcctcagccactggagggatttcgaccatatttgtcatttggatgagctgttattagattgaaatctacacatcatttcattaaaaattgtgccttagaaaacgcaaagctgttgcacatggcgataaattatggatgcagtacattgaagagagatgaagtcacttccaagtttccaagacttctcatggaggtgtttgctgttttacaggaaaaaataaaaataaaaaaagaaaaaaagaaaaaattaaaaagaaaaattgttttgaaaatgtacagatcaagtccaatattttgattatccacctgcatgttttattaaatattttgataatgtggatgtttacactttgcatgatattagcagagtaccactagtaatgcacaaacatgtacaatatggtcattcataaccgatttttatagaatactttttacatgtgcaactccatccgttatgtaaggattacatgaatattgcacattcccttctggtttcacaaacccatttatacatatttcttagtgaggctcattgtacatgtattgaagctagaatcgagtcaagaaaaataaagccccattctccaactgcaaaatgtgctttcccataatgaacactagtcaccagcacagaataatctccaacattttctaaattctaattgccaactgtttctatttatatttgatttatatttcatttggagtctgttacatggcagcttaggcagactagatcttgttttttccaatgcagcataatgagtatgatctatttcttttcaaataatctttgagatcccaggaaaaaaaaaatgctctgctccattgagctataatgtaaatgtgtttgtttaaaaaacaggtgaggcaagtgagtgatttattgttcctgaggaagtatatctgattttttttctcatactccaaaagctagtccctactctttaataaaaataatgggtaactttttgtttttcactagcgaacttccatgacatttcctttctatgtagtgtgattaatgcaatacatattatagttatctatacacagtgtaagatttaacaaactgaaatgatccacctcatatgtgagtccgtccaaaagatgttactgctctgggtgggccagtgttctatatcggttatactaactttcatttaaagtatttattctaaaatgcctctgagaaacagtaaaaaataaaaacaacaagttgtctaaaatgcaacagcttttatagtaaatgtacatttataaataaaatactcaaatcaaaaaaaaaaac

SEQ ID NO: 314150 - DNA, 6734 bp, Homo sapiens
ttagtagagtactgaaacattccaaaatgtattctttaagatagaattgtatttggaatacaccagttgtatacttgtattagtttgttttcatgctgttgataaagacatacctgagactgggtaatttataaaggaaagaggcttcattgactcatagttccacatggctgaagaggcctcacagtcatggtggaagatgaaggaagagcaacgggacatcttacatggtggccagcaaagagagagcttgtgtagggaaacttccctttataaaaccatcagatctcgtgagacttattcactatcacaagaatagcacaagaaagacccaccctcatgattcagttacctcccaccaggtccctcccatgacatgtgggaatcatgggagctttgattcaagatttgggaggggacatagccaaaccgtatgaatactttcatctggttcatggaaactgtaattatagctgcatgctctggagacaaaatgcctgggttcaaattttcatgtgtctagttcttagctgtgtgaccttacccatcagatttcccctaatctctaatcagcacctgtaaactagaaataataccagtaataacctcatagggattttagaaataccaaatgggagaatccataaaaagtgtttagctcaatacctggcccagaataagcattcataatgtattctagtaattgtagaatagcagcaggaggagtaaaagaataaagcaagatgtcaggcagaaataaactactctcgaatcctttctttaaaataagagtgttcatgttgtggagatcgggtttttcactgtggttctcaaaccctgtgtgccagggtccctgtagggcttggagcccactctcacagtgtctcattcagtaggtctaggctggggccagaggatttgcatttcttacaggttcccaggtgatgctcatgctgcacatctcaccacactctgaaaaccactggcctcaagtatttatttaaattgtgcaccaaaaatatcactgattgatatgaaaataacagtaataattgcttgacatttataaagtctccatctttcaagaagccagagacctctaataaatgtaaccttaaaatacatgatttgtcttcaattgggatggggaaatgggggaggcataggtctctgcccagcacccatttaagggactgatctgaagtcaagcatcaagttccaatgaaactctagggttaggatcaggtatcctggagccacacctaacactttctcccccagaaagtggtctctcccccatttctataaagtcatccattcatagactggtcatacaggtcactgaagatctgctgatcgaccctaatgatgttccacacgttttccttacacacacacacccaggcattcagtttttaaatgccctgaaaacagtcataaaatacatttgaaagtgacaaattcccttttcttagctgcctctcagcagcagaaagatatctcaaactgatgtttcagtaaaatatgtgcgcattaaaaactgatttttttattgaaaatgacgacaacagcagagtttaaggatacaaatccttgccatgagccaccacagaaaggcatatactcaacctttatttatacgtacaaaaaacttctgccacagacttctatacataacctttatgatgtgtaatgtatatgaaatagtaattaaaccacccatctttgctgccttttatacttttctagtgttctccaaaaagcaatacaaattatacatttttgttcttgcatagtatatcattctatcattttgagatttaacattttaacactatcaccattaagtatgaccctgtgaaatttcatctaacaccaaagaagacaatagcataaactgtcctggttctgttgattttgtacatgtcttcaggttttatatgtgtgttattaagacattttgtactgtagatttactgactctcaattctggtattgactagagccaaactccctatagtacttgggagcatggttctattcagttctcaccccagttttcatggttttctgtttgttctgttctgccatctgatctagagtcgcctggcactgccagtgttccgcttagagttcagaactcttggcgacgatcccagtttttctcccagtcaggtaaactgcatactgggtagctgtatttcttttgtgcgaaaatccatgttggggcgatcaatgatgtgtggcacttgtcttcatttctgatttctggggaaaaaattatttcttatgcacagttagcaaagagctagttcttttatattactaccagttatgctaaaattgggggtaggaggagaggaatcacacaactttatgttgatttcaagaattcaaagaaataataatattcatcattttcttgagagtcccctgcctttaaaaaaaaaaaaaaagattaaaagcatttaccagaaactgatcatagttctcttgttaactgtgtcactgtgtttgcttcctgggtgacatctggcctctgtttgtatggtacttctccatgccagacagtgaggggactgctcagtcaagccacaatgcaaggtgcactaagaatcagtactaataggaacagtttttgcttcctgtagtctagtacctggtgttaattgatgtgatcaatcatttgatagtagtttaaacttcttttggtgatgggtgcaacctgctacaggggttgtctgctttattatgattttctaatgttcttgacttaccaaacacacacacacacacacacacacacacacacacacacacacaaaattggtttaaagctgatgtaggaactatactccactgataggtcaaaaacaaagacaattagaaaatactcacattcatatcttttttttctttcttttttttctgtgcagtggattctccaagcagtgagaagtcacctgttatgacaccttttaagttctgggcatgggacccagaagaggagcgcaggcgacaggaaaaatggcaacaggaacaggaacgtttgctccaggagagataccagaaggagcaggacaagctgaaagaagagtgggaaaaggcccaaaaggaggtggaagaggaagaacgcagatactatgaggaggagcgtaagataattgaagacactgtggttccatttactgtttcttcaagttccgctgaccagctgtctacctcttcctccatgactgaaggcagtgggacaatgaataagatagacctgggaaactgtcaagatgaaaaacaagacagaagatggaagaaatcattccagggagatgacagtgacttattgctgaagactagggaaagtgatcgactggaggagaagggcagcctaactgaaggggccttggctcattctgggaaccctgtatcaaaaggagtccatgaagaccatcagctggataccgaggctggggccccacactgtggaacaaacccacagcttgctcaggatccatcccagaatcagcagacatcaaatccaacgcacagttcagaagatgtgaagccaaaaaccctcccgctggataaaagcattaaccatcagatcgagtctcccagtgaaaggcggaagtctataagtggaaagaagctgtgctcttcctgtgggcttcctttgggtaaaggagctgcaatgatcatcgagaccctcaatctctattttcacatccagtgtttcaggtgtggaatttgtaaaggccagcttggagatgcagtgagtgggacggatgttaggattcgaaatggtctcctgaactgtaatgattgctacatgcgatccagaagtgccgggcagcctacaacattgtgacacggctttcaagcttccggatcactcaccatttctttactgagagtgtcccctggcaactgcttaacaaaatcccaagctcaggggcttctcagcatttacctaatttctgaaaggctcttctgaaaggtggtatctgttctttcgtagcacagtgtttatgtttttcctgtttattgttttggttttttttttttttttgcatttgcacagtatacacaaaagaatatggggttgtaatgatcctgaatagctcaaaaaaggttttagcatggtcaaacaggcttatggtttaaaatgtgttattctcttctttgggaattagctaaatgatgcaataaacctgttttgttttagaatgtctaggaattaaacactttatgtttacagaattgagctgcagaaagtgcaagacatgccaatttgagacacacggtcttctaagactgaaggataaatttaatgcatttcagaaactaaacatcacagcaagctctatctctgagctataatttgtttttaatgcaaagacactagtttgataatatatactgtaatcctgaaacatttgtgttacttacctttggaggtagaaattataccaataaattattgcaccgttagtattagattctgtgtaccttggaagttatgtcattaatataggctggttcatcaaataaagcaaaaccttgcaatatcagctagatttacactccgggacgttgcccaaaggtaggaagaaagcagagggaaatatttcagtcatcatttccaaagtcattatcaaaatctgtgaggaagtttaatcttccaaagagtcaatgtcagacatcaggcctctgttgcctgcttctctcgaggcactagattaggagtcttcaataagagacttaacatgaggtatatggaagatgaggcaccgagataagttcatcattaggtgtgagcactgctcacccttgctggcaagttctccttaagggcctgaagcacaggtgtccaaagaaaagcgttaagtccatcttaatagaatctatgtggtatatgatgtggtcagcccctggtctgtgatcagcaagaacctacagcacagattatgccctgcccacttcaatgaatacctactctcctccattctccatcactttttttgctatcaagaactccggaccttgcccatggagaagtttagagaggaactcttgtggagagctggtttattttctgccctgtgcgacgagtttcagctggccaagaaaggagtcaagttattaaaaagcatcacaatgtagatctccaggctggttttttgttttttgttgttaagactggggaaagggggactatttattctgccttaaatcaatggcaaataagtcaagatgacattttgtgaatgtagactatggatacactcctaatagattgatgtagtcataaaagggggtcaagtagatgtttttctgttatgtaagcaataatttttccgtgtcttattgagtatggctagcgattatttattacatgctagatgggttctttgcatgtgggttccatataggtgcagaaatttcctcagccactggagggatttcgaccatatttgtcatttggatgagctgttattagattgaaatctacacatcatttcattaaaaattgtgccttagaaaacgcaaagctgttgcacatggcgataaattatggatgcagtacattgaagagagatgaagtcacttccaagtttccaagacttctcatggaggtgtttgctgttttacaggaaaaaataaaaataaaaaaagaaaaaaagaaaaaattaaaaagaaaaattgttttgaaaatgtacagatcaagtccaatattttgattatccacctgcatgttttattaaatattttgataatgtggatgtttacactttgcatgatattagcagagtaccactagtaatgcacaaacatgtacaatatggtcattcataaccgatttttatagaatactttttacatgtgcaactccatccgttatgtaaggattacatgaatattgcacattcccttctggtttcacaaacccatttatacatatttcttagtgaggctcattgtacatgtattgaagctagaatcgagtcaagaaaaataaagccccattctccaactgcaaaatgtgctttcccataatgaacactagtcaccagcacagaataatctccaacattttctaaattctaattgccaactgtttctatttatatttgatttatatttcatttggagtctgttacatggcagcttaggcagactagatcttgttttttccaatgcagcataatgagtatgatctatttcttttcaaataatctttgagatcccaggaaaaaaaaaatgctctgctccattgagctataatgtaaatgtgtttgtttaaaaaacaggtgaggcaagtgagtgatttattgttcctgaggaagtatatctgattttttttctcatactccaaaagctagtccctactctttaataaaaataatgggtaactttttgtttttcactagcgaacttccatgacatttcctttctatgtagtgtgattaatgcaatacatattatagttatctatacacagtgtaagatttaacaaactgaaatgatccacctcatatgtgagtccgtccaaaagatgttactgctctgggtgggccagtgttctatatcggttatactaactttcatttaaagtatttattctaaaatgcctctgagaaacagtaaaaaataaaaacaacaagttgtctaaaatgcaacagcttttatagtaaatgtacatttataaataaaatactcaaatcaaaaaaaaaaac

SEQ ID NO: 314151 - DNA, 6804 bp, Homo sapiens
ttagtagagtactgaaacattccaaaatgtattctttaagatagaattgtatttggaatacaccagttgtatacttgtattagtttgttttcatgctgttgataaagacatacctgagactgggtaatttataaaggaaagaggcttcattgactcatagttccacatggctgaagaggcctcacagtcatggtggaagatgaaggaagagcaacgggacatcttacatggtggccagcaaagagagagcttgtgtagggaaacttccctttataaaaccatcagatctcgtgagacttattcactatcacaagaatagcacaagaaagacccaccctcatgattcagttacctcccaccaggtccctcccatgacatgtgggaatcatgggagctttgattcaagatttgggaggggacatagccaaaccgtatgaatactttcatctggttcatggaaactgtaattatagctgcatgctctggagacaaaatgcctgggttcaaattttcatgtgtctagttcttagctgtgtgaccttacccatcagatttcccctaatctctaatcagcacctgtaaactagaaataataccagtaataacctcatagggattttagaaataccaaatgggagaatccataaaaagtgtttagctcaatacctggcccagaataagcattcataatgtattctagtaattgtagaatagcagcaggaggagtaaaagaataaagcaagatgtcaggcagaaataaactactctcgaatcctttctttaaaataagagtgttcatgttgtggagatcgggtttttcactgtggttctcaaaccctgtgtgccagggtccctgtagggcttggagcccactctcacagtgtctcattcagtaggtctaggctggggccagaggatttgcatttcttacaggttcccaggtgatgctcatgctgcacatctcaccacactctgaaaaccactggcctcaagtatttatttaaattgtgcaccaaaaatatcactgattgatatgaaaataacagtaataattgcttgacatttataaagtctccatctttcaagaagccagagacctctaataaatgtaaccttaaaatacatgatttgtcttcaattgggatggggaaatgggggaggcataggtctctgcccagcacccatttaagggactgatctgaagtcaagcatcaagttccaatgaaactctagggttaggatcaggtatcctggagccacacctaacactttctcccccagaaagtggtctctcccccatttctataaagtcatccattcatagactggtcatacaggtcactgaagatctgctgatcgaccctaatgatgttccacacgttttccttacacacacacacccaggcattcagtttttaaatgccctgaaaacagtcataaaatacatttgaaagtgacaaattcccttttcttagctgcctctcagcagcagaaagatatctcaaactgatgtttcagtaaaatatgtgcgcattaaaaactgatttttttattgaaaatgacgacaacagcagagtttaaggatacaaatccttgccatgagccaccacagaaaggcatatactcaacctttatttatacgtacaaaaaacttctgccacagacttctatacataacctttatgatgtgtaatgtatatgaaatagtaattaaaccacccatctttgctgccttttatacttttctagtgttctccaaaaagcaatacaaattatacatttttgttcttgcatagtatatcattctatcattttgagatttaacattttaacactatcaccattaagtatgaccctgtgaaatttcatctaacaccaaagaagacaatagcataaactgtcctggttctgttgattttgtacatgtcttcaggttttatatgtgtgttattaagacattttgtactgtagatttactgactctcaattctggtattgactagagccaaactccctatagtacttgggagcatggttctattcagttctcaccccagttttcatggttttctgtttgttctgttctgccatctgatctagagtcgcctggcactgccagtgttccgcttagagttcagaactcttggcgacgatcccagtttttctcccagtcaggtaaactgcatactgggtagctgtatttcttttgtgcgaaaatccatgttggggcgatcaatgatgtgtggcacttgtcttcatttctgatttctggggaaaaaattatttcttatgcacagttagcaaagagctagttcttttatattactaccagttatgctaaaattgggggtaggaggagaggaatcacacaactttatgttgatttcaagaattcaaagaaataataatattcatcattttcttgagagtcccctgcctttaaaaaaaaaaaaaaagattaaaagcatttaccagaaactgatcatagttctcttgttaactgtgtcactgtgtttgcttcctgggtgacatctggcctctgtttgtatggtacttctccatgccagacagtgaggggactgctcagtcaagccacaatgcaaggtgcactaagaatcagtactaataggaacagtttttgcttcctgtagtctagtacctggtgttaattgatgtgatcaatcatttgatagtagtttaaacttcttttggtgatgggtgcaacctgctacaggggttgtctgctttattatgattttctaatgttcttgacttaccaaacacacacacacacacacacacacacacacacacacacacacaaaattggtttaaagctgatgtaggaactatactccactgataggtcaaaaacaaagacaattagaaaatactcacattcatatcttttttttctttcttttttttctgtgcagtggattctccaagcagtgagaagtcacctgttatgacaccttttaagttctgggcatgggacccagaagaggagcgcaggcgacaggaaaaatggcaacaggaacaggaacgtttgctccaggagagataccagaaggagcaggacaagctgaaagaagagtgggaaaaggcccaaaaggaggtggaagaggaagaacgcagatactatgaggaggagcgtaagataattgaagacactgtggttccatttactgtttcttcaagttccgctgaccagctgtctacctcttcctccatgactgaaggcagtgggacaatgaataagatagacctgggaaactgtcaagatgaaaaacaagacagaagatggaagaaatcattccagggagatgacagtgacttattgctgaagactagggaaagtgatcgactggaggagaagggcagcctaactgaaggggccttggctcattctgggaaccctgtatcaaaaggagtccatgaagaccatcagctggataccgaggctggggccccacactgtggaacaaacccacagcttgctcaggatccatcccagaatcagcagacatcaaatccaacgcacagttcagaagatgtgaagccaaaaaccctcccgctggataaaagcattaaccatcagatcgagtctcccagtgaaaggcggaagaaaagtccccgagagcacttccaggctgggcctttctctccctgttctcccacccctcccggtcagtcagtctataagtggaaagaagctgtgctcttcctgtgggcttcctttgggtaaaggagctgcaatgatcatcgagaccctcaatctctattttcacatccagtgtttcaggtgtggaatttgtaaaggccagcttggagatgcagtgagtgggacggatgttaggattcgaaatggtctcctgaactgtaatgattgctacatgcgatccagaagtgccgggcagcctacaacattgtgacacggctttcaagcttccggatcactcaccatttctttactgagagtgtcccctggcaactgcttaacaaaatcccaagctcaggggcttctcagcatttacctaatttctgaaaggctcttctgaaaggtggtatctgttctttcgtagcacagtgtttatgtttttcctgtttattgttttggttttttttttttttttgcatttgcacagtatacacaaaagaatatggggttgtaatgatcctgaatagctcaaaaaaggttttagcatggtcaaacaggcttatggtttaaaatgtgttattctcttctttgggaattagctaaatgatgcaataaacctgttttgttttagaatgtctaggaattaaacactttatgtttacagaattgagctgcagaaagtgcaagacatgccaatttgagacacacggtcttctaagactgaaggataaatttaatgcatttcagaaactaaacatcacagcaagctctatctctgagctataatttgtttttaatgcaaagacactagtttgataatatatactgtaatcctgaaacatttgtgttacttacctttggaggtagaaattataccaataaattattgcaccgttagtattagattctgtgtaccttggaagttatgtcattaatataggctggttcatcaaataaagcaaaaccttgcaatatcagctagatttacactccgggacgttgcccaaaggtaggaagaaagcagagggaaatatttcagtcatcatttccaaagtcattatcaaaatctgtgaggaagtttaatcttccaaagagtcaatgtcagacatcaggcctctgttgcctgcttctctcgaggcactagattaggagtcttcaataagagacttaacatgaggtatatggaagatgaggcaccgagataagttcatcattaggtgtgagcactgctcacccttgctggcaagttctccttaagggcctgaagcacaggtgtccaaagaaaagcgttaagtccatcttaatagaatctatgtggtatatgatgtggtcagcccctggtctgtgatcagcaagaacctacagcacagattatgccctgcccacttcaatgaatacctactctcctccattctccatcactttttttgctatcaagaactccggaccttgcccatggagaagtttagagaggaactcttgtggagagctggtttattttctgccctgtgcgacgagtttcagctggccaagaaaggagtcaagttattaaaaagcatcacaatgtagatctccaggctggttttttgttttttgttgttaagactggggaaagggggactatttattctgccttaaatcaatggcaaataagtcaagatgacattttgtgaatgtagactatggatacactcctaatagattgatgtagtcataaaagggggtcaagtagatgtttttctgttatgtaagcaataatttttccgtgtcttattgagtatggctagcgattatttattacatgctagatgggttctttgcatgtgggttccatataggtgcagaaatttcctcagccactggagggatttcgaccatatttgtcatttggatgagctgttattagattgaaatctacacatcatttcattaaaaattgtgccttagaaaacgcaaagctgttgcacatggcgataaattatggatgcagtacattgaagagagatgaagtcacttccaagtttccaagacttctcatggaggtgtttgctgttttacaggaaaaaataaaaataaaaaaagaaaaaaagaaaaaattaaaaagaaaaattgttttgaaaatgtacagatcaagtccaatattttgattatccacctgcatgttttattaaatattttgataatgtggatgtttacactttgcatgatattagcagagtaccactagtaatgcacaaacatgtacaatatggtcattcataaccgatttttatagaatactttttacatgtgcaactccatccgttatgtaaggattacatgaatattgcacattcccttctggtttcacaaacccatttatacatatttcttagtgaggctcattgtacatgtattgaagctagaatcgagtcaagaaaaataaagccccattctccaactgcaaaatgtgctttcccataatgaacactagtcaccagcacagaataatctccaacattttctaaattctaattgccaactgtttctatttatatttgatttatatttcatttggagtctgttacatggcagcttaggcagactagatcttgttttttccaatgcagcataatgagtatgatctatttcttttcaaataatctttgagatcccaggaaaaaaaaaatgctctgctccattgagctataatgtaaatgtgtttgtttaaaaaacaggtgaggcaagtgagtgatttattgttcctgaggaagtatatctgattttttttctcatactccaaaagctagtccctactctttaataaaaataatgggtaactttttgtttttcactagcgaacttccatgacatttcctttctatgtagtgtgattaatgcaatacatattatagttatctatacacagtgtaagatttaacaaactgaaatgatccacctcatatgtgagtccgtccaaaagatgttactgctctgggtgggccagtgttctatatcggttatactaactttcatttaaagtatttattctaaaatgcctctgagaaacagtaaaaaataaaaacaacaagttgtctaaaatgcaacagcttttatagtaaatgtacatttataaataaaatactcaaatcaaaaaaaaaaac

SEQ ID NO: 314152 - DNA, 4931 bp, Homo sapiens
  misc_feature (7)..(7): n is a, c, g, or t
  misc_feature (9)..(9): n is a, c, g, or t
  misc_feature (11)..(11): n is a, c, g, or t
ccaattngncnttcggcctttttggccgggggacttaatcaagaaagaggaagaaaggaaaaaaatggagaagttactggctggagaagatgggacaagtgaacgaaggaaaagcatcaaaacctacagagaaattgttcaagaaaaagagcggagagagagagagctgcatgaagcatataagaacgctcggtcccaggaggaggcagaggggatccttcaacagtacattgagaggttcaccatcagtgaggctgttctcgaacgcttggagatgccaaaaattctggaaagaagccattcaacagagccaaatttatcctccttcctgaatgaccccaatcccatgaaatacctgcggcaacagtcactgcctccacccaaattcactgccactgttgaaaccaccattgctcgtgccagtgttctggataccagcatgtcagcaggcagtgggtctccaagcaaaactgtcactcccaaagcagtgcctatgctgacacccaagccttactcccagcccaaaaattctcaagatgttctgaagacctttaaggtagacgggaaagtcagtgtgaatggagagacggttcatagagaggaggagaaggaaagagagtgtcccacggtggcacctgcccactccttaaccaaatcccagatgtttgaaggtgtggccagagtgcacgggtctccactggagctgaaacaagacaacggtagcatcgagatcaacataaagaagccaaactctgttccccaagagctcgcagcaaccactgagaaaacggaaccgaatagtcaagaggacaagaatgatggtggaaaatcaagaaaagggaatatagaacttgcctcatcagaaccacagcattttacaacaactgtgactcgatgcagcccgaccgtggcctttgtggaatttccctccagcccccagctgaagaatgatgtgtcggaagaaaaagaccagaagaaaccagaaaatgaaatgagtggaaaggtggagttggtgctgtcacaaaaggtggtaaagccaaaatctccagaacccgaagcaacgctgacatttccatttctggacaaaatgcctgaagccaaccaactacatttgccaaatctcaattctcaagtggattctccaagcagtgagaagtcacctgttatgacaccttttaagttctgggcatgggacccagaagaggagcgcaggcgacaggaaaaatggcaacaggaacaggaacgtttgctccaggagagataccagaaggagcaggacaagctgaaagaagagtgggaaaaggcccaaaaggaggtggaagaggaagaacgcagatactatgaggaggagcgtaagataattgaagacactgtggttccatttactgtttcttcaagttccgctgaccagctgtctacctcttcctccatgactgaaggcagtgggacaatgaataagatagacctgggaaactgtcaagatgaaaaacaagacagaagatggaagaaatcattccagggagatgacagtgacttattgctgaagactagggaaagtgatcgactggaggagaagggcagcctaactgaaggggccttggctcattctgggaaccctgtatcaaaaggagtccatgaagaccatcagctggataccgaggctggggccccacactgtggaacaaacccacagcttgctcaggatccatcccagaatcagcagacatcaaatccaacgcacagttcagaagatgtgaagccaaaaaccctcccgctggataaaagcattaaccatcagatcgagtctcccagtgaaaggcggaagtctataagtggaaagaagctgtgctcttcctgtgggcttcctttgggtaaaggagctgcaatgatcatcgagaccctcaatctctattttcacatccagtgtttcaggtgtggaatttgtaaaggccagcttggagatgcagtgagtgggacggatgttaggattcgaaatggtctcctgaactgtaatgattgctacatgcgatccagaagtgccgggcagcctacaacattgtgacacggctttcaagcttccggatcactcaccatttctttactgagagtgtcccctggcaactgcttaacaaaatcccaagctcaggggcttctcagcatttacctaatttctgaaaggctcttctgaaaggtggtatctgttctttcgtagcacagtgtttatgtttttcctgtttattgttttggttttttttttttttttgcatttgcacagtatacacaaaagaatatggggttgtaatgatcctgaatagctcaaaaaaggttttagcatggtcaaacaggcttatggtttaaaatgtgttattctcttctttgggaattagctaaatgatgcaataaacctgttttgttttagaatgtctaggaattaaacactttatgtttacagaattgagctgcagaaagtgcaagacatgccaatttgagacacacggtcttctaagactgaaggataaatttaatgcatttcagaaactaaacatcacagcaagctctatctctgagctataatttgtttttaatgcaaagacactagtttgataatatatactgtaatcctgaaacatttgtgttacttacctttggaggtagaaattataccaataaattattgcaccgttagtattagattctgtgtaccttggaagttatgtcattaatataggctggttcatcaaataaagcaaaaccttgcaatatcagctagatttacactccgggacgttgcccaaaggtaggaagaaagcagagggaaatatttcagtcatcatttccaaagtcattatcaaaatctgtgaggaagtttaatcttccaaagagtcaatgtcagacatcaggcctctgttgcctgcttctctcgaggcactagattaggagtcttcaataagagacttaacatgaggtatatggaagatgaggcaccgagataagttcatcattaggtgtgagcactgctcacccttgctggcaagttctccttaagggcctgaagcacaggtgtccaaagaaaagcgttaagtccatcttaatagaatctatgtggtatatgatgtggtcagcccctggtctgtgatcagcaagaacctacagcacagattatgccctgcccacttcaatgaatacctactctcctccattctccatcactttttttgctatcaagaactccggaccttgcccatggagaagtttagagaggaactcttgtggagagctggtttattttctgccctgtgcgacgagtttcagctggccaagaaaggagtcaagttattaaaaagcatcacaatgtagatctccaggctggttttttgttttttgttgttaagactggggaaagggggactatttattctgccttaaatcaatggcaaataagtcaagatgacattttgtgaatgtagactatggatacactcctaatagattgatgtagtcataaaagggggtcaagtagatgtttttctgttatgtaagcaataatttttccgtgtcttattgagtatggctagcgattatttattacatgctagatgggttctttgcatgtgggttccatataggtgcagaaatttcctcagccactggagggatttcgaccatatttgtcatttggatgagctgttattagattgaaatctacacatcatttcattaaaaattgtgccttagaaaacgcaaagctgttgcacatggcgataaattatggatgcagtacattgaagagagatgaagtcacttccaagtttccaagacttctcatggaggtgtttgctgttttacaggaaaaaataaaaataaaaaaagaaaaaaagaaaaaattaaaaagaaaaattgttttgaaaatgtacagatcaagtccaatattttgattatccacctgcatgttttattaaatattttgataatgtggatgtttacactttgcatgatattagcagagtaccactagtaatgcacaaacatgtacaatatggtcattcataaccgatttttatagaatactttttacatgtgcaactccatccgttatgtaaggattacatgaatattgcacattcccttctggtttcacaaacccatttatacatatttcttagtgaggctcattgtacatgtattgaagctagaatcgagtcaagaaaaataaagccccattctccaactgcaaaatgtgctttcccataatgaacactagtcaccagcacagaataatctccaacattttctaaattctaattgccaactgtttctatttatatttgatttatatttcatttggagtctgttacatggcagcttaggcagactagatcttgttttttccaatgcagcataatgagtatgatctatttcttttcaaataatctttgagatcccaggaaaaaaaaaatgctctgctccattgagctataatgtaaatgtgtttgtttaaaaaacaggtgaggcaagtgagtgatttattgttcctgaggaagtatatctgattttttttctcatactccaaaagctagtccctactctttaataaaaataatgggtaactttttgtttttcactagcgaacttccatgacatttcctttctatgtagtgtgattaatgcaatacatattatagttatctatacacagtgtaagatttaacaaactgaaatgatccacctcatatgtgagtccgtccaaaagatgttactgctctgggtgggccagtgttctatatcggttatactaactttcatttaaagtatttattctaaaatgcctctgagaaacagtaaaaaataaaaacaacaagttgtctaaaatgcaacagcttttatagtaaatgtacatttataaataaaatactcaaatcaaaaaaaaaaac

SEQ ID NO: 314153 - DNA, 6473 bp, Homo sapiens
ttagtagagtactgaaacattccaaaatgtattctttaagatagaattgtatttggaatacaccagttgtatacttgtattagtttgttttcatgctgttgataaagacatacctgagactgggtaatttataaaggaaagaggcttcattgactcatagttccacatggctgaagaggcctcacagtcatggtggaagatgaaggaagagcaacgggacatcttacatggtggccagcaaagagagagcttgtgtagggaaacttccctttataaaaccatcagatctcgtgagacttattcactatcacaagaatagcacaagaaagacccaccctcatgattcagttacctcccaccaggtccctcccatgacatgtgggaatcatgggagctttgattcaagatttgggaggggacatagccaaaccgtatgaatactttcatctggttcatggaaactgtaattatagctgcatgctctggagacaaaatgcctgggttcaaattttcatgtgtctagttcttagctgtgtgaccttacccatcagatttcccctaatctctaatcagcacctgtaaactagaaataataccagtaataacctcatagggattttagaaataccaaatgggagaatccataaaaagtgtttagctcaatacctggcccagaataagcattcataatgtattctagtaattgtagaatagcagcaggaggagtaaaagaataaagcaagatgtcaggcagaaataaactactctcgaatcctttctttaaaataagagtgttcatgttgtggagatcgggtttttcactgtggttctcaaaccctgtgtgccagggtccctgtagggcttggagcccactctcacagtgtctcattcagtaggtctaggctggggccagaggatttgcatttcttacaggttcccaggtgatgctcatgctgcacatctcaccacactctgaaaaccactggcctcaagtatttatttaaattgtgcaccaaaaatatcactgattgatatgaaaataacagtaataattgcttgacatttataaagtctccatctttcaagaagccagagacctctaataaatgtaaccttaaaatacatgatttgtcttcaattgggatggggaaatgggggaggcataggtctctgcccagcacccatttaagggactgatctgaagtcaagcatcaagttccaatgaaactctagggttaggatcaggtatcctggagccacacctaacactttctcccccagaaagtggtctctcccccatttctataaagtcatccattcatagactggtcatacaggtcactgaagatctgctgatcgaccctaatgatgttccacacgttttccttacacacacacacccaggcattcagtttttaaatgccctgaaaacagtcataaaatacatttgaaagtgacaaattcccttttcttagctgcctctcagcagcagaaagatatctcaaactgatgtttcagtaaaatatgtgcgcattaaaaactgatttttttattgaaaatgacgacaacagcagagtttaaggatacaaatccttgccatgagccaccacagaaaggcatatactcaacctttatttatacgtacaaaaaacttctgccacagacttctatacataacctttatgatgtgtaatgtatatgaaatagtaattaaaccacccatctttgctgccttttatacttttctagtgttctccaaaaagcaatacaaattatacatttttgttcttgcatagtatatcattctatcattttgagatttaacattttaacactatcaccattaagtatgaccctgtgaaatttcatctaacaccaaagaagacaatagcataaactgtcctggttctgttgattttgtacatgtcttcaggttttatatgtgtgttattaagacattttgtactgtagatttactgactctcaattctggtattgactagagccaaactccctatagtacttgggagcatggttctattcagttctcaccccagttttcatggttttctgtttgttctgttctgccatctgatctagagtcgcctggcactgccagtgttccgcttagagttcagaactcttggcgacgatcccagtttttctcccagtcaggtaaactgcatactgggtagctgtatttcttttgtgcgaaaatccatgttggggcgatcaatgatgtgtggcacttgtcttcatttctgatttctggggaaaaaattatttcttatgcacagttagcaaagagctagttcttttatattactaccagttatgctaaaattgggggtaggaggagaggaatcacacaactttatgttgatttcaagaattcaaagaaataataatattcatcattttcttgagagtcccctgcctttaaaaaaaaaaaaaaagattaaaagcatttaccagaaactgatcatagttctcttgttaactgtgtcactgtgtttgcttcctgggtgacatctggcctctgtttgtatggtacttctccatgccagacagtgaggggactgctcagtcaagccacaatgcaaggtgcactaagaatcagtactaataggaacagtttttgcttcctgtagtctagtacctggtgttaattgatgtgatcaatcatttgatagtagtttaaacttcttttggtgatgggtgcaacctgctacaggggttgtctgctttattatgattttctaatgttcttgacttaccaaacacacacacacacacacacacacacacacacacacacacacaaaattggtttaaagctgatgtaggaactatactccactgataggtcaaaaacaaagacaattagaaaatactcacattcatatcttttttttctttcttttttttctgtgcagtggattctccaagcagtgagaagtcacctgttatgacaccttttaagttctgggcatgggacccagaagaggagcgcaggcgacaggaaaaatggcaacaggaacaggaacgtttgctccaggagagataccagaaggagcaggacaagctgaaagaagagtgggaaaaggcccaaaaggaggtggaagaggaagaacgcagatactatgaggaggagcgtaagataattgaagacactgtggttccatttactgtttcttcaagttccgctgaccagctgtctacctcttcctccatgactgaaggcagtgggacaatgaataagatagacctgggaaactgtcaagatgaaaaacaagacagaagatggaagaaatcattccagggagatgacagtgacttattgctgaagactagggaaagtgatcgactggaggagaagggcagcctaactgaaggggccttggctcattctgggaaccctgtatcaaaaggagtccatgaagaccatcagctggataccgaggctggggccccacactgtggaacaaacccacagcttgctcaggatccatcccagaatcagcagacatcaaatccaacgcacagttcagaagatgtgaagccaaaaaccctcccgctggataaaagcattaaccatcagatcgagtctcccagtgaaaggcggaagtctataagtggaaagaagctgtgctcttcctgtgggcttcctttgggtaaaggagctgcaatgatcatcgagaccctcaatctctattttcacatccagtgtttcaggtgtggaatttgtaaaggccagcttggagatgcagtgagtgggacggatgttaggattcgaaatggtctcctgaactgtaatgattgctacatgcgatccagaagtgccgggcagcctacaacattgtgacacggctttcaagcttccggatcactcaccatttctttactgagagtgtcccctggcaactgcttaacaaaatcccaagctcaggggcttctcagcatttacctaatttctgaaaggctcttctgaaagaattgagctgcagaaagtgcaagacatgccaatttgagacacacggtcttctaagactgaaggataaatttaatgcatttcagaaactaaacatcacagcaagctctatctctgagctataatttgtttttaatgcaaagacactagtttgataatatatactgtaatcctgaaacatttgtgttacttacctttggaggtagaaattataccaataaattattgcaccgttagtattagattctgtgtaccttggaagttatgtcattaatataggctggttcatcaaataaagcaaaaccttgcaatatcagctagatttacactccgggacgttgcccaaaggtaggaagaaagcagagggaaatatttcagtcatcatttccaaagtcattatcaaaatctgtgaggaagtttaatcttccaaagagtcaatgtcagacatcaggcctctgttgcctgcttctctcgaggcactagattaggagtcttcaataagagacttaacatgaggtatatggaagatgaggcaccgagataagttcatcattaggtgtgagcactgctcacccttgctggcaagttctccttaagggcctgaagcacaggtgtccaaagaaaagcgttaagtccatcttaatagaatctatgtggtatatgatgtggtcagcccctggtctgtgatcagcaagaacctacagcacagattatgccctgcccacttcaatgaatacctactctcctccattctccatcactttttttgctatcaagaactccggaccttgcccatggagaagtttagagaggaactcttgtggagagctggtttattttctgccctgtgcgacgagtttcagctggccaagaaaggagtcaagttattaaaaagcatcacaatgtagatctccaggctggttttttgttttttgttgttaagactggggaaagggggactatttattctgccttaaatcaatggcaaataagtcaagatgacattttgtgaatgtagactatggatacactcctaatagattgatgtagtcataaaagggggtcaagtagatgtttttctgttatgtaagcaataatttttccgtgtcttattgagtatggctagcgattatttattacatgctagatgggttctttgcatgtgggttccatataggtgcagaaatttcctcagccactggagggatttcgaccatatttgtcatttggatgagctgttattagattgaaatctacacatcatttcattaaaaattgtgccttagaaaacgcaaagctgttgcacatggcgataaattatggatgcagtacattgaagagagatgaagtcacttccaagtttccaagacttctcatggaggtgtttgctgttttacaggaaaaaataaaaataaaaaaagaaaaaaagaaaaaattaaaaagaaaaattgttttgaaaatgtacagatcaagtccaatattttgattatccacctgcatgttttattaaatattttgataatgtggatgtttacactttgcatgatattagcagagtaccactagtaatgcacaaacatgtacaatatggtcattcataaccgatttttatagaatactttttacatgtgcaactccatccgttatgtaaggattacatgaatattgcacattcccttctggtttcacaaacccatttatacatatttcttagtgaggctcattgtacatgtattgaagctagaatcgagtcaagaaaaataaagccccattctccaactgcaaaatgtgctttcccataatgaacactagtcaccagcacagaataatctccaacattttctaaattctaattgccaactgtttctatttatatttgatttatatttcatttggagtctgttacatggcagcttaggcagactagatcttgttttttccaatgcagcataatgagtatgatctatttcttttcaaataatctttgagatcccaggaaaaaaaaaatgctctgctccattgagctataatgtaaatgtgtttgtttaaaaaacaggtgaggcaagtgagtgatttattgttcctgaggaagtatatctgattttttttctcatactccaaaagctagtccctactctttaataaaaataatgggtaactttttgtttttcactagcgaacttccatgacatttcctttctatgtagtgtgattaatgcaatacatattatagttatctatacacagtgtaagatttaacaaactgaaatgatccacctcatatgtgagtccgtccaaaagatgttactgctctgggtgggccagtgttctatatcggttatactaactttcatttaaagtatttattctaaaatgcctctgagaaacagtaaaaaataaaaacaacaagttgtctaaaatgcaacagcttttatagtaaatgtacatttataaataaaatactcaaatcaaaaaaaaaaac

SEQ ID NO: 314154 - DNA, 5373 bp, Homo sapiens
cgctctcggcagacgccttcaccagatgtagtcctcaggggaagcagcgatgggagaggaagcgactctgaatccgacttgcctcatcggaagctgccagatgtgaagaaggatgacatgtctgcacggcggacttcccatggtgagccgaaatcagcagtgccttttaaccagtacctcccgaacaaaagcaatcagacggcctacgtccccgcgcctctgagaaagaagaaagcagagagagaggaataccgcaagagctggagtaccgccacctccccgctgggtggggagaggcccttcagatacggtccgagaactcctgtgtctgatgacgcagagagcaccagcatgtttgacatgcggtgtgaggaggaggccgcggtgcagccgcacagcagggcccgccaggagcagctgcagctgataaataaccagctgagggaagaggacgacaaatggcaagatgacctggctcgttggaagagtcgtagaagaagtgtttctcaggacttaatcaagaaagaggaagaaaggaaaaaaatggagaagttactggctggagaagatgggacaagtgaacgaaggaaaagcatcaaaacctacagagaaattgttcaagaaaaagagcggagagagagagagctgcatgaagcatataagaacgctcggtcccaggaggaggcagaggggatccttcaacagtacattgagaggttcaccatcagtgaggctgttctcgaacgcttggagatgccaaaaattctggaaagaagccattcaacagagccaaatttatcctccttcctgaatgaccccaatcccatgaaatacctgcggcaacagtcactgcctccacccaaattcactgccactgttgaaaccaccattgctcgtgccagtgttctggataccagcatgtcagcaggcagtgggtctccaagcaaaactgtcactcccaaagcagtgcctatgctgacacccaagccttactcccagcccaaaaattctcaagatgttctgaagacctttaaggtagacgggaaagtcagtgtgaatggagagacggttcatagagaggaggagaaggaaagagagtgtcccacggtggcacctgcccactccttaaccaaatcccagatgtttgaaggtgtggccagagtgcacgggtctccactggagctgaaacaagacaacggtagcatcgagatcaacataaagaagccaaactctgttccccaagagctcgcagcaaccactgagaaaacggaaccgaatagtcaagaggacaagaatgatggtggaaaatcaagaaaagggaatatagaacttgcctcatcagaaccacagcattttacaacaactgtgactcgatgcagcccgaccgtggcctttgtggaatttccctccagcccccagctgaagaatgatgtgtcggaagaaaaagaccagaagaaaccagaaaatgaaatgagtggaaaggtggagttggtgctgtcacaaaaggtggtaaagccaaaatctccagaacccgaagcaacgctgacatttccatttctggacaaaatgcctgaagccaaccaactacatttgccaaatctcaattctcaagtggattctccaagcagtgagaagtcacctgttatgacaccttttaagttctgggcatgggacccagaagaggagcgcaggcgacaggaaaaatggcaacaggaacaggaacgtttgctccaggagagataccagaaggagcaggacaagctgaaagaagagtgggaaaaggcccaaaaggaggtggaagaggaagaacgcagatactatgaggaggagcgtaagataattgaagacactgtggttccatttactgtttcttcaagttccgctgaccagctgtctacctcttcctccatgactgaaggcagtgggacaatgaataagatagacctgggaaactgtcaagatgaaaaacaagacagaagatggaagaaatcattccagggagatgacagtgacttattgctgaagactagggaaagtgatcgactggaggagaagggcagcctaactgaaggggccttggctcattctgggaaccctgtatcaaaaggagtccatgaagaccatcagctggataccgaggctggggccccacactgtggaacaaacccacagcttgctcaggatccatcccagaatcagcagacatcaaatccaacgcacagttcagaagatgtgaagccaaaaaccctcccgctggataaaagcattaaccatcagatcgagtctcccagtgaaaggcggaagtctataagtggaaagaagctgtgctcttcctgtgggcttcctttgggtaaaggagctgcaatgatcatcgagaccctcaatctctattttcacatccagtgtttcaggtgtggaatttgtaaaggccagcttggagatgcagtgagtgggacggatgttaggattcgaaatggtctcctgaactgtaatgattgctacatgcgatccagaagtgccgggcagcctacaacattgtgacacggctttcaagcttccggatcactcaccatttctttactgagagtgtcccctggcaactgcttaacaaaatcccaagctcaggggcttctcagcatttacctaatttctgaaaggctcttctgaaaggtggtatctgttctttcgtagcacagtgtttatgtttttcctgtttattgttttggttttttttttttttttgcatttgcacagtatacacaaaagaatatggggttgtaatgatcctgaatagctcaaaaaaggttttagcatggtcaaacaggcttatggtttaaaatgtgttattctcttctttgggaattagctaaatgatgcaataaacctgttttgttttagaatgtctaggaattaaacactttatgtttacagaattgagctgcagaaagtgcaagacatgccaatttgagacacacggtcttctaagactgaaggataaatttaatgcatttcagaaactaaacatcacagcaagctctatctctgagctataatttgtttttaatgcaaagacactagtttgataatatatactgtaatcctgaaacatttgtgttacttacctttggaggtagaaattataccaataaattattgcaccgttagtattagattctgtgtaccttggaagttatgtcattaatataggctggttcatcaaataaagcaaaaccttgcaatatcagctagatttacactccgggacgttgcccaaaggtaggaagaaagcagagggaaatatttcagtcatcatttccaaagtcattatcaaaatctgtgaggaagtttaatcttccaaagagtcaatgtcagacatcaggcctctgttgcctgcttctctcgaggcactagattaggagtcttcaataagagacttaacatgaggtatatggaagatgaggcaccgagataagttcatcattaggtgtgagcactgctcacccttgctggcaagttctccttaagggcctgaagcacaggtgtccaaagaaaagcgttaagtccatcttaatagaatctatgtggtatatgatgtggtcagcccctggtctgtgatcagcaagaacctacagcacagattatgccctgcccacttcaatgaatacctactctcctccattctccatcactttttttgctatcaagaactccggaccttgcccatggagaagtttagagaggaactcttgtggagagctggtttattttctgccctgtgcgacgagtttcagctggccaagaaaggagtcaagttattaaaaagcatcacaatgtagatctccaggctggttttttgttttttgttgttaagactggggaaagggggactatttattctgccttaaatcaatggcaaataagtcaagatgacattttgtgaatgtagactatggatacactcctaatagattgatgtagtcataaaagggggtcaagtagatgtttttctgttatgtaagcaataatttttccgtgtcttattgagtatggctagcgattatttattacatgctagatgggttctttgcatgtgggttccatataggtgcagaaatttcctcagccactggagggatttcgaccatatttgtcatttggatgagctgttattagattgaaatctacacatcatttcattaaaaattgtgccttagaaaacgcaaagctgttgcacatggcgataaattatggatgcagtacattgaagagagatgaagtcacttccaagtttccaagacttctcatggaggtgtttgctgttttacaggaaaaaataaaaataaaaaaagaaaaaaagaaaaaattaaaaagaaaaattgttttgaaaatgtacagatcaagtccaatattttgattatccacctgcatgttttattaaatattttgataatgtggatgtttacactttgcatgatattagcagagtaccactagtaatgcacaaacatgtacaatatggtcattcataaccgatttttatagaatactttttacatgtgcaactccatccgttatgtaaggattacatgaatattgcacattcccttctggtttcacaaacccatttatacatatttcttagtgaggctcattgtacatgtattgaagctagaatcgagtcaagaaaaataaagccccattctccaactgcaaaatgtgctttcccataatgaacactagtcaccagcacagaataatctccaacattttctaaattctaattgccaactgtttctatttatatttgatttatatttcatttggagtctgttacatggcagcttaggcagactagatcttgttttttccaatgcagcataatgagtatgatctatttcttttcaaataatctttgagatcccaggaaaaaaaaaatgctctgctccattgagctataatgtaaatgtgtttgtttaaaaaacaggtgaggcaagtgagtgatttattgttcctgaggaagtatatctgattttttttctcatactccaaaagctagtccctactctttaataaaaataatgggtaactttttgtttttcactagcgaacttccatgacatttcctttctatgtagtgtgattaatgcaatacatattatagttatctatacacagtgtaagatttaacaaactgaaatgatccacctcatatgtgagtccgtccaaaagatgttactgctctgggtgggccagtgttctatatcggttatactaactttcatttaaagtatttattctaaaatgcctctgagaaacagtaaaaaataaaaacaacagggttggctagtcggggtggcatcgataaacaccggg

SEQ ID NO: 314155 - DNA, 5353 bp, Homo sapiens
cgctctcggcagacgccttcaccagatgtagtcctcaggggaagcagcgatgggagaggaagcgactctgaatccgacttgcctcatcggaagctgccagatgtgaagaaggatgacatgtctgcacggcggacttcccatggtgagccgaaatcagcagtgccttttaaccagtacctcccgaacaaaagcaatcagacggcctacgtccccgcgcctctgagaaagaagaaagcagagagagaggaataccgcaagagctggagtaccgccacctccccgctgggtggggagaggcccttcagatacggtccgagaactcctgtgtctgatgacgcagagagcaccagcatgtttgacatgcggtgtgaggaggaggccgcggtgcagccgcacagcagggcccgccaggagcagctgcagctgataaataaccagctgagggaagaggacgacaaatggcaagatgacctggctcgttggaagagtcgtagaagaagtgtttctcaggacttaatcaagaaagaggaagaaaggaaaaaaatggagaagttactggctggagaagatgggacaagtgaacgaaggaaaagcatcaaaacctacagagaaattgttcaagaaaaagagcggagagagagagagctgcatgaagcatataagaacgctcggtcccaggaggaggcagaggggatccttcaacagtacattgagaggttcaccatcagtgaggctgttctcgaacgcttggagatgccaaaaattctggaaagaagccattcaacagagccaaatttatcctccttcctgaatgaccccaatcccatgaaatacctgcggcaacagtcactgcctccacccaaattcactgccactgttgaaaccaccattgctcgtgccagtgttctggataccagcatgtcagcaggcagtgggtctccaagcaaaactgtcactcccaaagcagtgcctatgctgacacccaagccttactcccagcccaaaaattctcaagatgttctgaagacctttaaggtagacgggaaagtcagtgtgaatggagagacggttcatagagaggaggagaaggaaagagagtgtcccacggtggcacctgcccactccttaaccaaatcccagatgtttgaaggtgtggccagagtgcacgggtctccactggagctgaaacaagacaacggtagcatcgagatcaacataaagaagccaaactctgttccccaagagctcgcagcaaccactgagaaaacggaaccgaatagtcaagaggacaagaatgatggtggaaaatcaagaaaagggaatatagaacttgcctcatcagaaccacagcattttacaacaactgtgactcgatgcagcccgaccgtggcctttgtggaatttccctccagcccccagctgaagaatgatgtgtcggaagaaaaagaccagaagaaaccagaaaatgaaatgagtggaaaggtggagttggtgctgtcacaaaaggtggtaaagccaaaatctccagaacccgaagcaacgctgacatttccatttctggacaaaatgcctgaagccaaccaactacatttgccaaatctcaattctcaagtggattctccaagcagtgagaagtcacctgttatgacaccttttaagttctgggcatgggacccagaagaggagcgcaggcgacaggaaaaatggcaacaggaacaggaacgtttgctccaggagagataccagaaggagcaggacaagctgaaagaagagtgggaaaaggcccaaaaggaggtggaagaggaagaacgcagatactatgaggaggagcgtaagataattgaagacactgtggttccatttactgtttcttcaagttccgctgaccagctgtctacctcttcctccatgactgaaggcagtgggacaatgaataagatagacctgggaaactgtcaagatgaaaaacaagacagaagatggaagaaatcattccagggagatgacagtgacttattgctgaagactagggaaagtgatcgactggaggagaagggcagcctaactgaaggggccttggctcattctgggaaccctgtatcaaaaggagtccatgaagaccatcagctggataccgaggctggggccccacactgtggaacaaacccacagcttgctcaggatccatcccagaatcagcagacatcaaatccaacgcacagttcagaagatgtgaagccaaaaaccctcccgctggataaaagcattaaccatcagatcgagtctcccagtgaaaggcggaagtctataagtggaaagaagctgtgctcttcctgtgggcttcctttgggtaaaggagctgcaatgatcatcgagaccctcaatctctattttcacatccagtgtttcaggtgtggaatttgtaaaggccagcttggagatgcagtgagtgggacggatgttaggattcgaaatggtctcctgaactgtaatgattgctacatgcgatccagaagtgccgggcagcctacaacattgtgacacggctttcaagcttccggatcactcaccatttctttactgagagtgtcccctggcaactgcttaacaaaatcccaagctcaggggcttctcagcatttacctaatttctgaaaggctcttctgaaaggtggtatctgttctttcgtagcacagtgtttatgtttttcctgtttattgttttggttttttttttttttttgcatttgcacagtatacacaaaagaatatggggttgtaatgatcctgaatagctcaaaaaaggttttagcatggtcaaacaggcttatggtttaaaatgtgttattctcttctttgggaattagctaaatgatgcaataaacctgttttgttttagaatgtctaggaattaaacactttatgtttacagaattgagctgcagaaagtgcaagacatgccaatttgagacacacggtcttctaagactgaaggataaatttaatgcatttcagaaactaaacatcacagcaagctctatctctgagctataatttgtttttaatgcaaagacactagtttgataatatatactgtaatcctgaaacatttgtgttacttacctttggaggtagaaattataccaataaattattgcaccgttagtattagattctgtgtaccttggaagttatgtcattaatataggctggttcatcaaataaagcaaaaccttgcaatatcagctagatttacactccgggacgttgcccaaaggtaggaagaaagcagagggaaatatttcagtcatcatttccaaagtcattatcaaaatctgtgaggaagtttaatcttccaaagagtcaatgtcagacatcaggcctctgttgcctgcttctctcgaggcactagattaggagtcttcaataagagacttaacatgaggtatatggaagatgaggcaccgagataagttcatcattaggtgtgagcactgctcacccttgctggcaagttctccttaagggcctgaagcacaggtgtccaaagaaaagcgttaagtccatcttaatagaatctatgtggtatatgatgtggtcagcccctggtctgtgatcagcaagaacctacagcacagattatgccctgcccacttcaatgaatacctactctcctccattctccatcactttttttgctatcaagaactccggaccttgcccatggagaagtttagagaggaactcttgtggagagctggtttattttctgccctgtgcgacgagtttcagctggccaagaaaggagtcaagttattaaaaagcatcacaatgtagatctccaggctggttttttgttttttgttgttaagactggggaaagggggactatttattctgccttaaatcaatggcaaataagtcaagatgacattttgtgaatgtagactatggatacactcctaatagattgatgtagtcataaaagggggtcaagtagatgtttttctgttatgtaagcaataatttttccgtgtcttattgagtatggctagcgattatttattacatgctagatgggttctttgcatgtgggttccatataggtgcagaaatttcctcagccactggagggatttcgaccatatttgtcatttggatgagctgttattagattgaaatctacacatcatttcattaaaaattgtgccttagaaaacgcaaagctgttgcacatggcgataaattatggatgcagtacattgaagagagatgaagtcacttccaagtttccaagacttctcatggaggtgtttgctgttttacaggaaaaaataaaaataaaaaaagaaaaaaagaaaaaattaaaaagaaaaattgttttgaaaatgtacagatcaagtccaatattttgattatccacctgcatgttttattaaatattttgataatgtggatgtttacactttgcatgatattagcagagtaccactagtaatgcacaaacatgtacaatatggtcattcataaccgatttttatagaatactttttacatgtgcaactccatccgttatgtaaggattacatgaatattgcacattcccttctggtttcacaaacccatttatacatatttcttagtgaggctcattgtacatgtattgaagctagaatcgagtcaagaaaaataaagccccattctccaactgcaaaatgtgctttcccataatgaacactagtcaccagcacagaataatctccaacattttctaaattctaattgccaactgtttctatttatatttgatttatatttcatttggagtctgttacatggcagcttaggcagactagatcttgttttttccaatgcagcataatgagtatgatctatttcttttcaaataatctttgagatcccaggaagtgaggcaagtgagtgatttattgttcctgaggaagtatatctgattttttttctcatactccaaaagctagtccctactctttaataaaaataatgggtaactttttgtttttcactagcgaacttccatgacatttcctttctatgtagtgtgattaatgcaatacatattatagttatctatacacagtgtaagatttaacaaactgaaatgatccacctcatatgtgagtccgtccaaaagatgttactgctctgggtgggccagtgttctatatcggttatactaactttcatttaaagtatttattctaaaatgcctctgagaaacagtaaaaaataaaaacaacaagttgtctaaaatgcaacagcttttatagtaaatgtacatttataaataaaatactcaaatcaaaaaaaaaaac

SEQ ID NO: 314156 - DNA, 2012 bp, Homo sapiens
cagtcagaaactcttttaaaaaattggagtgaagatagggagtgtgaaattcaagaatgactatttctcaaagtgaagtcacgtttttactgcctttttacatggatctcaaatctctgcaagactgaaaactttgagaataaaaattgaaggtgccgggcagcctacaacattgtgacacggctttcaagcttccggatcactcaccatttctttactgagagtgtcccctggcaactgcttaacaaaatcccaagctcaggggcttctcagcatttacctaatttctgaaaggctcttctgaaagaactccggaccttgcccatggagaagtttagagaggaactcttgtggagagctggtttattttctgccctgtgcgacgagtttcagctggccaagaaaggagtcaagttattaaaaagcatcacaatgtagatctccaggctggttttttgttttttgttgttaagactggggaaagggggactatttattctgccttaaatcaatggcaaataagtcaagatgacattttgtgaatgtagactatggatacactcctaatagattgatgtagtcataaaagggggtcaagtagatgtttttctgttatgtaagcaataatttttccgtgtcttattgagtatggctagcgattatttattacatgctagatgggttctttgcatgtgggttccatataggtgcagaaatttcctcagccactggagggatttcgaccatatttgtcatttggatgagctgttattagattgaaatctacacatcatttcattaaaaattgtgccttagaaaacgcaaagctgttgcacatggcgataaattatggatgcagtacattgaagagagatgaagtcacttccaagtttccaagacttctcatggaggtgtttgctgttttacaggaaaaaataaaaataaaaaaagaaaaaaagaaaaaattaaaaagaaaaattgttttgaaaatgtacagatcaagtccaatattttgattatccacctgcatgttttattaaatattttgataatgtggatgtttacactttgcatgatattagcagagtaccactagtaatgcacaaacatgtacaatatggtcattcataaccgatttttatagaatactttttacatgtgcaactccatccgttatgtaaggattacatgaatattgcacattcccttctggtttcacaaacccatttatacatatttcttagtgaggctcattgtacatgtattgaagctagaatcgagtcaagaaaaataaagccccattctccaactgcaaaatgtgctttcccataatgaacactagtcaccagcacagaataatctccaacattttctaaattctaattgccaactgtttctatttatatttgatttatatttcatttggagtctgttacatggcagcttaggcagactagatcttgttttttccaatgcagcataatgagtatgatctatttcttttcaaataatctttgagatcccaggaaaaaaaaaatgctctgctccattgagctataatgtaaatgtgtttgtttaaaaaacaggtgaggcaagtgagtgatttattgttcctgaggaagtatatctgattttttttctcatactccaaaagctagtccctactctttaataaaaataatgggtaactttttgtttttcactagcgaacttccatgacatttcctttctatgtagtgtgattaatgcaatacatattatagttatctatacacagtgtaagatttaacaaactgaaatgatccacctcatatgtgagtccgtccaaaagatgttactgctctgggtgggccagtgttctatatcggttatactaactttcatttaaagtatttattctaaaatgcctctgagaaacagtaaaaaataaaaacaacaagttgtctaaaatgcaacagcttttatagtaaatgtacatttataaataaaatactcaaatcaaaaaaaaaaac

SEQ ID NO: 314157 - DNA, 1588 bp, Homo sapiens
atttactcacctgggagtagtccaatcacaggaggagcaagctactattattggggaaagggggactatttattctgccttaaatcaatggcaaataagtcaagatgacattttgtgaatgtagactatggatacactcctaatagattgatgtagtcataaaagggggtcaagtagatgtttttctgttatgtaagcaataatttttccgtgtcttattgagtatggctagcgattatttattacatgctagatgggttctttgcatgtgggttccatataggtgcagaaatttcctcagccactggagggatttcgaccatatttgtcatttggatgagctgttattagattgaaatctacacatcatttcattaaaaattgtgccttagaaaacgcaaagctgttgcacatggcgataaattatggatgcagtacattgaagagagatgaagtcacttccaagtttccaagacttctcatggaggtgtttgctgttttacaggaaaaaataaaaataaaaaaagaaaaaaagaaaaaattaaaaagaaaaattgttttgaaaatgtacagatcaagtccaatattttgattatccacctgcatgttttattaaatattttgataatgtggatgtttacactttgcatgatattagcagagtaccactagtaatgcacaaacatgtacaatatggtcattcataaccgatttttatagaatactttttacatgtgcaactccatccgttatgtaaggattacatgaatattgcacattcccttctggtttcacaaacccatttatacatatttcttagtgaggctcattgtacatgtattgaagctagaatcgagtcaagaaaaataaagccccattctccaactgcaaaatgtgctttcccataatgaacactagtcaccagcacagaataatctccaacattttctaaattctaattgccaactgtttctatttatatttgatttatatttcatttggagtctgttacatggcagcttaggcagactagatcttgttttttccaatgcagcataatgagtatgatctatttcttttcaaataatctttgagatcccaggaaaaaaaaaatgctctgctccattgagctataatgtaaatgtgtttgtttaaaaaacaggtgaggcaagtgagtgatttattgttcctgaggaagtatatctgattttttttctcatactccaaaagctagtccctactctttaataaaaataatgggtaactttttgtttttcactagcgaacttccatgacatttcctttctatgtagtgtgattaatgcaatacatattatagttatctatacacagtgtaagatttaacaaactgaaatgatccacctcatatgtgagtccgtccaaaagatgttactgctctgggtgggccagtgttctatatcggttatactaactttcatttaaagtatttattctaaaatgcctctgagaaacagtaaaaaataaaaacaacaagttgtctaaaatgcaacagcttttatagtaaatgtacatttataaataaaatactcaaatcaaaaaaaaaaac

SEQ ID NO: 314158 - DNA, 3284 bp, Homo sapiens
attcggcacaggcgtaatacagttttacttcatggaacaccgccctctttccccacaaattctacccaggttataccttttaattatcttaattttattttttaaatgcatttccaagtgagaggagcctggggttcaaataccatttttctagctcttctttaaacctattttggcacctacatataaaatgatattgacccgattcagtgacatcactgaagacaaagacggtcacattttggcgtttgcggcaaaaggaggcggtggggtgccagcacgcccaccccccgcccagggccagaacacaccgcccagttcacgcgctgtgcgcagcccgggaagggggcagttttccaagcccggtagcgcccccacgcggcaggaagcccaggcgccggagacgcgacggggctgatcgcggtccctcttgtgttcgctctctccacactcaggagcaccagcatgtttgacatgcggtgtgaggaggaggccgcggtgcagccgcacagcagggcccgccaggagcagctgcagctgataaataaccagctgagggaagaggacgacaaatggcaagatgacctggctcgttggaagagtcgtagaagaagtgtttctcaggacttaatcaagaaagaggaagaaaggaaaaaaatggagaagttactggctggagaagatgggacaagtgaacgaaggaaaagcatcaaaacctacagagaaattgttcaagaaaaagagcggagagagagagagctgcatgaagcatataagaacgctcggtcccaggaggaggcagaggggatccttcaacagtacattgagaggttcaccatcagtgaggctgttctcgaacgcttggagatgccaaaaattctggaaagaagccattcaacagagccaaatttatcctccttcctgaatgaccccaatcccatgaaatacctgcggcaacagtcactgcctccacccaaattcactgccactgttgaaaccaccattgctcgtgccagtgttctggataccagcatgtcagcaggcagtgggtctccaagcaaaactgtcactcccaaagcagtgcctatgctgacacccaagccttactcccagcccaaaaattctcaagatgttctgaagacctttaaggtagacgggaaagtcagtgtgaatggagagacggttcatagagaggaggagaaggaaagagagtgtcccacggtggcacctgcccactccttaaccaaatcccagatgtttgaaggtgtggccagagtgcacgggtctccactggagctgaaacaagacaacggtagcatcgagatcaacataaagaagccaaactctgttccccaagagctcgcagcaaccactgagaaaacggaaccgaatagtcaagaggacaagaatgatggtggaaaatcaagaaaagggaatatagaacttgcctcatcagaaccacagcattttacaacaactgtgactcgatgcagcccgaccgtggcctttgtggaatttccctccagcccccagctgaagaatgatgtgtcggaagaaaaagaccagaagaaaccagaaaatgaaatgagtggaaaggtggagttggtgctgtcacaaaaggtggtaaagccaaaatctccagaacccgaagcaacgctgacatttccatttctggacaaaatgcctgaagccaaccaactacatttgccaaatctcaattctcaagtggattctccaagcagtgagaagtcacctgttatgacaccttttaagttctgggcatgggacccagaagaggagcgcaggcgacaggaaaaatggcaacaggaacaggaacgtttgctccaggagagataccagaaggagcaggacaagctgaaagaagagtgggaaaaggcccaaaaggaggtggaagaggaagaacgcagatactatgaggaggagcgtaagataattgaagacactgtggttccatttactgtttcttcaagttccgctgaccagctgtctacctcttcctccatgactgaaggcagtgggacaatgaataagatagacctgggaaactgtcaagatgaaaaacaagacagaagatggaagaaatcattccagggagatgacagtgacttattgctgaagactagggaaagtgatcgactggaggagaagggcagcctaactgaaggggccttggctcattctgggaaccctgtatcaaaaggagtccatgaagaccatcagctggataccgaggctggggccccacactgtggaacaaacccacagcttgctcaggatccatcccagaatcagcagacatcaaatccaacgcacagttcagaagatgtgaagccaaaaaccctcccgctggataaaagcattaaccatcagatcgagtctcccagtgaaaggcggaagtctataagtggaaagaagctgtgctcttcctgtgggcttcctttgggtaaaggagctgcaatgatcatcgagaccctcaatctctattttcacatccagtgtttcaggtgtggaatttgtaaaggccagcttggagatgcagtgagtgggacggatgttaggattcgaaatggtctcctgaactgtaatgattgctacatgcgatccagaagtgccgggcagcctacaacattgtgacacggctttcaagcttccggatcactcaccatttctttactgagagtgtcccctggcaactgcttaacaaaatcccaagctcaggggcttctcagcatttacctaatttctgaaaggctcttctgaaaggtggtatctgttctttcgtagcacagtgtttatgtttttcctgtttattgttttggttttttttttttttttgcatttgcacagtatacacaaaagaatatggggttgtaatgatcctgaatagctcaaaaaaggttttagcatggtcaaacaggcttatggtttaaaatgtgttattctcttctttgggaattagctaaatgatgcaataaacctgttttgttttagaatgtctaggaattaaacactttatgtttacagaattgagctgcagaaagtgcaagacatgccaatttgagacacacggtcttctaagactgaaggataaatttaatgcatttcagaaactaaacatcacagcaagctctatctctgagctataatttgtttttaatgcaaagacactagtttgataatatatactgtaatcctgaaacatttgtgttacttacctttggaggtagaaattataccaataaattattgcaccgttagtatta

SEQ ID NO: 314159 - DNA, 1018 bp, Homo sapiens
attcggcacaggcgtaatacagttttacttcatggaacaccgccctctttccccacaaattctacccaggttataccttttaattatcttaattttattttttaaatgcatttccaagtgagaggagcctggggttcaaataccatttttctagctcttctttaaacctattttggcacctacatataaaatgatattgacccgattcagtgacatcactgaagacaaagacggtcacattttggcgtttgcggcaaaaggaggcggtggggtgccagcacgcccaccccccgcccagggccagaacacaccgcccagttcacgcgctgtgcgcagcccgggaagggggcagttttccaagcccggtagcgcccccacgcggcaggaagcccaggcgccggagacgcgacggggctgatcgcggtccctcttgtgttcgctctctccacactcaggagcaccagcatgtttgacatgcggtgtgaggaggaggccgcggtgcagccgcacagcagggcccgccaggagcagctgcagctgataaataaccagctgagggaagaggacgacaaatggcaagatgacctggctcgttggaagagtcgtagaagaagtgtttctcaggacttaatcaagaaagaggaagaaaggaaaaaaatggagaagttactggctggagaagatgggacaagtgaacgaaggaaaagcatcaaaacctacagagaaattgttcaagaaaaagagcggagagagagagagctgcatgaagcatataagaacgctcggtcccaggaggaggcagaggggatccttcaacagtacattgagaggttcaccatcagtgaggctgttctcgaacgcttggagatgccaaaaattctggaaagaaaagaacgcgttctttcattgcagggctgacaaagactgaacaggatgttattcttgcagctaaggacatttgccttttgaccttttttcggctatgaaacagctattgggtagggaatttttatcggga

SEQ ID NO: 314160 - DNA, 407 bp, Homo sapiens
tctgagcacactgtcattcagcttatattgccaggacgggatatggactgaatgtacttcatggcattgcagaataaatggtcctatagatatttgattttcttttccttctgtacgtttctggatgtaactccattgcagaaccacagcattttacaacaactgtgactcgatgcagcccgaccgtggcctttgtggaatttccctccagcccccagctgaagaatgatgtgtcggaagaaaaagaccagaagaaaccagaaaatgaaatgagtggaaaggtggagttggtgctgtcacaaaaggtgaagtgcagagtggaggaaagcggttaaacccacaagttaacatggccccatattacagctagctgctgctgtggcagttgtgaataatgaagatttatt

SEQ ID NO: 314161 - DNA, 5524 bp, Homo sapiens
attcggcacaggcgtaatacagttttacttcatggaacaccgccctctttccccacaaattctacccaggttataccttttaattatcttaattttattttttaaatgcatttccaagtgagaggagcctggggttcaaataccatttttctagctcttctttaaacctattttggcacctacatataaaatgatattgacccgattcagtgacatcactgaagacaaagacggtcacattttggcgtttgcggcaaaaggaggcggtggggtgccagcacgcccaccccccgcccagggccagaacacaccgcccagttcacgcgctgtgcgcagcccgggaagggggcagttttccaagcccggtagcgcccccacgcggcaggaagcccaggcgccggagacgcgacggggctgatcgcggtccctcttgtgttcgctctctccacactcaggagcaccagcatgtttgacatgcggtgtgaggaggaggccgcggtgcagccgcacagcagggcccgccaggagcagctgcagctgataaataaccagctgagggaagaggacgacaaatggcaagatgacctggctcgttggaagagtcgtagaagaagtgtttctcaggacttaatcaagaaagaggaagaaaggaaaaaaatggagaagttactggctggagaagatgggacaagtgaacgaaggaaaagcatcaaaacctacagagaaattgttcaagaaaaagagcggagagagagagagctgcatgaagcatataagaacgctcggtcccaggaggaggcagaggggatccttcaacagtacattgagaggttcaccatcagtgaggctgttctcgaacgcttggagatgccaaaaattctggaaagaagccattcaacagagccaaatttatcctccttcctgaatgaccccaatcccatgaaatacctgcggcaacagtcactgcctccacccaaattcactgccactgttgaaaccaccattgctcgtgccagtgttctggataccagcatgtcagcaggcagtgggtctccaagcaaaactgtcactcccaaagcagtgcctatgctgacacccaagccttactcccagcccaaaaattctcaagatgttctgaagacctttaaggtagacgggaaagtcagtgtgaatggagagacggttcatagagaggaggagaaggaaagagagtgtcccacggtggcacctgcccactccttaaccaaatcccagatgtttgaaggtgtggccagagtgcacgggtctccactggagctgaaacaagacaacggtagcatcgagatcaacataaagaagccaaactctgttccccaagagctcgcagcaaccactgagaaaacggaaccgaatagtcaagaggacaagaatgatggtggaaaatcaagaaaagggaatatagaacttgcctcatcagaaccacagcattttacaacaactgtgactcgatgcagcccgaccgtggcctttgtggaatttccctccagcccccagctgaagaatgatgtgtcggaagaaaaagaccagaagaaaccagaaaatgaaatgagtggaaaggtggagttggtgctgtcacaaaaggtggtaaagccaaaatctccagaacccgaagcaacgctgacatttccatttctggacaaaatgcctgaagccaaccaactacatttgccaaatctcaattctcaagtggattctccaagcagtgagaagtcacctgttatgacaccttttaagttctgggcatgggacccagaagaggagcgcaggcgacaggaaaaatggcaacaggaacaggaacgtttgctccaggagagataccagaaggagcaggacaagctgaaagaagagtgggaaaaggcccaaaaggaggtggaagaggaagaacgcagatactatgaggaggagcgtaagataattgaagacactgtggttccatttactgtttcttcaagttccgctgaccagctgtctacctcttcctccatgactgaaggcagtgggacaatgaataagatagacctgggaaactgtcaagatgaaaaacaagacagaagatggaagaaatcattccagggagatgacagtgacttattgctgaagactagggaaagtgatcgactggaggagaagggcagcctaactgaaggggccttggctcattctgggaaccctgtatcaaaaggagtccatgaagaccatcagctggataccgaggctggggccccacactgtggaacaaacccacagcttgctcaggatccatcccagaatcagcagacatcaaatccaacgcacagttcagaagatgtgaagccaaaaaccctcccgctggataaaagcattaaccatcagatcgagtctcccagtgaaaggcggaagtctataagtggaaagaagctgtgctcttcctgtgggcttcctttgggtaaaggagctgcaatgatcatcgagaccctcaatctctattttcacatccagtgtttcaggtgtggaatttgtaaaggccagcttggagatgcagtgagtgggacggatgttaggattcgaaatggtctcctgaactgtaatgattgctacatgcgatccagaagtgccgggcagcctacaacattgtgacacggctttcaagcttccggatcactcaccatttctttactgagagtgtcccctggcaactgcttaacaaaatcccaagctcaggggcttctcagcatttacctaatttctgaaaggctcttctgaaaggtggtatctgttctttcgtagcacagtgtttatgtttttcctgtttattgttttggttttttttttttttttgcatttgcacagtatacacaaaagaatatggggttgtaatgatcctgaatagctcaaaaaaggttttagcatggtcaaacaggcttatggtttaaaatgtgttattctcttctttgggaattagctaaatgatgcaataaacctgttttgttttagaatgtctaggaattaaacactttatgtttacagaattgagctgcagaaagtgcaagacatgccaatttgagacacacggtcttctaagactgaaggataaatttaatgcatttcagaaactaaacatcacagcaagctctatctctgagctataatttgtttttaatgcaaagacactagtttgataatatatactgtaatcctgaaacatttgtgttacttacctttggaggtagaaattataccaataaattattgcaccgttagtattagattctgtgtaccttggaagttatgtcattaatataggctggttcatcaaataaagcaaaaccttgcaatatcagctagatttacactccgggacgttgcccaaaggtaggaagaaagcagagggaaatatttcagtcatcatttccaaagtcattatcaaaatctgtgaggaagtttaatcttccaaagagtcaatgtcagacatcaggcctctgttgcctgcttctctcgaggcactagattaggagtcttcaataagagacttaacatgaggtatatggaagatgaggcaccgagataagttcatcattaggtgtgagcactgctcacccttgctggcaagttctccttaagggcctgaagcacaggtgtccaaagaaaagcgttaagtccatcttaatagaatctatgtggtatatgatgtggtcagcccctggtctgtgatcagcaagaacctacagcacagattatgccctgcccacttcaatgaatacctactctcctccattctccatcactttttttgctatcaagaactccggaccttgcccatggagaagtttagagaggaactcttgtggagagctggtttattttctgccctgtgcgacgagtttcagctggccaagaaaggagtcaagttattaaaaagcatcacaatgtagatctccaggctggttttttgttttttgttgttaagactggggaaagggggactatttattctgccttaaatcaatggcaaataagtcaagatgacattttgtgaatgtagactatggatacactcctaatagattgatgtagtcataaaagggggtcaagtagatgtttttctgttatgtaagcaataatttttccgtgtcttattgagtatggctagcgattatttattacatgctagatgggttctttgcatgtgggttccatataggtgcagaaatttcctcagccactggagggatttcgaccatatttgtcatttggatgagctgttattagattgaaatctacacatcatttcattaaaaattgtgccttagaaaacgcaaagctgttgcacatggcgataaattatggatgcagtacattgaagagagatgaagtcacttccaagtttccaagacttctcatggaggtgtttgctgttttacaggaaaaaataaaaataaaaaaagaaaaaaagaaaaaattaaaaagaaaaattgttttgaaaatgtacagatcaagtccaatattttgattatccacctgcatgttttattaaatattttgataatgtggatgtttacactttgcatgatattagcagagtaccactagtaatgcacaaacatgtacaatatggtcattcataaccgatttttatagaatactttttacatgtgcaactccatccgttatgtaaggattacatgaatattgcacattcccttctggtttcacaaacccatttatacatatttcttagtgaggctcattgtacatgtattgaagctagaatcgagtcaagaaaaataaagccccattctccaactgcaaaatgtgctttcccataatgaacactagtcaccagcacagaataatctccaacattttctaaattctaattgccaactgtttctatttatatttgatttatatttcatttggagtctgttacatggcagcttaggcagactagatcttgttttttccaatgcagcataatgagtatgatctatttcttttcaaataatctttgagatcccaggaaaaaaaaaatgctctgctccattgagctataatgtaaatgtgtttgtttaaaaaacaggtgaggcaagtgagtgatttattgttcctgaggaagtatatctgattttttttctcatactccaaaagctagtccctactctttaataaaaataatgggtaactttttgtttttcactagcgaacttccatgacatttcctttctatgtagtgtgattaatgcaatacatattatagttatctatacacagtgtaagatttaacaaactgaaatgatccacctcatatgtgagtccgtccaaaagatgttactgctctgggtgggccagtgttctatatcggttatactaactttcatttaaagtatttattctaaaatgcctctgagaaacagtaaaaaataaaaacaacaagttgtctaaaatgcaacagcttttatagtaaatgtacatttataaataaaatactcaaatcaaaaaaaaaaac

SEQ ID NO: 314162 - DNA, 5395 bp, Homo sapiens
cgctctcggcagacgccttcaccagatgtagtcctcaggggaagcagcgatgggagaggaagcgactctgaatccgacttgcctcatcggaagctgccagatgtgaagaaggatgacatgtctgcacggcggacttcccatggtgagccgaaatcagcagtgccttttaaccagtacctcccgaacaaaagcaatcagacggcctacgtccccgcgcctctgagaaagaagaaagcagagagagaggaataccgcaagagctggagtaccgccacctccccgctgggtggggagaggcccttcagatacggtccgagaactcctgtgtctgatgacgcagagagcaccagcatgtttgacatgcggtgtgaggaggaggccgcggtgcagccgcacagcagggcccgccaggagcagctgcagctgataaataaccagctgagggaagaggacgacaaatggcaagatgacctggctcgttggaagagtcgtagaagaagtgtttctcaggacttaatcaagaaagaggaagaaaggaaaaaaatggagaagttactggctggagaagatgggacaagtgaacgaaggaaaagcatcaaaacctacagagaaattgttcaagaaaaagagcggagagagagagagctgcatgaagcatataagaacgctcggtcccaggaggaggcagaggggatccttcaacagtacattgagaggttcaccatcagtgaggctgttctcgaacgcttggagatgccaaaaattctggaaagaagccattcaacagagccaaatttatcctccttcctgaatgaccccaatcccatgaaatacctgcggcaacagtcactgcctccacccaaattcactgccactgttgaaaccaccattgctcgtgccagtgttctggataccagcatgtcagcaggcagtgggtctccaagcaaaactgtcactcccaaagcagtgcctatgctgacacccaagccttactcccagcccaaaaattctcaagatgttctgaagacctttaaggtagacgggaaagtcagtgtgaatggagagacggttcatagagaggaggagaaggaaagagagtgtcccacggtggcacctgcccactccttaaccaaatcccagatgtttgaaggtgtggccagagtgcacgggtctccactggagctgaaacaagacaacggtagcatcgagatcaacataaagaagccaaactctgttccccaagagctcgcagcaaccactgagaaaacggaaccgaatagtcaagaggacaagaatgatggtggaaaatcaagaaaagggaatatagaacttgcctcatcagaaccacagcattttacaacaactgtgactcgatgcagcccgaccgtggcctttgtggaatttccctccagcccccagctgaagaatgatgtgtcggaagaaaaagaccagaagaaaccagaaaatgaaatgagtggaaaggtggagttggtgctgtcacaaaaggtggtaaagccaaaatctccagaacccgaagcaacgctgacatttccatttctggacaaaatgcctgaagccaaccaactacatttgccaaatctcaattctcaagtggattctccaagcagtgagaagtcacctgttatgacaccttttaagttctgggcatgggacccagaagaggagcgcaggcgacaggaaaaatggcaacaggaacaggaacgtttgctccaggagagataccagaaggagcaggacaagctgaaagaagagtgggaaaaggcccaaaaggaggtggaagaggaagaacgcagatactatgaggaggagcgtaagataattgaagacactgtggttccatttactgtttcttcaagttccgctgaccagctgtctacctcttcctccatgactgaaggcagtgggacaatgaataagatagacctgggaaactgtcaagatgaaaaacaagacagaagatggaagaaatcattccagggagatgacagtgacttattgctgaagactagggaaagtgatcgactggaggagaagggcagcctaactgaaggggccttggctcattctgggaaccctgtatcaaaaggagtccatgaagaccatcagctggataccgaggctggggccccacactgtggaacaaacccacagcttgctcaggatccatcccagaatcagcagacatcaaatccaacgcacagttcagaagatgtgaagccaaaaaccctcccgctggataaaagcattaaccatcagatcgagtctcccagtgaaaggcggaagtctataagtggaaagaagctgtgctcttcctgtgggcttcctttgggtaaaggagctgcaatgatcatcgagaccctcaatctctattttcacatccagtgtttcaggtgtggaatttgtaaaggccagcttggagatgcagtgagtgggacggatgttaggattcgaaatggtctcctgaactgtaatgattgctacatgcgatccagaagtgccgggcagcctacaacattgtgacacggctttcaagcttccggatcactcaccatttctttactgagagtgtcccctggcaactgcttaacaaaatcccaagctcaggggcttctcagcatttacctaatttctgaaaggctcttctgaaaggtggtatctgttctttcgtagcacagtgtttatgtttttcctgtttattgttttggttttttttttttttttgcatttgcacagtatacacaaaagaatatggggttgtaatgatcctgaatagctcaaaaaaggttttagcatggtcaaacaggcttatggtttaaaatgtgttattctcttctttgggaattagctaaatgatgcaataaacctgttttgttttagaatgtctaggaattaaacactttatgtttacagaattgagctgcagaaagtgcaagacatgccaatttgagacacacggtcttctaagactgaaggataaatttaatgcatttcagaaactaaacatcacagcaagctctatctctgagctataatttgtttttaatgcaaagacactagtttgataatatatactgtaatcctgaaacatttgtgttacttacctttggaggtagaaattataccaataaattattgcaccgttagtattagattctgtgtaccttggaagttatgtcattaatataggctggttcatcaaataaagcaaaaccttgcaatatcagctagatttacactccgggacgttgcccaaaggtaggaagaaagcagagggaaatatttcagtcatcatttccaaagtcattatcaaaatctgtgaggaagtttaatcttccaaagagtcaatgtcagacatcaggcctctgttgcctgcttctctcgaggcactagattaggagtcttcaataagagacttaacatgaggtatatggaagatgaggcaccgagataagttcatcattaggtgtgagcactgctcacccttgctggcaagttctccttaagggcctgaagcacaggtgtccaaagaaaagcgttaagtccatcttaatagaatctatgtggtatatgatgtggtcagcccctggtctgtgatcagcaagaacctacagcacagattatgccctgcccacttcaatgaatacctactctcctccattctccatcactttttttgctatcaagaactccggaccttgcccatggagaagtttagagaggaactcttgtggagagctggtttattttctgccctgtgcgacgagtttcagctggccaagaaaggagtcaagttattaaaaagcatcacaatgtagatctccaggctggttttttgttttttgttgttaagactggggaaagggggactatttattctgccttaaatcaatggcaaataagtcaagatgacattttgtgaatgtagactatggatacactcctaatagattgatgtagtcataaaagggggtcaagtagatgtttttctgttatgtaagcaataatttttccgtgtcttattgagtatggctagcgattatttattacatgctagatgggttctttgcatgtgggttccatataggtgcagaaatttcctcagccactggagggatttcgaccatatttgtcatttggatgagctgttattagattgaaatctacacatcatttcattaaaaattgtgccttagaaaacgcaaagctgttgcacatggcgataaattatggatgcagtacattgaagagagatgaagtcacttccaagtttccaagacttctcatggaggtgtttgctgttttacaggaaaaaataaaaataaaaaaagaaaaaaagaaaaaattaaaaagaaaaattgttttgaaaatgtacagatcaagtccaatattttgattatccacctgcatgttttattaaatattttgataatgtggatgtttacactttgcatgatattagcagagtaccactagtaatgcacaaacatgtacaatatggtcattcataaccgatttttatagaatactttttacatgtgcaactccatccgttatgtaaggattacatgaatattgcacattcccttctggtttcacaaacccatttatacatatttcttagtgaggctcattgtacatgtattgaagctagaatcgagtcaagaaaaataaagccccattctccaactgcaaaatgtgctttcccataatgaacactagtcaccagcacagaataatctccaacattttctaaattctaattgccaactgtttctatttatatttgatttatatttcatttggagtctgttacatggcagcttaggcagactagatcttgttttttccaatgcagcataatgagtatgatctatttcttttcaaataatctttgagatcccaggaaaaaaaaaatgctctgctccattgagctataatgtaaatgtgtttgtttaaaaaacaggtgaggcaagtgagtgatttattgttcctgaggaagtatatctgattttttttctcatactccaaaagctagtccctactctttaataaaaataatgggtaactttttgtttttcactagcgaacttccatgacatttcctttctatgtagtgtgattaatgcaatacatattatagttatctatacacagtgtaagatttaacaaactgaaatgatccacctcatatgtgagtccgtccaaaagatgttactgctctgggtgggccagtgttctatatcggttatactaactttcatttaaagtatttattctaaaatgcctctgagaaacagtaaaaaataaaaacaagtatctccatgaatccttttcctggagggcacccttcggcagacagagaagacatggtaga

SEQ ID NO: 314163 - DNA, 4331 bp, Homo sapiens
cgtgacccttactaaaaacttaagttcttcatagtgtggttataggacgtgatttgtgttgcttgttgttcaataccatgaaagagctttgggaattccagcatcttaggctcttttatatctctgagcacactgtcattcagcttatattgccaggacgggatatggactgaatgtacttcatggcattgcagaataaatggtcctatagatatttgattttcttttccttctgtacgtttctggatgtaactccattgcagaaccacagcattttacaacaactgtgactcgatgcagcccgaccgtggcctttgtggaatttccctccagcccccagctgaagaatgatgtgtcggaagaaaaagaccagaagaaaccagaaaatgaaatgagtggaaaggtggagttggtgctgtcacaaaaggtggtaaagccaaaatctccagaacccgaagcaacgctgacatttccatttctggacaaaatgcctgaagccaaccaactacatttgccaaatctcaattctcaagtggattctccaagcagtgagaagtcacctgttatgacaccttttaagttctgggcatgggacccagaagaggagcgcaggcgacaggaaaaatggcaacaggaacaggaacgtttgctccaggagagataccagaaggagcaggacaagctgaaagaagagtgggaaaaggcccaaaaggaggtggaagaggaagaacgcagatactatgaggaggagcgtaagataattgaagacactgtggttccatttactgtttcttcaagttccgctgaccagctgtctacctcttcctccatgactgaaggcagtgggacaatgaataagatagacctgggaaactgtcaagatgaaaaacaagacagaagatggaagaaatcattccagggagatgacagtgacttattgctgaagactagggaaagtgatcgactggaggagaagggcagcctaactgaaggggccttggctcattctgggaaccctgtatcaaaaggagtccatgaagaccatcagctggataccgaggctggggccccacactgtggaacaaacccacagcttgctcaggatccatcccagaatcagcagacatcaaatccaacgcacagttcagaagatgtgaagccaaaaaccctcccgctggataaaagcattaaccatcagatcgagtctcccagtgaaaggcggaagtctataagtggaaagaagctgtgctcttcctgtgggcttcctttgggtaaaggagctgcaatgatcatcgagaccctcaatctctattttcacatccagtgtttcaggtgtggaatttgtaaaggccagcttggagatgcagtgagtgggacggatgttaggattcgaaatggtctcctgaactgtaatgattgctacatgcgatccagaagtgccgggcagcctacaacattgtgacacggctttcaagcttccggatcactcaccatttctttactgagagtgtcccctggcaactgcttaacaaaatcccaagctcaggggcttctcagcatttacctaatttctgaaaggctcttctgaaaggtggtatctgttctttcgtagcacagtgtttatgtttttcctgtttattgttttggttttttttttttttttgcatttgcacagtatacacaaaagaatatggggttgtaatgatcctgaatagctcaaaaaaggttttagcatggtcaaacaggcttatggtttaaaatgtgttattctcttctttgggaattagctaaatgatgcaataaacctgttttgttttagaatgtctaggaattaaacactttatgtttacagaattgagctgcagaaagtgcaagacatgccaatttgagacacacggtcttctaagactgaaggataaatttaatgcatttcagaaactaaacatcacagcaagctctatctctgagctataatttgtttttaatgcaaagacactagtttgataatatatactgtaatcctgaaacatttgtgttacttacctttggaggtagaaattataccaataaattattgcaccgttagtattagattctgtgtaccttggaagttatgtcattaatataggctggttcatcaaataaagcaaaaccttgcaatatcagctagatttacactccgggacgttgcccaaaggtaggaagaaagcagagggaaatatttcagtcatcatttccaaagtcattatcaaaatctgtgaggaagtttaatcttccaaagagtcaatgtcagacatcaggcctctgttgcctgcttctctcgaggcactagattaggagtcttcaataagagacttaacatgaggtatatggaagatgaggcaccgagataagttcatcattaggtgtgagcactgctcacccttgctggcaagttctccttaagggcctgaagcacaggtgtccaaagaaaagcgttaagtccatcttaatagaatctatgtggtatatgatgtggtcagcccctggtctgtgatcagcaagaacctacagcacagattatgccctgcccacttcaatgaatacctactctcctccattctccatcactttttttgctatcaagaactccggaccttgcccatggagaagtttagagaggaactcttgtggagagctggtttattttctgccctgtgcgacgagtttcagctggccaagaaaggagtcaagttattaaaaagcatcacaatgtagatctccaggctggttttttgttttttgttgttaagactggggaaagggggactatttattctgccttaaatcaatggcaaataagtcaagatgacattttgtgaatgtagactatggatacactcctaatagattgatgtagtcataaaagggggtcaagtagatgtttttctgttatgtaagcaataatttttccgtgtcttattgagtatggctagcgattatttattacatgctagatgggttctttgcatgtgggttccatataggtgcagaaatttcctcagccactggagggatttcgaccatatttgtcatttggatgagctgttattagattgaaatctacacatcatttcattaaaaattgtgccttagaaaacgcaaagctgttgcacatggcgataaattatggatgcagtacattgaagagagatgaagtcacttccaagtttccaagacttctcatggaggtgtttgctgttttacaggaaaaaataaaaataaaaaaagaaaaaaagaaaaaattaaaaagaaaaattgttttgaaaatgtacagatcaagtccaatattttgattatccacctgcatgttttattaaatattttgataatgtggatgtttacactttgcatgatattagcagagtaccactagtaatgcacaaacatgtacaatatggtcattcataaccgatttttatagaatactttttacatgtgcaactccatccgttatgtaaggattacatgaatattgcacattcccttctggtttcacaaacccatttatacatatttcttagtgaggctcattgtacatgtattgaagctagaatcgagtcaagaaaaataaagccccattctccaactgcaaaatgtgctttcccataatgaacactagtcaccagcacagaataatctccaacattttctaaattctaattgccaactgtttctatttatatttgatttatatttcatttggagtctgttacatggcagcttaggcagactagatcttgttttttccaatgcagcataatgagtatgatctatttcttttcaaataatctttgagatcccaggaaaaaaaaaatgctctgctccattgagctataatgtaaatgtgtttgtttaaaaaacaggtgaggcaagtgagtgatttattgttcctgaggaagtatatctgattttttttctcatactccaaaagctagtccctactctttaataaaaataatgggtaactttttgtttttcactagcgaacttccatgacatttcctttctatgtagtgtgattaatgcaatacatattatagttatctatacacagtgtaagatttaacaaactgaaatgatccacctcatatgtgagtccgtccaaaagatgttactgctctgggtgggccagtgttctatatcggttatactaactttcatttaaagtatttattctaaaatgcctctgagaaacagtaaaaaataaaaacaacaagttgtctaaaatgcaacagcttttatagtaaatgtacatttataaataaaatactcaaatcaaaaaaaaaaac

SEQ ID NO: 314164 - DNA, 1907 bp, Homo sapiens
attcggcacaggcgtaatacagttttacttcatggaacaccgccctctttccccacaaattctacccaggttataccttttaattatcttaattttattttttaaatgcatttccaagtgagaggagcctggggttcaaataccatttttctagctcttctttaaacctattttggcacctacatataaaatgatattgacccgattcagtgacatcactgaagacaaagacggtcacattttggcgtttgcggcaaaaggaggcggtggggtgccagcacgcccaccccccgcccagggccagaacacaccgcccagttcacgcgctgtgcgcagcccgggaagggggcagttttccaagcccggtagcgcccccacgcggcaggaagcccaggcgccggagacgcgacggggctgatcgcggtccctcttgtgttcgctctctccacactcaggagcaccagcatgtttgacatgcggtgtgaggaggaggccgcggtgcagccgcacagcagggcccgccaggagcagctgcagctgataaataaccagctgagggaagaggacgacaaatggcaagatgacctggctcgttggaagagtcgtagaagaagtgtttctcaggacttaatcaagaaagaggaagaaaggaaaaaaatggagaagttactggctggagaagatgggacaagtgaacgaaggaaaagcatcaaaacctacagagaaattgttcaagaaaaagagcggagagagagagagctgcatgaagcatataagaacgctcggtcccaggaggaggcagaggggatccttcaacagtacattgagaggttcaccatcagtgaggctgttctcgaacgcttggagatgccaaaaattctggaaagaagccattcaacagagccaaatttatcctccttcctgaatgaccccaatcccatgaaatacctgcggcaacagtcactgcctccacccaaattcactgccactgttgaaaccaccattgctcgtgccagtgttctggataccagcatgtcagcaggcagtgggtctccaagcaaaactgtcactcccaaagcagtgcctatgctgacacccaagccttactcccagcccaaaaattctcaagatgttctgaagacctttaaggtagacgggaaagtcagtgtgaatggagagacggttcatagagaggaggagaaggaaagagagtgtcccacggtggcacctgcccactccttaaccaaatcccagatgtttgaaggtgtggccagagtgcacgggtctccactggagctgaaacaagacaacggtagcatcgagatcaacataaagaagccaaactctgttccccaagagctcgcagcaaccactgagaaaacggaaccgaatagtcaagaggacaagaatgatggtggaaaatcaagaaaagggaatatagaacttgcctcatcagaaccacagcattttacaacaactgtgactcgatgcagcccgaccgtggcctttgtggaatttccctccagcccccagctgaagaatgatgtgtcggaagaaaaagaccagaagaaaccagaaaatgaaatgagtggaaaggtggagttggtgctgtcacaaaaggtggtaaagccaaaatctccagaacccgaagcaacgctgacatttccatttctggacaaaatgcctgaagccaaccaactacatttgccaaatctcaattctcaagtggattctccaagcagtgagaagtcacctgttatgacaccttttaagttctgggcatgggacccagaagaggagcgcaggcgacaggaaaaatggcaacaggaacaggaacgtttgctccaggagagataccagaagggtcacagaccctggaggagcagctctgaagcaccttctgaggg

SEQ ID NO: 314165 - DNA, 2100 bp, Homo sapiens
aaatgatgctaagcataacgtagatgagacgccaggctgaaccaggggaaggctggcattgttagtgtccccaactagcagtccacctttatctgtggcagctataaatgtacaggacccatcagagtcctaagaaaatgagagtaattatctctggcatcatccacatttccgactctttccaatctcttttccctttttctgtaatgtacccagcatccccctattgtattttggttgcccaagattcttgattctttgagtgtgtagtagcatttcttaaaatgagatcatcagaccaacccttgattcacatgaaagctgtaatgacacaacaaagagaaggcgacagttttaaagtataattgtcagccaaatgtgtattttatatttggttcatagaatatatctagatgtggggaaagtctcctatttggtaatttagttaaaatgtaaatgttatatcacagcatatgttggtatgttttggagtgtgcttccattgtgctcagcttttgaaaagtttgaaatccactttagtcaaatgtagtcaatgggatttccagagatacatattgtttttcttagtgtaccacacactccttgaaggcagatactgtacttaatatatcactgtcttccataatactgccctaggtctttttagtttttaagagaccgggtctcgctatgtttcccatgctgaactcaaatgcctgggcttaagcaatcctcccacctcagcctctggagtagctgggactacaggggcatgcaccaccaggcctggcttcctaggagggtctttaaagagaaaatatttgttcaattgaaaacaggattcttgtcatctacaactccaacacagcctgaaaatatccacattataacctggaccttagacctactttctccactatcctgcaaagctacatctgtaactacctattggctatctatatgagtcctcaagcatctcagactttacatgaataaaactcaacttccttcccattcaaatctgtttattttcttctgtaagagaaagataccatttgagactccagaatctgcctctaactctcaacaagactctgcaattactcaagtatcctttccatcctcattgccctgctgttattacataggccctggttcaagtccttgttacttgttcccattattgcaataacttctaattccaatgccgttgtgtgatcccattttaaacacggccagagcagtcttccaacaacatagctctaatctagtttcatccccacttttacatgcttcagtggctttcccagtgacttggcatggaacacgtcctcagttgccatacattccagctaactcttacccaacctttctttgttcacacagtttccttttccttcctcattgacccatccgcatctctgtttatccaagacttctctgtgatagctgacccttagtctttctctcccctattcctccagactagatcctgtctccttcctgcagccccgacacagccttcagttcatatcttttgcatgatgcttagcaccttctatccctaaggacaacttactcatttgagatttctggcagggtaccttgcatgcagtggacactcagtatttgctgaattaaattccttcctatggatcccttctgattttttttaagtgcctctaatacacatatcattctagggctcatgccacttttaatgtcattttctaaaggaaaatcttatctatgatattttcccttataagagatagttgttttgagtagggttttttaaaagataaaggtagtaggaaattttttaaagcctaaatatcaaattcctttccctttggagttgggggaaggaatgaagggggagcaacttgctctttcatatgagttggtcatagcatgtaagaaccaatcttgaaatatcgttttttttttaatggcttataatgtatttctagaaatactttgtacttaaaatgataacagtttgtatctttttgtccatataaagatactttataaataaaaaaattagcattgtaaataatgttaatatgtatttatacaaaataaatttactataat

SEQ ID NO: 314166 - DNA, 654 bp, Homo sapiens
aaatgatgctaagcataacgtagatgagacgccaggctgaaccaggggaaggctggcattgttagtgtccccaactagcagtccacctttatctgtggcagctataaatgtacaggacccatcagagtcctaagaaaatgagagtaattatctctggcatcatccacatttccgactctttccaatctcttttccctttttctgtaatgtacccagcatccccctattgtattttggttgcccaagattcttgattctttgagtgtgtagtagcatttcttaaaatgagatcatcagaccaacccttgattcacatgaaagctgtaatgacacaacaaagagaaggcgacagttttaaagtataattgtcagccaaatgtgtattttatatttggttcatagaatatatctagatgtggggaaagtctcctatttggtaatttagttaaaatgtaaatgttatatcacagcatatgttggtatgttttggagtgtgcttccattgtgctcagcttttgaaaagtttgaaaccccatctctattaaaaatacaagaattagccggtcgtggtggtacatggctgtagtcctagctattcagcaggctgaggcaggagcatcgcttgaacccaggaggcagaggttgcagtgagcc

SEQ ID NO: 314167 - DNA, 2602 bp, Homo sapiens
aaatgatgctaagcataacgtagatgagacgccaggctgaaccaggggaaggctggcattgttagtgtccccaactagcagtccacctttatctgtggcagctataaatgtacaggacccatcagagtcctaagaaaatgagagtaattatctctggcatcatccacatttccgactctttccaatctcttttccctttttctgtaatgtacccagcatccccctattgtattttggttgcccaagattcttgattctttgagtgtgtagtagcatttcttaaaatgagatcatcagaccaacccttgattcacatgaaagctgtaatgacacaacaaagagaaggcgacagttttaaagtataattgtcagccaaatgtgtattttatatttggttcatagaatatatctagatgtggggaaagtctcctatttggtaatttagttaaaatgtaaatgttatatcacagcatatgttggtatgttttggagtgtgcttccattgtgctcagcttttgaaaagtttgaaatccactttagtcaaatgtagtcaatgggatttccagagatacatattgtttttcttagtgtaccacacactccttgaaggcagatactgtacttaatatatcactgtcttccataatactgccctaggtctttttagtttttaagagaccgggtctcgctatgtttcccatgctgaactcaaatgcctgggcttaagcaatcctcccacctcagcctctggagtagctgggactacaggggcatgcaccaccaggcctggcttcctaggagggtctttaaagagaaaatatttgttcaattgaaaacaggattcttgtcatctacaactccaacacagcctgaaaatatccacattataacctggaccttagacctactttctccactatcctgcaaagctacatctgtaactacctattggctatctatatgagtcctcaagcatctcagactttacatgaataaaactcaacttccttcccattcaaatctgtttattttcttctgtaagagaaagataccatttgagactccagaatctgcctctaactctcaacaagactctgcaattactcaagtatcctttccatcctcattgccctgctgttattacataggccctggttcaagtccttgttacttgttcccattattgcaataacttctaattccaatgccgttgtgtgatcccattttaaacacggccagagcagtcttccaacaacatagctctaatctagtttcatccccacttttacatgcttcagtggctttcccagtgacttggcatggaacacgtcctcagttgccatacattccagctaactcttacccaacctttctttgttcacacagtttccttttccttcctcattgacccatccgcatctctgtttatccaagacttctctgtgatagctgacccttagtctttctctcccctattcctccagactagatcctgtctccttcctgcagccccgacacagccttcagttcatatcttttgcatgatgcttagcaccttctatccctaaggacaacttactcatttgagatttctggcagggtaccttgcatgcagtggacactcagtatttgctgaattaaattccttcctatggatcccttctgattttttttaagtgcctctaatacacatatcattctagggctcatgccacttttaatgtcattttctaaaggaaaatcttatctatgatattttcccttataagagatagttgttttgagtagggttttttaaaagataaaggtagtaggaaattttttaaagcctaaatatcaaattcctttccctttggagttgggggaaggaatgaagggggagcaacttgctctttcatatgagttggtcatagcatgtaagaaccaatcttgaaatatcgttttttttttaatggcttataatgtatttctagaaatactttgtacttaaaatgataacagtttgtatctttttgtccatataaagatactttataaataaaaaaattagcattgtaaataatgttaatatgtatttatacaaaataaatttactataatataaaaaaatggtgtgatttttttccccctcaagacagagtcttgctctgtcgcccaggctggagtgcagtggcgcgatctcggctcattgcaatcttcacttcctgggttcaagcaattctcctgcctcagcctcctgaggagctgggatgacaggtgcgcaccaccatgcccggctaattttttgtatttttagtagagacgggatttcaccatgttggccaggctggtctcaaactctgacctcaggtgatccacccgcctcaacctccccaagtgctaggattacaggcgtgagctactgagcctggccagcatcatagatttaaagatgaacttcggctagagtcacacatttaaagatgaacttcggctgggcacggtggctcatgcctgtaatcccagcactttggggaggccaaggcgagcggatcacttgaggtgaggagttcgagaccagcctggccaacatggtgaaaccctgtctctactaaaaatacaa

SEQ ID NO: 314168 - DNA, 1833 bp, Homo sapiens
  misc_feature (13)..(13): n is a, c, g, or t
acgtcgcaacagntaaacgagacggttaggagggtctttaaagagaaaatatttgttcaattgaaaacaggattcttgtcatctacaactccaacacagcctgaaaatatccacattataacctggaccttagacctactttctccactatcctgcaaagctacatctgtaactacctattggctatctatatgagtcctcaagcatctcagactttacatgaataaaactcaacttccttcccattcaaatctgtttattttcttctgtaagagaaagataccatttgagactccagaatctgcctctaactctcaacaagactctgcaattactcaagtatcctttccatcctcattgccctgctgttattacataggccctggttcaagtccttgttacttgttcccattattgcaataacttctaattccaatgccgttgtgtgatcccattttaaacacggccagagcagtcttccaacaacatagctctaatctagtttcatccccacttttacatgcttcagtggctttcccagtgacttggcatggaacacgtcctcagttgccatacattccagctaactcttacccaacctttctttgttcacacagtttccttttccttcctcattgacccatccgcatctctgtttatccaagacttctctgtgatagctgacccttagtctttctctcccctattcctccagactagatcctgtctccttcctgcagccccgacacagccttcagttcatatcttttgcatgatgcttagcaccttctatccctaaggacaacttactcatttgagatttctggcagggtaccttgcatgcagtggacactcagtatttgctgaattaaattccttcctatggatcccttctgattttttttaagtgcctctaatacacatatcattctagggctcatgccacttttaatgtcattttctaaaggaaaatcttatctatgatattttcccttataagagatagttgttttgagtagggttttttaaaagataaaggtagtaggaaattttttaaagcctaaatatcaaattcctttccctttggagttgggggaaggaatgaagggggagcaacttgctctttcatatgagttggtcatagcatgtaagaaccaatcttgaaatatcgttttttttttaatggcttataatgtatttctagaaatactttgtacttaaaatgataacagtttgtatctttttgtccatataaagatactttataaataaaaaaattagcattgtaaataatgttaatatgtatttatacaaaataaatttactataatataaaaaaatggtgtgatttttttccccctcaagacagagtcttgctctgtcgcccaggctggagtgcagtggcgcgatctcggctcattgcaatcttcacttcctgggttcaagcaattctcctgcctcagcctcctgaggagctgggatgacaggtgcgcaccaccatgcccggctaattttttgtatttttagtagagacgggatttcaccatgttggccaggctggtctcaaactctgacctcaggtgatccacccgcctcaacctccccaagtgctaggattacaggcgtgagctactgagcctggccagcatcatagatttaaagatgaacttcggctagagtcacacatttaaagatgaacttcggctgggcacggtggctcatgcctgtaatcccagcactttggggaggccaaggcgagcggatcacttgaggtgaggagttcgagaccagcctggccaacatggtgaaaccctgtctctactaaaaatacaa

SEQ ID NO: 314169 - DNA, 1542 bp, Homo sapiens
  misc_feature (68)..(68): n is a, c, g, or t
  misc_feature (102)..(102): n is a, c, g, or t
gagagttagaggcagattctggatctcaatggtatctttctcttacagaagaaaataaacagatttgnatgggaaggaagttgagttttattcatgtaaagnctgagatggttgttcccattattgcaataacttctaattccaatgccgttgtgtgatcccattttaaacacggccagagcagtcttccaacaacatagctctaatctagtttcatccccacttttacatgcttcagtggctttcccagtgacttggcatggaacacgtcctcagttgccatacattccagctaactcttacccaacctttctttgttcacacagtttccttttccttcctcattgacccatccgcatctctgtttatccaagacttctctgtgatagctgacccttagtctttctctcccctattcctccagactagatcctgtctccttcctgcagccccgacacagccttcagttcatatcttttgcatgatgcttagcaccttctatccctaaggacaacttactcatttgagatttctggcagggtaccttgcatgcagtggacactcagtatttgctgaattaaattccttcctatggatcccttctgattttttttaagtgcctctaatacacatatcattctagggctcatgccacttttaatgtcattttctaaaggaaaatcttatctatgatattttcccttataagagatagttgttttgagtagggttttttaaaagataaaggtagtaggaaattttttaaagcctaaatatcaaattcctttccctttggagttgggggaaggaatgaagggggagcaacttgctctttcatatgagttggtcatagcatgtaagaaccaatcttgaaatatcgttttttttttaatggcttataatgtatttctagaaatactttgtacttaaaatgataacagtttgtatctttttgtccatataaagatactttataaataaaaaaattagcattgtaaataatgttaatatgtatttatacaaaataaatttactataatataaaaaaatggtgtgatttttttccccctcaagacagagtcttgctctgtcgcccaggctggagtgcagtggcgcgatctcggctcattgcaatcttcacttcctgggttcaagcaattctcctgcctcagcctcctgaggagctgggatgacaggtgcgcaccaccatgcccggctaattttttgtatttttagtagagacgggatttcaccatgttggccaggctggtctcaaactctgacctcaggtgatccacccgcctcaacctccccaagtgctaggattacaggcgtgagctactgagcctggccagcatcatagatttaaagatgaacttcggctagagtcacacatttaaagatgaacttcggctgggcacggtggctcatgcctgtaatcccagcactttggggaggccaaggcgagcggatcacttgaggtgaggagttcgagaccagcctggccaacatggtgaaaccctgtctctactaaaaatacaa

SEQ ID NO: 314170 - DNA, 3180 bp, Homo sapiens
agcgggatccaagaggtgcagagcaagcgcatgcgtcgtgacggcccggcttaggcgactctgggcgggtctgggccgctccagtgttttggggcacagaagctgtgggaggagctggaggcttcaccgtggtaaccacagcgccgctgctgccccgccttgcaggcctcaggactgtcatcgcctctgggtgtgagggtactttggccaccgtccccggaaataaccgcgcctgcctctcaagataccccatcctctccacgccgctgccgctgccgccatgcaaggggaggacgccagatacctcaaaaggaaagttaaaggagggaatatagatgtacatccatcagaaaaagcactcattgttcactatgaagtggaagctaccattcttggagaaatgggggaccccatgttgggagaacgaaaagaatgtcaaaaaatcattcgacttaagagtctcaatgccaacacagatataacttccctggcaaggaaggtggttgaagaatgtaaactcattcatccttcaaaactaaatgaggtagaacagctgttgtactatctacagaaccgccgtgattcattgtcaggaaaagagaaaaaagaaaaatcaagcaagcctaaagatccacctccttttgaaggaatggagattgatgaagttgctaacattaatgacatggatgaatatattgagttattatatgaagatattcctgacaaagttcggggttctgctttgatcctgcagcttgctcgaaatcctgataacttggaagaactactattgaatgaaactgcccttggtgcattagcaagggtcctgagagaagactggaagcaaagtgtcgagttagctacaaacataatttacatctttttttgtttctccagcttttctcaatttcatggacttattactcactataaaattggagctctgtgtatgaatattattgatcatgagttaaaaagacatgagctttggcaagaagaactctcaaagaagaagaaagctgttgatgaagaccctgaaaaccaaaccttgagaaaggattatgaaaaaacctttaaaaagtaccaggggcttgtggtaaaacaggaacagctattacgagttgctctttatttgcttctgaatcttgctgaggatactcgtaccgaactgaaaatgaggaacaagaacatagttcacatgttggtgaaagcccttgatcgggacaattttgagctgctaattttagttgtgtcattcttgaagaaactcagcatttttatggagaataaaaatgatatggtggaaatggatattgttgaaaaactggtgaaaatgataccttgtgagcatgaagacctgctgaatatcaccctccgacttttactaaacctatcctttgacacaggactgaggaataagatggtacaagttggactgcttcccaagctcactgcactcctaggcaatgacaactacaaacaaatagcaatgtgtgttctttaccacataagcatggatgaccgctttaaatcaatgtttgcatacactgactgtataccacagttaatgaagatgctgtttgaatgttcagatgaacgaattgacttggaactcatttctttctgcattaatcttgctgctaacaaaagaaatgtacagcttatctgtgaaggaaatgggctgaagatgctcatgaagagggctctgaagtttaaggatccattgctgatgaaaatgattagaaacatttctcagcatgatggaccaactaaaaatctgtttattgattatgttggggaccttgcagcccagatctctaatgatgaagaagaggagtttgtgattgaatgtttgggaactcttgcaaacttgaccattccagacttagactgggaattggttcttaaagaatataagttggttccatacctcaaggataaactaaaaccaggtgctgcagaagatgatcttgttttagaagtggttataatgattggaactgtatccatggatgactcttgtgctgcattgctagccaaatctggcataatccctgcactcattgaattgctaaatgctcaacaagaagatgatgaatttgtgtgtcagataatttatgtcttctaccagatggttttccaccaagccacaagagacgtcataatcaaggaaacacaggctccagcatatctcatagacctaatgcatgataagaataatgaaatccgaaaggtctgtgataatacattagatattatagcggaatatgatgaagaatgggctaagaaaattcagagtgaaaagtttcgctggcataactctcagtggctggagatggtagagagtcgtcagatggatgagagtgagcagtacttgtatggtgatgatcgaattgagccatacattcatgaaggagatattctcgaaagacctgaccttttctacaactcagatggattaattgcctctgaaggagccataagtcccgatttcttcaatgattaccaccttcaaaatggagatgttgttgggcagcattcatttcctggcagccttggaatggatggctttggccaaccagttggcattcttggacgccctgccacagcatatggattccgccctgatgaaccttactactatggctatggatcttgataaagtatctgtttccatgtgtaatctcagcttagaagaaatctgtgtgggttgggttaattttggatctttgcctaataatgcatgttgatgttattgtgggtctgtgtttgtttttatttttatatgttgttagctgcagattaaccccagcccctctgtcttctgttaagtacagttgatactgacattgttcactcatcaaaccacatcttgatgctaagtaacatttcccatgagcctcaaaactgaatgctgaaaagctactagactggaaaacaaacactgcattatgtatgttaagtgactaatttaatttcaattaaaaagcgtaaagtgaaaatgaataagtgaaagtcatgtgtttatatttcacacatttcactacgaattacatgttaatatagggtgcgcgtgaattttattttttctcctttttttctgtttgtaaactcttgagtaatttgtataatatatgctacctttaaaatttataaaaagaacatcaccttcatattcca

SEQ ID NO: 314171 - DNA, 2870 bp, Homo sapiens
accaggaagagaattattttaaagggtccttttaactgaaatctcctttgtattaagatgtgctacatgagctcaaactaattggaaaggtggcaggataatggcattgatagccagtggatatgggctccttgggccccactggccatttgatggcatcccaaaggcaatcacaaggaaagttaaaggagggaatatagatgtacatccatcagaaaaagcactcattgttcactatgaagtggaagctaccattcttggagaaatgggggaccccatgttgggagaacgaaaagaatgtcaaaaaatcattcgacttaagagtctcaatgccaacacagatataacttccctggcaaggaaggtggttgaagaatgtaaactcattcatccttcaaaactaaatgaggtagaacagctgttgtactatctacagaaccgccgtgattcattgtcaggaaaagagaaaaaagaaaaatcaagcaagcctaaagatccacctccttttgaaggaatggagattgatgaagttgctaacattaatgacatggatgaatatattgagttattatatgaagatattcctgacaaagttcggggttctgctttgatcctgcagcttgctcgaaatcctgataacttggaagaactactattgaatgaaactgcccttggtgcattagcaagggtcctgagagaagactggaagcaaagtgtcgagttagctacaaacataatttacatctttttttgtttctccagcttttctcaatttcatggacttattactcactataaaattggagctctgtgtatgaatattattgatcatgagttaaaaagacatgagctttggcaagaagaactctcaaagaagaagaaagctgttgatgaagaccctgaaaaccaaaccttgagaaaggattatgaaaaaacctttaaaaagtaccaggggcttgtggtaaaacaggaacagctattacgagttgctctttatttgcttctgaatcttgctgaggatactcgtaccgaactgaaaatgaggaacaagaacatagttcacatgttggtgaaagcccttgatcgggacaattttgagctgctaattttagttgtgtcattcttgaagaaactcagcatttttatggagaataaaaatgatatggtggaaatggatattgttgaaaaactggtgaaaatgataccttgtgagcatgaagacctgctgaatatcaccctccgacttttactaaacctatcctttgacacaggactgaggaataagatggtacaagttggactgcttcccaagctcactgcactcctaggcaatgacaactacaaacaaatagcaatgtgtgttctttaccacataagcatggatgaccgctttaaatcaatgtttgcatacactgactgtataccacagttaatgaagatgctgtttgaatgttcagatgaacgaattgacttggaactcatttctttctgcattaatcttgctgctaacaaaagaaatgtacagcttatctgtgaaggaaatgggctgaagatgctcatgaagagggctctgaagtttaaggatccattgctgatgaaaatgattagaaacatttctcagcatgatggaccaactaaaaatctgtttattgattatgttggggaccttgcagcccagatctctaatgatgaagaagaggagtttgtgattgaatgtttgggaactcttgcaaacttgaccattccagacttagactgggaattggttcttaaagaatataagttggttccatacctcaaggataaactaaaaccaggtgctgcagaagatgatcttgttttagaagtggttataatgattggaactgtatccatggatgactcttgtgctgcattgctagccaaatctggcataatccctgcactcattgaattgctaaatgctcaacaagaagatgatgaatttgtgtgtcagataatttatgtcttctaccagatggttttccaccaagccacaagagacgtcataatcaaggaaacacaggctccagcatatctcatagacctaatgcatgataagaataatgaaatccgaaaggtctgtgataatacattagatattatagcggaatatgatgaagaatgggctaagaaaattcagagtgaaaagtttcgctggcataactctcagtggctggagatggtagagagtcgtcagatggatgagagtgagcagtacttgtatggtgatgatcgaattgagccatacattcatgaaggagatattctcgaaagacctgaccttttctacaactcagatggattaattgcctctgaaggagccataagtcccgatttcttcaatgattaccaccttcaaaatggagatgttgttgggcagcattcatttcctggcagccttggaatggatggctttggccaaccagttggcattcttggacgccctgccacagcatatggattccgccctgatgaaccttactactatggctatggatcttgataaagtatctgtttccatgtgtaatctcagcttagaagaaatctgtgtgggttgggttaattttggatctttgcctaataatgcatgttgatgttattgtgggtctgtgtttgtttttatttttatatgttgttagctgcagattaaccccagcccctctgtcttctgttaagtacagttgatactgacattgttcactcatcaaaccacatcttgatgctaagtaacatttcccatgagcctcaaaactgaatgctgaaaagctactagactggaaaacaaacactgcattatgtatgttaagtgactaatttaatttcaattaaaaagcgtaaagtgaaaatga

SEQ ID NO: 314172 - DNA, 2827 bp, Homo sapiens
agcgggatccaagaggtgcagagcaagcgcatgcgtcgtgacggcccggcttaggcgactctgggcgggtctgggccgctccagtgttttggggcacagaagctgtgggaggagctggaggcttcaccgtggtaaccacagcgccgctgctgccccgccttgcaggcctcaggactgtcatcgcctctgggtgtgagggtactttggccaccgtccccggaaataaccgcgcctgcctctcaagataccccatcctctccacgccgctgccgctgccgccatgcaaggggaggacgccagatacctcaaaaggaaagttaaaggagggaatatagatgtacatccatcagaaaaagcactcattgttcactatgaagtggaagctaccattcttggagaaatgggggaccccatgttgggagaacgaaaagaatgtcaaaaaatcattcgacttaagagtctcaatgccaacacagatataacttccctggcaaggaaggtggttgaagaatgtaaactcattcatccttcaaaactaaatgaggtagaacagctgttgtactatctacagaaccgccgtgattcattgtcaggaaaagagaaaaaagaaaaatcaagcaagcctaaagatccacctccttttgaaggaatggagattgatgaagttgctaacattaatgacatggatgaatatattgagttattatatgaagatattcctgacaaagttcggggttctgctttgatcctgcagcttgctcgaaatcctgataacttggaagaactactattgaatgaaactgcccttggtgcattagcaagggtcctgagagaagactggaagcaaagtgtcgagttagctacaaacataatttacatctttttttgtttctccagcttttctcaatttcatggacttattactcactataaaattggagctctgtgtatgaatattattgatcatgagttaaaaagacatgagctttggcaagaagaactctcaaagaagaagaaagctgttgatgaagaccctgaaaaccaaaccttgagaaaggattatgaaaaaacctttaaaaagtaccaggggcttgtggtaaaacaggaacagctattacgagttgctctttatttgcttctgaatcttgctgaggatactcgtaccgaactgaaaatgaggaacaagaacatagttcacatgttggtgaaagcccttgatcgggacaattttgagctgctaattttagttgtgtcattcttgaagaaactcagcatttttatggagaataaaaatgatatggtggaaatggatattgttgaaaaactggtgaaaatgataccttgtgagcatgaagacctgctgaatatcaccctccgacttttactaaacctatcctttgacacaggactgaggaataagatggtacaagttggactgcttcccaagctcactgcactcctaggcaatgacaactacaaacaaatagcaatgtgtgttctttaccacataagcatggatgaccgctttaaatcaatgtttgcatacactgactgtataccacagttaatgaagatgctgtttgaatgttcagatgaacgaattgacttggaactcatttctttctgcattaatcttgctgctaacaaaagaaatgtacagcttatctgtgaaggaaatgggctgaagatgctcatgaagagggctctgaagtttaaggatccattgctgatgaaaatgattagaaacatttctcagcatgatggaccaactaaaaatctgtttattgattatgttggggaccttgcagcccagatctctaatgatgaagaagaggagtttgtgattgaatgtttgggaactcttgcaaacttgaccattccagacttagactgggaattggttcttaaagaatataagttggttccatacctcaaggataaactaaaaccaggtgctgcagaagatgatcttgttttagaagtggttataatgattggaactgtatccatggatgactcttgtgctgcattgctagccaaatctggcataatccctgcactcattgaattgctaaatgctcaacaagaagatgatgaatttgtgtgtcagataatttatgtcttctaccagatggttttccaccaagccacaagagacgtcataatcaaggaaacacaggctccagcatatctcatagacctaatgcatgataagaataatgaaatccgaaaggtctgtgataatacattagatattatagcggaatatgatgaagaatgggctaagaaaattcagagtgaaaagtttcgctggcataactctcagtggctggagatggtagagagtcgtcagatggatgagagtgagcagtacttgtatggtgatgatcgaattgagccatacattcatgaaggagatattctcgaaagacctgaccttttctacaactcagatggattaattgcctctgaaggagccataagtcccgatttcttcaatgattaccaccttcaaaatggagatgttgttgggcagcattcatttcctggcagcacttttcatccaaggatttcaaagtgctttacaaatacgcactaattaagcctcacaaacagccagagccttggaatggatggctttggccaaccagtaagaccaggagggggcaatgggcccaggctttctgtggtatctgatgcaggaaggactgcagtggatcagaacttacaaaccaaacttttattctgagaaactggctgtacaatatctaaaaagaaagtgacatgaaggaagcaatctacaacttccttccgcttagcgtgcaaa

SEQ ID NO: 314173 - DNA, 641 bp, Homo sapiens
ccatttttttttctttctagatggattaattgcctctgaaggagccataagtcccgatttcttcaatgattaccaccttcaaaatggagatgttgttgggcagcattcatttcctggcagcacttttcatccaaggatttcaaagtgctttacaaatacgcactaattaagcctcacaaacagccagagccttggaatggatggctttggccaaccagttggcattcttggacgccctgccacagcatatggattccgccctgatgaaccttactactatggctatggatcttgataaagtatctgtttccatgtgtaatctcagcttagaagaaatctgtgtgggttgggttaattttggatctttgcctaataatgcatgttgatgttattgtgggtctgtgtttgtttttatttttatatgttgttagctgcagattaaccccagcccctctgtcttctgttaagtacagttgatactgacattgttcactcatcaaaccacatcttgatgctaagtaacatttcccatgagcctcaaaactgaatgctgaaaagctactagactggaaaacaaacactgcattatgtatgttaagtgactaatttaatttcaattaaaaagcgtaaagtgaaaatga

SEQ ID NO: 314174 - DNA, 693 bp, Homo sapiens
aaattttgtcaaattccttatcttgttcttttaatcataggcttatggtatgatttggccctgcatgagagttcactgatataactcaaacacatgtttttactaaaagtggaattagtcctgtatcttcatatgaaaagacattataaacagcaaaactcactttactacagttttatttttatcattccctagcaatatattactgatcattgctagcatgtaaaatcttttcatatttttgcttaagagccatatataagtaatttattaaataaaacttttctgatttgattcttccactttgtttcaaatagtacctactgacagaggtttcccatacttttaacacacattgttagaagtattttattatatacacttttaatggctctattaaccttaaaaaaaaaagttaatgatatccacctaaatcactatccctgctaggaagagaatcttggtggtataaaaatgtaggcctcttaatctgcattgtggatgtgtgatgaaaaacatagcttatcattcttttttttcttttttagccttggaatggatggctttggccaaccagttggcattcttggacgccctgccacagcatatggattccgccctgatgaaccttactactatggctatggatcttgataaagtatctgtttccatgtgtaatctcagcttagaaga

SEQ ID NO: 314175 - DNA, 3005 bp, Homo sapiens
agcgggatccaagaggtgcagagcaagcgcatgcgtcgtgacggcccggcttaggcgactctgggcgggtctgggccgctccagtgttttggggcacagaagctgtgggaggagctggaggcttcaccgtggtaaccacagcgccgctgctgccccgccttgcaggcctcaggactgtcatcgcctctgggtgtgagggtactttggccaccgtccccggaaataaccgcgcctgcctctcaagataccccatcctctccacgccgctgccgctgccgccatgcaaggggaggacgccagatacctcaaaaggaaagttaaaggagggaatatagatgtacatccatcagaaaaagcactcattgttcactatgaagtggaagctaccattcttggagaaatgggggaccccatgttgggagaacgaaaagaatgtcaaaaaatcattcgacttaagagtctcaatgccaacacagatataacttccctggcaaggaaggtggttgaagaatgtaaactcattcatccttcaaaactaaatgaggtagaacagctgttgtactatctacagaaccgccgtgattcattgtcaggaaaagagaaaaaagaaaaatcaagcaagcctaaagatccacctccttttgaaggaatggagattgatgaagttgctaacattaatgacatggatgaatatattgagttattatatgaagatattcctgacaaagttcggggttctgctttgatcctgcagcttgctcgaaatcctgataacttggaagaactactattgaatgaaactgcccttggtgcattagcaagggtcctgagagaagactggaagcaaagtgtcgagttagctacaaacataatttacatctttttttgtttctccagcttttctcaatttcatggacttattactcactataaaattggagctctgtgtatgaatattattgatcatgagttaaaaagacatgagctttggcaagaagaactctcaaagaagaagaaagctgttgatgaagaccctgaaaaccaaaccttgagaaaggattatgaaaaaacctttaaaaagtaccaggggcttgtggtaaaacaggaacagctattacgagttgctctttatttgcttctgaatcttgctgaggatactcgtaccgaactgaaaatgaggaacaagaacatagttcacatgttggtgaaagcccttgatcgggacaattttgagctgctaattttagttgtgtcattcttgaagaaactcagcatttttatggagaataaaaatgatatggtggaaatggatattgttgaaaaactggtgaaaatgataccttgtgagcatgaagacctgctgaatatcaccctccgacttttactaaacctatcctttgacacaggactgaggaataagatggtacaagttggactgcttcccaagctcactgcactcctaggcaatgacaactacaaacaaatagcaatgtgtgttctttaccacataagcatggatgaccgctttaaatcaatgtttgcatacactgactgtataccacagttaatgaagatgctgtttgaatgttcagatgaacgaattgacttggaactcatttctttctgcattaatcttgctgctaacaaaagaaatgtacagcttatctgtgaaggaaatgggctgaagatgctcatgaagagggctctgaagtttaaggatccattgctgatgaaaatgattagaaacatttctcagcatgatggaccaactaaaaatctgtttattgattatgttggggaccttgcagcccagatctctaatgatgaagaagaggagtttgtgattgaatgtttgggaactcttgcaaacttgaccattccagacttagactgggaattggttcttaaagaatataagttggttccatacctcaaggataaactaaaaccaggtgctgcagaagatgatcttgttttagaagtggttataatgattggaactgtatccatggatgactcttgtgctgcattgctagccaaatctggcataatccctgcactcattgaattgctaaatgctcaacaagaagatgatgaatttgtgtgtcagataatttatgtcttctaccagatggttttccaccaagccacaagagacgtcataatcaaggaaacacaggctccagcatatctcatagacctaatgcatgataagaataatgaaatccgaaaggtctgtgataatacattagatattatagcggaatatgatgaagaatgggctaagaaaattcagagtgaaaagtttcgctggcataactctcagtggctggagatggtagagagtcgtcagatggatgagagtgagcagtacttgtatggtgatgatcgaattgagccatacattcatgaaggagatattctcgaaagacctgaccttttctacaactcagatggattaattgcctctgaaggagccataagtcccgatttcttcaatgattaccaccttcaaaatggagatgttgttgggcagcattcatttcctggcagccttggaatggatggctttggccaaccagttggcattcttggacgccctgccacagcatatggattccgccctgatgaaccttactactatggctatggatcttgataaagtatctgtttccatgtgtaatctcagcttagaagaaatctgtgtgggttgggttaattttggatctttgcctaataatgcatgttgatgttattgtgggtctgtgtttgtttttatttttatatgttgttagctgcagattaaccccagcccctctgtcttctgttaagtacagttgatactgacattgttcactcatcaaaccacatcttgatgctaagtaacatttcccatgagcctcaaaactgaatgctgaaaagctactagactggaaaacaaacactgcattatgtatgttaagtgactaatttaatttcaattaaaaagcgtaaagtgaaaatga

SEQ ID NO: 314176 - DNA, 3369 bp, Homo sapiens
agcgggatccaagaggtgcagagcaagcgcatgcgtcgtgacggcccggcttaggcgactctgggcgggtctgggccgctccagtgttttggggcacagaagctgtgggaggagctggaggcttcaccgtggtaaccacagcgccgctgctgccccgccttgcaggcctcaggactgtcatcgcctctgggtgtgagggtactttggccaccgtccccggaaataaccgcgcctgcctctcaagataccccatcctctccacgccgctgccgctgccgccatgcaaggggaggacgccagatacctcaaaaggaaagttaaaggagggaatatagatgtacatccatcagaaaaagcactcattgttcactatgaagtggaagctaccattcttggagaaatgggggaccccatgttgggagaacgaaaagaatgtcaaaaaatcattcgacttaagagtctcaatgccaacacagatataacttccctggcaaggaaggtggttgaagaatgtaaactcattcatccttcaaaactaaatgaggtagaacagctgttgtactatctacagaaccgccgtgattcattgtcaggaaaagagaaaaaagaaaaatcaagcaagcctaaagatccacctccttttgaaggaatggagattgatgaagttgctaacattaatgacatggatgaatatattgagttattatatgaagatattcctgacaaagttcggggttctgctttgatcctgcagcttgctcgaaatcctgataacttggaagaactactattgaatgaaactgcccttggtgcattagcaagggtcctgagagaagactggaagcaaagtgtcgagttagctacaaacataatttacatctttttttgtttctccagcttttctcaatttcatggacttattactcactataaaattggagctctgtgtatgaatattattgatcatgagttaaaaagacatgagctttggcaagaagaactctcaaagaagaagaaagctgttgatgaagaccctgaaaaccaaaccttgagaaaggattatgaaaaaacctttaaaaagtaccaggggcttgtggtaaaacaggaacagctattacgagttgctctttatttgcttctgaatcttgctgaggatactcgtaccgaactgaaaatgaggaacaagaacatagttcacatgttggtgaaagcccttgatcgggacaattttgagctgctaattttagttgtgtcattcttgaagaaactcagcatttttatggagaataaaaatgatatggtggaaatggatattgttgaaaaactggtgaaaatgataccttgtgagcatgaagacctgctgaatatcaccctccgacttttactaaacctatcctttgacacaggactgaggaataagatggtacaagttggactgcttcccaagctcactgcactcctaggcaatgacaactacaaacaaatagcaatgtgtgttctttaccacataagcatggatgaccgctttaaatcaatgtttgcatacactgactgtataccacagttaatgaagatgctgtttgaatgttcagatgaacgaattgacttggaactcatttctttctgcattaatcttgctgctaacaaaagaaatgtacagcttatctgtgaaggaaatgggctgaagatgctcatgaagagggctctgaagtttaaggatccattgctgatgaaaatgattagaaacatttctcagcatgatggaccaactaaaaatctgtttattgattatgttggggaccttgcagcccagatctctaatgatgaagaagaggagtttgtgattgaatgtttgggaactcttgcaaacttgaccattccagacttagactgggaattggttcttaaagaatataagttggttccatacctcaaggataaactaaaaccaggtgctgcagaagatgatcttgttttagaagtggttataatgattggaactgtatccatggatgactcttgtgctgcattgctagccaaatctggcataatccctgcactcattgaattgctaaatgctcaacaagaagatgatgaatttgtgtgtcagataatttatgtcttctaccagatggttttccaccaagccacaagagacgtcataatcaaggaaacacaggctccagcatatctcatagacctaatgcatgataagaataatgaaatccgaaaggtctgtgataatacattagatattatagcggaatatgatgaagaatgggctaagaaaattcagagtgaaaagtttcgctggcataactctcagtggctggagatggtagagagtcgtcagatggatgagagtgagcagtacttgtatggtgatgatcgaattgagccatacattcatgaaggagatattctcgaaagacctgaccttttctacaactcagatggattaattgcctctgaaggagccataagtcccgatttcttcaatgattaccaccttcaaaatggagatgttgttgggcagcattcatttcctggcagccttggaatggatggctttggccaaccagttggcattcttggacgccctgccacagcatatggattccgccctgatgaaccttactactatggctatggatcttgataaagtatctgtttccatgtgtaatctcagcttagaagaaatctgtgtgggttgggttaattttggatctttgcctaataatgcatgttgatgttattgtgggtctgtgtttgtttttatttttatatgttgttagctgcagattaaccccagcccctctgtcttctgttaagtacagttgatactgacattgttcactcatcaaaccacatcttgatgctaagtaacatttcccatgagcctcaaaactgaatgctgaaaagctactagactggaaaacaaacactgcattatgtatgttaagtgactaatttaatttcaattaaaaagcgtaaagtgaaaatgacaaaaaaaacaaaacacaaaaaaaagaaccaaacaaacaaaaaaaaacaacagaagcaaacagacaacaaaaaaaaacagacagaaacagccaacacacacaacacaaaaaaacacaaaagggggggggggggggcacgataaaataccatccccgggaggggacaaacaaagaggtacaagcccacaactgttgttggaaaaagagggcggccccatagtaggggggcgatataaaaaaagacggacgagagcggcgagaatcaaaaaacgctcgtggggggaacgacaacaccgatgcgcgagacttcgtgagggaagaaccacaccactacggagagggaagacatcagacggaacacact

SEQ ID NO: 314177 - DNA, 2493 bp, Homo sapiens
agcgggatccaagaggtgcagagcaagcgcatgcgtcgtgacggcccggcttaggcgactctgggcgggtctgggccgctccagtgttttggggcacagaagctgtgggaggagctggaggcttcaccgtggtaaccacagcgccgctgctgccccgccttgcaggcctcaggactgtcatcgcctctgggtgtgagggtactttggccaccgtccccggaaataaccgcgcctgcctctcaagataccccatcctctccacgccgctgccgctgccgccatgcaaggggaggacgccagatacctcaaaaggaaagttaaaggagggaatatagatgtacatccatcagaaaaagcactcattgttcactatgaagtggaagctaccattcttggagaaatgggggaccccatgttgggagaacgaaaagaatgtcaaaaaatcattcgacttaagagtctcaatgccaacacagatataacttccctggcaaggaaggtggttgaagaatgtaaactcattcatccttcaaaactaaatgaggtagaacagctgttgtactatctacagaaccgccgtgattcattgtcaggaaaagagaaaaaagaaaaatcaagcaagcctaaagatccacctccttttgaaggaatggagattgatgaagttgctaacattaatgacatggatgaatatattgagttattatatgaagatattcctgacaaagttcggggttctgctttgatcctgcagcttgctcgaaatcctgataacttggaagaactactattgaatgaaactgcccttggtgcattagcaagggtcctgagagaagactggaagcaaagtgtcgagttagctacaaacataatttacatctttttttgtttctccagcttttctcaatttcatggacttattactcactataaaattggagctctgtgtatgaatattattgatcatgagttaaaaagacatgagctttggcaagaagaactctcaaagaagaagaaagctgttgatgaagaccctgaaaaccaaaccttgagaaaggattatgaaaaaacctttaaaaagtaccaggggcttgtggtaaaacaggaacagctattacgagttgctctttatttgcttctgaatcttgctgaggatactcgtaccgaactgaaaatgaggaacaagaacatagttcacatgttggtgaaagcccttgatcgggacaattttgagctgctaattttagttgtgtcattcttgaagaaactcagcatttttatggagaataaaaatgatatggtggaaatggatattgttgaaaaactggtgaaaatgataccttgtgagcatgaagacctgctgaatatcaccctccgacttttactaaacctatcctttgacacaggactgaggaataagatggtacaagttggactgcttcccaagctcactgcactcctaggcaatgacaactacaaacaaatagcaatgtgtgttctttaccacataagcatggatgaccgctttaaatcaatgtttgcatacactgactgtataccacagttaatgaagatgctgtttgaatgttcagatgaacgaattgacttggaactcatttctttctgcattaatcttgctgctaacaaaagaaatgtacagcttatctgtgaaggaaatgggctgaagatgctcatgaagagggctctgaagtttaaggatccattgctgatgaaaatgattagaaacatttctcagcatgatggaccaactaaaaatctgtttattgattatgttggggaccttgcagcccagatctctaatgatgaagaagaggagtttgtgattgaatgtttgggaactcttgcaaacttgaccattccagacttagactgggaattggttcttaaagaatataagttggttccatacctcaaggataaactaaaaccaggtgctgcagaagatgatcttgttttagaagtggttataatgattggaactgtatccatggatgactcttgtgctgcattgctagccaaatctggcataatccctgcactcattgaattgctaaatgctcaacaagaagatgatgaatttgtgtgtcagataatttatgtcttctaccagatggttttccaccaagccacaagagacgtcataatcaaggaaacacaggctccagcatatctcatagacctaatgcatgataagaataatgaaatccgaaaggtctgtgataatacattagatattatagcggaatatgatgaagaatgggctaagaaaattcagagtgaaaagtttcgctggcataactctcagtggctggagatggtagagatcatcaaaccacatcttgatgctaagtaacatttcccatgagcctcaaaactgaatgctgaaaagctactagactggaaaacaaacactgcattatgtatgttaagtgactaatttaatttcaattaaaaagcgtaaagtgaaaatga

SEQ ID NO: 314178 - DNA, 3127 bp, Homo sapiens
tccgccgccgccgctgccgcgcggtggcccgtgcgcctcggcaccttcggcaatttccgtcgggccccagccgccattttctcgccgcttgtgtggctcgctggctgcgtggctcggttcttgtgagcgaagctttgtccggttcggcaatggacggaatcgtcactgaggttgcagttggcgtgaagagaggatctgacgaactactctcaggcagtgttctcagtagtccgaactctaatatgagcagcatggtagttacagccaatggtaatgatagtaaaaaatttaaaggagaagataaaatggatggtgctccttctcgtgtacttcatattcgaaaattacctggggaagtaacagaaactgaagttattgctttaggcttaccttttggtaaggtgaccaacatccttatgctgaaaggaaaaaatcaggcatttttggaactagcaaccgaggaagcagctattactatggttaattactattctgctgtgacacctcatcttcgtaaccaaccaatatatatccagtactcgaatcacaaagaactaaagacagataatacattaaaccaacgtgctcaggcagttcttcaagctgtgacagctgtccagacagcaaatactcctcttagtggcaccacagttagcgagagtgcagtgactccagcccagagtccagtacttagaataattattgacaacatgtactaccctgtaacacttgatgttcttcaccaaatattttctaagtttggtgctgtattgaagataatcacatttacaaaaaataaccagtttcaagctttgctccagtatggtgatccagtaaatgctcaacaagcaaaactagccctagatggtcagaatatttataatgcctgctgtaccctaaggattgatttttccaaacttgtgaatttgaatgtaaaatacaacaatgataaaagtagggattatactcgacctgatcttccatctggggatggacaacctgcattggacccagctattgctgcagcatttgccaaggagacatccctcttagctgttccaggagctctgagtcctttggccattccaaatgctgctgcagcagctgctgcagctgctgctggccgagtgggtatgcctggagtctcagctggtggcaatacagtcctgttggttagcaatttaaatgaagagatggttacgccccaaagtctgtttaccctcttcggtgtttatggagatgtgcagcgtgtgaagattttatacaataagaaagacagcgctctaatacagatggctgatggaaaccaatcacaacttgccatgaatcatcttaatggacagaaaatgtatggaaaaattattcgtgttactctgtctaaacatcagactgtacagctacctcgagagggacttgatgatcaagggctaacaaaagattttggtaattccccattgcatcgttttaagaaacctggatccaaaaattttcaaaacatttttcctccttctgccacccttcacctatctaatatccctccatcagtagcagaagaggatctacgaacactgttcgctaacactgggggcactgtgaaagcatttaagttttttcaagatcacaaaatggctcttcttcagatggcaacagtggaagaagctattcaggccttgattgatcttcataattataaccttggagaaaaccatcatctgagagtgtctttctccaagtcaacaatttaaaaatgggaagatgaagattgggggtgaatcacattgttcaatgtcatcacctatttgactgttcagaaaagtggggaccagagtttgattttttttgtttttgtttttttggggtttcttttttttttccatgctgttatcattccttggttataaaatgaaatggcatatgtaaaggcagagttgttaactgctatatttcatctgttctatagggaagccattttgtctgtttaaaatttcagtttaattttgcttttttttttttttttttcctttcaacttagttgacatacgtgccttaaaaaggaaaactagtgttgctattgtgcatttactagaaaaaaggaattggttgtttagggcacactgttatatgggaattaaaatatgtttaggcaggggtgtgtaaaaaggttaagtttttgtttctcctgcttggaacttattttgaattactggcttgtcacctttttttctatttaatcaaataagatacatgatattgaaagaataaagcagcatttttagtttttactaccttaggctttattgctttgaaaacaacattggccttttgtatctcacaattctggtctagattcagttatgaatgtaggcattagttaaaattaacaagatgcagagtattaatttcttaagacaacaaagtgatttctgtaagtttgagccctatgtggaaagcattgtggaatcttaacctttttgtacacactcttgtgggacgtatcatataaatgtcagcactaagtaatgtcttgtttgtggctgaatatttttcgtagatgtttttgaagttgacatgacttacgtgcatttaaatatatattgccatccttagtttgtaattaagatttggaatatggttgtggatttctgagcatgtgcagactggtctagctagttcaggaactggtgcatgtatttttcaaagataaagaaagtgtactgcgaaaatatgcaggaagattaattttgtggcagttttctaaaactgacaaccaggtgggaccaaagtttatgtgcctttagtcttaatttaccttgcattgtaatattcagttttaataaatcttcaaaatattttgtatttaggaatagatctgactttaataaaaacatggctcagaatctacaggtcaaattaatttgaacagttcttgtcaatccgaattgttgattctgtttaaatgaccaatactttttgaaattgatgtacttagtttcaagattcatagattctgttatctatgtagacagaatggtcatgtatattttctattagttgagtttttacatctttagaaatgtaaaattcagtatagtttgaaagcggcacaattaaaaattaattttctaac

SEQ ID NO: 314179 - DNA, 385 bp, Homo sapiens
aatctttaggtgacttccacataaaattaattccatttttggattacctctctgtggctccaaaaaaggtgtttatggagatgtgcagcgtgtgaagattttatacaataagaaagacagcgctctaatacagatggctgatggaaaccaatcacaacttgccatgaatcatcttaatggacagaaaatgtatggaaaaattattcgtgttactctgtctaaacatcagactgtacagctacctcgagagggacttgatgatcaagggctaacaaaagattttggtaattccccattgcatcgttttaagaaacctggatccaaaaattttcaaaacatttttcctccttctgccacccttcacctatctaatatcccgtaagta

SEQ ID NO: 314180 - DNA, 2385 bp, Homo sapiens
tcctggtagcttttaagttcgagtttttgttgttgagttttattactaaaattatactttcactaatttttattttttgtttaagattgctgatatgctttattcacttttacaggccctagatggtcagaatatttataatgcctgctgtaccctaaggattgatttttccaaacttgtgaatttgaatgtaaaatacaacaatgataaaagtagggattatactcgacctgatcttccatctggggatggacaacctgcattggacccagctattgctgcagcatttgccaaggagacatccctcttagctgttccaggagctctgagtcctttggccattccaaatgctgctgcagcagctgctgcagctgctgctggccgagtgggtatgcctggagtctcagctggtggcaatacagtcctgttggttagcaatttaaatgaagagatggttacgccccaaagtctgtttaccctcttcggtgtttatggagatgtgcagcgtgtgaagattttatacaataagaaagacagcgctctaatacagatggctgatggaaaccaatcacaacttgccatgaatcatcttaatggacagaaaatgtatggaaaaattattcgtgttactctgtctaaacatcagactgtacagctacctcgagagggacttgatgatcaagggctaacaaaagattttggtaattccccattgcatcgttttaagaaacctggatccaaaaattttcaaaacatttttcctccttctgccacccttcacctatctaatatccctccatcagtagcagaagaggatctacgaacactgttcgctaacactgggggcactgtgaaagcatttaagttttttcaagatcacaaaatggctcttcttcagatggcaacagtggaagaagctattcaggccttgattgatcttcataattataaccttggagaaaaccatcatctgagagtgtctttctccaagtcaacaatttaaaaatgggaagatgaagattgggggtgaatcacattgttcaatgtcatcacctatttgactgttcagaaaagtggggaccagagtttgattttttttgtttttgtttttttggggtttcttttttttttccatgctgttatcattccttggttataaaatgaaatggcatatgtaaaggcagagttgttaactgctatatttcatctgttctatagggaagccattttgtctgtttaaaatttcagtttaattttgcttttttttttttttttttcctttcaacttagttgacatacgtgccttaaaaaggaaaactagtgttgctattgtgcatttactagaaaaaaggaattggttgtttagggcacactgttatatgggaattaaaatatgtttaggcaggggtgtgtaaaaaggttaagtttttgtttctcctgcttggaacttattttgaattactggcttgtcacctttttttctatttaatcaaataagatacatgatattgaaagaataaagcagcatttttagtttttactaccttaggctttattgctttgaaaacaacattggccttttgtatctcacaattctggtctagattcagttatgaatgtaggcattagttaaaattaacaagatgcagagtattaatttcttaagacaacaaagtgatttctgtaagtttgagccctatgtggaaagcattgtggaatcttaacctttttgtacacactcttgtgggacgtatcatataaatgtcagcactaagtaatgtcttgtttgtggctgaatatttttcgtagatgtttttgaagttgacatgacttacgtgcatttaaatatatattgccatccttagtttgtaattaagatttggaatatggttgtggatttctgagcatgtgcagactggtctagctagttcaggaactggtgcatgtatttttcaaagataaagaaagtgtactgcgaaaatatgcaggaagattaattttgtggcagttttctaaaactgacaaccaggtgggaccaaagtttatgtgcctttagtcttaatttaccttgcattgtaatattcagttttaataaatcttcaaaatattttgtatttaggaatagatctgactttaataaaaacatggctcagaatctacaggtcaaattaatttgaacagttcttgtcaatccgaattgttgattctgtttaaatgaccaatactttttgaaattgatgtacttagtttcaagattcatagattctgttatctatgtagacagaatggtcatgtatattttctattagttgagtttttacatctttagaaatgtaaaattcagtatagtttgaaagcggcacaattaaaaattaattttctaac

SEQ ID NO: 314181 - DNA, 675 bp, Homo sapiens
tcacctatctaatatcccgtaagtatataagctagagtgtattgagatacattctattttgataaaatatgaaatttattcttaatcttcactttttcttcccattcaattttcctagtccatcagtagcagaagaggatctacgaacactgttcgctaacactgggggcactgtgaaagcatttaagttttttcagtaagcaagcttccttatctttaaattagtgacctgataaaatttttaagtagtttttgttcttttcgtttatagaaatttttgattccggaatggccaaaattcaagtatttaataagccctttctaatttgtatgaagtgtctaattttataattttgtttcagaagagatcacaaaatggctcttcttcagatggcaacagtggaagaagctattcaggccttgattgatcttcataattataaccttggagaaaaccatcatctgagagtgtctttctccaagtcaacaatttaaaaatgggaagatgaagattgggggtgaatcacattgttcaatgtcatcacctatttgactgttcagaaaagtggggaccagagtttgattttttttgtttttgtttttttggggtttcttttttttttccatgctgttatcattccttggttataaaatgaaatggcatatgtaaaggca

SEQ ID NO: 314182 - DNA, 3028 bp, Homo sapiens
ctgctccgcccctctctgtgggctacgtggacgacactccagttcgtgcgcttcgacaacgcgtcactgagggtgcagctggcgtgaagagaggatctgacgaactactctcaggcagtgttctcagtagtccgaactctaatatgagcagcatggtagttacagccaatggtaatgatagtaaaaaatttaaaggagaagataaaatggatggtgctccttctcgtgtacttcatattcgaaaattacctggggaagtaacagaaactgaagttattgctttaggcttaccttttggtaaggtgaccaacatccttatgctgaaaggaaaaaatcaggcatttttggaactagcaaccgaggaagcagctattactatggttaattactattctgctgtgacacctcatcttcgtaaccaaccaatatatatccagtactcgaatcacaaagaactaaagacagataatacattaaaccaacgtgctcaggcagttcttcaagctgtgacagctgtccagacagcaaatactcctcttagtggcaccacagttagcgagagtgcagtgactccagcccagagtccagtacttagaataattattgacaacatgtactaccctgtaacacttgatgttcttcaccaaatattttctaagtttggtgctgtattgaagataatcacatttacaaaaaataaccagtttcaagctttgctccagtatggtgatccagtaaatgctcaacaagcaaaactagccctagatggtcagaatatttataatgcctgctgtaccctaaggattgatttttccaaacttgtgaatttgaatgtaaaatacaacaatgataaaagtagggattatactcgacctgatcttccatctggggatggacaacctgcattggacccagctattgctgcagcatttgccaaggagacatccctcttagctgttccaggagctctgagtcctttggccattccaaatgctgctgcagcagctgctgcagctgctgctggccgagtgggtatgcctggagtctcagctggtggcaatacagtcctgttggttagcaatttaaatgaagagatggttacgccccaaagtctgtttaccctcttcggtgtttatggagatgtgcagcgtgtgaagattttatacaataagaaagacagcgctctaatacagatggctgatggaaaccaatcacaacttgccatgaatcatcttaatggacagaaaatgtatggaaaaattattcgtgttactctgtctaaacatcagactgtacagctacctcgagagggacttgatgatcaagggctaacaaaagattttggtaattccccattgcatcgttttaagaaacctggatccaaaaattttcaaaacatttttcctccttctgccacccttcacctatctaatatccctccatcagtagcagaagaggatctacgaacactgttcgctaacactgggggcactgtgaaagcatttaagttttttcaagatcacaaaatggctcttcttcagatggcaacagtggaagaagctattcaggccttgattgatcttcataattataaccttggagaaaaccatcatctgagagtgtctttctccaagtcaacaatttaaaaatgggaagatgaagattgggggtgaatcacattgttcaatgtcatcacctatttgactgttcagaaaagtggggaccagagtttgattttttttgtttttgtttttttggggtttcttttttttttccatgctgttatcattccttggttataaaatgaaatggcatatgtaaaggcagagttgttaactgctatatttcatctgttctatagggaagccattttgtctgtttaaaatttcagtttaattttgcttttttttttttttttttcctttcaacttagttgacatacgtgccttaaaaaggaaaactagtgttgctattgtgcatttactagaaaaaaggaattggttgtttagggcacactgttatatgggaattaaaatatgtttaggcaggggtgtgtaaaaaggttaagtttttgtttctcctgcttggaacttattttgaattactggcttgtcacctttttttctatttaatcaaataagatacatgatattgaaagaataaagcagcatttttagtttttactaccttaggctttattgctttgaaaacaacattggccttttgtatctcacaattctggtctagattcagttatgaatgtaggcattagttaaaattaacaagatgcagagtattaatttcttaagacaacaaagtgatttctgtaagtttgagccctatgtggaaagcattgtggaatcttaacctttttgtacacactcttgtgggacgtatcatataaatgtcagcactaagtaatgtcttgtttgtggctgaatatttttcgtagatgtttttgaagttgacatgacttacgtgcatttaaatatatattgccatccttagtttgtaattaagatttggaatatggttgtggatttctgagcatgtgcagactggtctagctagttcaggaactggtgcatgtatttttcaaagataaagaaagtgtactgcgaaaatatgcaggaagattaattttgtggcagttttctaaaactgacaaccaggtgggaccaaagtttatgtgcctttagtcttaatttaccttgcattgtaatattcagttttaataaatcttcaaaatattttgtatttaggaatagatctgactttaataaaaacatggctcagaatctacaggtcaaattaatttgaacagttcttgtcaatccgaattgttgattctgtttaaatgaccaatactttttgaaattgatgtacttagtttcaagattcatagattctgttatctatgtagacagaatggtcatgtatattttctattagttgagtttttacatctttagaaatgtaaaattcagtatagtttgaaagcggcacaattaaaaattaattttctaac

SEQ ID NO: 314183 - DNA, 3386 bp, Homo sapiens
tccgccgccgccgctgccgcgcggtggcccgtgcgcctcggcaccttcggcaatttccgtcgggccccagccgccattttctcgccgcttgtgtggctcgctggctgcgtggctcggttcttgtgagcgaagctttgtccggttcggcaatggacggaatcgtcactgaggttgcagttggcgtgaagagaggatctgacgaactactctcaggcagtgttctcagtagtccgaactctaatatgagcagcatggtagttacagccaatggtaatgatagtaaaaaatttaaaggagaagataaaatggatggtgctccttctcgtgtacttcatattcgaaaattacctggggaagtaacagaaactgaagttattgctttaggcttaccttttggtaaggtgaccaacatccttatgctgaaaggaaaaaatcaggcatttttggaactagcaaccgaggaagcagctattactatggttaattactattctgctgtgacacctcatcttcgtaaccaaccaatatatatccagtactcgaatcacaaagaactaaagacagataatacattaaaccaacgtgctcaggcagttcttcaagctgtgacagctgtccagacagcaaatactcctcttagtggcaccacagttagcgagagtgcagtgactccagcccagagtccagtacttagaataattattgacaacatgtactaccctgtaacacttgatgttcttcaccaaatattttctaagtttggtgctgtattgaagataatcacatttacaaaaaataaccagtttcaagctttgctccagtatggtgatccagtaaatgctcaacaagcaaaactagccctagatggtcagaatatttataatgcctgctgtaccctaaggattgatttttccaaacttgtgaatttgaatgtaaaatacaacaatgataaaagtagggattatactcgacctgatcttccatctggggatggacaacctgcattggacccagctattgctgcagcatttgccaaggagacatccctcttagctgttccaggagctctgagtcctttggccattccaaatgctgctgcagcagctgctgcagctgctgctggccgagtgggtatgcctggagtctcagctggtggcaatacagtcctgttggttagcaatttaaatgaagagatggttacgccccaaagtctgtttaccctcttcggtgtttatggagatgtgcagcgtgtgaagattttatacaataagaaagacagcgctctaatacagatggctgatggaaaccaatcacaacttgccatgaatcatcttaatggacagaaaatgtatggaaaaattattcgtgttactctgtctaaacatcagactgtacagctacctcgagagggacttgatgatcaagggctaacaaaagattttggtaattccccattgcatcgttttaagaaacctggatccaaaaattttcaaaacatttttcctccttctgccacccttcacctatctaatatccctccatcagtagcagaagaggatctacgaacactgttcgctaacactgggggcactgtgaaagcatttaagttttttcaagatcacaaaatggctcttcttcagatggcaacagtggaagaagctattcaggccttgattgatcttcataattataaccttggagaaaaccatcatctgagagtgtctttctccaagtcaacaatttaaaaatgggaagatgaagattgggggtgaatcacattgttcaatgtcatcacctatttgactgttcagaaaagtggggaccagagtttgattttttttgtttttgtttttttggggtttcttttttttttccatgctgttatcattccttggttataaaatgaaatggcatatgtaaaggcagagttgttaactgctatatttcatctgttctatagggaagccattttgtctgtttaaaatttcagtttaattttgcttttttttttttttttttcctttcaacttagttgacatacgtgccttaaaaaggaaaactagtgttgctattgtgcatttactagaaaaaaggaattggttgtttagggcacactgttatatgggaattaaaatatgtttaggcaggggtgtgtaaaaaggttaagtttttgtttctcctgcttggaacttattttgaattactggcttgtcacctttttttctatttaatcaaataagatacatgatattgaaagaataaagcagcatttttagtttttactaccttaggctttattgctttgaaaacaacattggccttttgtatctcacaattctggtctagattcagttatgaatgtaggcattagttaaaattaacaagatgcagagtattaatttcttaagacaacaaagtgatttctgtaagtttgagccctatgtggaaagcattgtggaatcttaacctttttgtacacactcttgtgggacgtatcatataaatgtcagcactaagtaatgtcttgtttgtggctgaatatttttcgtagatgtttttgaagttgacatgacttacgtgcatttaaatatatattgccatccttagtttgtaattaagatttggaatatggttgtggatttctgagcatgtgcagactggtctagctagttcaggaactggtgcatgtatttttcaaagataaagaaagtgtactgcgaaaatatgcaggaagattaattttgtggcagttttctaaaactgacaaccaggtgggaccaaagtttatgtgcctttagtcttaatttaccttgcattgtaatattcagttttaataaatcttcaaaatattttgtatttaggaatagatctgactttaataaaaacatggctcagaatctacaggtcaaattaatttgaacagttcttgtcaatccgaattgttgattctgtttaaatgaccaatactttttgaaattgatgtacttagtttcaagattcatagattctgttatctatgtagacagaatggtcatgtatattttctattagttgagtttttacatctttagaaatgtaaaattcagtatagtttgaaagcggcacaattaaaaattaattttctaacaaagttgggaggtttgatggttgtttaatttcattttgtgtgtactctgcttacccctgtagcatgctcaataaacacttctgtagctctatattcaccttttctgtctttctctgctgccttttctctctcctcttctttgttttcactccactgtgcttctgaattcatgtttattctctgccagggtgggaaaggagtaataatattacaattctatggctttataccataaataaatctagatgctgtgaaaata

SEQ ID NO: 314184 - DNA, 1829 bp, Homo sapiens
aaatcagccaaagcctgagggaagcgagacgagtgtgctgagaggggagcctctcactgcaggtgtcccccgaccgccgtcgctgttggccaccttgcagcgctggggcacaacacagcccaaatccccctgtctgactgccttggatacaactgggaaagccgtctacactctcacctatggtaaactttggagtcggagtttaaaactagcttatactctacttaataaactgacaagtaagaatgaacctctacttaaacctggagacagagtggcgctcgtgtttccgaatagtgaccctgtgatgttcatggttgcattttatgggtgtctcctggcagagctggttcctgtccccatagaagtgccattaacaagaaaggatgcaggcagccagcaggttgggtttctgctgggcagctgtggagtcttcttggccctgaccacagacgcttgtcagaaaggcctccccaaggcacagacaggagaggtggcagctttcaaaggttggcccccgctctcctggctagtgattgatgggaagcatctagccaagcccccaaaggactggcaccctctggcccaggacacagggactgggactgcctacattgagtataaaaccagcaaagaaggcagtacggtgggggtcacagtgtcccacgcatccctgctggcacagtgccgggctctgacccaggcgtgcgggtactcagaagctgaaacattaacaaacgtgctggatttcaaaagggatgctggtctgtggcatggcgtgttaacaagcgtcatgaacaggatgcacgtggtcagcgtcccctacgcgctgatgaaggcgaacccactctcctggatccagaaagtgtgcttctataaagctcgggccgcgctggtgaagtcgcgagacatgcactggtctctcctagctcagcggggccagagggacgtcagcctcagctcactgcgcatgctgattgtggccgatggtgccaacccgtggtcgatctcctcctgtgacgccttcctcaacgtcttccagtccagaggtctgaggccagaggtcatctgtccttgtgcaagttctcctgaggcgctgactgtcgccatccgcaggccacctgatctgggaggaccacctccaagaaaagcagtcctgtcgatgaacggtctaagttatggtgttatcagagtggatactgaagaaaagttgtcagtccttactgttcaggacgttggtcaggtgatgcctggagctaatgtatgtgttgtgaagttagaaggtaccccttatctttgtaaaactgatgaagtgggagaaatatgcgtcagttccagtgcaactggcacagcgtactatggattgcttggaatcacgaagaatgtgtttgaggcagttccggtcaccacaggaggagcacccatctttgacaggccattcaccaggacaggcctgctgggcttcatcgggcctgtgagtatgtcctcctgtaccagcactggcagtcagagaaggtagggggtgtggctaagggacacctcgttgcagccccacccttgtcctggccgttcctgacctcccatgtggccttggtcggtggcgctgacctccctgcccatcaccctacctgtgtgcagggccatccacacctccgagactggtgcacagtcctgcacacaggcctgagtcgggggtccccggggtggatgaggatgttttgctttttatatggagtggcaggtttgtgagtattcattatatcattctttaccattttggatgtctaaactattcaaaaataaatgcttctatttgtaacatcttggcc

SEQ ID NO: 314185 - DNA, 2111 bp, Homo sapiens
aaatcagccaaagcctgagggaagcgagacgagtgtgctgagaggggagcctctcactgcaggtgtcccccgaccgccgtcgctgttggccaccttgcagcgctggggcacaacacagcccaaatccccctgtctgactgccttggatacaactgggaaagccgtctacactctcacctatggtaaactttggagtcggagtttaaaactagcttatactctacttaataaactgacaagtaagaatgaacctctacttaaacctggagacagagtggcgctcgtgtttccgaatagtgaccctgtgatgttcatggttgcattttatgggtgtctcctggcagagctggttcctgtccccatagaagtgccattaacaagaaaggatgcaggcagccagcaggttgggtttctgctgggcagctgtggagtcttcttggccctgaccacagacgcttgtcagaaaggcctccccaaggcacagacaggagaggtggcagctttcaaaggttggcccccgctctcctggctagtgattgatgggaagcatctagccaagcccccaaaggactggcaccctctggcccaggacacagggactgggactgcctacattgagtataaaaccagcaaagaaggcagtacggtgggggtcacagtgtcccacgcatccctgctggcacagtgccgggctctgacccaggcgtgcgggtactcagaagctgaaacattaacaaacgtgctggatttcaaaagggatgctggtctgtggcatggcgtgttaacaagcgtcatgaacaggatgcacgtggtcagcgtcccctacgcgctgatgaaggcgaacccactctcctggatccagaaagtgtgcttctataaagctcgggccgcgctggtgaagtcgcgagacatgcactggtctctcctagctcagcggggccagagggacgtcagcctcagctcactgcgcatgctgattgtggccgatggtgccaacccgtggtcgatctcctcctgtgacgccttcctcaacgtcttccagtccagaggtctgaggccagaggtcatctgtccttgtgcaagttctcctgaggcgctgactgtcgccatccgcaggccacctgatctgggaggaccacctccaagaaaagcagtcctgtcgatgaacggtctaagttatggtgttatcagagtggatactgaagaaaagttgtcagtccttactgttcaggacgttggtcaggtgatgcctggagctaatgtatgtgttgtgaagttagaaggtaccccttatctttgtaaaactgatgaagtgggagaaatatgcgtcagttccagtgcaactggcacagcgtactatggattgcttggaatcacgaagaatgtgtttgaggcagttccggtcaccacaggaggagcacccatctttgacaggccattcaccaggacaggcctgctgggcttcatcgggcctgacaacctggtcttcatcgtgggcaaactggacgggctgatggtcactggagttcgcagacacaatgcagatgacgttgtggccaccgcactggccgtggagcccatgaagtttgtctacagaggcaggatcgctgtgttctctgtgaccgtgctgcacgacgaccggattgtcctggtggctgagcagcggccggatgcctcggaggaggacagcttccagtggatgagccgtgtgctgcaggccattgatagcatccaccaggtgggcgtgtactgtctggccctggttcctgccaacaccttgcccaaggctcctctcggagggattcacatttctgaaaccaaacagcgctttctggaagggacgctgcacccgtgtaatgtgctgatgtgccctcacacctgtgttaccaacctccccaaacctcgtcagaaacaaccagaggttggaccagcctcaatgatcgtggggaacctggttgctgggaagagaatcgctcaggcttccgggagagagctcgcccacctggaggacagcgaccaggcacggaagttcctgttcctggctgacgtgctgcagtggcgtgcccacaccactcctgaccacccgctgttcttgctgctgaacgccaagg

SEQ ID NO: 314186 - DNA, 584 bp, Homo sapiens
ctcgggccgcgctggtgaagtcgcgagacatgcactggtctctcctagctcagcggggccagagggacgtcagcctcagctcactgcgcatgctgattgtggccgatggtgccaacccgtgtgagtgagcctgtgtgcccggcgcataccccacacagtgtcccctcctgcaaaccaaagtagaatacactgagaagcaaaatggaggcattttcactgccattgtcatatagatacacatgtcccatcgtttctatgacacggaacatcttggtgattcactggtttatcccatgcatgtttattaggccactaaatttaaaagcaattttaatatgcttgatgaaaggtacatgccttaatgagagtcatctttcttaagaaattaccagattgtgctgtggcctggggttcctgtttctctttaggcctcatccccaccctcctgccctttgtcctggtgcccccacgtctctggcttctggcttcacttctcccaccaggacccaaccattctccctcctggtttgcctgggtgtcccccacatcctcccaggaggagctccctatggctgctgcctgac

SEQ ID NO: 314187 - DNA, 307 bp, Homo sapiens
tccttttataaatttactccatctcaggcaagtacttttatagcagcatgagaacagactaatacagtaaattggcactggtagagtggggtgctgatattaagatacccaaaaatgtgggagtgactttggatctgggtaacaggcagagtaggaacagtttcgagggctcaggcttccgggagagagctcgcccacctggaggacagcgaccaggcacggaagttcctgttcctggctgacgtgctgcagtggcgtgcccacaccactcctgaccacccgctgttcttgctgctgaacgccaagg

SEQ ID NO: 314188 - DNA, 1961 bp, Homo sapiens
aaatcagccaaagcctgagggaagcgagacgagtgtgctgagaggggagcctctcactgcaggtgtcccccgaccgccgtcgctgttggccaccttgcagcgctggggcacaacacagcccaaatccccctgtctgactgccttggatacaactgggaaagccgtctacactctcacctatggtaaactttggagtcggagtttaaaactagcttatactctacttaataaactgacaagtaagaatgaacctctacttaaacctggagacagagtggcgctcgtgtttccgaatagtgaccctgtgatgttcatggttgcattttatgggtgtctcctggcagagctggttcctgtccccatagaagtgccattaacaagaaaggatgcaggcagccagcaggttgggtttctgctgggcagctgtggagtcttcttggccctgaccacagacgcttgtcagaaaggcctccccaaggcacagacaggagaggtggcagctttcaaaggttggcccccgctctcctggctagtgattgatgggaagcatctagccaagcccccaaaggactggcaccctctggcccaggacacagggactgggactgcctacattgagtataaaaccagcaaagaaggcagtacggtgggggtcacagtgtcccacgcatccctgctggcacagtgccgggctctgacccaggcgtgcgggtactcagaagctgaaacattaacaaacgtgctggatttcaaaagggatgctggtctgtggcatggcgtgttaacaagcgtcatgaacaggatgcacgtggtcagcgtcccctacgcgctgatgaaggcgaacccactctcctggatccagaaagtgtgcttctataaagctcgggccgcgctggtgaagtcgcgagacatgcactggtctctcctagctcagcggggccagagggacgtcagcctcagctcactgcgcatgctgattgtggccgatggtgccaacccgtggtcgatctcctcctgtgacgccttcctcaacgtcttccagtccagaggtctgaggccagaggtcatctgtccttgtgcaagttctcctgaggcgctgactgtcgccatccgcaggccacctgatctgggaggaccacctccaagaaaagcagtcctgtcgatgaacggtctaagttatggtgttatcagagtggatactgaagaaaagttgtcagtccttactgttcaggacgttggtcaggtgatgcctggagctaatgtatgtgttgtgaagttagaaggtaccccttatctttgtaaaactgatgaagtgggagaaatatgcgtcagttccagtgcaactggcacagcgtactatggattgcttggaatcacgaagaatgtgtttgaggcagttccggtcaccacaggaggagcacccatctttgacaggccattcaccaggacaggcctgctgggcttcatcgggcctgacaacctggtcttcatcgtgggcaaactggacgggctgatggtcactggagttcgcagacacaatgcagatgacgttgtggccaccgcactggccgtggagcccatgaagtttgtctacagaggcaggtgatgcgctgcggacccccacgccgggagtagattccttcatttgcagctcgggaagtctttgtgcagtagatggaaagcccagcaaacttgaattcacaaagcctaaaaattgttgtacatcagaaaactcctaaagtaaaaggaaaatatttgcagcaatgataccagagttaatatccttactgtccaaagagttccttggattccttaagaaaataaggttttgatgtaaaatttggggcaaaggctcaaggggacaaatcagggagggaagaattgagtaaagcaaaggagaaatgggtctaagttcctaataaccttggaatgtgaattaaaacagaaaagtgccattttct

SEQ ID NO: 314189 - DNA, 5833 bp, Homo sapiens
gcggggccagctgcagcgtgtagtgcgagtggggcggacgcgcgcagcccgcccgcccggcgaccagcaaggagttggcatcctttggaagagttcgtgaaagctttctgcccagagctcctggaccaatgcatcttcccaccaccttaaaccactgagcagttcagagccccagttgcagacgacttgtcctgccaccaccatgagttctgaatgtgatggtggttccaaagctgtgatgaatggcttggcacctggcagcaatgggcaagacaaagcaactgccgaccctttacgcgcacgctctatttctgctgttaaaatcattcctgtgaagacagtgaaaaacgcctcaggcctagttctccctacagacatggatcctacaaaaatctgcactgggaagggagcggtgactctccgggcctcgtcttcctacagggaaaccccaagcagtagccctgcgagccctcaggaaacccggcaacacgaaagcaaaccaggtctggagccagagccttcttcagcagatgagtggaggctttcttccagtgctgatgccaatggaaatgcccagccctcttcactcgctgccaagggctacagaagtgtgcatcccaaccttccttctgacaagtcccaggattccagtcctctactaaatgaagtttcttcttcccttattggaactgattcccaagcctttccatcagttagcaagccttcatccgcctatccctccacaacgattgtcaatcctactattgtgctcttgcaacacaatcgagaacagcaaaaacgactcagtagcctttcagatcctgtctcagaaagaagagtgggagagcaggactcagcaccaacccaggaaaaacccacctcacctggcaaggctattgaaaaaagagcaaaggatgacagtaggcgggtggtgaagagcactcaggacttaagcgatgtttccatggatgaagtgggcatcccactccggaacactgagagatcaaaagactggtacaagactatgtttaaacagatccacaaactgaacagagatgatgattcagatctgtactctcccagatactcattttctgaagacacaaaatctcccctttctgtgcctcgctcaaaaagtgagatgagctacattgatggtgagaaggtagtcaagaggtcggccacactacccctcccagcccgctcttcctcactgaagtcaagctcagaaagaaatgactgggaacccccagataagaaagtagatacaagaaaatatcgtgcagagcccaagagcatttacgaatatcagcctggcaagtcttccgttctgaccaacgaaaagatgagctcagccatcagccctactccggaaatttcttcagagactcctggatatatatattcttccaacttccatgcagtgaagagggaatcagacggggctcctggggatctcactagcttggagaatgagagacaaatttataaaagtgtcttggaaggtggtgacatccctcttcagggcctgagtgggctcaagcgaccatccagctctgcttccactaaagattcagaatcgccaagacattttataccagctgattacttggaatccacggaagaatttattcgaagacgtcatgatgataaagagaaacttttagcggaccagagacgacttaaacgcgagcaagaagaggctgatattgcagctcgacgccacacaggcgtcattccgacgcaccatcagtttatcactaatgagcgctttggggacctcctcaatatagacgatactgcaaaaaggaaatctgggtcagagatgagacctgccagagccaaatttgactttaaagctcagacactaaaggagcttcctctgcagaagggagatattgtttacatttataagcaaattgatcagaactggtatgaaggagaacaccacggccgggtgggaatcttcccacgcacctacatcgagcttcttcctcctgctgagaaggcacagcccaaaaagttgacaccagtgcaggttttggaatatggagaagctattgctaagtttaactttaatggtgatacacaagtagaaatgtccttcagaaagggtgagaggatcacactgctccggcaggtagatgagaactggtacgaagggaggatcccggggacatcccgacaaggcatcttccccatcacctacgtggatgtgatcaagcgaccactggtgaaaaaccctgtggattacatggacctgcctttctcctcctccccaagtcgcagtgccactgcaagcccacagcaacctcaagcccagcagcgaagagtcacccccgacaggagtcaaacctcacaagatttatttagctatcaagcattatatagctatataccacagaatgatgatgagttggaactccgcgatggagatatcgttgatgtcatggaaaaatgtgacgatggatggtttgttggtacttcaagaaggacaaagcagtttggtacttttccaggcaactatgtaaaacctttgtatctataagaagactgaaaaccatggagattatttttattggaggaggaagcatcattcatgaaccgatctttttagttgagtcagtaggaaaattaatacagtggataaagtaagaagcaaaagacagggacagagaagtgttgtgtttaaaacccaagcctgtctaaggttactgtgtattagacagggccgaactagtgtgctgagcaaaaagaattgaagcaaattgtatttacttagccgcttctgggagccacttcagcctttcccctcccctccacttcttgggtaatctgacctgaagcatagtccaggagcagagttagccagaaatgcctcctgctgccccagccttagagagctcccatctcaatcattgagcctgaaggcttcaagcccaagaatgcaacaagacccccagcctacatttctcagctcccctggagccagctgatcctgtaacgctgctggaggtcagtctgagctaccaagactgtccctagacaaaggtggagtcccccacactgcccaagaccaaatccctcactcaacctgctgaggtgtggatggggaaacagaggcaaaactgaggcacctgatgcattcagcctgctgtgcagcagtgccattgactgccctgatgttcagagagaaacgcacacaaggtttgcccatgagaattggggagcagatggccaagcagataggttatgtctgttttctgagtgatgaagtcaggaagccctgtggctctggaggccacttgtggttcattcttttcccatatccttggcttttagaaatggttaccttcaggacagtgcagctgcatttatcagagcactattgctaagttttcttttctggcttgtgtttttctgggacagtttagaattgggaggcctattctcatagaacaccaaaaatgatgttcagtgattcatttaacatacaccaatgtactctggctgctggggggacaaccataagcaagacatgcccagggtttgccgtggctccagatctactccctgtaggagttcaaggatcacacaaacggtagtaaccagggttgtgaatctgagtacaccctggcaaggcttctcttcagactgaagcagcaattctgccactaccagcagcaaccaggacgtctgttctttgtgggggccagatcagaagagagaggcccctgtgacgcccgggctgcttggtcacaactctgtccaattcaaggatgtttatcggcctctcttagatcctgagtgagacaaatacagaaatgacccattccctgcccaccagaaactcagaggtgattggggagactgacacaggaaaatgaacttaatcaagagagactgtgatatgtgctaagaagggtgtgagggagggagagatgaattttccctggagggatcctagaaagcattgtcatattgccatctccattagctcacttttaaacaactagggtgctggaagaacctttgtctgagggtagttcatagctggaaatacttggaatattttccagagtctctaaactctcatcttcccccacagatacacatccaagctcacaaataggagtagcaattctaggtggtagggttgtgtacggaacccctggctgtctgcatatatctcagaattaccccaggaccattgtcccaaagtctagagtctttacaggtaggcaaaatttgttttcaatgcctgtgcctcagctgctgtcacaaatacccatcttaggatcccatcagcttcccatcccccaccagacagccacagtaccctcactttctccctattgttctttcaaatcctgttctcaggaaagaaactgccactaattcattcacactaaggtgtaaatgattgataataggaatgagttacctcttcccacagacatttgtttttaagtatgacagagcagggccttaatcccaagggaaaaggttatggaactggagggggtgagctttctgggtagaaggagacttcctgaatttccttaaaacccagtaagagtaagacctgttgttttggaaggtctgctccaccatctaagagcactgtttttttttttttgttgttgttgttgttttacggtctctgagggaatatagtaaaaatgcatatgcacgtgcaatttgcacggcagcatttcaccgattgtggactgtattggctaatgtgtttcctggtctttagatgcaaaccattaataacactatcttatctcatagttttttcaggggtgcttcttgattagtagggaattttgaacacctctttaaatacagctagaaaataaaaccaatttgtaaagccacatttgcatatgatgccagcctcacgcatttgtatatctccagaaattcaggtatgcctcaccaatttgcccgtctttaataaaatcttgtgttaaaatttgcatcacgtcgccttcctatgtatgacgaaacaagaaacagagatttccaattgctcttttgtcttcagacatttagtaatataaagtacctatttttatgctgaaatgtttatacaggtttattaatagcaagtgcaactaactggcggcatgccttgcaacacattttgatatattagccatgcttccgggtaaaggcaagccccaaactccttatcttttgcagtctctctgggatcagtaaaagaaaaaaaaaataatgtgcttaagaagtgggactgtaaatatgtatatttaactttgtatagcccatgtacctaccttgtatagaaaaataattttaaaaatttgaatggaagggggtaaaggaagtcatgaagtttttttgcatttttatttaaatgaaggaattccaaataactcacctacagatttttagcacaaaaatagccattgtaaagtgttaaaatttacgataagtattctattggggaggaaaggtaactctgatctcagttacagtttttttttcctttttaatttcattattttgggtttttggtttttgcagtcctatttatctgcagtcgtattaagtcctattgctagaataggttactacaaaaaaggttatattctgaaagaaaaataactgacattatatataaccaattaatttaaagtattgccatttaaattacacactgagagcatgtcctatgcagacatagatttttctgttcatttatttttcttcattgcagtggattgatttgataaatagatgtgttgaattactacatttgctgtacatattatttaataaactttattcagaattgcgtggc

SEQ ID NO: 314190 - DNA, 5938 bp, Homo sapiens
gcggggccagctgcagcgtgtagtgcgagtggggcggacgcgcgcagcccgcccgcccggcgaccagcaaggagttggcatcctttggaagagttcgtgaaagctttctgcccagagctcctggaccaatgcatcttcccaccaccttaaaccactgagcagttcagagccccagttgcagacgacttgtcctgccaccaccatgagttctgaatgtgatggtggttccaaagctgtgatgaatggcttggcacctggcagcaatgggcaagacaaagacatggatcctacaaaaatctgcactgggaagggagcggtgactctccgggcctcgtcttcctacagggaaaccccaagcagtagccctgcgagccctcaggaaacccggcaacacgaaagcaaaccaggtctggagccagagccttcttcagcagatgagtggaggctttcttccagtgctgatgccaatggaaatgcccagccctcttcactcgctgccaagggctacagaagtgtgcatcccaaccttccttctgacaagtcccaggatgccacttcctccagtgcagcccagccggaggtaatagttgtccctctctacctggttaatactgacagagggcaagaaggcactgccagacctccaacacctctggggcctcttggctgcgtccccacaatcccagcgactgcctctgccgcctcacctctgaccttcccgactctagatgatttcattccccctcatctgcagaggtggccccaccacagccagccagcccgcgcctctggctcctttgcccccattagccagacgccaccatccttctcaccaccacctccgctggtccctcctgccccggaggacctccgcagagtctcggagcctgacctcacgggagctgtttcgagtaccgattccagtcctctactaaatgaagtttcttcttcccttattggaactgattcccaagcctttccatcagttagcaagccttcatccgcctatccctccacaacgattgtcaatcctactattgtgctcttgcaacacaatcgagaacagcaaaaacgactcagtagcctttcagatcctgtctcagaaagaagagtgggagagcaggactcagcaccaacccaggaaaaacccacctcacctggcaaggctattgaaaaaagagcaaaggatgacagtaggcgggtggtgaagagcactcaggacttaagcgatgtttccatggatgaagtgggcatcccactccggaacactgagagatcaaaagactggtacaagactatgtttaaacagatccacaaactgaacagagatgatgattcagatctgtactctcccagatactcattttctgaagacacaaaatctcccctttctgtgcctcgctcaaaaagtgagatgagctacattgatggtgagaaggtagtcaagaggtcggccacactacccctcccagcccgctcttcctcactgaagtcaagctcagaaagaaatgactgggaacccccagataagaaagtagatacaagaaaatatcgtgcagagcccaagagcatttacgaatatcagcctggcaagtcttccgttctgaccaacgaaaagatgagctcagccatcagccctactccggaaatttcttcagagactcctggatatatatattcttccaacttccatgcagtgaagagggaatcagacggggctcctggggatctcactagcttggagaatgagagacaaatttataaaagtgtcttggaaggtggtgacatccctcttcagggcctgagtgggctcaagcgaccatccagctctgcttccactaaagattcagaatcgccaagacattttataccagctgattacttggaatccacggaagaatttattcgaagacgtcatgatgataaagagatgagacctgccagagccaaatttgactttaaagctcagacactaaaggagcttcctctgcagaagggagatattgtttacatttataagcaaattgatcagaactggtatgaaggagaacaccacggccgggtgggaatcttcccacgcacctacatcgagcttcttcctcctgctgagaaggcacagcccaaaaagttgacaccagtgcaggttttggaatatggagaagctattgctaagtttaactttaatggtgatacacaagtagaaatgtccttcagaaagggtgagaggatcacactgctccggcaggtagatgagaactggtacgaagggaggatcccggggacatcccgacaaggcatcttccccatcacctacgtggatgtgatcaagcgaccactggtgaaaaaccctgtggattacatggacctgcctttctcctcctccccaagtcgcagtgccactgcaagcccacagcaacctcaagcccagcagcgaagagtcacccccgacaggagtcaaacctcacaagatttatttagctatcaagcattatatagctatataccacagaatgatgatgagttggaactccgcgatggagatatcgttgatgtcatggaaaaatgtgacgatggatggtttgttggtacttcaagaaggacaaagcagtttggtacttttccaggcaactatgtaaaacctttgtatctataagaagactgaaaaccatggagattatttttattggaggaggaagcatcattcatgaaccgatctttttagttgagtcagtaggaaaattaatacagtggataaagtaagaagcaaaagacagggacagagaagtgttgtgtttaaaacccaagcctgtctaaggttactgtgtattagacagggccgaactagtgtgctgagcaaaaagaattgaagcaaattgtatttacttagccgcttctgggagccacttcagcctttcccctcccctccacttcttgggtaatctgacctgaagcatagtccaggagcagagttagccagaaatgcctcctgctgccccagccttagagagctcccatctcaatcattgagcctgaaggcttcaagcccaagaatgcaacaagacccccagcctacatttctcagctcccctggagccagctgatcctgtaacgctgctggaggtcagtctgagctaccaagactgtccctagacaaaggtggagtcccccacactgcccaagaccaaatccctcactcaacctgctgaggtgtggatggggaaacagaggcaaaactgaggcacctgatgcattcagcctgctgtgcagcagtgccattgactgccctgatgttcagagagaaacgcacacaaggtttgcccatgagaattggggagcagatggccaagcagataggttatgtctgttttctgagtgatgaagtcaggaagccctgtggctctggaggccacttgtggttcattcttttcccatatccttggcttttagaaatggttaccttcaggacagtgcagctgcatttatcagagcactattgctaagttttcttttctggcttgtgtttttctgggacagtttagaattgggaggcctattctcatagaacaccaaaaatgatgttcagtgattcatttaacatacaccaatgtactctggctgctggggggacaaccataagcaagacatgcccagggtttgccgtggctccagatctactccctgtaggagttcaaggatcacacaaacggtagtaaccagggttgtgaatctgagtacaccctggcaaggcttctcttcagactgaagcagcaattctgccactaccagcagcaaccaggacgtctgttctttgtgggggccagatcagaagagagaggcccctgtgacgcccgggctgcttggtcacaactctgtccaattcaaggatgtttatcggcctctcttagatcctgagtgagacaaatacagaaatgacccattccctgcccaccagaaactcagaggtgattggggagactgacacaggaaaatgaacttaatcaagagagactgtgatatgtgctaagaagggtgtgagggagggagagatgaattttccctggagggatcctagaaagcattgtcatattgccatctccattagctcacttttaaacaactagggtgctggaagaacctttgtctgagggtagttcatagctggaaatacttggaatattttccagagtctctaaactctcatcttcccccacagatacacatccaagctcacaaataggagtagcaattctaggtggtagggttgtgtacggaacccctggctgtctgcatatatctcagaattaccccaggaccattgtcccaaagtctagagtctttacaggtaggcaaaatttgttttcaatgcctgtgcctcagctgctgtcacaaatacccatcttaggatcccatcagcttcccatcccccaccagacagccacagtaccctcactttctccctattgttctttcaaatcctgttctcaggaaagaaactgccactaattcattcacactaaggtgtaaatgattgataataggaatgagttacctcttcccacagacatttgtttttaagtatgacagagcagggccttaatcccaagggaaaaggttatggaactggagggggtgagctttctgggtagaaggagacttcctgaatttccttaaaacccagtaagagtaagacctgttgttttggaaggtctgctccaccatctaagagcactgtttttttttttttgttgttgttgttgttttacggtctctgagggaatatagtaaaaatgcatatgcacgtgcaatttgcacggcagcatttcaccgattgtggactgtattggctaatgtgtttcctggtctttagatgcaaaccattaataacactatcttatctcatagttttttcaggggtgcttcttgattagtagggaattttgaacacctctttaaatacagctagaaaataaaaccaatttgtaaagccacatttgcatatgatgccagcctcacgcatttgtatatctccagaaattcaggtatgcctcaccaatttgcccgtctttaataaaatcttgtgttaaaatttgcatcacgtcgccttcctatgtatgacgaaacaagaaacagagatttccaattgctcttttgtcttcagacatttagtaatataaagtacctatttttatgctgaaatgtttatacaggtttattaatagcaagtgcaactaactggcggcatgccttgcaacacattttgatatattagccatgcttccgggtaaaggcaagccccaaactccttatcttttgcagtctctctgggatcagtaaaagaaaaaaaaaataatgtgcttaagaagtgggactgtaaatatgtatatttaactttgtatagcccatgtacctaccttgtatagaaaaataattttaaaaatttgaatggaagggggtaaaggaagtcatgaagtttttttgcatttttatttaaatgaaggaattccaaataactcacctacagatttttagcacaaaaatagccattgtaaagtgttaaaatttacgataagtattctattggggaggaaaggtaactctgatctcagttacagtttttttttcctttttaatttcattattttgggtttttggtttttgcagtcctatttatctgcagtcgtattaagtcctattgctagaataggttactacaaaaaaggttatattctgaaagaaaaataactgacattatatataaccaattaatttaaagtattgccatttaaattacacactgagagcatgtcctatgcagacatagatttttctgttcatttatttttcttcattgcagtggattgatttgataaatagatgtgttgaattactacatttgctgtacatattatttaataaactttattcagaattgcgtggc

SEQ ID NO: 314191 - DNA, 4113 bp, Homo sapiens
gattattttgcttccggacctcgactggaaattttttaaaagcccttatgacaaatgagcatgttacctctccttttttctttttagcagctttcagctttaacctaatgggtctatttattttattctgcatgcttaccagtggatcgtaaaggtgggaatgctcacatgatttcttcatcttcagtccatagccgaacgtttaacactagcaatgcgttaggccctgtgtgtaagcacaagaagcccctgtcagctgcgaaggcctgcatttcggaaatccttccatccaaattcaaacccaggctctctgctcccagcgctcttttgcaggaacagaagagtatcctcttgccctcagagaaggctcaaagctgtgagaacctttgtgtttctggttctttaaatgattccaaaagaggcctccccctccaagtgggagggagcattgagaacctgctcatgcgctcccgacgggattatgacagcaagtcgagcagtaccatgagcctccaggagtacagcaccagcggcaggaggccctgtcctctctcaagaaaggctgggatgcagttcaccatgctttatcgggacatgcaccagatcaaccgatctggcctcttcctgggctccatctcctcctcctcgagtgtgcgggatcttgcctcccactttgaaaagagtagcctggcattgtccaggggtgagctgggccccagccaggagggctcggaacacatccccaagcacaccgtctcttcccgcatcaccgcttttgagcagctaattcagcggtcccgttccatgccatccctggacctgtccggaaggctgagcaagtctcccacacctgtgctgtcccggggcagcctgacctcagcccgctcggccgagtccctacttgagtcaaccaagctccatcccaaggagatggatgggatgaactccagtggggtctatgcttccccaacatgtagcaatatggcacaccatgccttgagcttcaggggccttgtgccttctgagcctctctccacctgctctgatgacgtggaccgctgttcaaatatctccactgacagcagagaaggcagtggcggcagtgttcatggagatttccccaaacatcgcctcaacaagtgcaagggcacctgcccggcctcatacacccgcttcaccaccatccggaagcatgagcagcagcagacctctagacagcctgagtggcgcctggatgccagaggggacaagagcaccctcctcaggaacatctacctaatgagcccccttcctttccggctgaaaaagcccctccaccaccaccccagacaaccttcccctggtgactcctcaggcctcctggtgggccagaagccagacctccccagtcagccccatcaggaccagcccccttctggggggaagcccgtggttcccacacgcctgtcttcccgacacaccatggccaggcttagccgcagctcagagccctctcaggagagacccacggccctggaggactacccaagggccattaataatggaaactccgtgccatactcagaccacagcctggacaggaacaacaacccacaaagtgaactggcaccatcccgtggaggtggcattttgtgtgtttgcctagtctcacctgcccgtccctccactttgcttgcattatcccgtcctcctctgtgcccttggtgctcattttctggtctgtcctttgttttctgtttgttttgcttggcaattaatcatggctcgtagtggctgcacttctttaaaaacaaagcccccatgtcatttagactaaccaccaaactgtgtttcgaaagaaaaattggccgtttagctcaactgagaaatgtgttcatttgaactcttgaaccccttgctgtttgcaccaatccccaacataccccatggtttttttgagaggcagcctctctcaatggccctatatgtgtgtgagtgtgtgccttgtccctataaggtcctgcacgcctctttgtagggacactttacaaagaaagttctctcattttgctcaccttttgccttttgagtagttttctttgcattaaactagttcacaaataaatccaaaaaatggggtggggggtggaatttttttttccttcagaattcgaccattgatcattaatcaagaatgacttcaaaattttgatatttataatagatgaaaggtgaactcttttcgcaagctggtttccagcgaaatctttgcctgttttaactctactttgttgttttaaagattcagaatcgccaagacatttcttcatttcctcctctgcttcccgtcagcctcccaaaaagatatgggattatactcctggagactgctctatccttcctagagaggatagaaaggtaattccgctgtgcctcctccgttggactgtgtgtgctctctagccttggttagtgtgagtgtgttgtgggtttgtttgtttgtttgtttgttttcttaaatcacttttgaaaaaacttgatgctttttttttttttggttaggtaataaaactatgtaacaaattctctaagacatatactaatgtttagaggtttttaaagcaattacgtattcttctgacatatagtatttgtcactgtcaccacactctgaaaaaagagaaaataggcatttccttaaaggtaggtttttgtagttctccgtagcaagtagaatagctttttgaagctctgatgacttcaggatttctgctttatatgcctaatgttacattctctgttttcatgtcttcaactaatttccagtgagctcttgtgttttaatcatgctatcttggccgtatgaaagtataacactaagaaaaaaattcatttttttcaaacgtaaccttccattctttctccctttcctctaaactaaaaccttctttcccatcttttctttcttgaaccagactaatctagacaaagatctcagcctctgccagacagagttagaggcagatttagaaaaaatggagacgcttaataaagcacccagtgcaaacgtgccacaggtatttcctagtttttctcatgccatcagttccttttcaagctgtgctttgttttcttctttgttctatggtttttgatgtagttgaggtgacggatggtgatgctggctattttaggctgcatggctttctgactactgttttagactccttcccccacacctacccagttcatttttgcttggttttcttttgagcttggcatcttccttaaaggggattcttcaaatatatgcagagaggctgctgattgaaactactctcccaccttattctcttcctctgctttccaggggcgaccttttaagttcccttcctttgcctctgtctgccttctctgaattttcagggagccatttttggcagtttccatgtcttttttgcagccctgggagataccaacctcaaagatcagtttcaaaaactcagcagcagtgctttgggtaccctttctgtgcatggtgctctcagagtagtagtgtttgtcattttaaagttcagaaagttctcaatgaaaaatgcactcagaggtcagatggcctggacacacaaaaaaagtgtttgaaactgagtctgccatgatattttaaagggagctatgtcaaaatgtggtttattaaagggtatacgagagagagtaagagagagagagaaagacatcatggtaagtaggtttccaaggaggaaaaaaccaaatgttcatagaactgcctggagggctccctgacaaaacaaaagagactcttaaaaggaaaaggtatctttagagaaggtacaaaaggaggccgggcgcggtggctcacgcctgtaatcccagcaatttgggaggccgaggcaagtggatcacttgaggtcaggagttcaagaccagcgtggccaacatgatgaaacccagtctctactaaaaatacaaaaattagccaggcatggtggcaggcctctgtattcccagctatttgggaggctgaggcaggagaatcgcttgaattcgggaggcagagctgagatcacacctctgcactccagcctgggtgacagagcgagactccgtctcagg

SEQ ID NO: 314192 - DNA, 5967 bp, Homo sapiens
tgctgtagtgatctagaggatcccgatggcgggcgtcgtcccggccttgtctcccgcacagccggcacaggaaaaccaccccctgctcctcctcctgaccctcccaagctattctttgacatccgtaaagatgccgttaaccgtggcgagagtccttccctggggactcaggcttcgttcccagatgtgagaccacctgtgctaggcccccgggttacctctgatcccgaaaaccggaagagcaaagaatcttaccttttgcagccgagttatccagccaaggatgccacttcctccagtgcagcccagccggaggtaatagttgtccctctctacctggttaatactgacagagggcaagaaggcactgccagacctccaacacctctggggcctcttggctgcgtccccacaatcccagcgactgcctctgccgcctcacctctgaccttcccgactctagatgatttcattccccctcatctgcagaggtggccccaccacagccagccagcccgcgcctctggctcctttgcccccattagccagacgccaccatccttctcaccaccacctccgctggtccctcctgccccggaggacctccgcagagtctcggagcctgacctcacgggagctgtttcgagtaccgattccagtcctctactaaatgaagtttcttcttcccttattggaactgattcccaagcctttccatcagttagcaagccttcatccgcctatccctccacaacgattgtcaatcctactattgtgctcttgcaacacaatcgagaacagcaaaaacgactcagtagcctttcagatcctgtctcagaaagaagagtgggagagcaggactcagcaccaacccaggaaaaacccacctcacctggcaaggctattgaaaaaagagcaaaggatgacagtaggcgggtggtgaagagcactcaggacttaagcgatgtttccatggatgaagtgggcatcccactccggaacactgagagatcaaaagactggtacaagactatgtttaaacagatccacaaactgaacagagatgatgattcagatctgtactctcccagatactcattttctgaagacacaaaatctcccctttctgtgcctcgctcaaaaagtgagatgagctacattgatggtgagaaggtagtcaagaggtcggccacactacccctcccagcccgctcttcctcactgaagtcaagctcagaaagaaatgactgggaacccccagataagaaagtagatacaagaaaatatcgtgcagagcccaagagcatttacgaatatcagcctggcaagtcttccgttctgaccaacgaaaagatgagctcagccatcagccctactccggaaatttcttcagagactcctggatatatatattcttccaacttccatgcagtgaagagggaatcagacggggctcctggggatctcactagcttggagaatgagagacaaatttataaaagtgtcttggaaggtggtgacatccctcttcagggcctgagtgggctcaagcgaccatccagctctgcttccactaaagattcagaatcgccaagacattttataccagctgattacttggaatccacggaagaatttattcgaagacgtcatgatgataaagagaaacttttagcggaccagagacgacttaaacgcgagcaagaagaggctgatattgcagctcgacgccacacaggcgtcattccgacgcaccatcagtttatcactaatgagcgctttggggacctcctcaatatagacgatactgcaaaaaggaaatctgggtcagagatgagacctgccagagccaaatttgactttaaagctcagacactaaaggagcttcctctgcagaagggagatattgtttacatttataagcaaattgatcagaactggtatgaaggagaacaccacggccgggtgggaatcttcccacgcacctacatcgagcttcttcctcctgctgagaaggcacagcccaaaaagttgacaccagtgcaggttttggaatatggagaagctattgctaagtttaactttaatggtgatacacaagtagaaatgtccttcagaaagggtgagaggatcacactgctccggcaggtagatgagaactggtacgaagggaggatcccggggacatcccgacaaggcatcttccccatcacctacgtggatgtgatcaagcgaccactggtgaaaaaccctgtggattacatggacctgcctttctcctcctccccaagtcgcagtgccactgcaagcccacagcaacctcaagcccagcagcgaagagtcacccccgacaggagtcaaacctcacaagatttatttagctatcaagcattatatagctatataccacagaatgatgatgagttggaactccgcgatggagatatcgttgatgtcatggaaaaatgtgacgatggatggtttgttggtacttcaagaaggacaaagcagtttggtacttttccaggcaactatgtaaaacctttgtatctataagaagactgaaaaccatggagattatttttattggaggaggaagcatcattcatgaaccgatctttttagttgagtcagtaggaaaattaatacagtggataaagtaagaagcaaaagacagggacagagaagtgttgtgtttaaaacccaagcctgtctaaggttactgtgtattagacagggccgaactagtgtgctgagcaaaaagaattgaagcaaattgtatttacttagccgcttctgggagccacttcagcctttcccctcccctccacttcttgggtaatctgacctgaagcatagtccaggagcagagttagccagaaatgcctcctgctgccccagccttagagagctcccatctcaatcattgagcctgaaggcttcaagcccaagaatgcaacaagacccccagcctacatttctcagctcccctggagccagctgatcctgtaacgctgctggaggtcagtctgagctaccaagactgtccctagacaaaggtggagtcccccacactgcccaagaccaaatccctcactcaacctgctgaggtgtggatggggaaacagaggcaaaactgaggcacctgatgcattcagcctgctgtgcagcagtgccattgactgccctgatgttcagagagaaacgcacacaaggtttgcccatgagaattggggagcagatggccaagcagataggttatgtctgttttctgagtgatgaagtcaggaagccctgtggctctggaggccacttgtggttcattcttttcccatatccttggcttttagaaatggttaccttcaggacagtgcagctgcatttatcagagcactattgctaagttttcttttctggcttgtgtttttctgggacagtttagaattgggaggcctattctcatagaacaccaaaaatgatgttcagtgattcatttaacatacaccaatgtactctggctgctggggggacaaccataagcaagacatgcccagggtttgccgtggctccagatctactccctgtaggagttcaaggatcacacaaacggtagtaaccagggttgtgaatctgagtacaccctggcaaggcttctcttcagactgaagcagcaattctgccactaccagcagcaaccaggacgtctgttctttgtgggggccagatcagaagagagaggcccctgtgacgcccgggctgcttggtcacaactctgtccaattcaaggatgtttatcggcctctcttagatcctgagtgagacaaatacagaaatgacccattccctgcccaccagaaactcagaggtgattggggagactgacacaggaaaatgaacttaatcaagagagactgtgatatgtgctaagaagggtgtgagggagggagagatgaattttccctggagggatcctagaaagcattgtcatattgccatctccattagctcacttttaaacaactagggtgctggaagaacctttgtctgagggtagttcatagctggaaatacttggaatattttccagagtctctaaactctcatcttcccccacagatacacatccaagctcacaaataggagtagcaattctaggtggtagggttgtgtacggaacccctggctgtctgcatatatctcagaattaccccaggaccattgtcccaaagtctagagtctttacaggtaggcaaaatttgttttcaatgcctgtgcctcagctgctgtcacaaatacccatcttaggatcccatcagcttcccatcccccaccagacagccacagtaccctcactttctccctattgttctttcaaatcctgttctcaggaaagaaactgccactaattcattcacactaaggtgtaaatgattgataataggaatgagttacctcttcccacagacatttgtttttaagtatgacagagcagggccttaatcccaagggaaaaggttatggaactggagggggtgagctttctgggtagaaggagacttcctgaatttccttaaaacccagtaagagtaagacctgttgttttggaaggtctgctccaccatctaagagcactgtttttttttttttgttgttgttgttgttttacggtctctgagggaatatagtaaaaatgcatatgcacgtgcaatttgcacggcagcatttcaccgattgtggactgtattggctaatgtgtttcctggtctttagatgcaaaccattaataacactatcttatctcatagttttttcaggggtgcttcttgattagtagggaattttgaacacctctttaaatacagctagaaaataaaaccaatttgtaaagccacatttgcatatgatgccagcctcacgcatttgtatatctccagaaattcaggtatgcctcaccaatttgcccgtctttaataaaatcttgtgttaaaatttgcatcacgtcgccttcctatgtatgacgaaacaagaaacagagatttccaattgctcttttgtcttcagacatttagtaatataaagtacctatttttatgctgaaatgtttatacaggtttattaatagcaagtgcaactaactggcggcatgccttgcaacacattttgatatattagccatgcttccgggtaaaggcaagccccaaactccttatcttttgcagtctctctgggatcagtaaaagaaaaaaaaaataatgtgcttaagaagtgggactgtaaatatgtatatttaactttgtatagcccatgtacctaccttgtatagaaaaataattttaaaaatttgaatggaagggggtaaaggaagtcatgaagtttttttgcatttttatttaaatgaaggaattccaaataactcacctacagatttttagcacaaaaatagccattgtaaagtgttaaaatttacgataagtattctattggggaggaaaggtaactctgatctcagttacagtttttttttcctttttaatttcattattttgggtttttggtttttgcagtcctatttatctgcagtcgtattaagtcctattgctagaataggttactacaaaaaaggttatattctgaaagaaaaataactgacattatatataaccaattaatttaaagtattgccatttaaattacacactgagagcatgtcctatgcagacatagatttttctgttcatttatttttcttcattgcagtggattgatttgataaatagatgtgttgaattactacatttgctgtacatattatttaataaactttattcagaattgcgtggccaaaaaaaaaaaaaaaaaaaaaaaaacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaac

SEQ ID NO: 314193 - DNA, 6773 bp, Homo sapiens
aggaggaagcatcattcatgaaccgatctttgcagacgacttgtcctgccaccaccatgagttctgaatgtgatggtggttccaaagctgtgatgaatggcttggcacctggcagcaatgggcaagacaaagcaactgccgaccctttacgcgcacgctctatttctgctgttaaaatcattcctgtgaagacagtgaaaaacgcctcaggcctagttctccctacagacatggatcctacaaaaatctgcactgggaagggagcggtgactctccgggcctcgtcttcctacagggaaaccccaagcagtagccctgcgagccctcaggaaacccggcaacacgaaagcaaaccaggtctggagccagagccttcttcagcagatgagtggaggctttcttccagtgctgatgccaatggaaatgcccagccctcttcactcgctgccaagggctacagaagtgtgcatcccaaccttccttctgacaagtcccaggttctctctcccccacgccctcctctccctcaaaaggaccgctttgcatggcagtcccccaccatccacaatacctataaggattccctctacctgagctcaccaaagccttatgtcccactcggcacccccagacagcagaacccctcacaaccccagcctatctctgtcctcctggcagctggatcggctcccaaaggtgtggtgtgccctggttccttgcttccggactccacgttccccagtgcttcatcccaaccccagcagcgctatgcagccaccaggacagtttatcataagaatgtgagctctaacccatgtcatgaggcagttgggattaaaaaggtcagcagcttatatgtaccttgtttatccaataacatttgcctggcggcgtcagaaaactcctctcgtgttgcacgtgaccctgccgaaggcactcccttggaggctgcgggcacccgagcaccggctcccggccttgtctcccgcacagccggcacaggaaaaccaccccctgctcctcctcctgaccctcccaagctattctttgacatccgtaaagatgccgttaaccgtggcgagagtccttccctggggactcaggcttcgttcccagatgtgagaccacctgtgctaggcccccgggttacctctgatcccgaaaaccggaagagcaaagaatcttaccttttgcagccgagttatccagccaaggatgccacttcctccagtgcagcccagccggaggtaatagttgtccctctctacctggttaatactgacagagggcaagaaggcactgccagacctccaacacctctggggcctcttggctgcgtccccacaatcccagcgactgcctctgccgcctcacctctgaccttcccgactctagatgatttcattccccctcatctgcagaggtggccccaccacagccagccagcccgcgcctctggctcctttgcccccattagccagacgccaccatccttctcaccaccacctccgctggtccctcctgccccggaggacctccgcagagtctcggagcctgacctcacgggagctgtttcgagtaccgattccagtcctctactaaatgaagtttcttcttcccttattggaactgattcccaagcctttccatcagttagcaagccttcatccgcctatccctccacaacgattgtcaatcctactattgtgctcttgcaacacaatcgagaacagcaaaaacgactcagtagcctttcagatcctgtctcagaaagaagagtgggagagcaggactcagcaccaacccaggaaaaacccacctcacctggcaaggctattgaaaaaagagcaaaggatgacagtaggcgggtggtgaagagcactcaggacttaagcgatgtttccatggatgaagtgggcatcccactccggaacactgagagatcaaaagactggtacaagactatgtttaaacagatccacaaactgaacagagatgatgattcagatctgtactctcccagatactcattttctgaagacacaaaatctcccctttctgtgcctcgctcaaaaagtgagatgagctacattgatggtgagaaggtagtcaagaggtcggccacactacccctcccagcccgctcttcctcactgaagtcaagctcagaaagaaatgactgggaacccccagataagaaagtagatacaagaaaatatcgtgcagagcccaagagcatttacgaatatcagcctggcaagtcttccgttctgaccaacgaaaagatgagctcagccatcagccctactccggaaatttcttcagagactcctggatatatatattcttccaacttccatgcagtgaagagggaatcagacggggctcctggggatctcactagcttggagaatgagagacaaatttataaaagtgtcttggaaggtggtgacatccctcttcagggcctgagtgggctcaagcgaccatccagctctgcttccactaaagattcagaatcgccaagacattttataccagctgattacttggaatccacggaagaatttattcgaagacgtcatgatgataaagagaaacttttagcggaccagagacgacttaaacgcgagcaagaagaggctgatattgcagctcgacgccacacaggcgtcattccgacgcaccatcagtttatcactaatgagcgctttggggacctcctcaatatagacgatactgcaaaaaggaaatctgggtcagagatgagacctgccagagccaaatttgactttaaagctcagacactaaaggagcttcctctgcagaagggagatattgtttacatttataagcaaattgatcagaactggtatgaaggagaacaccacggccgggtgggaatcttcccacgcacctacatcgagcttcttcctcctgctgagaaggcacagcccaaaaagttgacaccagtgcaggttttggaatatggagaagctattgctaagtttaactttaatggtgatacacaagtagaaatgtccttcagaaagggtgagaggatcacactgctccggcaggtagatgagaactggtacgaagggaggatcccggggacatcccgacaaggcatcttccccatcacctacgtggatgtgatcaagcgaccactggtgaaaaaccctgtggattacatggacctgcctttctcctcctccccaagtcgcagtgccactgcaagcccacagcaacctcaagcccagcagcgaagagtcacccccgacaggagtcaaacctcacaagatttatttagctatcaagcattatatagctatataccacagaatgatgatgagttggaactccgcgatggagatatcgttgatgtcatggaaaaatgtgacgatggatggtttgttggtacttcaagaaggacaaagcagtttggtacttttccaggcaactatgtaaaacctttgtatctataagaagactgaaaaccatggagattatttttattggaggaggaagcatcattcatgaaccgatctttttagttgagtcagtaggaaaattaatacagtggataaagtaagaagcaaaagacagggacagagaagtgttgtgtttaaaacccaagcctgtctaaggttactgtgtattagacagggccgaactagtgtgctgagcaaaaagaattgaagcaaattgtatttacttagccgcttctgggagccacttcagcctttcccctcccctccacttcttgggtaatctgacctgaagcatagtccaggagcagagttagccagaaatgcctcctgctgccccagccttagagagctcccatctcaatcattgagcctgaaggcttcaagcccaagaatgcaacaagacccccagcctacatttctcagctcccctggagccagctgatcctgtaacgctgctggaggtcagtctgagctaccaagactgtccctagacaaaggtggagtcccccacactgcccaagaccaaatccctcactcaacctgctgaggtgtggatggggaaacagaggcaaaactgaggcacctgatgcattcagcctgctgtgcagcagtgccattgactgccctgatgttcagagagaaacgcacacaaggtttgcccatgagaattggggagcagatggccaagcagataggttatgtctgttttctgagtgatgaagtcaggaagccctgtggctctggaggccacttgtggttcattcttttcccatatccttggcttttagaaatggttaccttcaggacagtgcagctgcatttatcagagcactattgctaagttttcttttctggcttgtgtttttctgggacagtttagaattgggaggcctattctcatagaacaccaaaaatgatgttcagtgattcatttaacatacaccaatgtactctggctgctggggggacaaccataagcaagacatgcccagggtttgccgtggctccagatctactccctgtaggagttcaaggatcacacaaacggtagtaaccagggttgtgaatctgagtacaccctggcaaggcttctcttcagactgaagcagcaattctgccactaccagcagcaaccaggacgtctgttctttgtgggggccagatcagaagagagaggcccctgtgacgcccgggctgcttggtcacaactctgtccaattcaaggatgtttatcggcctctcttagatcctgagtgagacaaatacagaaatgacccattccctgcccaccagaaactcagaggtgattggggagactgacacaggaaaatgaacttaatcaagagagactgtgatatgtgctaagaagggtgtgagggagggagagatgaattttccctggagggatcctagaaagcattgtcatattgccatctccattagctcacttttaaacaactagggtgctggaagaacctttgtctgagggtagttcatagctggaaatacttggaatattttccagagtctctaaactctcatcttcccccacagatacacatccaagctcacaaataggagtagcaattctaggtggtagggttgtgtacggaacccctggctgtctgcatatatctcagaattaccccaggaccattgtcccaaagtctagagtctttacaggtaggcaaaatttgttttcaatgcctgtgcctcagctgctgtcacaaatacccatcttaggatcccatcagcttcccatcccccaccagacagccacagtaccctcactttctccctattgttctttcaaatcctgttctcaggaaagaaactgccactaattcattcacactaaggtgtaaatgattgataataggaatgagttacctcttcccacagacatttgtttttaagtatgacagagcagggccttaatcccaagggaaaaggttatggaactggagggggtgagctttctgggtagaaggagacttcctgaatttccttaaaacccagtaagagtaagacctgttgttttggaaggtctgctccaccatctaagagcactgtttttttttttttgttgttgttgttgttttacggtctctgagggaatatagtaaaaatgcatatgcacgtgcaatttgcacggcagcatttcaccgattgtggactgtattggctaatgtgtttcctggtctttagatgcaaaccattaataacactatcttatctcatagttttttcaggggtgcttcttgattagtagggaattttgaacacctctttaaatacagctagaaaataaaaccaatttgtaaagccacatttgcatatgatgccagcctcacgcatttgtatatctccagaaattcaggtatgcctcaccaatttgcccgtctttaataaaatcttgtgttaaaatttgcatcacgtcgccttcctatgtatgacgaaacaagaaacagagatttccaattgctcttttgtcttcagacatttagtaatataaagtacctatttttatgctgaaatgtttatacaggtttattaatagcaagtgcaactaactggcggcatgccttgcaacacattttgatatattagccatgcttccgggtaaaggcaagccccaaactccttatcttttgcagtctctctgggatcagtaaaagaaaaaaaaaataatgtgcttaagaagtgggactgtaaatatgtatatttaactttgtatagcccatgtacctaccttgtatagaaaaataattttaaaaatttgaatggaagggggtaaaggaagtcatgaagtttttttgcatttttatttaaatgaaggaattccaaataactcacctacagatttttagcacaaaaatagccattgtaaagtgttaaaatttacgataagtattctattggggaggaaaggtaactctgatctcagttacagtttttttttcctttttaatttcattattttgggtttttggtttttgcagtcctatttatctgcagtcgtattaagtcctattgctagaataggttactacaaaaaaggttatattctgaaagaaaaataactgacattatatataaccaattaatttaaagtattgccatttaaattacacactgagagcatgtcctatgcagacatagatttttctgttcatttatttttcttcattgcagtggattgatttgataaatagatgtgttgaattactacatttgctgtacatattatttaataaactttattcagaattgcgtggc

SEQ ID NO: 314194 - DNA, 6757 bp, Homo sapiens
aggaggaagcatcattcatgaaccgatctttgcagacgacttgtcctgccaccaccatgagttctgaatgtgatggtggttccaaagctgtgatgaatggcttggcacctggcagcaatgggcaagacaaagcaactgccgaccctttacgcgcacgctctatttctgctgttaaaatcattcctgtgaagacagtgaaaaacgcctcaggcctagttctccctacagacatggatcctacaaaaatctgcactgggaagggagcggtgactctccgggcctcgtcttcctacagggaaaccccaagcagtagccctgcgagccctcaggaaacccggcaacacgaaagcaaaccaggtctggagccagagccttcttcagcagatgagtggaggctttcttccagtgctgatgccaatggaaatgcccagccctcttcactcgctgccaagggctacagaagtgtgcatcccaaccttccttctgacaagtcccaggttctctctcccccacgccctcctctccctcaaaaggaccgctttgcatggcagtcccccaccatccacaatacctataaggattccctctacctgagctcaccaaagccttatgtcccactcggcacccccagacagcagaacccctcacaaccccagcctatctctgtcctcctggcagctggatcggctcccaaaggtgtggtgtgccctggttccttgcttccggactccacgttccccagtgcttcatcccaaccccagcagcgctatgcagccaccaggacagtttatcataagaatgtgagctctaacccatgtcatgaggcagttgggattaaaaaggtcagcagcttatatgtaccttgtttatccaataacatttgcctggcggcgtcagaaaactcctctcgtgttgcacgtgaccctgccgaaggcactcccttggaggctgcgggcacccgagcaccggctcccggccttgtctcccgcacagccggcacaggaaaaccaccccctgctcctcctcctgaccctcccaagctattctttgacatccgtaaagatgccgttaaccgtggcgagagtccttccctggggactcaggcttcgttcccagatgtgagaccacctgtgctaggcccccgggttacctctgatcccgaaaaccggaagagcaaagaatcttaccttttgcagccgagttatccagccaaggatgccacttcctccagtgcagcccagccggaggtaatagttgtccctctctacctggttaatactgacagagggcaagaaggcactgccagacctccaacacctctggggcctcttggctgcgtccccacaatcccagcgactgcctctgccgcctcacctctgaccttcccgactctagatgatttcattccccctcatctgcagaggtggccccaccacagccagccagcccgcgcctctggctcctttgcccccattagccagacgccaccatccttctcaccaccacctccgctggtccctcctgccccggaggacctccgcagagtctcggagcctgacctcacgggagctgtttcgagtaccgattccagtcctctactaaatgaagtttcttcttcccttattggaactgattcccaagcctttccatcagttagcaagccttcatccgcctatccctccacaacgattgtcaatcctactattgtgctcttgcaacacaatcgagaacagcaaaaacgactcagtagcctttcagatcctgtctcagaaagaagagtgggagagcaggactcagcaccaacccaggaaaaacccacctcacctggcaaggctattgaaaaaagagcaaaggatgacagtaggcgggtggtgaagagcactcaggacttaagcgatgtttccatggatgaagtgggcatcccactccggaacactgagagatcaaaagactggtacaagactatgtttaaacagatccacaaactgaacagagatgatgattcagatctgtactctcccagatactcattttctgaagacacaaaatctcccctttctgtgcctcgctcaaaaagtgagatgagctacattgatggtgagaaggtagtcaagaggtcggccacactacccctcccagcccgctcttcctcactgaagtcaagctcagaaagaaatgactgggaacccccagataagaaagtagatacaagaaaatatcgtgcagagcccaagagcatttacgaatatcagcctggcaagtcttccgttctgaccaacgaaaagatgagctcagccatcagccctactccggaaatttcttcagagactcctggatatatatattcttccaacttccatgcagtgaagagggaatcagacggggctcctggggatctcactagcttggagaatgagagacaaatttataaaagtgtcttggaaggtggtgacatccctcttcagggcctgagtgggctcaagcgaccatccagctctgcttccactaaagattcagaatcgccaagacattttataccagctgattacttggaatccacggaagaatttattcgaagacgtcatgatgataaagagaaacttttagcggaccagagacgacttaaacgcgagcaagaagaggctgatattgcagctcgacgccacacaggcgtcattccgacgcaccatcagtttatcactaatgagcgctttggggacctcctcaatatagacgatactgcaaaaaggaaatctgggtcagagatgagacctgccagagccaaatttgactttaaagctcagacactaaaggagcttcctctgcagaagggagatattgtttacatttataagcaaattgatcagaactggtatgaaggagaacaccacggccgggtgggaatcttcccacgcacctacatcgagcttcttcctcctgctgagaaggcacagcccaaaaagttgacaccagtgcaggttttggaatatggagaagctattgctaagtttaactttaatggtgatacacaagtagaaatgtccttcagaaagggtgagaggatcacactgctccggcaggtagatgagaactggtacgaagggaggatcccggggacatcccgacaaggcatcttccccatcacctacgtggatgtgatcaagcgaccactggtgaaaaaccctgtggattacatggacctgcctttctcctcctccccaagtcgcagtgccactgcaagcccacagcaacctcaagcccagcagcgaagagtcacccccgacaggagtcaaacctcacaagatttatttagctatcaagcattatatagctatataccacagaatgatgatgagttggaactccgcgatggagatatcgttgatgtcatggaaaaatgtgacgatggatggtttgttggtacttcaagaaggacaaagcagtttggtacttttccaggcaactatgtaaaacctttgtatctataagaagactgaaaaccatggagattatttttattggaggaggaagcatcattcatgaaccgatctttttagttgagtcagtaggaaaattaatacagtggataaagtaagaagcaaaagacagggacagagaagtgttgtgtttaaaacccaagcctgtctaaggttactgtgtattagacagggccgaactagtgtgctgagcaaaaagaattgaagcaaattgtatttacttagccgcttctgggagccacttcagcctttcccctcccctccacttcttgggtaatctgacctgaagcatagtccaggagcagagttagccagaaatgcctcctgctgccccagccttagagagctcccatctcaatcattgagcctgaaggcttcaagcccaagaatgcaacaagacccccagcctacatttctcagctcccctggagccagctgatcctgtaacgctgctggaggtcagtctgagctaccaagactgtccctagacaaaggtggagtcccccacactgcccaagaccaaatccctcactcaacctgctgaggtgtggatggggaaacagaggcaaaactgaggcacctgatgcattcagcctgctgtgcagcagtgccattgactgccctgatgttcagagagaaacgcacacaaggtttgcccatgagaattggggagcagatggccaagcagataggttatgtctgttttctgagtgatgaagtcaggaagccctgtggctctggaggccacttgtggttcattcttttcccatatccttggcttttagaaatggttaccttcaggacagtgcagctgcatttatcagagcactattgctaagttttcttttctggcttgtgtttttctgggacagtttagaattgggaggcctattctcatagaacaccaaaaatgatgttcagtgattcatttaacatacaccaatgtactctggctgctggggggacaaccataagcaagacatgcccagggtttgccgtggctccagatctactccctgtaggagttcaaggatcacacaaacggtagtaaccagggttgtgaatctgagtacaccctggcaaggcttctcttcagactgaagcagcaattctgccactaccagcagcaaccaggacgtctgttctttgtgggggccagatcagaagagagaggcccctgtgacgcccgggctgcttggtcacaactctgtccaattcaaggatgtttatcggcctctcttagatcctgagtgagacaaatacagaaatgacccattccctgcccaccagaaactcagaggtgattggggagactgacacaggaaaatgaacttaatcaagagagactgtgatatgtgctaagaagggtgtgagggagggagagatgaattttccctggagggatcctagaaagcattgtcatattgccatctccattagctcacttttaaacaactagggtgctggaagaacctttgtctgagggtagttcatagctggaaatacttggaatattttccagagtctctaaactctcatcttcccccacagatacacatccaagctcacaaataggagtagcaattctaggtggtagggttgtgtacggaacccctggctgtctgcatatatctcagaattaccccaggaccattgtcccaaagtctagagtctttacaggtaggcaaaatttgttttcaatgcctgtgcctcagctgctgtcacaaatacccatcttaggatcccatcagcttcccatcccccaccagacagccacagtaccctcactttctccctattgttctttcaaatcctgttctcaggaaagaaactgccactaattcattcacactaaggtgtaaatgattgataataggaatgagttacctcttcccacagacatttgtttttaagtatgacagagcagggccttaatcccaagggaaaaggttatggaactggagggggtgagctttctgggtagaaggagacttcctgaatttccttaaaacccagtaagagtaagacctgttgttttggaaggtctgctccaccatctaagagcactgtttttttttttttgttgttgttgttgttttacggtctctgagggaatatagtaaaaatgcatatgcacgtgcaatttgcacggcagcatttcaccgattgtggactgtattggctaatgtgtttcctggtctttagatgcaaaccattaataacactatcttatctcatagttttttcaggggtgcttcttgattagtagggaattttgaacacctctttaaatacagctagaaaataaaaccaatttgtaaagccacatttgcatatgatgccagcctcacgcatttgtatatctccagaaattcaggtatgcctcaccaatttgcccgtctttaataaaatcttgtgttaaaatttgcatcacgtcgccttcctatgtatgacgaaacaagaaacagagatttccaattgctcttttgtcttcagacatttagtaatataaagtacctatttttatgctgaaatgtttatacaggtttattaatagcaagtgcaactaactggcggcatgccttgcaacacattttgatatattagccatgcttccgggtaaaggcaagccccaaactccttatcttttgcagtctctctgggatcagtaaaagaaaaaaaaaataatgtgcttaagaagtgggactgtaaatatgtatatttaactttgtatagcccatgtacctaccttgtatagaaaaataattttaaaaatttgaatggaagggggtaaaggaagtcatgaagtttttttgcatttttatttaaatgaaggaattccaaataactcacctacagatttttagcacaaaaatagccattgtaaagtgttaaaatttacgataagtattctattggggaggaaaggtaactctgatctcagttacagtttttttttcctttttaatttcattattttgggtttttggtttttgcagtcctatttatctgcagtcgtattaagtcctattgctagaataggttactacaaaaaaggttatattctgaaagaaaaataactgacattatatataaccaattaatttaaagtattgccatttaaattacacactgagagcatgtcctatgcagacatagatttttctgttcatttatttttcttcattgcagtggattgatttgataaatagatgtgttgaattactacatttgctgtacctcggccgcgaccacgctaa

SEQ ID NO: 314195 - DNA, 6431 bp, Homo sapiens
aggaggaagcatcattcatgaaccgatctttgcagacgacttgtcctgccaccaccatgagttctgaatgtgatggtggttccaaagctgtgatgaatggcttggcacctggcagcaatgggcaagacaaagcaactgccgaccctttacgcgcacgctctatttctgctgttaaaatcattcctgtgaagacagtgaaaaacgcctcaggcctagttctccctacagacatggatcctacaaaaatctgcactgggaagggagcggtgactctccgggcctcgtcttcctacagggaaaccccaagcagtagccctgcgagccctcaggaaacccggcaacacgaaagcaaaccaggtctggagccagagccttcttcagcagatgagtggaggctttcttccagtgctgatgccaatggaaatgcccagccctcttcactcgctgccaagggctacagaagtgtgcatcccaaccttccttctgacaagtcccaggttctctctcccccacgccctcctctccctcaaaaggaccgctttgcatggcagtcccccaccatccacaatacctataaggattccctctacctgagctcaccaaagccttatgtcccactcggcacccccagacagcagaacccctcacaaccccagcctatctctgtcctcctggcagctggatcggctcccaaaggtgtggtgtgccctggttccttgcttccggactccacgttccccagtgcttcatcccaaccccagcagcgctatgcagccaccaggacagtttatcataagaatgtgagctctaacccatgtcatgaggcagttgggattaaaaaggtcagcagcttatatgtaccttgtttatccaataacatttgcctggcggcgtcagaaaactcctctcgtgttgcacgtgaccctgccgaaggcactcccttggaggctgcgggcacccgagcaccggctcccggccttgtctcccgcacagccggcacaggaaaaccaccccctgctcctcctcctgaccctcccaagctattctttgacatccgtaaagatgccgttaaccgtggcgagagtccttccctggggactcaggcttcgttcccagatgtgagaccacctgtgctaggcccccgggttacctctgatcccgaaaaccggaagagcaaagaatcttaccttttgcagccgagttatccagccaaggatgccacttcctccagtgcagcccagccggaggtaatagttgtccctctctacctggttaatactgacagagggcaagaaggcactgccagacctccaacacctctggggcctcttggctgcgtccccacaatcccagcgactgcctctgccgcctcacctctgaccttcccgactctagatgatttcattccccctcatctgcagaggtggccccaccacagccagccagcccgcgcctctggctcctttgcccccattagccagacgccaccatccttctcaccaccacctccgctggtccctcctgccccggaggacctccgcagagtctcggagcctgacctcacgggagctgtttcgagtaccgattccagtcctctactaaatgaagtttcttcttcccttattggaactgattcccaagcctttccatcagttagcaagccttcatccgcctatccctccacaacgattgtcaatcctactattgtgctcttgcaacacaatcgagaacagcaaaaacgactcagtagcctttcagatcctgtctcagaaagaagagtgggagagcaggactcagcaccaacccaggaaaaacccacctcacctggcaaggctattgaaaaaagagcaaaggatgacagtaggcgggtggtgaagagcactcaggacttaagcgatgtttccatggatgaagtgggcatcccactccggaacactgagagatcaaaagactggtacaagactatgtttaaacagatccacaaactgaacagagatgatgattcagatctgtactctcccagatactcattttctgaagacacaaaatctcccctttctgtgcctcgctcaaaaagtgagatgagctacattgatggtgagaaggtagtcaagaggtcggccacactacccctcccagcccgctcttcctcactgaagtcaagctcagaaagaaatgactgggaacccccagataagaaagtagatacaagaaaatatcgtgcagagcccaagagcatttacgaatatcagcctggcaagtcttccgttctgaccaacgaaaagatgagctcagccatcagccctactccggaaatttcttcagagactcctggatatatatattcttccaacttccatgcagtgaagagggaatcagacggggctcctggggatctcactagcttggagaatgagagacaaatttataaaagtgtcttggaaggtggtgacatccctcttcagggcctgagtgggctcaagcgaccatccagctctgcttccactaaagattcagaatcgccaagacattttataccagctgattacttggaatccacggaagaatttattcgaagacgtcatgatgataaagagaaacttttagcggaccagagacgacttaaacgcgagcaagaagaggctgatattgcagctcgacgccacacaggcgtcattccgacgcaccatcagtttatcactaatgagcgctttggggacctcctcaatatagacgatactgcaaaaaggaaatctgggtcagagatgagacctgccagagccaaatttgactttaaagctcagacactaaaggagcttcctctgcagaagggagatattgtttacatttataagcaaattgatcagaactggtatgaaggagaacaccacggccgggtgggaatcttcccacgcacctacatcgagcttcttcctcctgctgagaaggcacagcccaaaaagttgacaccagtgcaggttttggaatatggagaagctattgctaagtttaactttaatggtgatacacaagtagaaatgtccttcagaaagggtgagaggatcacactgctccggcaggtagatgagaactggtacgaagggaggatcccggggacatcccgacaaggcatcttccccatcacctacgtggatgtgatcaagcgaccactggtgaaaaaccctgtggattacatggacctgcctttctcctcctccccaagtcgcagtgccactgcaagcccacagcaacctcaagcccagcagcgaagagtcacccccgacaggagtcaaacctcacaagatttatttagctatcaagcattatatagctatataccacagaatgatgatgagttggaactccgcgatggagatatcgttgatgtcatggaaaaatgtgacgatggatggtttgttggtacttcaagaaggacaaagcagtttggtacttttccaggcaactatgtaaaacctttgtatctataagaagactgaaaaccatggagattatttttattggaggaggaagcatcattcatgaaccgatctttttagttgagtcagtaggaaaattaatacagtggataaagtaagaagcaaaagacagggacagagaagtgttgtgtttaaaacccaagcctgtctaaggttactgtgtattagacagggccgaactagtgtgctgagcaaaaagaattgaagcaaattgtatttacttagccgcttctgggagccacttcagcctttcccctcccctccacttcttgggtaatctgacctgaagcatagtccaggagcagagttagccagaaatgcctcctgctgccccagccttagagagctcccatctcaatcattgagcctgaaggcttcaagcccaagaatgcaacaagacccccagcctacatttctcagctcccctggagccagctgatcctgtaacgctgctggaggtcagtctgagctaccaagactgtccctagacaaaggtggagtcccccacactgcccaagaccaaatccctcactcaacctgctgaggtgtggatggggaaacagaggcaaaactgaggcacctgatgcattcagcctgctgtgcagcagtgccattgactgccctgatgttcagagagaaacgcacacaaggtttgcccatgagaattggggagcagatggccaagcagataggttatgtctgttttctgagtgatgaagtcaggaagccctgtggctctggaggccacttgtggttcattcttttcccatatccttggcttttagaaatggttaccttcaggacagtgcagctgcatttatcagagcactattgctaagttttcttttctggcttgtgtttttctgggacagtttagaattgggaggcctattctcatagaacaccaaaaatgatgttcagtgattcatttaacatacaccaatgtactctggctgctggggggacaaccataagcaagacatgcccagggtttgccgtggctccagatctactccctgtaggagttcaaggatcacacaaacggtagtaaccagggttgtgaatctgagtacaccctggcaaggcttctcttcagactgaagcagcaattctgccactaccagcagcaaccaggacgtctgttctttgtgggggccagatcagaagagagaggcccctgtgacgcccgggctgcttggtcacaactctgtccaattcaaggatgtttatcggcctctcttagatcctgagtgagacaaatacagaaatgacccattccctgcccaccagaaactcagaggtgattggggagactgacacaggaaaatgaacttaatcaagagagactgtgatatgtgctaagaagggtgtgagggagggagagatgaattttccctggagggatcctagaaagcattgtcatattgccatctccattagcctcactttctccctattgttctttcaaatcctgttctcaggaaagaaactgccactaattcattcacactaaggtgtaaatgattgataataggaatgagttacctcttcccacagacatttgtttttaagtatgacagagcagggccttaatcccaagggaaaaggttatggaactggagggggtgagctttctgggtagaaggagacttcctgaatttccttaaaacccagtaagagtaagacctgttgttttggaaggtctgctccaccatctaagagcactgtttttttttttttgttgttgttgttgttttacggtctctgagggaatatagtaaaaatgcatatgcacgtgcaatttgcacggcagcatttcaccgattgtggactgtattggctaatgtgtttcctggtctttagatgcaaaccattaataacactatcttatctcatagttttttcaggggtgcttcttgattagtagggaattttgaacacctctttaaatacagctagaaaataaaaccaatttgtaaagccacatttgcatatgatgccagcctcacgcatttgtatatctccagaaattcaggtatgcctcaccaatttgcccgtctttaataaaatcttgtgttaaaatttgcatcacgtcgccttcctatgtatgacgaaacaagaaacagagatttccaattgctcttttgtcttcagacatttagtaatataaagtacctatttttatgctgaaatgtttatacaggtttattaatagcaagtgcaactaactggcggcatgccttgcaacacattttgatatattagccatgcttccgggtaaaggcaagccccaaactccttatcttttgcagtctctctgggatcagtaaaagaaaaaaaaaataatgtgcttaagaagtgggactgtaaatatgtatatttaactttgtatagcccatgtacctaccttgtatagaaaaataattttaaaaatttgaatggaagggggtaaaggaagtcatgaagtttttttgcatttttatttaaatgaaggaattccaaataactcacctacagatttttagcacaaaaatagccattgtaaagtgttaaaatttacgataagtattctattggggaggaaaggtaactctgatctcagttacagtttttttttcctttttaatttcattattttgggtttttggtttttgcagtcctatttatctgcagtcgtattaagtcctattgctagaataggttactacaaaaaaggttatattctgaaagaaaaataactgacattatatataaccaattaatttaaagtattgccatttaaattacacactgagagcatgtcctatgcagacatagatttttctgttcatttatttttcttcattgcagtggattgatttgataaatagatgtgttgaattactacatttgctgtacatattatttaataaactttattcagaattgcgtggc

SEQ ID NO: 314196 - DNA, 3115 bp, Homo sapiens
aggaggaagcatcattcatgaaccgatctttgcagacgacttgtcctgccaccaccatgagttctgaatgtgatggtggttccaaagctgtgatgaatggcttggcacctggcagcaatgggcaagacaaagcaactgccgaccctttacgcgcacgctctatttctgctgttaaaatcattcctgtgaagacagtgaaaaacgcctcaggcctagttctccctacagacatggatcctacaaaaatctgcactgggaagggagcggtgactctccgggcctcgtcttcctacagggaaaccccaagcagtagccctgcgagccctcaggaaacccggcaacacgaaagcaaaccaggtctggagccagagccttcttcagcagatgagtggaggctttcttccagtgctgatgccaatggaaatgcccagccctcttcactcgctgccaagggctacagaagtgtgcatcccaaccttccttctgacaagtcccaggttctctctcccccacgccctcctctccctcaaaaggaccgctttgcatggcagtcccccaccatccacaatacctataaggattccctctacctgagctcaccaaagccttatgtcccactcggcacccccagacagcagaacccctcacaaccccagcctatctctgtcctcctggcagctggatcggctcccaaaggtgtggtgtgccctggttccttgcttccggactccacgttccccagtgcttcatcccaaccccagcagcgctatgcagccaccaggacagtttatcataagaatgtgagctctaacccatgtcatgaggcagttgggattaaaaaggtcagcagcttatatgtaccttgtttatccaataacatttgcctggcggcgtcagaaaactcctctcgtgttgcacgtgaccctgccgaaggcactcccttggaggctgcgggcacccgagcaccggctcccggccttgtctcccgcacagccggcacaggaaaaccaccccctgctcctcctcctgaccctcccaagctattctttgacatccgtaaagatgccgttaaccgtggcgagagtccttccctggggactcaggcttcgttcccagatgtgagaccacctgtgctaggcccccgggttacctctgatcccgaaaaccggaagagcaaagaatcttaccttttgcagccgagttatccagccaaggatgccacttcctccagtgcagcccagccggaggtaatagttgtccctctctacctggttaatactgacagagggcaagaaggcactgccagacctccaacacctctggggcctcttggctgcgtccccacaatcccagcgactgcctctgccgcctcacctctgaccttcccgactctagatgatttcattccccctcatctgcagaggtggccccaccacagccagccagcccgcgcctctggctcctttgcccccattagccagacgccaccatccttctcaccaccacctccgctggtccctcctgccccggaggacctccgcagagtctcggagcctgacctcacgggagctgtttcgagtaccgattccagtcctctactaaatgaagtttcttcttcccttattggaactgattcccaagcctttccatcagttagcaagccttcatccgcctatccctccacaacgattgtcaatcctactattgtgctcttgcaacacaatcgaggtaagagaggcttgtgccccactcccagcccactggaatcaacatagctattccatgatacttgggtcagaaattctgttatttcacagaaattttcacaaatcccattgtttcccaaggccatttgccctcagtttactcactctcatggcccataaaataaatcccagcagacagacagaggcccctgatctgaggtgatatcaggtgtctgaataagtaagctgggttcgttccacttcttgggtgttcatgattgtcttcttcaaatcgtaacaccaaaaaaaaggagaaaggaaaaagtttgtgtctcttgatggtaatagagatttaacttcgaaaatctaggtacaataatacctcttttaagtagtatcttaaatgatttatttttttgacataatgaaatttagagagagcagaattttgagtatcaaatttaaaaaagaaaacatattgtgtagacaattttctggaatgtaaaacacgtttttgtaccttgaaaacagagactattgaatttttcttgaagactcactggccttcattcttgccagctgtttgtctctgtactatgtggctctaggcagctctgcttagagttttcatgtttgttttctgtagtgtctctgactgcttctggttggtttttctgcttctctgaaaagcagagaagctttgagttggggtgaagcggaagttctttgggtatatgttgacccttctgctttaaaattccagacgatgattctaaatcccaagttttcctttttggaaatccatacaggaataaactttgtctttacaaaagtcctttgcagcatgaaatgtaaagttttcaagctgtttcctcatgtagaaagggcttgttagtctgaatttctgataacagtggaggtttaattattttgttcagagctcacgtcttccttttgactctgtgctctctgacttcacagttttcctccactcctccccctcccccttcctctctgcattaatttgaatgagaatgggactggagtctatttttaattgttttccttactaaatagagtttttctgtttcctgcttctaacttgaaaagcagatgaataaaacattttctttcacttcagatctttccactaaaatcttaaggttgttttagtagttttgtattttttttcactatgtgtggctcctgtattaattttcacccatgaatctgggttcttaataaaaagggccccagctcccacacggaaccatgcaggagcccattctccttcagcggtgccatgccccttactggcagtggctctccttgcccagaaagtgtctgtaatgtgggacaaagtgaaattttgtttctctgaacttccttgtgactcatatttaaaaaaa

SEQ ID NO: 314197 - DNA, 2566 bp, Homo sapiens
aggaggaagcatcattcatgaaccgatctttgcagacgacttgtcctgccaccaccatgagttctgaatgtgatggtggttccaaagctgtgatgaatggcttggcacctggcagcaatgggcaagacaaagcaactgccgaccctttacgcgcacgctctatttctgctgttaaaatcattcctgtgaagacagtgaaaaacgcctcaggcctagttctccctacagacatggatcctacaaaaatctgcactgggaagggagcggtgactctccgggcctcgtcttcctacagggaaaccccaagcagtagccctgcgagccctcaggaaacccggcaacacgaaagcaaaccaggtctggagccagagccttcttcagcagatgagtggaggctttcttccagtgctgatgccaatggaaatgcccagccctcttcactcgctgccaagggctacagaagtgtgcatcccaaccttccttctgacaagtcccaggttctctctcccccacgccctcctctccctcaaaaggaccgctttgcatggcagtcccccaccatccacaatacctataaggattccctctacctgagctcaccaaagccttatgtcccactcggcacccccagacagcagaacccctcacaaccccagcctatctctgtcctcctggcagctggatcggctcccaaaggtgtggtgtgccctggttccttgcttccggactccacgttccccagtgcttcatcccaaccccagcagcgctatgcagccaccaggacagtttatcataagaatgtgagctctaacccatgtcatgaggcagttgggattaaaaaggtcagcagcttatatgtaccttgtttatccaataacatttgcctggcggcgtcagaaaactcctctcgtgttgcacgtgaccctgccgaaggcactcccttggaggctgcgggcacccgagcaccggctcccggccttgtctcccgcacagccggcacaggaaaaccaccccctgctcctcctcctgaccctcccaagctattctttgacatccgtaaagatgccgttaaccgtggcgagagtccttccctggggactcaggcttcgttcccagatgtgagaccacctgtgctaggcccccgggttacctctgatcccgaaaaccggaagagcaaagaatcttaccttttgcagccgagttatccagccaaggatgccacttcctccagtgcagcccagccggaggtaatagttgtccctctctacctggttaatactgacagagggcaagaaggcactgccagacctccaacacctctggggcctcttggctgcgtccccacaatcccagcgactgcctctgccgcctcacctctgaccttcccgactctagatgatttcattccccctcatctgcagaggtggccccaccacagccagccagcccgcgcctctggctcctttgcccccattagccagacgccaccatccttctcaccaccacctccgctggtccctcctgccccggaggacctccgcagagtctcggagcctgacctcacgggagctgtttcgagtaccgattccagtcctctactaaatgaagtttcttcttcccttattggaactgattcccaagcctttccatcagttagcaagccttcatccgcctatccctccacaacgattgtcaatcctactattgtgctcttgcaacacaatcgagaacagcaaaaacgactcagtagcctttcagatcctgtctcagaaagaagagtgggagagcaggactcagcaccaacccaggaaaaacccacctcacctggcaaggctattgaaaaaagagcaaaggatgacagtaggcgggtggtgaagagcactcaggacttaagcgatgtttccatggatgaagtgggcatcccactccggaacactgagagatcaaaagactggtacaagactatgtttaaacagatccacaaactgaacagagatgatgattcagatctgtactctcccagatactcattttctgaagacacaaaatctcccctttctgtgcctcgctcaaaaagtgagatgagctacattgatggtgagaaggtagtcaagaggtcggccacactacccctcccagcccgctcttcctcactgaagtcaagctcagaaagaaatgactgggaacccccagataagaaagtagatacaagaaaatatcgtgcagagcccaagagcatttacgaatatcagcctggcaagtcttccgttctgaccaacgaaaagatggtaatgtgcatattaaagttattttgtctcaccgtgcccatgttctttaatcagaatgcattgtgcagttggattacattctttccccttgagatagacttaactttgttttgaagataatgacaaaaatgaagtacttttacccttttcatttttgcaggtgttcataaaataagtcccgcgagtctgcttttaaaaaaccctcttattgtggctctgttgctttttttgtgcatggttttaactaatattaatttttctactaacataaagattga

SEQ ID NO: 314198 - DNA, 2789 bp, Homo sapiens
aggaggaagcatcattcatgaaccgatctttgcagacgacttgtcctgccaccaccatgagttctgaatgtgatggtggttccaaagctgtgatgaatggcttggcacctggcagcaatgggcaagacaaagcaactgccgaccctttacgcgcacgctctatttctgctgttaaaatcattcctgtgaagacagtgaaaaacgcctcaggcctagttctccctacagacatggatcctacaaaaatctgcactgggaagggagcggtgactctccgggcctcgtcttcctacagggaaaccccaagcagtagccctgcgagccctcaggaaacccggcaacacgaaagcaaaccaggtctggagccagagccttcttcagcagatgagtggaggctttcttccagtgctgatgccaatggaaatgcccagccctcttcactcgctgccaagggctacagaagtgtgcatcccaaccttccttctgacaagtcccaggttctctctcccccacgccctcctctccctcaaaaggaccgctttgcatggcagtcccccaccatccacaatacctataaggattccctctacctgagctcaccaaagccttatgtcccactcggcacccccagacagcagaacccctcacaaccccagcctatctctgtcctcctggcagctggatcggctcccaaaggtgtggtgtgccctggttccttgcttccggactccacgttccccagtgcttcatcccaaccccagcagcgctatgcagccaccaggacagtttatcataagaatgtgagctctaacccatgtcatgaggcagttgggattaaaaaggtcagcagcttatatgtaccttgtttatccaataacatttgcctggcggcgtcagaaaactcctctcgtgttgcacgtgaccctgccgaaggcactcccttggaggctgcgggcacccgagcaccggctcccggccttgtctcccgcacagccggcacaggaaaaccaccccctgctcctcctcctgaccctcccaagctattctttgacatccgtaaagatgccgttaaccgtggcgagagtccttccctggggactcaggcttcgttcccagatgtgagaccacctgtgctaggcccccgggttacctctgatcccgaaaaccggaagagcaaagaatcttaccttttgcagccgagttatccagccaaggatgccacttcctccagtgcagcccagccggaggtaatagttgtccctctctacctggttaatactgacagagggcaagaaggcactgccagacctccaacacctctggggcctcttggctgcgtccccacaatcccagcgactgcctctgccgcctcacctctgaccttcccgactctagatgatttcattccccctcatctgcagaggtggccccaccacagccagccagcccgcgcctctggctcctttgcccccattagccagacgccaccatccttctcaccaccacctccgctggtccctcctgccccggaggacctccgcagagtctcggagcctgacctcacgggagctgtttcgagtaccgattccagtcctctactaaatgaagtttcttcttcccttattggaactgattcccaagcctttccatcagttagcaagccttcatccgcctatccctccacaacgattgtcaatcctactattgtgctcttgcaacacaatcgagaacagcaaaaacgactcagtagcctttcagatcctgtctcagaaagaagagtgggagagcaggactcagcaccaacccaggaaaaacccacctcacctggcaaggctattgaaaaaagagcaaaggatgacagtaggcgggtggtgaagagcactcaggacttaagcgatgtttccatggatgaagtgggcatcccactccggaacactgagagatcaaaagactggtacaagactatgtttaaacagatccacaaactgaacagagatgatgattcagatctgtactctcccagatactcattttctgaagacacaaaatctcccctttctgtgcctcgctcaaaaagtgagatgagctacattgatggtgagaaggtagtcaagaggtcggccacactacccctcccagcccgctcttcctcactgaagtcaagctcagaaagaaatgactgggaacccccagataagaaagtagatacaagaaaatatcgtgcagagcccaagagcatttacgaatatcagcctggcaagtcttccgttctgaccaacgaaaagatgagctcagccatcagccctactccggaaatttcttcagagactcctggatatatatattcttccaacttccatgcagtgaagagggaatcagacggggctcctggggatctcactagcttggagaatgagagacaaatttataaaagtgtcttggaaggtggtgacatccctcttcagggcctgagtgggctcaagcgaccatccagctctgcttccactaaaggtaattaactgggtgaagcctgcaggcctctgtctcccatccacctccattcactgagcgtcggccgtggtgaacctccagcaatggggataagtcctgccttgttcagacccacattcaggcctcagagccctcttaaattccctcccctattttcttaccggccatttttctttctggttttaatagtttctgttcctttgaccccccaaccttgttctccttcaagatttctctctctctctctctctctttctctctttctctctctctctcat

SEQ ID NO: 314199 - DNA, 2039 bp, Homo sapiens
aggaggaagcatcattcatgaaccgatctttgcagacgacttgtcctgccaccaccatgagttctgaatgtgatggtggttccaaagctgtgatgaatggcttggcacctggcagcaatgggcaagacaaagcaactgccgaccctttacgcgcacgctctatttctgctgttaaaatcattcctgtgaagacagtgaaaaacgcctcaggcctagttctccctacagacatggatcctacaaaaatctgcactgggaagggagcggtgactctccgggcctcgtcttcctacagggaaaccccaagcagtagccctgcgagccctcaggaaacccggcaacacgaaagcaaaccaggtctggagccagagccttcttcagcagatgagtggaggctttcttccagtgctgatgccaatggaaatgcccagccctcttcactcgctgccaagggctacagaagtgtgcatcccaaccttccttctgacaagtcccaggttctctctcccccacgccctcctctccctcaaaaggaccgctttgcatggcagtcccccaccatccacaatacctataaggattccctctacctgagctcaccaaagccttatgtcccactcggcacccccagacagcagaacccctcacaaccccagcctatctctgtcctcctggcagctggatcggctcccaaaggtgtggtgtgccctggttccttgcttccggactccacgttccccagtgcttcatcccaaccccagcagcgctatgcagccaccaggacagtttatcataagaatgtgagctctaacccatgtcatgaggcagttgggattaaaaaggtcagcagcttatatgtaccttgtttatccaataacatttgcctggcggcgtcagaaaactcctctcgtgttgcacgtgaccctgccgaaggcactcccttggaggctgcgggcacccgagcaccggctcccggccttgtctcccgcacagccggcacaggaaaaccaccccctgctcctcctcctgaccctcccaagctattctttgacatccgtaaagatgccgttaaccgtggcgagagtccttccctggggactcaggcttcgttcccagatgtgagaccacctgtgctaggcccccgggttacctctgatcccgaaaaccggaagagcaaagaatcttaccttttgcagccgagttatccagccaaggatgccacttcctccagtgcagcccagccggaggtaatagttgtccctctctacctggttaatactgacagagggcaagaaggcactgccagacctccaacacctctggggcctcttggctgcgtccccacaatcccagcgactgcctctgccgcctcacctctgaccttcccgactctagatgatttcattccccctcatctgcagaggtggccccaccacagccagccagcccgcgcctctggctcctttgcccccattagccagacgccaccatccttctcaccaccacctccgctggtccctcctgccccggaggacctccgcagagtctcggagcctgacctcacgggagctgtttcgagtaccgtaagcttgctggactcccctcctcacggcttttctgaatgtctcctcccagcagtcacattccctttctcactgaagcactgagctctgaggacagcactggctgccgctgtgcctgtgtgatgactggagccgtgtcccctgtcactagcgtgcatgcttcccgtgtgtcttccctgggtctctcggggctgttccccatctctgcagtgcctcatctgctctgtcctgttgggaatgcacatctttctccctcagaagacaacatctgtggcctttatgttgactggccatgcttttcacaggccaggtcgggggtcgtgtggtgagctgaggaaagctaagaattatgggggaaagcaacggcaggcgtggtgggtgctacttaccagggagcggggagatctcggggaggaagcgattctctgattctcttgttgacctagtgagtaaata

SEQ ID NO: 314200 - DNA, 729 bp, Homo sapiens
tgactagcccgacaggtccccgagtagcccgacagtccgattagcccgacagtccccgactagcccgacagtccccgattagcccgacagtccccgactagcccgacagtccccgactcccaccacagccagccagcccgcgcctctggctcctttgcccccattagccagacgccaccatccttctcaccaccacctccgctggtccctcctgccccggaggacctccgcagagtctcggagcctgacctcacgggagctgtttcgagtaccgtaagcttgctggactcccctcctcacggcttttctgaatgtctcctcccagcagtcacattccctttctcactgaagcactgagctctgaggacagcactggctgccgctgtgcctgtgtgatgactggagccgtgtcccctgtcactagcgtgcatgcttcccgtgtgtcttccctgggtctctcggggctgttccccatctctgcagtgcctcatctgctctgtcctgttgggaatgcacatctttctccctcagaagacaacatctgtggcctttatgttgactggccatgcttttcacaggccaggtcgggggtcgtgtggtgagctgaggaaagctaagaattatgggggaaagcaacggcaggcgtggtgggtgctacttaccagggagcggggagatctcggggaggaagcgattctctgattctcttgttgacctagtgagtaaata

SEQ ID NO: 314201 - DNA, 206 bp, Homo sapiens
cttcacttagaattgtggatactaggaggagtctaacctgaggatgtgctgaaaaacgtgttaagaattgtttttgcttgaatcatgttatgctgtcgtttctaatgatcgtccttctttccatttcccctcctctttcttttttccctgtttgataacatatcttgaaaatattgctaaaggttctctctcccccacgccctcct

SEQ ID NO: 314202 - DNA, 408 bp, Homo sapiens
tgttttgtacatttgtcattgcaggagttggcatcctttggaagagttcgtgaaagctttctgcccagagctcctggaccaatgcatcttcccaccaccttaaaccactggtgaatatatgtgtttttttccttcttctcagtgaagggaaatgctttgttaactgtagaatgcgatttgcagagaactatgctgtcctttctattatagaaggaagtatactgggctgggcctaggcatatctgggttttggtacttacttgattctgccatttttactgtgggattgtaggtgaattctttgacctcccaggccccagacagagaaacatatcctgctgtttacaggatatgtttgctttgcagactaaaagagataatccatgcaagaagtaatgtatgcacgaa

SEQ ID NO: 314203 - DNA, 430 bp, Homo sapiens
gttttctttgcattaaactagttcacaaataaatccaaaaaatggggtggggggtggaatttttttttccttcagaattcgaccattgatcattaatcaagaatgacttcaaaattttgatatttataatagatgaaaggtgaactcttttcgcaagctggtttccagcgaaatctttgcctgttttaactctactttgttgttttaaagattcagaatcgccaagacattttataccagctgattacttggaatccacggaagaatttattcgaagacgtcatgatgataaagaggtaaatcccatcttttaaatccattagtttttgcttggaaaaatgtatgaagcaagtacagattcttgacatctatcagagaggtgacatgatctagcaattagaggcaaaaattgaggctttcacaagtgatt

SEQ ID NO: 314204 - DNA, 421 bp, Homo sapiens
aacatctcagcagcccagagtggtaatcctattaataataatagtcttataatgacataaccaccacctcagtgactatgtggctgtcattaattgagcccttgccacatacaagtttctgtgctgaatatatcactattgttatctcattttcattctcccagcagccccatgaagtaactcttcattttatcaatgaggagtatgaggttcagagagattaagtaatatatgcaagattacacagtaagtagcagaaccaggattcaaacctaggtgtttggggctccattaacacaggcttttactcaacgctgctatactgccctgcagattcctttccccttcctgactctgtgttcttgcttgtccccttcttgtccagaggctctctggtatctgactgcaggcattcagcttc

SEQ ID NO: 314205 - DNA, 2105 bp, Homo sapiens
  misc_feature (175)..(175): n is a, c, g, or t
gcggggccagctgcagcgtgtagtgcgagtggggcggacgcgcgcagcccgcccgcccggcgaccagcaagacggagtctcactctgtcgcccaggctggagtgcagcggcgtgatcttggctcactgcaaagtctgcttccctggttcaagcgattgtcctgcctcagcctccngagtagctgggattacaggagttggcatcctttggaagagttcgtgaaagctttctgcccagagctcctggaccaatgcatcttcccaccaccttaaaccactgagcagttcagagccccagttgcagacgacttgtcctgccaccaccatgagttctgaatgtgatggtggttccaaagctgtgatgaatggcttggcacctggcagcaatgggcaagacaaagacatggatcctacaaaaatctgcactgggaagggagcggtgactctccgggcctcgtcttcctacagggaaaccccaagcagtagccctgcgagccctcaggaaacccggcaacacgaaagcaaaccaggtctggagccagagccttcttcagcagatgagtggaggctttcttccagtgctgatgccaatggaaatgcccagccctcttcactcgctgccaagggctacagaagtgtgcatcccaaccttccttctgacaagtcccaggatgccacttcctccagtgcagcccagccggaggtaatagttgtccctctctacctggttaatactgacagagggcaagaaggcactgccagacctccaacacctctggggcctcttggctgcgtccccacaatcccagcgactgcctctgccgcctcacctctgaccttcccgactctagatgatttcattccccctcatctgcagaggtggccccaccacagccagccagcccgcgcctctggctcctttgcccccattagccagacgccaccatccttctcaccaccacctccgctggtccctcctgccccggaggacctccgcagagtctcggagcctgacctcacgggagctgtttcgagtaccgtaagcttgctggactcccctcctcacggcttttctgaatgtctcctcccagcagtcacattccctttctcactgaagcactgagctctgaggacagcactggctgccgctgtgcctgtgtgatgactggagccgtgtcccctgtcactagcgtgcatgcttcccgtgtgtcttccctgggtctctcggggctgttccccatctctgcagtgcctcatctgctctgtcctgttgggaatgcacatctttctccctcagaagacaacatctgtggcctttatgttgactggccatgcttttcacaggccaggtcgggggtcgtgtggtgagctgaggaaagctaagaattatgggggaaagcaacggcaggcgtggtgggtgctacttaccagggagcggggagatctcggggaggaagcgattctctgattctttttcattctcccagcagccccatgaagtaactcttcattttatcaatgaggagtatgaggttcagagagattaagtaatatatgcaagattacacagtaagtagcagaaccaggattcaaacctaggtgtttggggctccattaacacaggcttttactcaacgctgctatactgccctgcagattcctttccccttcctgactctgtgttcttgcttgtccccttcttgtccagaggctctctggtatctgactgcaggcattcagcttcccctgagtcagtcctgcctcagtctgctaagccagtacctcccagatggtgcctggaaatatatagttagggacccagcacggtggctcatgcctgtaatttcagcactttgggaggccgaggtgggcagatcacctgaggtcaagagttcgagaccagcctggccaacatagtgaaaccctgtctttactaaaaatacaaaaaaaaaaattagccagtgggcgtgatggcaggcgcctgtaatcccagctacttgggaggctgaggcaagagaatcacttgaatctgggatgcagaggttgcagtgagccgagatcgcaccactgcactccaccatgggcaacagagtgagtctctgtctc

SEQ ID NO: 314206 - DNA, 6899 bp, Homo sapiens
aggaggaagcatcattcatgaaccgatctttgcagacgacttgtcctgccaccaccatgagttctgaatgtgatggtggttccaaagctgtgatgaatggcttggcacctggcagcaatgggcaagacaaagcaactgccgaccctttacgcgcacgctctatttctgctgttaaaatcattcctgtgaagacagtgaaaaacgcctcaggcctagttctccctacagacatggatcctacaaaaatctgcactgggaagggagcggtgactctccgggcctcgtcttcctacagggaaaccccaagcagtagccctgcgagccctcaggaaacccggcaacacgaaagcaaaccaggtctggagccagagccttcttcagcagatgagtggaggctttcttccagtgctgatgccaatggaaatgcccagccctcttcactcgctgccaagggctacagaagtgtgcatcccaaccttccttctgacaagtcccaggttctctctcccccacgccctcctctccctcaaaaggaccgctttgcatggcagtcccccaccatccacaatacctataaggattccctctacctgagctcaccaaagccttatgtcccactcggcacccccagacagcagaacccctcacaaccccagcctatctctgtcctcctggcagctggatcggctcccaaaggtgtggtgtgccctggttccttgcttccggactccacgttccccagtgcttcatcccaaccccagcagcgctatgcagccaccaggacagtttatcataagaatgtgagctctaacccatgtcatgaggcagttgggattaaaaaggtcagcagcttatatgtaccttgtttatccaataacatttgcctggcggcgtcagaaaactcctctcgtgttgcacgtgaccctgccgaaggcactcccttggaggctgcgggcacccgagcaccggctcccggccttgtctcccgcacagccggcacaggaaaaccaccccctgctcctcctcctgaccctcccaagctattctttgacatccgtaaagatgccgttaaccgtggcgagagtccttccctggggactcaggcttcgttcccagatgtgagaccacctgtgctaggcccccgggttacctctgatcccgaaaaccggaagagcaaagaatcttaccttttgcagccgagttatccagccaaggatgccacttcctccagtgcagcccagccggaggtaatagttgtccctctctacctggttaatactgacagagggcaagaaggcactgccagacctccaacacctctggggcctcttggctgcgtccccacaatcccagcgactgcctctgccgcctcacctctgaccttcccgactctagatgatttcattccccctcatctgcagaggtggccccaccacagccagccagcccgcgcctctggctcctttgcccccattagccagacgccaccatccttctcaccaccacctccgctggtccctcctgccccggaggacctccgcagagtctcggagcctgacctcacgggagctgtttcgagtaccgattccagtcctctactaaatgaagtttcttcttcccttattggaactgattcccaagcctttccatcagttagcaagccttcatccgcctatccctccacaacgattgtcaatcctactattgtgctcttgcaacacaatcgagaacagcaaaaacgactcagtagcctttcagatcctgtctcagaaagaagagtgggagagcaggactcagcaccaacccaggaaaaacccacctcacctggcaaggctattgaaaaaagagcaaaggatgacagtaggcgggtggtgaagagcactcaggacttaagcgatgtttccatggatgaagtgggcatcccactccggaacactgagagatcaaaagactggtacaagactatgtttaaacagatccacaaactgaacagagatgatgattcagatctgtactctcccagatactcattttctgaagacacaaaatctcccctttctgtgcctcgctcaaaaagtgagatgagctacattgatggtgagaaggtagtcaagaggtcggccacactacccctcccagcccgctcttcctcactgaagtcaagctcagaaagaaatgactgggaacccccagataagaaagtagatacaagaaaatatcgtgcagagcccaagagcatttacgaatatcagcctggcaagtcttccgttctgaccaacgaaaagatgagctcagccatcagccctactccggaaatttcttcagagactcctggatatatatattcttccaacttccatgcagtgaagagggaatcagacggggctcctggggatctcactagcttggagaatgagagacaaatttataaaagtgtcttggaaggtggtgacatccctcttcagggcctgagtgggctcaagcgaccatccagctctgcttccactaaagattcagaatcgccaagacattttataccagctgattacttggaatccacggaagaatttattcgaagacgtcatgatgataaagagaaacttttagcggaccagagacgacttaaacgcgagcaagaagaggctgatattgcagctcgacgccacacaggcgtcattccgacgcaccatcagtttatcactaatgagcgctttggggacctcctcaatatagacgatactgcaaaaaggaaatctgggtcagagatgagacctgccagagccaaatttgactttaaagctcagacactaaaggagcttcctctgcagaagggagatattgtttacatttataagcaaattgatcagaactggtatgaaggagaacaccacggccgggtgggaatcttcccacgcacctacatcgagcttcttcctcctgctgagaaggcacagcccaaaaagttgacaccagtgcaggttttggaatatggagaagctattgctaagtttaactttaatggtgatacacaagtagaaatgtccttcagaaagggtgagaggatcacactgctccggcaggtagatgagaactggtacgaagggaggatcccggggacatcccgacaaggcatcttccccatcacctacgtggatgtgatcaagcgaccactggtgaaaaaccctgtggattacatggacctgcctttctcctcctccccaagtcgcagtgccactgcaagcccacagcaacctcaagcccagcagcgaagagtcacccccgacaggagtcaaacctcacaagatttatttagctatcaagcattatatagctatataccacagaatgatgatgagttggaactccgcgatggagatatcgttgatgtcatggaaaaatgtgacgatggatggtttgttggtacttcaagaaggacaaagcagtttggtacttttccaggcaactatgtaaaacctttgtatctataagaagactgaaaaccatggagattatttttattggaggaggaagcatcattcatgaaccgatctttttagttgagtcagtaggaaaattaatacagtggataaagtaagaagcaaaagacagggacagagaagtgttgtgtttaaaacccaagcctgtctaaggttactgtgtattagacagggccgaactagtgtgctgagcaaaaagaattgaagcaaattgtatttacttagccgcttctgggagccacttcagcctttcccctcccctccacttcttgggtaatctgacctgaagcatagtccaggagcagagttagccagaaatgcctcctgctgccccagccttagagagctcccatctcaatcattgagcctgaaggcttcaagcccaagaatgcaacaagacccccagcctacatttctcagctcccctggagccagctgatcctgtaacgctgctggaggtcagtctgagctaccaagactgtccctagacaaaggtggagtcccccacactgcccaagaccaaatccctcactcaacctgctgaggtgtggatggggaaacagaggcaaaactgaggcacctgatgcattcagcctgctgtgcagcagtgccattgactgccctgatgttcagagagaaacgcacacaaggtttgcccatgagaattggggagcagatggccaagcagataggttatgtctgttttctgagtgatgaagtcaggaagccctgtggctctggaggccacttgtggttcattcttttcccatatccttggcttttagaaatggttaccttcaggacagtgcagctgcatttatcagagcactattgctaagttttcttttctggcttgtgtttttctgggacagtttagaattgggaggcctattctcatagaacaccaaaaatgatgttcagtgattcatttaacatacaccaatgtactctggctgctggggggacaaccataagcaagacatgcccagggtttgccgtggctccagatctactccctgtaggagttcaaggatcacacaaacggtagtaaccagggttgtgaatctgagtacaccctggcaaggcttctcttcagactgaagcagcaattctgccactaccagcagcaaccaggacgtctgttctttgtgggggccagatcagaagagagaggcccctgtgacgcccgggctgcttggtcacaactctgtccaattcaaggatgtttatcggcctctcttagatcctgagtgagacaaatacagaaatgacccattccctgcccaccagaaactcagaggtgattggggagactgacacaggaaaatgaacttaatcaagagagactgtgatatgtgctaagaagggtgtgagggagggagagatgaattttccctggagggatcctagaaagcattgtcatattgccatctccattagctcacttttaaacaactagggtgctggaagaacctttgtctgagggtagttcatagctggaaatacttggaatattttccagagtctctaaactctcatcttcccccacagatacacatccaagctcacaaataggagtagcaattctaggtggtagggttgtgtacggaacccctggctgtctgcatatatctcagaattaccccaggaccattgtcccaaagtctagagtctttacaggtaggcaaaatttgttttcaatgcctgtgcctcagctgctgtcacaaatacccatcttaggatcccatcagcttcccatcccccaccagacagccacagtaccctcactttctccctattgttctttcaaatcctgttctcaggaaagaaactgccactaattcattcacactaaggtgtaaatgattgataataggaatgagttacctcttcccacagacatttgtttttaagtatgacagagcagggccttaatcccaagggaaaaggttatggaactggagggggtgagctttctgggtagaaggagacttcctgaatttccttaaaacccagtaagagtaagacctgttgttttggaaggtctgctccaccatctaagagcactgtttttttttttttgttgttgttgttgttttacggtctctgagggaatatagtaaaaatgcatatgcacgtgcaatttgcacggcagcatttcaccgattgtggactgtattggctaatgtgtttcctggtctttagatgcaaaccattaataacactatcttatctcatagttttttcaggggtgcttcttgattagtagggaattttgaacacctctttaaatacagctagaaaataaaaccaatttgtaaagccacatttgcatatgatgccagcctcacgcatttgtatatctccagaaattcaggtatgcctcaccaatttgcccgtctttaataaaatcttgtgttaaaatttgcatcacgtcgccttcctatgtatgacgaaacaagaaacagagatttccaattgctcttttgtcttcagacatttagtaatataaagtacctatttttatgctgaaatgtttatacaggtttattaatagcaagtgcaactaactggcggcatgccttgcaacacattttgatatattagccatgcttccgggtaaaggcaagccccaaactccttatcttttgcagtctctctgggatcagtaaaagaaaaaaaaaataatgtgcttaagaagtgggactgtaaatatgtatatttaactttgtatagcccatgtacctaccttgtatagaaaaataattttaaaaatttgaatggaagggggtaaaggaagtcatgaagtttttttgcatttttatttaaatgaaggaattccaaataactcacctacagatttttagcacaaaaatagccattgtaaagtgttaaaatttacgataagtattctattggggaggaaaggtaactctgatctcagttacagtttttttttcctttttaatttcattattttgggtttttggtttttgcagtcctatttatctgcagtcgtattaagtcctattgctagaataggttactacaaaaaaggttatattctgaaagaaaaataactgacattatatataaccaattaatttaaagtattgccatttaaattacacactgagagcatgtcctatgcagacatagatttttctgttcatttatttttcttcattgcagtggattgatttgataaatagatgtgttgaattactacatttgctgtacatattatttaataaactttattcagaattgcgtggccaaaaaaaaaaaaaaaaaaaaaaaaacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaac

SEQ ID NO: 314207 - DNA, 6530 bp, Homo sapiens
aggaggaagcatcattcatgaaccgatctttgcagacgacttgtcctgccaccaccatgagttctgaatgtgatggtggttccaaagctgtgatgaatggcttggcacctggcagcaatgggcaagacaaagcaactgccgaccctttacgcgcacgctctatttctgctgttaaaatcattcctgtgaagacagtgaaaaacgcctcaggcctagttctccctacagacatggatcctacaaaaatctgcactgggaagggagcggtgactctccgggcctcgtcttcctacagggaaaccccaagcagtagccctgcgagccctcaggaaacccggcaacacgaaagcaaaccaggtctggagccagagccttcttcagcagatgagtggaggctttcttccagtgctgatgccaatggaaatgcccagccctcttcactcgctgccaagggctacagaagtgtgcatcccaaccttccttctgacaagtcccaggttctctctcccccacgccctcctctccctcaaaaggaccgctttgcatggcagtcccccaccatccacaatacctataaggattccctctacctgagctcaccaaagccttatgtcccactcggcacccccagacagcagaacccctcacaaccccagcctatctctgtcctcctggcagctggatcggctcccaaaggtgtggtgtgccctggttccttgcttccggactccacgttccccagtgcttcatcccaaccccagcagcgctatgcagccaccaggacagtttatcataagaatgtgagctctaacccatgtcatgaggcagttgggattaaaaaggtcagcagcttatatgtaccttgtttatccaataacatttgcctggcggcgtcagaaaactcctctcgtgttgcacgtgaccctgccgaaggcactcccttggaggctgcgggcacccgagcaccggctcccggccttgtctcccgcacagccggcacaggaaaaccaccccctgctcctcctcctgaccctcccaagctattctttgacatccgtaaagatgccgttaaccgtggcgagagtccttccctggggactcaggcttcgttcccagatgtgagaccacctgtgctaggcccccgggttacctctgatcccgaaaaccggaagagcaaagaatcttaccttttgcagccgagttatccagccaaggattccagtcctctactaaatgaagtttcttcttcccttattggaactgattcccaagcctttccatcagttagcaagccttcatccgcctatccctccacaacgattgtcaatcctactattgtgctcttgcaacacaatcgagaacagcaaaaacgactcagtagcctttcagatcctgtctcagaaagaagagtgggagagcaggactcagcaccaacccaggaaaaacccacctcacctggcaaggctattgaaaaaagagcaaaggatgacagtaggcgggtggtgaagagcactcaggacttaagcgatgtttccatggatgaagtgggcatcccactccggaacactgagagatcaaaagactggtacaagactatgtttaaacagatccacaaactgaacagagatgatgattcagatctgtactctcccagatactcattttctgaagacacaaaatctcccctttctgtgcctcgctcaaaaagtgagatgagctacattgatggtgagaaggtagtcaagaggtcggccacactacccctcccagcccgctcttcctcactgaagtcaagctcagaaagaaatgactgggaacccccagataagaaagtagatacaagaaaatatcgtgcagagcccaagagcatttacgaatatcagcctggcaagtcttccgttctgaccaacgaaaagatgagctcagccatcagccctactccggaaatttcttcagagactcctggatatatatattcttccaacttccatgcagtgaagagggaatcagacggggctcctggggatctcactagcttggagaatgagagacaaatttataaaagtgtcttggaaggtggtgacatccctcttcagggcctgagtgggctcaagcgaccatccagctctgcttccactaaagattcagaatcgccaagacattttataccagctgattacttggaatccacggaagaatttattcgaagacgtcatgatgataaagagaaacttttagcggaccagagacgacttaaacgcgagcaagaagaggctgatattgcagctcgacgccacacaggcgtcattccgacgcaccatcagtttatcactaatgagcgctttggggacctcctcaatatagacgatactgcaaaaaggaaatctgggtcagagatgagacctgccagagccaaatttgactttaaagctcagacactaaaggagcttcctctgcagaagggagatattgtttacatttataagcaaattgatcagaactggtatgaaggagaacaccacggccgggtgggaatcttcccacgcacctacatcgagcttcttcctcctgctgagaaggcacagcccaaaaagttgacaccagtgcaggttttggaatatggagaagctattgctaagtttaactttaatggtgatacacaagtagaaatgtccttcagaaagggtgagaggatcacactgctccggcaggtagatgagaactggtacgaagggaggatcccggggacatcccgacaaggcatcttccccatcacctacgtggatgtgatcaagcgaccactggtgaaaaaccctgtggattacatggacctgcctttctcctcctccccaagtcgcagtgccactgcaagcccacagcaacctcaagcccagcagcgaagagtcacccccgacaggagtcaaacctcacaagatttatttagctatcaagcattatatagctatataccacagaatgatgatgagttggaactccgcgatggagatatcgttgatgtcatggaaaaatgtgacgatggatggtttgttggtacttcaagaaggacaaagcagtttggtacttttccaggcaactatgtaaaacctttgtatctataagaagactgaaaaccatggagattatttttattggaggaggaagcatcattcatgaaccgatctttttagttgagtcagtaggaaaattaatacagtggataaagtaagaagcaaaagacagggacagagaagtgttgtgtttaaaacccaagcctgtctaaggttactgtgtattagacagggccgaactagtgtgctgagcaaaaagaattgaagcaaattgtatttacttagccgcttctgggagccacttcagcctttcccctcccctccacttcttgggtaatctgacctgaagcatagtccaggagcagagttagccagaaatgcctcctgctgccccagccttagagagctcccatctcaatcattgagcctgaaggcttcaagcccaagaatgcaacaagacccccagcctacatttctcagctcccctggagccagctgatcctgtaacgctgctggaggtcagtctgagctaccaagactgtccctagacaaaggtggagtcccccacactgcccaagaccaaatccctcactcaacctgctgaggtgtggatggggaaacagaggcaaaactgaggcacctgatgcattcagcctgctgtgcagcagtgccattgactgccctgatgttcagagagaaacgcacacaaggtttgcccatgagaattggggagcagatggccaagcagataggttatgtctgttttctgagtgatgaagtcaggaagccctgtggctctggaggccacttgtggttcattcttttcccatatccttggcttttagaaatggttaccttcaggacagtgcagctgcatttatcagagcactattgctaagttttcttttctggcttgtgtttttctgggacagtttagaattgggaggcctattctcatagaacaccaaaaatgatgttcagtgattcatttaacatacaccaatgtactctggctgctggggggacaaccataagcaagacatgcccagggtttgccgtggctccagatctactccctgtaggagttcaaggatcacacaaacggtagtaaccagggttgtgaatctgagtacaccctggcaaggcttctcttcagactgaagcagcaattctgccactaccagcagcaaccaggacgtctgttctttgtgggggccagatcagaagagagaggcccctgtgacgcccgggctgcttggtcacaactctgtccaattcaaggatgtttatcggcctctcttagatcctgagtgagacaaatacagaaatgacccattccctgcccaccagaaactcagaggtgattggggagactgacacaggaaaatgaacttaatcaagagagactgtgatatgtgctaagaagggtgtgagggagggagagatgaattttccctggagggatcctagaaagcattgtcatattgccatctccattagctcacttttaaacaactagggtgctggaagaacctttgtctgagggtagttcatagctggaaatacttggaatattttccagagtctctaaactctcatcttcccccacagatacacatccaagctcacaaataggagtagcaattctaggtggtagggttgtgtacggaacccctggctgtctgcatatatctcagaattaccccaggaccattgtcccaaagtctagagtctttacaggtaggcaaaatttgttttcaatgcctgtgcctcagctgctgtcacaaatacccatcttaggatcccatcagcttcccatcccccaccagacagccacagtaccctcactttctccctattgttctttcaaatcctgttctcaggaaagaaactgccactaattcattcacactaaggtgtaaatgattgataataggaatgagttacctcttcccacagacatttgtttttaagtatgacagagcagggccttaatcccaagggaaaaggttatggaactggagggggtgagctttctgggtagaaggagacttcctgaatttccttaaaacccagtaagagtaagacctgttgttttggaaggtctgctccaccatctaagagcactgtttttttttttttgttgttgttgttgttttacggtctctgagggaatatagtaaaaatgcatatgcacgtgcaatttgcacggcagcatttcaccgattgtggactgtattggctaatgtgtttcctggtctttagatgcaaaccattaataacactatcttatctcatagttttttcaggggtgcttcttgattagtagggaattttgaacacctctttaaatacagctagaaaataaaaccaatttgtaaagccacatttgcatatgatgccagcctcacgcatttgtatatctccagaaattcaggtatgcctcaccaatttgcccgtctttaataaaatcttgtgttaaaatttgcatcacgtcgccttcctatgtatgacgaaacaagaaacagagatttccaattgctcttttgtcttcagacatttagtaatataaagtacctatttttatgctgaaatgtttatacaggtttattaatagcaagtgcaactaactggcggcatgccttgcaacacattttgatatattagccatgcttccgggtaaaggcaagccccaaactccttatcttttgcagtctctctgggatcagtaaaagaaaaaaaaaataatgtgcttaagaagtgggactgtaaatatgtatatttaactttgtatagcccatgtacctaccttgtatagaaaaataattttaaaaatttgaatggaagggggtaaaggaagtcatgaagtttttttgcatttttatttaaatgaaggaattccaaataactcacctacagatttttagcacaaaaatagccattgtaaagtgttaaaatttacgataagtattctattggggaggaaaggtaactctgatctcagttacagtttttttttcctttttaatttcattattttgggtttttggtttttgcagtcctatttatctgcagtcgtattaagtcctattgctagaataggttactacaaaaaaggttatattctgaaagaaaaataactgacattatatataaccaattaatttaaagtattgccatttaaattacacactgagagcatgtcctatgcagacatagatttttctgttcatttatttttcttcattgcagtggattgatttgataaatagatgtgttgaattactacatttgctgtacatattatttaataaactttattcagaattgcgtggccaaaaaaaaaaaaaaaaaaaaaaaaacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaac

SEQ ID NO: 314208 - DNA, 6719 bp, Homo sapiens
aggaggaagcatcattcatgaaccgatctttgcagacgacttgtcctgccaccaccatgagttctgaatgtgatggtggttccaaagctgtgatgaatggcttggcacctggcagcaatgggcaagacaaagcaactgccgaccctttacgcgcacgctctatttctgctgttaaaatcattcctgtgaagacagtgaaaaacgcctcaggcctagttctccctacagacatggatcctacaaaaatctgcactgggaagggagcggtgactctccgggcctcgtcttcctacagggaaaccccaagcagtagccctgcgagccctcaggaaacccggcaacacgaaagcaaaccaggtctggagccagagccttcttcagcagatgagtggaggctttcttccagtgctgatgccaatggaaatgcccagccctcttcactcgctgccaagggctacagaagtgtgcatcccaaccttccttctgacaagtcccaggttctctctcccccacgccctcctctccctcaaaaggaccgctttgcatggcagtcccccaccatccacaatacctataaggattccctctacctgagctcaccaaagccttatgtcccactcggcacccccagacagcagaacccctcacaaccccagcctatctctgtcctcctggcagctggatcggctcccaaaggtgtggtgtgccctggttccttgcttccggactccacgttccccagtgcttcatcccaaccccagcagcgctatgcagccaccaggacagtttatcataagaatgtgagctctaacccatgtcatgaggcagttgggattaaaaaggtcagcagcttatatgtaccttgtttatccaataacatttgcctggcggcgtcagaaaactcctctcgtgttgcacgtgaccctgccgaaggcactcccttggaggctgcgggcacccgagcaccggctcccggccttgtctcccgcacagccggcacaggaaaaccaccccctgctcctcctcctgaccctcccaagctattctttgacatccgtaaagatgccgttaaccgtggcgagagtccttccctggggactcaggcttcgttcccagatgtgagaccacctgtgctaggcccccgggttacctctgatcccgaaaaccggaagagcaaagaatcttaccttttgcagccgagttatccagccaaggatgccacttcctccagtgcagcccagccggaggtaatagttgtccctctctacctggttaatactgacagagggcaagaaggcactgccagacctccaacacctctggggcctcttggctgcgtccccacaatcccagcgactgcctctgccgcctcacctctgaccttcccgactctagatgatttcattccccctcatctgcagaggtggccccaccacagccagccagcccgcgcctctggctcctttgcccccattagccagacgccaccatccttctcaccaccacctccgctggtccctcctgccccggaggacctccgcagagtctcggagcctgacctcacgggagctgtttcgagtaccgattccagtcctctactaaatgaagtttcttcttcccttattggaactgattcccaagcctttccatcagttagcaagccttcatccgcctatccctccacaacgattgtcaatcctactattgtgctcttgcaacacaatcgagaacagcaaaaacgactcagtagcctttcagatcctgtctcagaaagaagagtgggagagcaggactcagcaccaacccaggaaaaacccacctcacctggcaaggctattgaaaaaagagcaaaggatgacagtaggcgggtggtgaagagcactcaggacttaagcgatgtttccatggatgaagtgggcatcccactccggaacactgagagatcaaaagactggtacaagactatgtttaaacagatccacaaactgaacagagatgatgattcagatctgtactctcccagatactcattttctgaagacacaaaatctcccctttctgtgcctcgctcaaaaagtgagatgagctacattgatggtgagaaggtagtcaagaggtcggccacactacccctcccagcccgctcttcctcactgaagtcaagctcagaaagaaatgactgggaacccccagataagaaagtagatacaagaaaatatcgtgcagagcccaagagcatttacgaatatcagcctggcaagtcttccgttctgaccaacgaaaagatgagctcagccatcagccctactccggaaatttcttcagagactcctggatatatatattcttccaacttccatgcagtgaagagggaatcagacggggctcctggggatctcactagcttggagaatgagagacaaatttataaaagtgtcttggaaggtggtgacatccctcttcagggcctgagtgggctcaagcgaccatccagctctgcttccactaaagattcagaatcgccaagacattttataccagctgattacttggaatccacggaagaatttattcgaagacgtcatgatgataaagagaaacttttagcggaccagagacgacttaaacgcgagcaagaagaggctgatattgcagctcgacgccacacaggcgtcattccgacgcaccatcagtttatcactaatgagcgctttggggacctcctcaatatagacgatactgcaaaaaggaaatctgggtcagagatgagacctgccagagccaaatttgactttaaagctcagacactaaaggagcttcctctgcagaagggagatattgtttacatttataagcaaattgatcagaactggtatgaaggagaacaccacggccgggtgggaatcttcccacgcacctacatcgagcttcttcctcctgctgagaaggcacagcccaaaaagttgacaccagtgcaggttttggaatatggagaagctattgctaagtttaactttaatggtgatacacaagtagaaatgtccttcagaaagggtgagaggatcacactgctccggcaggtagatgagaactggtacgaagggaggatcccggggacatcccgacaaggcatcttccccatcacctacgtggatgtgatcaagcgaccactggtgaaaaaccctgtggattacatggacctgcctttctcctcctccccaagtcgcagtgccactgcaagcccacagcaacctcaagcccagcagcgaagagtcacccccgacaggagtcaaacctcacaagatttatttagctatcaagcattatatagctatataccacagaatgatgatgagttggaactccgcgatggagatatcgttgatgtcatggaaaaatgtgacgatggatggtttgttggtacttcaagaaggacaaagcagtttggtacttttccaggcaactatgtaaaacctttgtatctataagaagactgaaaaccatggagattatttttattggaggaggaagcatcattcatgaaccgatctttttagttgagtcagtaggaaaattaatacagtggataaagtaagaagcaaaagacagggacagagaagtgttgtgtttaaaacccaagcctgtctaaggttactgtgtattagacagggccgaactagtgtgctgagcaaaaagaattgaagcaaattgtatttacttagccgcttctgggagccacttcagcctttcccctcccctccacttcttgggtaatctgacctgaagcatagtccaggagcagagttagccagaaatgcctcctgctgccccagccttagagagctcccatctcaatcattgagcctgaaggcttcaagcccaagaatgcaacaagacccccagcctacatttctcagctcccctggagccagctgatcctgtaacgctgctggaggtcagtctgagctaccaagactgtccctagacaaaggtggagtcccccacactgcccaagaccaaatccctcactcaacctgctgaggtgtggatggggaaacagaggcaaaactgaggcacctgatgcattcagcctgctgtgcagcagtgccattgactgccctgatgttcagagagaaacgcacacaaggtttgcccatgagaattggggagcagatggccaagcagataggttatgtctgttttctgagtgatgaagtcaggaagccctgtggctctggaggccacttgtggttcattcttttcccatatccttggcttttagaaatggttaccttcaggacagtgcagctgcatttatcagagcactattgctaagttttcttttctggcttgtgtttttctgggacagtttagaattgggaggcctattctcatagaacaccaaaaatgatgttcagtgattcatttaacatacaccaatgtactctggctgctggggggacaaccataagcaagacatgcccagggtttgccgtggctccagatctactccctgtaggagttcaaggatcacacaaacggtagtaaccagggttgtgaatctgagtacaccctggcaaggcttctcttcagactgaagcagcaattctgccactaccagcagcaaccaggacgtctgttctttgtgggggccagatcagaagagagaggcccctgtgacgcccgggctgcttggtcacaactctgtccaattcaaggatgtttatcggcctctcttagatcctgagtgagacaaatacagaaatgacccattccctgcccaccagaaactcagaggtgattggggagactgacacaggaaaatgaacttaatcaagagagactgtgatatgtgctaagaagggtgtgagggagggagagatgaattttccctggagggatcctagaaagcattgtcatattgccatctccattagctcacttttaaacaactagggtgctggaagaacctttgtctgagggtagttcatagctggaaatacttggaatattttccagagtctctaaactctcatcttcccccacagatacacatccaagctcacaaataggagtagcaattctaggtggtagggttgtgtacggaacccctggctgtctgcatatatctcagaattaccccaggaccattgtcccaaagtctagagtctttacaggtaggcgatcccatcagcttcccatcccccaccagacagccacagtaccctcactttctccctattgttctttcaaatcctgttctcaggaaagaaactgccactaattcattcacactaaggtgtaaatgattgataataggaatgagttacctcttcccacagacatttgtttttaagtatgacagagcagggccttaatcccaagggaaaaggttatggaactggagggggtgagctttctgggtagaaggagacttcctgaatttccttaaaacccagtaagagtaagacctgttgttttggaaggtctgctccaccatctaagagcactgtttttttttttttgttgttgttgttgttttacggtctctgagggaatatagtaaaaatgcatatgcacgtgcaatttgcacggcagcatttcaccgattgtggactgtattggctaatgtgtttcctggtctttagatgcaaaccattaataacactatcttatctcatagttttttcaggggtgcttcttgattagtagggaattttgaacacctctttaaatacagctagaaaataaaaccaatttgtaaagccacatttgcatatgatgccagcctcacgcatttgtatatctccagaaattcaggtatgcctcaccaatttgcccgtctttaataaaatcttgtgttaaaatttgcatcacgtcgccttcctatgtatgacgaaacaagaaacagagatttccaattgctcttttgtcttcagacatttagtaatataaagtacctatttttatgctgaaatgtttatacaggtttattaatagcaagtgcaactaactggcggcatgccttgcaacacattttgatatattagccatgcttccgggtaaaggcaagccccaaactccttatcttttgcagtctctctgggatcagtaaaagaaaaaaaaaataatgtgcttaagaagtgggactgtaaatatgtatatttaactttgtatagcccatgtacctaccttgtatagaaaaataattttaaaaatttgaatggaagggggtaaaggaagtcatgaagtttttttgcatttttatttaaatgaaggaattccaaataactcacctacagatttttagcacaaaaatagccattgtaaagtgttaaaatttacgataagtattctattggggaggaaaggtaactctgatctcagttacagtttttttttcctttttaatttcattattttgggtttttggtttttgcagtcctatttatctgcagtcgtattaagtcctattgctagaataggttactacaaaaaaggttatattctgaaagaaaaataactgacattatatataaccaattaatttaaagtattgccatttaaattacacactgagagcatgtcctatgcagacatagatttttctgttcatttatttttcttcattgcagtggattgatttgataaatagatgtgttgaattactacatttgctgtacatattatttaataaactttattcagaattgcgtggc

SEQ ID NO: 314209 - DNA, 5878 bp, Homo sapiens
aggaggaagcatcattcatgaaccgatctttgcagacgacttgtcctgccaccaccatgagttctgaatgtgatggtggttccaaagctgtgatgaatggcttggcacctggcagcaatgggcaagacaaagcaactgccgaccctttacgcgcacgctctatttctgctgttaaaatcattcctgtgaagacagtgaaaaacgcctcaggcctagttctccctacagacatggatcctacaaaaatctgcactgggaagggagcggtgactctccgggcctcgtcttcctacagggaaaccccaagcagtagccctgcgagccctcaggaaacccggcaacacgaaagcaaaccaggtctggagccagagccttcttcagcagatgagtggaggctttcttccagtgctgatgccaatggaaatgcccagccctcttcactcgctgccaagggctacagaagtgtgcatcccaaccttccttctgacaagtcccaggttctctctcccccacgccctcctctccctcaaaaggaccgctttgcatggcagtcccccaccatccacaatacctataaggattccctctacctgagctcaccaaagccttatgtcccactcggcacccccagacagcagaacccctcacaaccccagcctatctctgtcctcctggcagctggatcggctcccaaaggtgtggtgtgccctggttccttgcttccggactccacgttccccagtgcttcatcccaaccccagcagcgctatgcagccaccaggacagtttatcataagaatgtgagctctaacccatgtcatgaggcagttgggattaaaaaggtcagcagcttatatgtaccttgtttatccaataacatttgcctggcggcgtcagaaaactcctctcgtgttgcacgtgaccctgccgaaggcactcccttggaggctgcgggcacccgagcaccggctcccggccttgtctcccgcacagccggcacaggaaaaccaccccctgctcctcctcctgaccctcccaagctattctttgacatccgtaaagatgccgttaaccgtggcgagagtccttccctggggactcaggcttcgttcccagatgtgagaccacctgtgctaggcccccgggttacctctgatcccgaaaaccggaagagcaaagaatcttaccttttgcagccgagttatccagccaaggatgccacttcctccagtgcagcccagccggaggtaatagttgtccctctctacctggttaatactgacagagggcaagaaggcactgccagacctccaacacctctggggcctcttggctgcgtccccacaatcccagcgactgcctctgccgcctcacctctgaccttcccgactctagatgatttcattccccctcatctgcagaggtggccccaccacagccagccagcccgcgcctctggctcctttgcccccattagccagacgccaccatccttctcaccaccacctccgctggtccctcctgccccggaggacctccgcagagtctcggagcctgacctcacgggagctgtttcgagtaccgattccagtcctctactaaatgaagtttcttcttcccttattggaactgattcccaagcctttccatcagttagcaagccttcatccgcctatccctccacaacgattgtcaatcctactattgtgctcttgcaacacaatcgagaacagcaaaaacgactcagtagcctttcagatcctgtctcagaaagaagagtgggagagcaggactcagcaccaacccaggaaaaacccacctcacctggcaaggctattgaaaaaagagcaaaggatgacagtaggcgggtggtgaagagcactcaggacttaagcgatgtttccatggatgaagtgggcatcccactccggaacactgagagatcaaaagactggtacaagactatgtttaaacagatccacaaactgaacagagatgatgattcagatctgtactctcccagatactcattttctgaagacacaaaatctcccctttctgtgcctcgctcaaaaagtgagatgagctacattgatggtgagaaggtagtcaagaggtcggccacactacccctcccagcccgctcttcctcactgaagtcaagctcagaaagaaatgactgggaacccccagataagaaagtagatacaagaaaatatcgtgcagagcccaagagcatttacgaatatcagcctggcaagtcttccgttctgaccaacgaaaagatgagctcagccatcagccctactccggaaatttcttcagagactcctggatatatatattcttccaacttccatgcagtgaagagggaatcagacggggctcctggggatctcactagcttggagaatgagagacaaatttataaaagtgtcttggaaggtggtgacatccctcttcagggcctgagtgggctcaagcgaccatccagctctgcttccactaaagattcagaatcgccaagacattttataccagctgattacttggaatccacggaagaatttattcgaagacgtcatgatgataaagagaaacttttagcggaccagagacgacttaaacgcgagcaagaagaggctgatattgcagctcgacgccacacaggcgtcattccgacgcaccatcagtttatcactaatgagcgctttggggacctcctcaatatagacgatactgcaaaaaggaaatctgggtcagagatgagacctgccagagccaaatttgactttaaagctcagacactaaaggagcttcctctgcagaagggagatattgtttacatttataagcaaattgatcagaactggtatgaaggagaacaccacggccgggtgggaatcttcccacgcacctacatcgagcttcttcctcctgctgagaaggcacagcccaaaaagttgacaccagtgcaggttttggaatatggagaagctattgctaagtttaactttaatggtgatacacaagtagaaatgtccttcagaaagggtgagaggatcacactgctccggcaggtagatgagaactggtacgaagggaggatcccggggacatcccgacaaggcatcttccccatcacctacgtggatgtgatcaagcgaccactggtgaaaaaccctgtggattacatggacctgcctttctcctcctccccaagtcgcagtgccactgcaagcccacagcaacctcaagcccagcagcgaagagtcacccccgacaggagtcaaacctcacaagatttatttagctatcaagcattatatagctatataccacagaatgatgatgagttggaactccgcgatggagatatcgttgatgtcatggaaaaatgtgacgatggatggtttgttggtacttcaagaaggacaaagcagtttggtacttttccaggcaactatgtaaaacctttgtatctataagaagactgaaaaccatggagattatttttattggaggaggaagcatcattcatgaaccgatctttttagttgagtcagtaggaaaattaatacagtggataaagtaagaagcaaaagacagggacagagaagtgttgtgtttaaaacccaagcctgtctaaggttactgtgtattagacagggccgaactagtgtgctgagcaaaaagaattgaagcaaattgtatttacttagccgcttctgggagccacttcagcctttcccctcccctccacttcttgggtaatctgacctgaagcatagtccaggagcagagttagccagaaatgcctcctgctgccccagccttagagagctcccatctcaatcattgagcctgaaggcttcaagcccaagaatgcaacaagacccccagcctacatttctcagctcccctggagccagctgatcctgtaacgctgctggaggtcagtctgagctaccaagactgtccctagacaaaggtggagtcccccacactgcccaagaccaaatccctcactcaacctgctgaggtgtggatggggaaacagaggcaaaactgaggcacctgatgcattcagcctgctgtgcagcagtgccattgactgccctgatgttcagagagaaacgcacacaaggtttgcccatgagaattggggagcagatggccaagcagataggttatgtctgttttctgagtgatgaagtcaggaagccctgtggctctggaggccacttgtggttcattcttttcccatatccttggcttttagaaatggttaccttcaggacagtgcagctgcatttatcagagcactattgctaagttttcttttctggcttgtgtttttctgggacagtttagaattgggaggcctattctcatagaacaccaaaaatgatgttcagtgattcatttaacatacaccaatgtactctggctgctggggggacaaccataagcaagacatgcccagggtttgccgtggctccagatctactccctgtaggagttcaaggatcacacaaacggtagtaaccagggttgtgaatctgagtacaccctggcaaggcttctcttcagactgaagcagcaattctgccactaccagcagcaaccaggacgtctgttctttgtgggggccagatcagaagagagaggcccctgtgacgcccgggctgcttggtcacaactctgtccaattcaaggatgtttatcggcctctcttagatcctgagtgagacaaatacagaaatgacccattccctgcccaccagaaactcagaggtgattggggagactgacacaggaaaatgaacttaatcaagagagactgtgatatgtgctaagaagggtgtgagggagggagagatgaattttccctggagggatcctagaaagcattgtcatattgccatctccattagctcacttttaaacaactagggtgctggaagaacctttgtctgagggtagttcatagctggaaatacttggaatattttccagagtctctaaactctcatcttcccccacagatacacatccaagctcacaaataggagtagcaattctaggtggtagggttgtgtacggaacccctggctgtctgcatatatctcagaattaccccaggaccattgtcccaaagtctagagtctttacaggtaggcaaaatttgttttcaatgcctgtgcctcagctgctgtcacaaatacccatcttaggatcccatcagcttcccatcccccaccagacagccacagtaccctcactttctccctattgttctttcaaatcctgttctcaggaaagaaactgccactaattcattcacactaaggtgtaaatgattgataataggaatgagttacctcttcccacagacatttgtttttaagtatgacagagcagggccttaatcccaagggaaaaggttatggaactggagggggtgagctttctgggtagaaggagacttcctgaatttccttaaaacccagtaagagtaagacctgttgttttggaaggtctgctccaccatctaagagcactgtttttttttttttgttgttgttgttgttttacggtctctgagggaatatagtaaaaatgcatatgcacgtgcaatttgcacggcagcatttcaccgattgtggactgtattggctaatgtgtttcctggtctttagatgcaaaccattaataacactatcttatctcatagttttttcaggggtgcttcttgattagtagggaattttgaacacctctttaaatacagctagaaaataaaacagtgctctaagatggtggagcagaccttccaaaacaacaggtcttactcttacggggtttaaaggaaaat

SEQ ID NO: 314210 - DNA, 2788 bp, Homo sapiens
aggaggaagcatcattcatgaaccgatctttgcagacgacttgtcctgccaccaccatgagttctgaatgtgatggtggttccaaagctgtgatgaatggcttggcacctggcagcaatgggcaagacaaagcaactgccgaccctttacgcgcacgctctatttctgctgttaaaatcattcctgtgaagacagtgaaaaacgcctcaggcctagttctccctacagacatggatcctacaaaaatctgcactgggaagggagcggtgactctccgggcctcgtcttcctacagggaaaccccaagcagtagccctgcgagccctcaggaaacccggcaacacgaaagcaaaccaggtctggagccagagccttcttcagcagatgagtggaggctttcttccagtgctgatgccaatggaaatgcccagccctcttcactcgctgccaagggctacagaagtgtgcatcccaaccttccttctgacaagtcccaggttctctctcccccacgccctcctctccctcaaaaggaccgctttgcatggcagtcccccaccatccacaatacctataaggattccctctacctgagctcaccaaagccttatgtcccactcggcacccccagacagcagaacccctcacaaccccagcctatctctgtcctcctggcagctggatcggctcccaaaggtgtggtgtgccctggttccttgcttccggactccacgttccccagtgcttcatcccaaccccagcagcgctatgcagccaccaggacagtttatcataagaatgtgagctctaacccatgtcatgaggcagttgggattaaaaaggtcagcagcttatatgtaccttgtttatccaataacatttgcctggcggcgtcagaaaactcctctcgtgttgcacgtgaccctgccgaaggcactcccttggaggctgcgggcacccgagcaccggctcccggccttgtctcccgcacagccggcacaggaaaaccaccccctgctcctcctcctgaccctcccaagctattctttgacatccgtaaagatgccgttaaccgtggcgagagtccttccctggggactcaggcttcgttcccagatgtgagaccacctgtgctaggcccccgggttacctctgatcccgaaaaccggaagagcaaagaatcttaccttttgcagccgagttatccagccaaggatgccacttcctccagtgcagcccagccggaggtaatagttgtccctctctacctggttaatactgacagagggcaagaaggcactgccagacctccaacacctctggggcctcttggctgcgtccccacaatcccagcgactgcctctgccgcctcacctctgaccttcccgactctagatgatttcattccccctcatctgcagaggtggccccaccacagccagccagcccgcgcctctggctcctttgcccccattagccagacgccaccatccttctcaccaccacctccgctggtccctcctgccccggaggacctccgcagagtctcggagcctgacctcacgggagctgtttcgagtaccgattccagtcctctactaaatgaagtttcttcttcccttattggaactgattcccaagcctttccatcagttagcaagccttcatccgcctatccctccacaacgattgtcaatcctactattgtgctcttgcaacacaatcgagaacagcaaaaacgactcagtagcctttcagatcctgtctcagaaagaagagtgggagagcaggactcagcaccaacccaggaaaaacccacctcacctggcaaggctattgaaaaaagagcaaaggatgacagtaggcgggtggtgaagagcactcaggacttaagcgatgtttccatggatgaagtgggcatcccactccggaacactgagagatcaaaagactggtacaagactatgtttaaacagatccacaaactgaacagagatgatgattcagatctgtactctcccagatactcattttctgaagacacaaaatctcccctttctgtgcctcgctcaaaaagtgagatgagctacattgatggtgagaaggtagtcaagaggtcggccacactacccctcccagcccgctcttcctcactgaagtcaagctcagaaagaaatgactgggaacccccagataagaaagtagatacaagaaaatatcgtgcagagcccaagagcatttacgaatatcagcctggcaagtcttccgttctgaccaacgaaaagatgagctcagccatcagccctactccggaaatttcttcagagactcctggatatatatattcttccaacttccatgcagtgaagagggaatcagacggggctcctggggatctcactagcttggagaatgagagacaaatttataaaagtgtcttggaaggtggtgacatccctcttcagggcctgagtgggctcaagcgaccatccagctctgcttccactaaagattcagaatcgccaagacattttataccagctgattacttggaatccacggaagaatttattcgaagacgtcatgatgataaagagaaacttttagcggaccagagacgacttaaacgcgagcaagaagaggctgatattgcagctcgacgccacacaggcgtcattccgacgcaccatcagtttatcactaatgagcgctttggggacctcctcaatatagacgatactgcaaaaaggaaatctgggtcagagaaaaaaaaaaaaaaaaaaaaaac

SEQ ID NO: 314211 - DNA, 2460 bp, Homo sapiens
aggaggaagcatcattcatgaaccgatctttgcagacgacttgtcctgccaccaccatgagttctgaatgtgatggtggttccaaagctgtgatgaatggcttggcacctggcagcaatgggcaagacaaagcaactgccgaccctttacgcgcacgctctatttctgctgttaaaatcattcctgtgaagacagtgaaaaacgcctcaggcctagttctccctacagacatggatcctacaaaaatctgcactgggaagggagcggtgactctccgggcctcgtcttcctacagggaaaccccaagcagtagccctgcgagccctcaggaaacccggcaacacgaaagcaaaccaggtctggagccagagccttcttcagcagatgagtggaggctttcttccagtgctgatgccaatggaaatgcccagccctcttcactcgctgccaagggctacagaagtgtgcatcccaaccttccttctgacaagtcccaggttctctctcccccacgccctcctctccctcaaaaggaccgctttgcatggcagtcccccaccatccacaatacctataaggattccctctacctgagctcaccaaagccttatgtcccactcggcacccccagacagcagaacccctcacaaccccagcctatctctgtcctcctggcagctggatcggctcccaaaggtgtggtgtgccctggttccttgcttccggactccacgttccccagtgcttcatcccaaccccagcagcgctatgcagccaccaggacagtttatcataagaatgtgagctctaacccatgtcatgaggcagttgggattaaaaaggtcagcagcttatatgtaccttgtttatccaataacatttgcctggcggcgtcagaaaactcctctcgtgttgcacgtgaccctgccgaaggcactcccttggaggctgcgggcacccgagcaccggctcccggccttgtctcccgcacagccggcacaggaaaaccaccccctgctcctcctcctgaccctcccaagctattctttgacatccgtaaagatgccgttaaccgtggcgagagtccttccctggggactcaggcttcgttcccagatgtgagaccacctgtgctaggcccccgggttacctctgatcccgaaaaccggaagagcaaagaatcttaccttttgcagccgagttatccagccaaggatgccacttcctccagtgcagcccagccggaggtaatagttgtccctctctacctggttaatactgacagagggcaagaaggcactgccagacctccaacacctctggggcctcttggctgcgtccccacaatcccagcgactgcctctgccgcctcacctctgaccttcccgactctagatgatttcattccccctcatctgcagaggtggccccaccacagccagccagcccgcgcctctggctcctttgcccccattagccagacgccaccatccttctcaccaccacctccgctggtccctcctgccccggaggacctccgcagagtctcggagcctgacctcacgggagctgtttcgagtaccgattccagtcctctactaaatgaagtttcttcttcccttattggaactgattcccaagcctttccatcagttagcaagccttcatccgcctatccctccacaacgattgtcaatcctactattgtgctcttgcaacacaatcgagaacagcaaaaacgactcagtagcctttcagatcctgtctcagaaagaagagtgggagagcaggactcagcaccaacccaggaaaaacccacctcacctggcaaggctattgaaaaaagagcaaaggatgacagtaggcgggtggtgaagagcactcaggacttaagcgatgtttccatggatgaagtgggcatcccactccggaacactgagagatcaaaagactggtacaagactatgtttaaacagatccacaaactgaacagagatgatgattcagatctgtactctcccagatactcattttctgaagacacaaaatctcccctttctgtgcctcgctcaaaaagtgagatgagctacattgatggtgagaaggtagtcaagaggtcggccacactacccctcccagcccgctcttcctcactgaagtcaagctcagaaagaaatgactgggaacccccagataagaaagtagatacaagaaaatatcgtgcagagcccaagagcatttacgaatatcagcctggcaagtcttccgttctgaccaacgaaaagatgagctcagccatcagccctactccggaaatttcttcagagactcctggatatatatattcttccaacttccatgcagtgaagagggtttccatttatggagaaagaaaaaaatggcagagggtagaagagtgatgtggaagaaaaattagaaaatataacttgatactttttg

SEQ ID NO: 314212 - DNA, 2650 bp, Homo sapiens
aggaggaagcatcattcatgaaccgatctttgcagacgacttgtcctgccaccaccatgagttctgaatgtgatggtggttccaaagctgtgatgaatggcttggcacctggcagcaatgggcaagacaaagcaactgccgaccctttacgcgcacgctctatttctgctgttaaaatcattcctgtgaagacagtgaaaaacgcctcaggcctagttctccctacagacatggatcctacaaaaatctgcactgggaagggagcggtgactctccgggcctcgtcttcctacagggaaaccccaagcagtagccctgcgagccctcaggaaacccggcaacacgaaagcaaaccaggtctggagccagagccttcttcagcagatgagtggaggctttcttccagtgctgatgccaatggaaatgcccagccctcttcactcgctgccaagggctacagaagtgtgcatcccaaccttccttctgacaagtcccaggttctctctcccccacgccctcctctccctcaaaaggaccgctttgcatggcagtcccccaccatccacaatacctataaggattccctctacctgagctcaccaaagccttatgtcccactcggcacccccagacagcagaacccctcacaaccccagcctatctctgtcctcctggcagctggatcggctcccaaaggtgtggtgtgccctggttccttgcttccggactccacgttccccagtgcttcatcccaaccccagcagcgctatgcagccaccaggacagtttatcataagaatgtgagctctaacccatgtcatgaggcagttgggattaaaaaggtcagcagcttatatgtaccttgtttatccaataacatttgcctggcggcgtcagaaaactcctctcgtgttgcacgtgaccctgccgaaggcactcccttggaggctgcgggcacccgagcaccggctcccggccttgtctcccgcacagccggcacaggaaaaccaccccctgctcctcctcctgaccctcccaagctattctttgacatccgtaaagatgccgttaaccgtggcgagagtccttccctggggactcaggcttcgttcccagatgtgagaccacctgtgctaggcccccgggttacctctgatcccgaaaaccggaagagcaaagaatcttaccttttgcagccgagttatccagccaaggatgccacttcctccagtgcagcccagccggaggtaatagttgtccctctctacctggttaatactgacagagggcaagaaggcactgccagacctccaacacctctggggcctcttggctgcgtccccacaatcccagcgactgcctctgccgcctcacctctgaccttcccgactctagatgatttcattccccctcatctgcagaggtggccccaccacagccagccagcccgcgcctctggctcctttgcccccattagccagacgccaccatccttctcaccaccacctccgctggtccctcctgccccggaggacctccgcagagtctcggagcctgacctcacgggagctgtttcgagtaccgtaagcttgctggactcccctcctcacggcttttctgaatgtctcctcccagcagtcacattccctttctcactgaagcactgagctctgaggacagcactggctgccgctgtgcctgtgtgatgactggagccgtgtcccctgtcactagcgtgcatgcttcccgtgtgtcttccctgggtctctcggggctgttccccatctctgcagtgcctcatctgctctgtcctgttgggaatgcacatctttctccctcagaagacaacatctgtggcctttatgttgactggccatgcttttcacaggccaggtcgggggtcgtgtggtgagctgaggaaagctaagaattatgggggaaagcaacggcaggcgtggtgggtgctacttaccagggagcggggagatctcggggaggaagcgattctctgattctttttcattctcccagcagccccatgaagtaactcttcattttatcaatgaggagtatgaggttcagagagattaagtaatatatgcaagattacacagtaagtagcagaaccaggattcaaacctaggtgtttggggctccattaacacaggcttttactcaacgctgctatactgccctgcagattcctttccccttcctgactctgtgttcttgcttgtccccttcttgtccagaggctctctggtatctgactgcaggcattcagcttcccctgagtcagtcctgcctcagtctgctaagccagtacctcccagatggtgcctggaaatatatagttagggacccagcacggtggctcatgcctgtaatttcagcactttgggaggccgaggtgggcagatcacctgaggtcaagagttcgagaccagcctggccaacatagtgaaaccctgtctttactaaaaatacaaaaaaaaaaattagccagtgggcgtgatggcaggcgcctgtaatcccagctacttgggaggctgaggcaagagaatcacttgaatctgggatgcagaggttgcagtgagccgagatcgcaccactgcactccaccatgggcaacagagtgagtctctgtctc

SEQ ID NO: 314213 - DNA, 1335 bp, Homo sapiens
aggaggaagcatcattcatgaaccgatctttgcagacgacttgtcctgccaccaccatgagttctgaatgtgatggtggttccaaagctgtgatgaatggcttggcacctggcagcaatgggcaagacaaagcaactgccgaccctttacgcgcacgctctatttctgctgttaaaatcattcctgtgaagacagtgaaaaacgcctcaggcctagttctccctacagacatggatcctacaaaaatctgcactgggaagggagcggtgactctccgggcctcgtcttcctacagggaaaccccaagcagtagccctgcgagccctcaggaaacccggcaacacgaaagcaaaccaggtctggagccagagccttcttcagcagatgagtggaggctttcttccagtgctgatgccaatggaaatgcccagccctcttcactcgctgccaagggctacagaagtgtgcatcccaaccttccttctgacaagtcccaggttctctctcccccacgccctcctctccctcaaaaggaccgctttgcatggcagtcccccaccatccacaatacctataaggattccctctacctgagctcaccaaagccttatgtcccactcggcacccccagacagcagaacccctcacaaccccagcctatctctgtcctcctggcagctggatcggctcccaaaggtgtggtgtgccctggttccttgcttccggactccacgttccccagtgcttcatcccaaccccagcagcgctatgcagccaccaggacagtttatcataagaatgtgagctctaacccatgtcatgaggcagttgggattaaaaaggtcagcagcttatatgtaccttgtttatccaataacatttgcctggcggcgtcagaaaactcctctcgtgttgcacgtgaccctgccgaaggcactcccttggaggctgcgggcacccgagcaccggctcccggccttgtctcccgcacagccggcacaggaaaaccaccccctgctcctcctcctgaccctcccaagctattctttgacatccgtaaagatgccgttaaccgtggcgagagtccttccctggggactcaggcttcgttcccagatgtgagaccacctgtgctaggcccccgggttacctctgatcccgaaaaccggaagagcaaagaatcttaccttttgcagccgagttatccagccaaggatgccacttcctccagtgcagcccagccggaggtaatagttgtccctctctacctggttaatactgacagagggcaagaaggcagagcagtcgctgggattgtgggcacgcagccaagag

SEQ ID NO: 314214 - DNA, 839 bp, Homo sapiens
gagcgcggccccgccccgggacggcagcctgcgcgcccggccgccgcctgccctctccgctggccacctgctgccgcccgcgccatggctggcaaagcacacaggctgagcgctgaggagagggaccagctgctgccaaacctgagggctgtggggtggaatgagctggaaggccgtgatgccatcttcaagcagtttcatttcaaagacttcaacagggcctttgggttcatgacaagagtggccctgcaggctgagaaactggaccaccatcctgaatggtttaacgtgtacaacaaggtccacatcacgctgagcacccatgagtgtgccggcctttcagaacgggacataaacctggccagcttcatcgaacaagtagcagtgtccatgacatagaccctgcccttcctctttgaattcttccgggggaaagggtgactgaactgggagtccagggagggagctgaggagcccttaccctcccaccactcccctcccaagacccagccgccgccgttgagggctgagtccttgctgtgggatgtgccagtgtccccaccaacaccaggaatttagaccttttccctgcaccactctcttcatcctgggggctctgttacactaatttgaataaactctcccctttctttgcaacttcccagcaacaataatgattttcttgccaggccgtctcttgctccctaattcatttcccaggaagctgtgatacagggtgaaataaagtcttgtcttagaaaccaggaccctaaaccccacactatgtaatagaaacacatgtgtttttatgtctcaaataaaactattatatcacttgg

SEQ ID NO: 314215 - DNA, 722 bp, Homo sapiens
acattggtcttttcctgctttcggacttaaactgaaacatccactctccttaggtctcaaggctacaagcctccggtgtgcaacaataccatctgctttcctggttctccagcttgccaactacagatcttgggacttgtcagcctccataatcacatgagccaattccttataagaaatctctttgtgtgtattggttctgtttctctggagaatcataatacacaggcctatcatatcagatatggcagatcccaaatcctgatggtctcttcagtttcttaaaatcttagcaaagttcttagggcttgcctggtttactccacaagagagaagacacaggcagcttaggacctggcaggctatttattactggagcagttaagagatggtttgcacagtcagttccccagccaggaactctctaggacagaatattcccacgctgtcatgaagaagggggcactaagagcagcctcatctctacccccacgagaatgccacacaaattttacctcacatatgtcactatgcagagactgggaagccttcttcctaatagttctcacctgtgtctcctaactcaagtactaagctgacttgtaaatgccggggtcacttggaacaggaatctagccatgtcacaactcagtctgaatgagttggtcccccagcaaaggccaggaaaggggcagaggctggaggttgagaaataagcgtat

SEQ ID NO: 314216 - DNA, 1075 bp, Homo sapiens
gagcgcggccccgccccgggacggcagcctgcgcgcccggccgccgcctgccctctccgctggccacctgctgccgcccgcgccatggctggcaaagcacacaggctgagcgctgaggagagggaccagctgctgccaaacctgagggctgtggggtggaatgagctggaaggccgtgatgccatcttcaagcagtttcatttcaaagacttcaacagggcctttgggttcatgacaagagtggccctgcaggctgagaaactggaccaccatcctgaatggtttaacgtgtacaacaaggtccacatcacgctgagcacccatgagtgtgccggcctttcagaacgggacataaacctggccagcttcatcgaacaagtagcagtgtccatgacatagaccctgcccttcctctttgaattcttccgggggaaagggtgactgaactgggagtccagggagggagctgaggagcccttaccctcccaccactcccctcccaagacccagccgccgccgttgagggctgagtccttgctgtgggatgtgccagtgtccccaccaacaccaggaatttagaccttttccctgcaccactctcttcatcctgggggctctgttacactaatttgaataaactctcccctttctttgcaacttcccagcaacaataatgattttcttgccaggccgtctcttgctccctaattcatttcccaggaagctgtgatacagggtgaaataaagtcttgtcttagaaaccaggaccctaaaccccacactatgtaatagaaacacatgtgtttttatgtctcaaataaaactattatatcacttggaaaaaaaaaaaaaaaaaaaaaaactaaaaaaaaaaaaaaaaaaactgctggaaggcataattttgggggggggtggaggagaggaagaggtgtagatagaaaggtggcgcagtgggtatatagcggtgtgttctcgagacccatgtttttgctgtacaagggggtgaaaatttaggggggctcccaatagagagggccggaatatttcgaaaaagccgtgttaccgtgttaagagg

SEQ ID NO: 314217 - DNA, 969 bp, Homo sapiens
gacctgagggcctatcggcagacgagcctggaccccacctcctgggcagggtgccacccttgaggcctcccagcctattgctcaaagacctgctgccctttggtcacccacgtccaaagcagccagtggaagctaagttcccctaaaggttggagcccctctgttttgacctataaagagaaatgcccttgggcctctgtttttttccctcttctaggctggcaaagcacacaggctgagcgctgaggagagggaccagctgctgccaaacctgagggctgtggggtggaatgagctggaaggccgtgatgccatcttcaagcagtttcatttcaaagacttcaacagggcctttgggttcatgacaagagtggccctgcaggctgagaaactggaccaccatcctgaatggtttaacgtgtacaacaaggtccacatcacgctgagcacccatgagtgtgccggcctttcagaacgggacataaacctggccagcttcatcgaacaagtagcagtgtccatgacatagaccctgcccttcctctttgaattcttccgggggaaagggtgactgaactgggagtccagggagggagctgaggagcccttaccctcccaccactcccctcccaagacccagccgccgccgttgagggctgagtccttgctgtgggatgtgccagtgtccccaccaacaccaggaatttagaccttttccctgcaccactctcttcatcctgggggctctgttacactaatttgaataaactctcccctttctttgcaacttcccagcaacaataatgattttcttgccaggccgtctcttgctccctaattcatttcccaggaagctgtgatacagggtgaaataaagtcttgtcttagaaaccaggaccctaaaccccacactatgtaatagaaacacatgtgtttttatgtctcaaataaaactattatatcacttgg

SEQ ID NO: 314218 - DNA, 969 bp, Homo sapiens
gagcgcggccccgccccgggacggcagcctgcgcgcccggccgccgcctgccctctccgctggccacctgctgccgcccgcgccatggctggcaaagcacacaggctgagcgctgaggagagggaccagctgctgccaaacctgagggctgtggggtggaatgagctggaaggccgtgatgccatcttcaagcagtttcatttcaaagacttcaacagggcctttgggttcatgacaagagtggccctgcaggctgagaaactggaccaccatcctgaatggtttaacgtgtacaacaaggtctcaaggctacaagcctccggtgtgcaacaataccatctgctttcctggttctccagcttgccaactacagatcttgggacttgtcagcctccataatcacatgagccaattccttataagaaatctctttgtgtgtattggttctgtttctctggagaatcataatacacaggcctatcatatcagatatggcagatcccaaatcctgatggtctcttcagtttcttaaaatcttagcaaagttcttagggcttgcctggtttactccacaagagagaagacacaggcagcttaggacctggcaggctatttattactggagcagttaagagatggtttgcacagtcagttccccagccaggaactctctaggacagaatattcccacgctgtcatgaagaagggggcactaagagcagcctcatctctacccccacgagaatgccacacaaattttacctcacatatgtcactatgcagagactgggaagccttcttcctaatagttctcacctgtgtctcctaactcaagtactaagctgacttgtaaatgccggggtcacttggaacaggaatctagccatgtcacaactcagtctgaatgagttggtcccccagcaaaggccaggaaaggggcagaggctggaggttgagaaataagcgtat

SEQ ID NO: 314219 - DNA, 474 bp, Homo sapiens
ccccacctcctgggcagggtgccacccttgaggcctcccagcctattgctcaaagacctgctgccctttggtcacccacgtccaaagcagccagtggaagctaagttcccctaaaggttggagcccctctgttttgacctataaagagaaatgcccttgggcctctgtttttttccctcttctaggctggcaaagcacacaggctgagcgctgaggagagggaccagctgctgccaaacctgagggctgtggggtggaatgagctggaaggccgtgatgccatcttcaagcagtttcatttcaaagacttcaacagggtatggcaccagggtgggacagagttttctgagacgggctgatggggtcaccttacaaagcatgttctctcccttcacgtcttgttagccaagactctcagacaccacactcatccagttatttgggcactgtgccagtggggaaattaattttcct

SEQ ID NO: 314220 - DNA, 859 bp, Homo sapiens
gagcgcggccccgccccgggacggcagcctgcgcgcccggccgccgcctgccctctccgctggccacctgctgccgcccgcgccatggctggcaaagcacacaggctgagcgctgaggagagggaccagctgctgccaaacctgagggctgtggggtggaatgagctggaaggccgtgatgccatcttcaagcagtttcatttcaaagacttcaacagggcctttgggttcatgacaagagtggccctgcaggctgagaaactggaccaccatcctgaatggtttaacgtgtacaacaaggtccacatcacgctgagcacccatgagtgtgccggcctttcagaacgggacataaacctggccagcttcatcgaacaagtagcagtgtccatgacatagaccctgcccttcctctttgaattcttccgggggaaagggtgactgaactgggagtccagggagggagctgaggagcccttaccctcccaccactcccctcccaagacccagccgccgccgttgagggctgagtccttgctgtgggatgtgccagtgtccccaccaacaccaggaatttagaccttttccctgcaccactctcttcatcctgggggctctgttacactaatttgaataaactctcccctttctttgcaacttcccagcaacaataatgattttcttgccaggccgtctcttgctccctaattcatttcccaggaagctgtgatacagggtgaaataaagtcttgtcttagaaaccaggaccctaaaccccacactatgtaatagaaacacatgtgtttttatgtctcaaataaaactattatatcacttggaaaaaacaggctctagaaac

SEQ ID NO: 314221 - DNA, 1160 bp, Homo sapiens
gggggcggggcctacgaccttcctgggccggggaagacagtcgtggaggagtccacggatctcgtccccttggtggcccgattctgctttatactggggtgggagcgagagggaggctgagtttgcgcgctcgtgtgcgtgcctgtccgctgccccttcccgctggcactctgggtacggggtctgcctgggactcacgctctgcgccggtatgctggccccagagccagtccccgcgccggcttgaggcccgtgccaggccacgggggcttggtggcgctggagcagccctcctcccgtgagcttcccccacccacccccggggcgggggcgggggcggggcccttgctctgctgtaagctcgcgagcttcatcagaccatttctggtccacaggccttcggagcaggctggcaaagcacacaggctgagcgctgaggagagggaccagctgctgccaaacctgagggctgtggggtggaatgagctggaaggccgtgatgccatcttcaagcagtttcatttcaaagacttcaacagggcctttgggttcatgacaagagtggccctgcaggctgagaaactggaccaccatcctgaatggtttaacgtgtacaacaaggtccacatcacgctgagcacccatgagtgtgccggcctttcagaacgggacataaacctggccagcttcatcgaacaagtagcagtgtccatgacatagaccctgcccttcctctttgaattcttccgggggaaagggtgactgaactgggagtccagggagggagctgaggagcccttaccctcccaccactcccctcccaagacccagccgccgccgttgagggctgagtccttgctgtgggatgtgccagtgtccccaccaacaccaggaatttagaccttttccctgcaccactctcttcatcctgggggctctgttacactaatttgaataaactctcccctttctttgcaacttcccagcaacaataatgattttcttgccaggccgtctcttgctccctaattcatttcccaggaagctgtgatacagggtgaaataaagtcttgtcttagaaaccaggaccctaaaccccacactatgtaatagaaacacatgtgtttttatgtctcaaataaaactattatatcacttgg

SEQ ID NO: 314222 - DNA, 1420 bp, Homo sapiens
gccccgccgagagcgtgaactatcgctgcggaggggcagacctggaccggtggaaggccgggcggaagtgcgcgcctggggccgccttggttaccgcgttttccgctcctcgctacgtcatcgttgtgagcccgctatcagcggccagcgcgggcgcggccggagaccgtggggcccccggttgccgccccctcgggagccaccatgttggtgataccccccggactgagcgaggaagaggaggctctgcagaagaaattcaacaagctcaagaaaaagaaaaaggcattgctggctctgaagaagcaaagtagcagcagcacaaccagccaaggtggtgtcaaacgctcactatcagagcagcctgtcatggacacagccacagcaacagagcaggcaaagcagctggtgaagtcaggagccatcagtgccatcaaggctgagaccaagaactcaggcttcaagcgttctcgaacccttgaggggaagttaaaggaccccgagaagggaccagtccccactttccagccgttccagaggagcatatctgctgatgatgacctgcaagagtcatccagacgtccccagaggaaatctctgtatgagagctttgtgtcttctagtgatcgacttcgagaactaggaccagatggagaagaggcagagggcccaggggctggtgatggtccccctcgaagctttgactggggctatgaagaacgcagtggtgcccactcctcagcctcccctccccgaagccgcagccgggaccgcagccatgagaggaaccgggacagagaccgagatcgggagcgggatcgagaccgggatcgagacagagacagagagcgggacagggatcgggatcgggatcgagatcgagaccgggaacgggacagggatcgggagcgggatcgagaccgagaccgagagggtcctttccgcaggtcggattcattccctgaacggcgagcccctaggaaagggaatactctctatgtatatggagaagacatgacacccacccttctccgtggggccttctctccttttggaaacatcattgacctctccatggacccacccagaaactgtgccttcgtcacctatgaaaagatggagtcagcagatcaggccgttgctgagctcaacgggacccaggtggagtctgtacagctcaaagtcaacatagcccgaaaacagcccatgctggatgccgctactggcaagtctgtctggggctccctcgctgtccagaacagccctaagggttgccaccgggacaagaggacccagattgtctacagtgatgacgtctacaaggaaaaccttgtggatggcttctagggaacagagctggattccttgtgcctcatatgccccaatgctggtctcagtaaaacactgaggtggaagctta

SEQ ID NO: 314223 - DNA, 1825 bp, Homo sapiens
gccccgccgagagcgtgaactatcgctgcggaggggcagacctggaccggtggaaggccgggcggaagtgcgcgcctggggccgccttggttaccgcgttttccgctcctcgctacgtcatcgttgtgagcccgctatcagcggccagcgcgggcgcggccggagaccgtggggcccccggttgccgccccctcgggagccaccatgttggtgataccccccggactgagcgaggaagaggaggctctgcagaagaaattcaacaagctcaagaaaaagaaaaaggcattgctggctctgaagaagcaaagtagcagcagcacaaccagccaaggtggtgtcaaacgctcactatcagagcagcctgtcatggacacagccacagcaacagagcaggcaaagcagctggtgaagtcaggagccatcagtgccatcaaggctgagaccaagaactcaggcttcaagcgttctcgaacccttgaggggaagttaaaggaccccgagaagggaccagtccccactttccagccgttccagaggagcatatctgctgatgatgacctgcaagagtcatccagacgtccccagaggaaatctctgtatgagagctttgtgtcttctagtgatcgacttcgagaactaggaccagatggagaagaggcagagggcccaggggctggtgatggtccccctcgaagctttgactggggctatgaagaacgcagtggtgcccactcctcagcctcccctccccgaagccgcagccgggaccgcagccatgagaggaaccgggacagagaccgagatcgggagcgggatcgagaccgggatcgagacagagacagagagcgggacagggatcgggatcgggatcgagatcgagaccgggaacgggacagggatcgggagcgggatcgagaccgagaccgagagggtcctttccgcaggtcggattcattccctgaacggcgagcccctaggaaagggaatactctctatgtatatggagaagacatgacacccacccttctccgtggggccttctctccttttggaaacatcattgacctctccatggacccacccagaaactgtgccttcgtcacctatgaaaagatggagtcagcagatcaggccgttgctgagctcaacgggacccaggtggagtctgtacagctcaaagtcaacatagcccgaaaacagcccatgctggatgccgctactggcaagtctgtctggggctccctcgctgtccagaacagccctaagggttgccaccgggacaagaggacccagattgtctacagtgatgacgtctacaaggaaaaccttgtggatggcttctagggaacagagctggattccttgtgcctcatatgccccaatgctggtctcagtaaaacactgaggtggaagcttaaaaaaaaaaaaaaaaaaaaaaaaaaaaaaaaaaaaagggggggggggcaaaagttttccccggggggcccaattttgcggtccccgttttttggaaagggggcgccaagaggagagcggaatataaaaggcaaggccggggcgcccgcgtataaccaagcgtctcgcgttggagaacccgccgctggggcctggcaaggacccttccttcggcgggtggcacttgggcccactcctaggatataggccaggaaactaacttcgggtagggaacccccattgctggtggagttggtccgttgttaatacgcgcgccgctgaacaacacaggaaatcgtgagccaagcagagcacgcaaataaccgaacagtagcacatcacacaagactcatcaacactcatcccc

SEQ ID NO: 314224 - DNA, 1857 bp, Homo sapiens
gccccgccgagagcgtgaactatcgctgcggaggggcagacctggaccggtggaaggccgggcggaagtgcgcgcctggggccgccttggttaccgcgttttccgctcctcgctacgtcatcgttgtgagcccgctatcagcggccagcgcgggcgcggccggagaccgtggggcccccggttgccgccccctcgggtaaggccctctgcttctcactcttcggccctttttctcatagccgtttctctgttcttcctctttgcgttgctctgcgggcgctacgctggctccaccgccttctctgccgttcaaaccccgcggttgtccttaccctagcgagggtaggggggtcgggtgccatcgtctttccgacggagtggatatttgtccctccttgaaccacatggtacctaaaggtgctggtgtctgtgatccctggagacaggagggaatgctggatgatcccgaccagcgggagcttggacagcagcctggtttaagcaaggggtagggaaagccaaagacaagagtaggcagacctgaaggggtggggttgggtacagtgtggacggcgtgtgaaccccgggtggtaacagtggagaaagatgtcttgggccctgcccctgaactaggagccaccatgttggtgataccccccggactgagcgaggaagaggaggctctgcagaagaaattcaacaagctcaagaaaaagaaaaaggcattgctggctctgaagaagcaaagtagcagcagcacaaccagccaaggtggtgtcaaacgctcactatcagagcagcctgtcatggacacagccacagcaacagagcaggcaaagcagctggtgaagtcaggagccatcagtgccatcaaggctgagaccaagaactcaggcttcaagcgttctcgaacccttgaggggaagttaaaggaccccgagaagggaccagtccccactttccagccgttccagaggagcatatctgctgatgatgacctgcaagagtcatccagacgtccccagaggaaatctctgtatgagagctttgtgtcttctagtgatcgacttcgagaactaggaccagatggagaagaggcagagggcccaggggctggtgatggtccccctcgaagctttgactggggctatgaagaacgcagtggtgcccactcctcagcctcccctccccgaagccgcagccgggaccgcagccatgagaggaaccgggacagagaccgagatcgggagcgggatcgagaccgggatcgagacagagacagagagcgggacagggatcgggatcgggatcgagatcgagaccgggaacgggacagggatcgggagcgggatcgagaccgagaccgagagggtcctttccgcaggtcggattcattccctgaacggcgagcccctaggaaagggaatactctctatgtatatggagaagacatgacacccacccttctccgtggggccttctctccttttggaaacatcattgacctctccatggacccacccagaaactgtgccttcgtcacctatgaaaagatggagtcagcagatcaggccgttgctgagctcaacgggacccaggtggagtctgtacagctcaaagtcaacatagcccgaaaacagcccatgctggatgccgctactggcaagtctgtctggggctccctcgctgtccagaacagccctaagggttgccaccgggacaagaggacccagattgtctacagtgatgacgtctacaaggaaaaccttgtggatggcttctagggaacagagctggattccttgtgcctcatatgccccaatgctggtctcagtaaaacactgaggtggaagctta

SEQ ID NO: 314225 - DNA, 1668 bp, Homo sapiens
gccccgccgagagcgtgaactatcgctgcggaggggcagacctggaccggtggaaggccgggcggaagtgcgcgcctggggccgccttggttaccgcgttttccgctcctcgctacgtcatcgttgtgagcccgctatcagcggccagcgcgggcgcggccggagaccgtggggcccccggttgccgccccctcgggagccaccatgttggtgataccccccggactgagcgaggaagaggaggctctgcagaagaaattcaacaagctcaagaaaaagaaaaaggcattgctggctctgaagaagcaaagtagcagcagcacaaccagccaaggtggtgtcaaacgctcactatcagagcagcctgtcatggacacagccacagcaacagagcaggcaaagcagctggtgaagtcaggagccatcagtgccatcaaggctgagaccaagaactcaggcttcaagcgttctcgaacccttgaggggaagttaaaggaccccgagaagggaccagtccccactttccagccgttccagaggagcatatctgctgatgatgacctgcaagagtcatccagacgtccccagaggaaatctctgtatgagagctttgtgtcttctagtgatcgacttcgagaactaggaccagatggagaagaggcagagggcccaggggctggtgatggtccccctcgaagctttgactggggctatgaagaacgcagtggtgcccactcctcagcctcccctccccgaagccgcagccgggaccgcagccatgagaggaaccgggacagagaccgagatcgggagcgggatcgagaccgggatcgagacagagacagagagcgggacagggatcgggatcgggatcgagatcgagaccgggaacgggacagggatcgggagcgggatcgagaccgagaccgagagggtcctttccgcaggtcggattcattccctgaacggcgagcccctaggaaagggaatactctctatgtatatggagaagacatgacacccacccttctccgtggggccttctctccttttggaaacatcattgacctctccatggacccacccagaaactgtgccttcgtcacctatgaaaagatggagtcagcagatcaggccgttgctgaggttggaacttcccaaatctgttcttcccatcgcttctgctgttctcatgtgttctcctcaaaatactagatgccaggaagaagttggttcctcttgataaagaaagcctctccctattcacacagaaaaactcacattctcagattccttattcagtctcctcctaggatagcaactcctggaataacttctttggtttatctgtaatgttttcctccccatcctctgcctcccctcttctgcttcagctcaacgggacccaggtggagtctgtacagctcaaagtcaacatagcccgaaaacagcccatgctggatgccgctactggcaagtctgtctggggctccctcgctgtccagaacagccctaagggttgccaccgggacaagaggacccagattgtctacagtgatgacgtctacaaggaaaaccttgtggatggcttctagggaacagagctggattccttgtgcctcatatgccccaatgctggtctcagtaaaacactgaggtggaagctta

SEQ ID NO: 314226 - DNA, 1591 bp, Homo sapiens
gccccgccgagagcgtgaactatcgctgcggaggggcagacctggaccggtggaaggccgggcggaagtgcgcgcctggggccgccttggttaccgcgttttccgctcctcgctacgtcatcgttgtgagcccgctatcagcggccagcgcgggcgcggccggagaccgtggggcccccggttgccgccccctcgggagccaccatgttggtgataccccccggactgagcgaggaagaggaggctctgcagaagaaattcaacaagctcaagaaaaagaaaaaggcattgctggctctgaagaagcaaagtagcagcagcacaaccagccaaggtggtgtcaaacgctcactatcagagcagcctgtcatggacacagccacagcaacagagcaggcaaagcagctggtgaagtcaggagccatcagtgccatcaaggctgagaccaagaactcaggcttcaagcgttctcgaacccttgaggggaagttaaaggaccccgagaagggaccagtccccactttccagccgttccagaggagcatatctgctgatgatgacctgcaagagtcatccagacgtccccagaggaaatctctgtatgagaggttagagagtagagataaggctgggcccatttggtggagttgattgcctgagtccttgggaggtttgggctgtaggagctgggctatagagggaatattgagtctccacagggtctgaggggagaaggtaaaacccccctttgatcttcagtctgcatctccccagctttgctttgtgtcttctagtgatcgacttcgagaactaggaccagatggagaagaggcagagggcccaggggctggtgatggtccccctcgaagctttgactggggctatgaagaacgcagtggtgcccactcctcagcctcccctccccgaagccgcagccgggaccgcagccatgagaggaaccgggacagagaccgagatcgggagcgggatcgagaccgggatcgagacagagacagagagcgggacagggatcgggatcgggatcgagatcgagaccgggaacgggacagggatcgggagcgggatcgagaccgagaccgagagggtcctttccgcaggtcggattcattccctgaacggcgagcccctaggaaagggaatactctctatgtatatggagaagacatgacacccacccttctccgtggggccttctctccttttggaaacatcattgacctctccatggacccacccagaaactgtgccttcgtcacctatgaaaagatggagtcagcagatcaggccgttgctgagctcaacgggacccaggtggagtctgtacagctcaaagtcaacatagcccgaaaacagcccatgctggatgccgctactggcaagtctgtctggggctccctcgctgtccagaacagccctaagggttgccaccgggacaagaggacccagattgtctacagtgatgacgtctacaaggaaaaccttgtggatggcttctagggaacagagctggattccttgtgcctcatatgccccaatgctggtctcagtaaaacactgaggtggaagctta

SEQ ID NO: 314227 - DNA, 1322 bp, Homo sapiens
gccccgccgagagcgtgaactatcgctgcggaggggcagacctggaccggtggaaggccgggcggaagtgcgcgcctggggccgccttggttaccgcgttttccgctcctcgctacgtcatcgttgtgagcccgctatcagcggccagcgcgggcgcggccggagaccgtggggcccccggttgccgccccctcgggagccaccatgttggtgataccccccggactgagcgaggaagaggaggctctgcagaagaaattcaacaagctcaagaaaaagaaaaaggcattgctggctctgaagaagcaaagtagcagcagcacaaccagccaaggtggtgtcaaacgctcactatcagagcagcctgtcatggacacagccacagcaacagagcaggcaaagcagctggtgaagtcaggagccatcagtgccatcaaggctgagaccaagaactcaggcttcaagcgttctcgaacccttgaggggaagttaaaggaccccgagaagggaccagtccccactttccagccgttccagaggagcatatctgctgatgatgacctgcaagagtcatccagacgtccccagaggaaatctctgtatgagagctttgtgtcttctagtgatcgacttcgagaactaggaccagatggagaagaggcagagggcccaggggctggtgatggtccccctcgaagctttgactggggctatgaagaacgcagtggtgcccactcctcagcctcccctccccgaagccgcagccgggaccgcagccatgagaggaaccgggacagagaccgagatcgggcgggatcgagaccgagaccgagagggtcctttccgcaggtcggattcattccctgaacggcgagcccctaggaaagggaatactctctatgtatatggagaagacatgacacccacccttctccgtggggccttctctccttttggaaacatcattgacctctccatggacccacccagaaactgtgccttcgtcacctatgaaaagatggagtcagcagatcaggccgttgctgagctcaacgggacccaggtggagtctgtacagctcaaagtcaacatagcccgaaaacagcccatgctggatgccgctactggcaagtctgtctggggctccctcgctgtccagaacagccctaagggttgccaccgggacaagaggacccagattgtctacagtgatgacgtctacaaggaaaaccttgtggatggcttctagggaacagagctggattccttgtgcctcatatgccccaatgctggtctcagtaaaacactgaggtggaagctta

SEQ ID NO: 314228 - DNA, 1422 bp, Homo sapiens
gccccgccgagagcgtgaactatcgctgcggaggggcagacctggaccggtggaaggccgggcggaagtgcgcgcctggggccgccttggttaccgcgttttccgctcctcgctacgtcatcgttgtgagcccgctatcagcggccagcgcgggcgcggccggagaccgtggggcccccggttgccgccccctcgggagccaccatgttggtgataccccccggactgagcgaggaagaggaggctctgcagaagaaattcaacaagctcaagaaaaagaaaaaggcattgctggctctgaagaagcaaagtagcagcagcacaaccagccaaggtggtgtcaaacgctcactatcagagcagcctgtcatggacacagccacagcaacagagcaggcaaagcagctggtgaagtcaggagccatcagtgccatcaaggctgagaccaagaactcaggcttcaagcgttctcgaacccttgaggggaagttaaaggaccccgagaagggaccagtccccactttccagccgttccagaggagcatatctgctgatgatgacctgcaagagtcatccagacgtccccagaggaaatctctgtatgagagctttgtgtcttctagtgatcgacttcgagaactaggaccagatggagaagaggcagagggcccaggggctggtgatggtccccctcgaagctttgactggggctatgaagaacgcagtggtgcccactcctcagcctcccctccccgaagccgcagccgggaccgcagccatgagaggaaccgggacagagaccgagatcgggagcgggatcgagaccgggatcgagacagtgagtgattttggctggaggtcaaggtgaccttaactgaggtttatgtgggtcctactaagtgaaatgtggcatgggctatgtcttgtgactatgatttgtgctcccaaggtcggattcattccctgaacggcgagcccctaggaaagggaatactctctatgtatatggagaagacatgacacccacccttctccgtggggccttctctccttttggaaacatcattgacctctccatggacccacccagaaactgtgccttcgtcacctatgaaaagatggagtcagcagatcaggccgttgctgagctcaacgggacccaggtggagtctgtacagctcaaagtcaacatagcccgaaaacagcccatgctggatgccgctactggcaagtctgtctggggctccctcgctgtccagaacagccctaagggttgccaccgggacaagaggacccagattgtctacagtgatgacgtctacaaggaaaaccttgtggatggcttctagggaacagagctggattccttgtgcctcatatgccccaatgctggtctcagtaaaacactgaggtggaagctta

SEQ ID NO: 314229 - DNA, 779 bp, Homo sapiens
gccccgccgagagcgtgaactatcgctgcggaggggcagacctggaccggtggaaggccgggcggaagtgcgcgcctggggccgccttggttaccgcgttttccgctcctcgctacgtcatcgttgtgagcccgctatcagcggccagcgcgggcgcggccggagaccgtggggcccccggttgccgccccctcgggagccaccatgttggtgataccccccggactgagcgaggaagaggaggctctgcagaagaaattcaacaagctcaagaaaaagaaaaaggcattgctggctctgaagaagcaaagtagcagcagcacaaccagccaaggtggtgtcaaacgctcactatcagagcagcctgtcatggacacagccacagcaacagagcaggcaaagcagctggtgaagtcaggagccatcagtgccatcaaggctgagaccaagaactcaggcttcaagcgttctcgaacccttgaggggaagttaaaggaccccgagaagggaccagtccccactttccagccgttccagaggagcatatctgctgatgatgacctgcaagagtcatccagacgtccccagaggaaatctctgtatgagagctgtccagaacagccctaagggttgccaccgggacaagaggacccagattgtctacagtgatgacgtctacaaggaaaaccttgtggatggcttctagggaacagagctggattccttgtgcctcatatgccccaatgctggtctcagtaaaacactgaggtggaagctta

SEQ ID NO: 314230 - DNA, 2464 bp, Homo sapiens
ggcacgaggggttgccgccccctcgggagccaccatgttggtgataccccccggactgagcgaggaagaggaggctctgcagaagaaattcaacaagctcaagaaaaagaaaaaggcattgctggctctgaagaagcaaagtagcagcagcacaaccagccaaggtggtgtcaaacgctcactatcagagcagcctgtcatggacacagccacagcaacagagcaggcaaagcagctggtgaagtcaggagccatcagtgccatcaaggctgagaccaagaactcaggcttcaagcgttctcgaacccttgaggggaagttaaaggaccccgagaagggaccagtccccactttccagccgttccagaggagcatatctgctgatgatgacctgcaagagtcatccagacgtccccagaggaaatctctgtatgagagctttgtgtcttctagtgatcgacttcgagaactaggaccagatggagaagaggcagagggcccaggggctggtgatggtccccctcgaagctttgactggggctatgaagaacgcagtggtgcccactcctcagcctcccctccccgaagccgcagccgggaccgcagccatgagaggaaccgggacagagaccgagatcgggggtcggattcattccctgaacggcgagcccctaggaaagggaatactctctatgtatatggagaagacatgacacccacccttctccgtggggccttctctccttttggaaacatcattgacctctccatggacccacccagaaactgtgccttcgtcacctatgaaaagatggagtcagcagatcaggccgttgctgagctcaacgggacccaggtggagtctgtacagctcaaagtcaacatagcccgaaaacagcccatgctggatgccgctactggcaagtctgtctggggctccctcgctgtccagaacagccctaagggttgccaccgggacaagaggacccagattgtctacagtgatgacgtctacaaggaaaaccttgtggatggcttctagggaacagagctggattccttgtgcctcatatgccccaatgctggtctcagtaaaacactgaggtggaagcttaaaaaaaaaggagcgtctctgcccggcctccccgtctgagaagtgaggaaaccctctgcctggcaaccgccccgtctgagaagtgaggagcccctccgtccggcagccaccccgtctgggaagtgaggagcgtctccgcccggcagccaccccgaccgggagggaggtggggggggggggtcagccccccgcccggccagccgccccgtccgggaggtgaggggctcctctgcccggccgcccctactgggaagtgaggagcccctctgcccggccagccgccccgtccgggagggaggtggggggatcagccccccgcctggccagccgccccgtccgggaggtgaggggcgcctctgcccggccgcccctactgggaagtgaggagcccctctgcccggccagccgccccgtccgggagggaggtgggggggtcagccccccgcccggccagccgccccatccgggagggaggtgggggggtcagccctccgcccggccagccgccccgtccgggagggaggtggggggggtcagccccccgcccggccagccgccccgtccgggagggaggtggggggatcagccccccgcctggccagccaccccgtccgggaggtgaggggcgcctctgcccggccgcccctactgggaagtgaggacccctctgcctggccagccgccccgtccgggagggttgggggggggtcagccccccgcccggccagccgccccatccgggaggtgaggggcgcttctgcccggccgcccctactgggaaatgaggagcccctctgcccggccacgaccccgtctgggaggtgtgcccagcggctcattggggatgggccatgatgacaatggcggttttgtggaatagaaaggcgggaagagtggggaaaaaattgagaaatcggatggttgccgggtctctgtggatagaagtagacatgggagacttttcattttgttctgtactaagaaaaattcttctgccttgggatcctgttgatctgtgaccttatccccaaccctgtgctctctgaaacatgtgctgtgtccactcagggttaaatggattaagggcggtgcaagatgtgctttgttaaacagatgcttgaaggcagcatgctcgttaagagtcatcaccactccctaatcttaagtacccagggacacaaacactgcggaaggccgcagggtcctctgcctaggaaaaccagagacctttgttcacttgtttatctactgaccttccctccactattgtcctatgaccctgccaaatccccctctgcgagaaacacccaagaatgatcaataaaataaataaataaataaataaataat

SEQ ID NO: 314231 - DNA, 1966 bp, Homo sapiens
gccccgccgagagcgtgaactatcgctgcggaggggcagacctggaccggtggaaggccgggcggaagtgcgcgcctggggccgccttggttaccgcgttttccgctcctcgctacgtcatcgttgtgagcccgctatcagcggccagcgcgggcgcggccggagaccgtggggcccccggttgccgccccctcgggagccaccatgttggtgataccccccggactgagcgaggaagaggaggctctgcagaagaaattcaacaagctcaagaaaaagaaaaaggcattgctggctctgaagaagcaaagtagcagcagcacaaccagccaaggtggtgtcaaacgctcactatcagagcagcctgtcatggacacagccacagcaacagagcaggcaaagcagctggtgaagtcaggagccatcagtgccatcaaggctgagaccaagaactcaggcttcaagcgttctcgaacccttgaggggaagttaaaggaccccgagaagggaccagtccccactttccagccgttccagaggagcatatctgctgatgatgacctgcaagagtcatccagacgtccccagaggaaatctctgtatgagagctttgtgtcttctagtgatcgacttcgagaactaggaccagatggagaagaggcagagggcccaggggctggtgatggtccccctcgaagctttgactggggctatgaagaacgcagtggtgcccactcctcagcctcccctccccgaagccgcagccgggaccgcagccatgagaggaaccgggacagagaccgagatcgggagcgggatcgagaccgggatcgagacagagacagagagcgggacagggatcgggatcgggatcgagatcgagaccgggaacgggacagggatcgggagcgggatcgagaccgagaccgagagggtcctttccgcaggtcggattcattccctgaacggcgagcccctaggaaagggaatactctctatgtatatggagaagacatgacacccacccttctccgtggggccttctctccttttggaaacatcattgacctctccatggacccacccagaaactgtgccttcgtcacctatgaaaagatggagtcagcagatcaggccgttgctgagctcaacgggacccaggtggagtctgtacagctcaaagtcaacatagcccgaaaacagcccatgctggatgccgctactggcaagtctgtctggggctccctcgctgtccagaacagccctaagggttgccaccgggacaagaggacccagattgtctacagtgatgacgtctacaaggaaaaccttgtggatggcttctagggaacagagctggattccttgtgcctcatatgccccaatgctggtctcagtaaaacactgaggtggaagcttacacatctccctcagcctctggtttttcagcacttgggattggggttaaacctttaaaaacggctgtcaggtttgatctcagtgtaacaacatggccagtgcctgttccccactcccttgccccaaaaggatctggaacacaaaaaaaaaaaaaaaaaaaaaaaaaaaaaaaaaaaaagggggggggggcaaaagttttccccggggggcccaattttgcggtccccgttttttggaaagggggcgccaagaggagagcggaatataaaaggcaaggccggggcgcccgcgtataaccaagcgtctcgcgttggagaacccgccgctggggcctggcaaggacccttccttcggcgggtggcacttgggcccactcctaggatataggccaggaaactaacttcgggtagggaacccccattgctggtggagttggtccgttgttaatacgcgcgccgctgaacaacacaggaaatcgtgagccaagcagagcacgcaaataaccgaacagtagcacatcacacaagactcatcaacactcatcccc

SEQ ID NO: 314232 - DNA, 1732 bp, Homo sapiens
gccccgccgagagcgtgaactatcgctgcggaggggcagacctggaccggtggaaggccgggcggaagtgcgcgcctggggccgccttggttaccgcgttttccgctcctcgctacgtcatcgttgtgagcccgctatcagcggccagcgcgggcgcggccggagaccgtggggcccccggttgccgccccctcgggtaaggccctctgcttctcactcttcggccctttttctcatagccgtttctctgttcttcctctttgcgttgctctgcgggcgctacgctggctccaccgccttctctgccgttcaaaccccgcggttgtccttaccctagcgagggtaggggggtcgggtgccatcgtctttccgacggagtggatatttgtccctccttgaaccacatggtacctaaaggtgctggtgtctgtgatccctggagacaggagggaatgctggatgatcccgaccagcgggagcttggacagcagcctggtttaagcaaggggagccaccatgttggtgataccccccggactgagcgaggaagaggaggctctgcagaagaaattcaacaagctcaagaaaaagaaaaaggcattgctggctctgaagaagcaaagtagcagcagcacaaccagccaaggtggtgtcaaacgctcactatcagagcagcctgtcatggacacagccacagcaacagagcaggcaaagcagctggtgaagtcaggagccatcagtgccatcaaggctgagaccaagaactcaggcttcaagcgttctcgaacccttgaggggaagttaaaggaccccgagaagggaccagtccccactttccagccgttccagaggagcatatctgctgatgatgacctgcaagagtcatccagacgtccccagaggaaatctctgtatgagagctttgtgtcttctagtgatcgacttcgagaactaggaccagatggagaagaggcagagggcccaggggctggtgatggtccccctcgaagctttgactggggctatgaagaacgcagtggtgcccactcctcagcctcccctccccgaagccgcagccgggaccgcagccatgagaggaaccgggacagagaccgagatcgggagcgggatcgagaccgggatcgagacagagacagagagcgggacagggatcgggatcgggatcgagatcgagaccgggaacgggacagggatcgggagcgggatcgagaccgagaccgagagggtcctttccgcaggtcggattcattccctgaacggcgagcccctaggaaagggaatactctctatgtatatggagaagacatgacacccacccttctccgtggggccttctctccttttggaaacatcattgacctctccatggacccacccagaaactgtgccttcgtcacctatgaaaagatggagtcagcagatcaggccgttgctgagctcaacgggacccaggtggagtctgtacagctcaaagtcaacatagcccgaaaacagcccatgctggatgccgctactggcaagtctgtctggggctccctcgctgtccagaacagccctaagggttgccaccgggacaagaggacccagattgtctacagtgatgacgtctacaaggaaaaccttgtggatggcttctagggaacagagctggattccttgtgcctcatatgccccaatgctggtctcagtaaaacactgaggtggaagctta

SEQ ID NO: 314233 - DNA, 1754 bp, Homo sapiens
gccccgccgagagcgtgaactatcgctgcggaggggcagacctggaccggtggaaggccgggcggaagtgcgcgcctggggccgccttggttaccgcgttttccgctcctcgctacgtcatcgttgtgagcccgctatcagcggccagcgcgggcgcggccggagaccgtggggcccccggttgccgccccctcgggagccaccatgttggtgataccccccggactgagcgaggaagaggaggctctgcagaagaaattcaacaagctcaagaaaaagaaaaaggcattgctggctctgaagaagcaaagtagcagcagcacaaccagccaaggtggtgtcaaacgctcactatcagagcagcctgtcatggacacagccacagcaacagagcaggcaaagcagctggtgaagtcaggagccatcagtgccatcaaggctgagaccaagaactcaggcttcaagcgttctcgaacccttgaggggaagttaaaggaccccgagaagggaccagtccccactttccagccgttccagaggagcatatctgctgatgatgacctgcaagagtcatccagacgtccccagaggaaatctctgtatgagagctttgtgtcttctagtgatcgacttcgagaactaggaccagatggagaagaggcagagggcccaggggctggtgatggtccccctcgaagctttgactggggctatgaagaacgcagtggtgcccactcctcagcctcccctccccgaagccgcagccgggaccgcagccatgagaggaaccgggacagagaccgagatcgggagcgggatcgagaccgggatcgagacagagacagagagcgggacagggatcgggatcgggatcgagatcgagaccgggaacgggacagggatcgggagcgggatcgagaccgagaccgagagggtcctttccgcaggtcggattcattccctgaacggcgagcccctaggaaagggaatactctctatgtatatggagaagacatgacacccacccttctccgtggggccttctctccttttggaaacatcattgacctctccatggacccacccagaaactgtgccttcgtcacctatgaaaagatggagtcagcagatcaggccgttgctgaggttggaacttcccaaatctgttcttcccatcgcttctgctgttctcatgtgttctcctcaaaatactagatgccaggaagaagttggttcctcttgataaagaaagcctctcccatcgcttctgctgttctcatgtgttctcctcaaaatactagatgccaggaagaagttggttcctcttgataaagaaagcctctccctattcacacagaaaaactcacattctcagattccttattcagtctcctcctaggatagcaactcctggaataacttctttggtttatctgtaatgttttcctccccatcctctgcctcccctcttctgcttcagctcaacgggacccaggtggagtctgtacagctcaaagtcaacatagcccgaaaacagcccatgctggatgccgctactggcaagtctgtctggggctccctcgctgtccagaacagccctaagggttgccaccgggacaagaggacccagattgtctacagtgatgacgtctacaaggaaaaccttgtggatggcttctagggaacagagctggattccttgtgcctcatatgccccaatgctggtctcagtaaaacactgaggtggaagctta

SEQ ID NO: 314234 - DNA, 2028 bp, Homo sapiens
gccccgccgagagcgtgaactatcgctgcggaggggcagacctggaccggtggaaggccgggcggaagtgcgcgcctggggccgccttggttaccgcgttttccgctcctcgctacgtcatcgttgtgagcccgctatcagcggccagcgcgggcgcggccggagaccgtggggcccccggttgccgccccctcgggtaaggccctctgcttctcactcttcggccctttttctcatagccgtttctctgttcttcctctttgcgttgctctgcgggcgctacgctggctccaccgccttctctgccgttcaaaccccgcggttgtccttaccctagcgagggtaggggggtcgggtgccatcgtctttccgacggagtggatatttgtccctccttgaaccacatggtacctaaaggtgctggtgtctgtgatccctggagacaggagggaatgctggatgatcccgaccagcgggagcttggacagcagcctggtttaagcaaggggtagggaaagccaaagacaagagtaggcagacctgaaggggtggggttgggtacagtgtggacggcgtgtgaaccccgggtggtaacagtggagaaagatgtcttgggccctgcccctgaactaggagccaccatgttggtgataccccccggactgagcgaggaagaggaggctctgcagaagaaattcaacaagctcaagaaaaagaaaaaggcattgctggctctgaagaagcaaagtagcagcagcacaaccagccaaggtggtgtcaaacgctcactatcagagcagcctgtcatggacacagccacagcaacagagcaggcaaagcagctggtgaagtcaggagccatcagtgccatcaaggctgagaccaagaactcaggcttcaagcgttctcgaacccttgaggggaagttaaaggaccccgagaagggaccagtccccactttccagccgttccagaggagcatatctgctgatgatgacctgcaagagtcatccagacgtccccagaggaaatctctgtatgagaggttagagagtagagataaggctgggcccatttggtggagttgattgcctgagtccttgggaggtttgggctgtaggagctgggctatagagggaatattgagtctccacagggtctgaggggagaaggtaaaacccccctttgatcttcagtctgcatctccccagctttgctttgtgtcttctagtgatcgacttcgagaactaggaccagatggagaagaggcagagggcccaggggctggtgatggtccccctcgaagctttgactggggctatgaagaacgcagtggtgcccactcctcagcctcccctccccgaagccgcagccgggaccgcagccatgagaggaaccgggacagagaccgagatcgggagcgggatcgagaccgggatcgagacagagacagagagcgggacagggatcgggatcgggatcgagatcgagaccgggaacgggacagggatcgggagcgggatcgagaccgagaccgagagggtcctttccgcaggtcggattcattccctgaacggcgagcccctaggaaagggaatactctctatgtatatggagaagacatgacacccacccttctccgtggggccttctctccttttggaaacatcattgacctctccatggacccacccagaaactgtgccttcgtcacctatgaaaagatggagtcagcagatcaggccgttgctgagctcaacgggacccaggtggagtctgtacagctcaaagtcaacatagcccgaaaacagcccatgctggatgccgctactggcaagtctgtctggggctccctcgctgtccagaacagccctaagggttgccaccgggacaagaggacccagattgtctacagtgatgacgtctacaaggaaaaccttgtggatggcttctagggaacagagctggattccttgtgcctcatatgccccaatgctggtctcagtaaaacactgaggtggaagctta

SEQ ID NO: 314235 - DNA, 1164 bp, Homo sapiens
gccccgccgagagcgtgaactatcgctgcggaggggcagacctggaccggtggaaggccgggcggaagtgcgcgcctggggccgccttggttaccgcgttttccgctcctcgctacgtcatcgttgtgagcccgctatcagcggccagcgcgggcgcggccggagaccgtggggcccccggttgccgccccctcgggagccaccatgttggtgataccccccggactgagcgaggaagaggaggctctgcagaagaaattcaacaagctcaagaaaaagaaaaaggcattgctggctctgaagaagcaaagtagcagcagcacaaccagccaaggtggtgtcaaacgctcactatcagagcagcctgtcatggacacagccacagcaacagagcaggcaaagcagctggtgaagtcaggagccatcagtgccatcaaggctgagaccaagaactcaggcttcaagcgttctcgaacccttgaggggaagttaaaggaccccgagaagggaccagtccccactttccagccgttccagaggagcatatctgctgatgatgacctgcaagagtcatccagacgtccccagaggaaatctctgtatgagagctttgtgtcttctagtgatcgacttcgagaactaggaccagatggagaagaggcagagggcccaggggctggtgatggtccccctcgaagctttgactggggctatgaagaacgcagtggtgcccactcctcagcctcccctccccgaagccgcagccgggaccgcagccatgagaggaaccgggacagagaccgagatcgggagcgggatcgagaccgggatcgagacagtgagtgattttggctggaggtcaaggtgaccttaactgaggtttatgtgggtcctactaagtgaaatgtggcatgggctatgtcttgtgactatgatttgtgctcccaaggtcggattcattccctgaacggcgagcccctaggaaagggaatactctctatgtatatggagaagacatgacacccacccttctccgtggggccttctctccttttggaaacatcattgacctctccatggacccacccagaaagtaaggatgacaacagggcatgatgagaagtcctgggagaatcctggggtgtgagacctgagggaagaagc

SEQ ID NO: 314236 - DNA, 1056 bp, Homo sapiens
tgacatgcctgatcctctcttttctgcagttcaagggaaagacgagatcttgcacaaggcactctgcttctgcccttggctggggaagggtggcatggagcctctccggctgctcatcttactctttgtcacagagctgtccggagcccacaacaccacagtgttccagggcgtggcgggccagtccctgcaggtgtcttgcccctatgactccatgaagcactgggggaggcgcaaggcctggtgccgccagctgggagagaagggcccatgccagcgtgtggtcagcacgcacaacttgtggctgctgtccttcctgaggaggtggaatgggagcacagccatcacagacgataccctgggtggcactctcaccattacgctgcggaatctacaaccccatgatgcgggtctctaccagtgccagagcctccatggcagtgaggctgacaccctcaggaaggtcctggtggaggtgctggcagaccccctggatcaccgggatgctggagatctctggttccccggggagtctgagagcttcgaggatgcccatgtggagcacagcatctccaggagcctcttggaaggagaaatccccttcccacccacttccatccttctcctcctggcctgcatctttctcatcaagattctagcagccagcgccctctgggctgcagcctggcatggacagaagccagggacacatccacccagtgaactggactgtggccatgacccagggtatcagctccaaactctgccagggctgagagacacgtgaaggaagatgatgggaggaaaagcccaggagaagtcccaccagggaccagcccagcctgcatacttgccacttggccaccaggactccttgttctgctctggcaagagactactctgcctgaacactgcttctcctggaccctggaagcagggactggttgagggagtggggaggtggtaagaacacctgacaacttctgaatattggacattttaaacacttacaaataaatccaagactgtcatatttagctggatagttttgggcat

SEQ ID NO: 314237 - DNA, 539 bp, Homo sapiens
caagctttagagatttaccaatatggaggaaaggatattcgggcgcctagggcaaaaaagagcctcttggaaggagaaatccccttcccacccacttccatccttctcctcctggcctgcatctttctcatcaagattctagcagccagcgccctctgggctgcagcctggcatggacagaagccagggacacatccacccagtgaactggactgtggccatgacccagggtatcagctccaaactctgccagggctgagagacacgtgaaggaagatgatgggaggaaaagcccaggagaagtcccaccagggaccagcccagcctgcatacttgccacttggccaccaggactccttgttctgctctggcaagagactactctgcctgaacactgcttctcctggaccctggaagcagggactggttgagggagtggggaggtggtaagaacacctgacaacttctgaatattggacattttaaacacttacaaataaatccaagactgtcatatttagctggatagttttgggcat

SEQ ID NO: 314238 - DNA, 1104 bp, Homo sapiens
tgacatgcctgatcctctcttttctgcagttcaagggaaagacgagatcttgcacaaggcactctgcttctgcccttggctggggaagggtggcatggagcctctccggctgctcatcttactctttgtcacagagctgtccggagcccacaacaccacagtgttccagggcgtggcgggccagtccctgcaggtgtcttgcccctatgactccatgaagcactgggggaggcgcaaggcctggtgccgccagctgggagagaagggcccatgccagcgtgtggtcagcacgcacaacttgtggctgctgtccttcctgaggaggtggaatgggagcacagccatcacagacgataccctgggtggcactctcaccattacgctgcggaatctacaaccccatgatgcgggtctctaccagtgccagagcctccatggcagtgaggctgacaccctcaggaaggtcctggtggaggtgctggcagaccccctggatcaccgggatgctggagatctctggttccccggggagtctgagagcttcgaggatgcccatgtggagcacagcatctccaggccatctcaaggctcccatctgccttcttgtctctccaaggagcctctgagcctcttggaaggagaaatccccttcccacccacttccatccttctcctcctggcctgcatctttctcatcaagattctagcagccagcgccctctgggctgcagcctggcatggacagaagccagggacacatccacccagtgaactggactgtggccatgacccagggtatcagctccaaactctgccagggctgagagacacgtgaaggaagatgatgggaggaaaagcccaggagaagtcccaccagggaccagcccagcctgcatacttgccacttggccaccaggactccttgttctgctctggcaagagactactctgcctgaacactgcttctcctggaccctggaagcagggactggttgagggagtggggaggtggtaagaacacctgacaacttctgaatattggacattttaaacacttacaaataaatccaagactgtcatatttagctggatagttttgggcat

SEQ ID NO: 314239 - DNA, 862 bp, Homo sapiens
tgacatgcctgatcctctcttttctgcagttcaagggaaagacgagatcttgcacaaggcactctgcttctgcccttggctggggaagggtggcatggagcctctccggctgctcatcttactctttgtcacagagctgtccggagcccacaacaccacagtgttccagggcgtggcgggccagtccctgcaggtgtcttgcccctatgactccatgaagcactgggggaggcgcaaggcctggtgccgccagctgggagagaagggcccatgccagcgtgtggtcagcacgcacaacttgtggctgctgtccttcctgaggaggtggaatgggagcacagccatcacagacgataccctgggtggcactctcaccattacgctgcggaatctacaaccccatgatgcgggtctctaccagtgccagagcctccatggcagtgaggctgacaccctcaggaaggtcctggtggaggtgctggcagaccccctggatcaccgggatgctggagatctctggttccccggggagtctgagagcttcgaggatgcccatgtggagcacagcatctccagggctgagagacacgtgaaggaagatgatgggaggaaaagcccaggagaagtcccaccagggaccagcccagcctgcatacttgccacttggccaccaggactccttgttctgctctggcaagagactactctgcctgaacactgcttctcctggaccctggaagcagggactggttgagggagtggggaggtggtaagaacacctgacaacttctgaatattggacattttaaacacttacaaataaatccaagactgtcatatttagctggatagttttgggcat

SEQ ID NO: 314240 - DNA, 467 bp, Homo sapiens
tagcagccagcgccctctgggctgcagcctggcatggacagaagccagggacacatccacccagtgaactggactgtggccatgacccagggtatcagctccaaactctgccaggtgggcttggagagcacagccatcaagggtggactgggcagggatgggaggcggtgccgagaggggccacatgagtccttggactattgcagggctgagagacacgtgaaggaagatgatgggaggaaaagcccaggagaagtcccaccagggaccagcccagcctgcatacttgccacttggccaccaggactccttgttctgctctggcaagagactactctgcctgaacactgcttctcctggaccctggaagcagggactggttgagggagtggggaggtggtaagaacacctgacaacttctgaatattggacattttaaacacttacaaataaatccaagactgtca

SEQ ID NO: 314241 - DNA, 846 bp, Homo sapiens
gactgtccctctgagcagctactgttggacccttttacagatgtatcccccatatctcccgttccctccgccctatggaccccaggggccttaccgataccccactcctgatgggcccaggtgagcaatccaggtctgggtttgtggctgggggcaggggaagcttattgggggaggagatggttttctagccaggaggctcagtctaggatcagtctcgcatgtggttatacaacatgccatatttcattttcttttttgtgtacagccgttttccccgtgtggcgggcccccgaggctcagggccaccaatgcgcttagtagagcctgtgggtcgtccctctattctcaaagaggataatctcaaagagtttgatcagttggatcaggagaatgatgatggttgggcaggtaagtggatattaagggtcaagaatttggatcttgaaaggcaaaacctaatgaggaaaaaaaaatacagggttatgtgggtgaaaggcagacattgaagtgtaggaagaccaggcccaatggctcacatctgtaatcccagtgctttgggagtgttaggtgagaggatcgcttgaagccaggagttcaagaccagcctgggcaacacagcaagaccccccacctctacaaaaaaaaaaaaattttttagttgggtgtggactgtgcatctgtggtcccagctactctggaggttgtggtgggaggatcagttgagcccaggagttggaggtcacagtgagctatgatcgtgccactgaactccatcctgggcaacagagcgagacttttaaaaggaaaaaaaaaaaagagtaggggaggatggatggggaatac

SEQ ID NO: 314242 - DNA, 362 bp, Homo sapiens
gtggattcgaactcctgcaatcatctactctgttcacaccatgacaaccttaattccgatactctccacatttctgtttgaggatttctccaaagccagtggtttcaagggacaaagacctgagacttcgttgcttcaggtacgccaggatctgccatccccttcggatttttattctactcctctgcagcctggtggccaaagtggctttctcccttcaggggctcctgcccagcagatgcttctacccatggtagactcacagctgcctgtggtgaactttggctccctgccgccagcaccacctcctgacgtagacacacgagcatatttcacctccgctaccataatcatcgctagca

SEQ ID NO: 314243 - DNA, 399 bp, Homo sapiens
ggagctagagatgagacgtgagattcctggggtgttcatggagtgtctattgttggactagatcactctgttgtgttttttccgatgcagtggaaccacaactgccctcaaaagagggtcctgaaccaccagaagaggttcctcctcctaccacacccccagttccaaaggtggaacccaagggtgatgggattggtcccacccgccagccccctagtcagggcttgggctaccccaaatatcagaagtcgttgcctcctcgtttccagcggcagcagcaggtgaaatcaagttgtttaccctctaagggctgcttttcttcctggcttcggtccctaattctcttcataagttaccttctgggtccctttgcttctttgtccagttgtctccattgtc

SEQ ID NO: 314244 - DNA, 938 bp, Homo sapiens
gggctcagccgcggagtgagcgagggagacgggaggagccgaacccggcgccatccgccgccatcctcccccgccccaccgccatcccgtcccggggagcccctaggcccgggtcccggatccccgcgcacccggccaggggacagagactgagacacttgctgtctggcccacaggctctggcacgttttgggggaggtgcctgcaggacccaacatactcaatgagcttccagcgcaatgtccgatcgctcggggccgactgccaagggaaaggatggaaagaagtattcctcgctcaacctgtttgatacgtataagggcaagtccttagagatccagaaacccgctgttgcccctcgccatggcctgcagagtctcgggaaagttgccattgcccggcgtatgccacctccaagcagctgttacatttggaaaacatagtaactttattaacatcaaagaaaagctcttgaattcagtgccacgtgtttaagacgaattgaacgagacacacatcgtagggggcgcggtctgctggaagtagaggatttcctccctcacagggggcccccactcatgtgtatgatttggcccaacgccctttgttttggataccaacgagggggtgccgccccataagcgtgggtcggtctacttgtcagaacactgttggccgtcccgcacacgtttctaaaacagcagccttcagtgctgtcggatacaacaacgcgtcttaggaccaaccctggggagacggacaccacattcattcgggggggcgagcaacatacgtcgggcgaaaacctcccccagagggattgttaacgcccccagggggaacaaccagccgacacgtgttttagcgggtgtacaccgcgcctcacattgtggcggctcagcaaggttcgccaccagcaatatttggagagatttacg

SEQ ID NO: 314245 - DNA, 6912 bp, Homo sapiens
cgagccggcccggttcgagctgcaggtactcaggtgcgagctgctaactcaggggcgagctgctaactcaggggcgagctgctaactcaggcgcgagctgccaagggaaaggatggaaagaagtattcctcgctcaacctgtttgatacgtataagggcaagtccttagagatccagaaacccgctgttgcccctcgccatggcctgcagagtctcgggaaagttgccattgcccggcgtatgccacctccagccaaccttccaagcctgaaagccgagaacaaaggcaatgaccccaatgtctcactagtgccaaaagacggaacaggatgggcaagcaaacaggagcagtccgaccccaagagttccgatgcctcaaccgctcagccgccggaatcgcagccactgccggcttcacagacgcctgcctccaaccagccgaaacgacccccagcagcccccgagaacactcctttggttccaagcggggtaaagtcctgggcacaagccagcgtcacccatggagcacatggagatggtggaagggcatcaagcctactgtcacgattctctcgagaggaatttccgaccctgcaggcggctggcgaccaggacaaggctgccaaggaaagggagtctgccgaacagtcgtctgggcccggaccaagcctccgcccccaaaattctacaacttggagggacggaggtgggcgtggccctgatgagctggagggcccggactccaaacttcatcatggtcatgatccccggggtgggctacagccttcaggcccaccccagttccctccctaccgcggaatgatgccgcctttcatgtatcccccatatctcccgttccctccgccctatggaccccaggggccttaccgataccccactcctgatgggcccaggtgagcaatccaggtctgggtttgtggctgggggcaggggaagcttattgggggaggagatggttttctagccaggaggctcagtctaggatcagtctcgcatgtggttatacaacatgccatatttcattttcttttttgtgtacagccgttttccccgtgtggcgggcccccgaggctcagggccaccaatgcgcttagtagagcctgtgggtcgtccctctattctcaaagaggataatctcaaagagtttgatcagttggatcaggagaatgatgatggttgggcaggggcccatgaagaggttgactacactgaaaagctcaagttcagcgatgaggaagatgggcgagactctgatgaggagggagctgagggccacagggattcccaatcagcttctggtgaggaacggccccctgaagcagatggcaaaaagggcaactcccccaacagcgaaccgcccactcctaagacggcctgggcagaaacctctcggcctccagagacagagccgggacctcctgccccaaagcctcccctacccccacctcaccggggccccgccgggaactggggcccccctggggactacccagatcgtgggggtcctccctgcaagcccccagcacctgaagatgaggatgaggcatggcggcagcgacgaaagcagtcgtcatctgagatttccctggcagtggagcgggcccggcgacggcgagaagaagaggagcggcgcatgcaagaagagcgccgggcagcctgtgctgagaagctcaagcgactcgatgaaaagtttggggcacctgacaagcggctcaaagcagagcctgctgccccacctgctgccccttctaccccagctccaccacctgcagtccctaaagaactccctgcacctccagctccacctccagcatcagccccaacaccagagaaagaacctgaagagccagcacaggcccctcctgcccaatctactcctactccaggtgtggctgcggctcccactctgtggaaccacaactgccctcaaaagagggtcctgaaccaccagaagaggttcctcctcctaccacacccccagttccaaaggtggaacccaagggtgatgggattggtcccacccgccagccccctagtcagggcttgggctaccccaaatatcagaagtcgttgcctcctcgtttccagcggcagcagcaggagcagctcctgaagcagcagcagcagcaccagtggcagcagcatcaacagggctctgcccctcctaccccagtgcccccatcaccaccacagcctgtgaccctgggggctgtgccagctccacaggctccacccccgccccccaaggccctgtacccaggtgctctgggccggcccccacccatgcccccaatgaactttgatccccgatggatgatgattcctccttatgtggacccccggctcctccagggtcgtccccctctagacttctaccctcctggtgtgcatccctctggcctagttccccgagagcgttcagacagtgggggctcaagctcagagccatttgaccgtcatgcacctgctatgttacgggaacggggcactccaccggtggatccaaagttggcctgggtaggagatgtcttcaccgccacacccgctgaaccccgcccacttacctcacctctgcgccaggctgcggatgaggatgacaaggggatgaggagcgagactcctccagtacctcccccaccaccctatctggccagttatccaggctttcctgagaatggagcccctgggcccccaatctctcgctttcctctggaggaaccagggccccgtccactcccctggcccccaggcagtgatgaagtggccaagatacaaactccaccacccaagaaggagccccctaaggaggagactgcacagctgacggggccagaagcaggccgaaagcctgcccgcggagtcgggagtggaggccagggccccccaccaccacgcagagagagtcgcacagagacccgctggggccctcgtccagggagcagtcgtcgtggaatccctccagaggagccaggggccccaccccgccgggctgggcctataaagaaacctccaccacctacaaaagtagaagagctgcctcccaagcccctcgaacagggggatgaaacccccaaacccccaaagccagacccactcaagataaccaaggggaagctagggggccccaaggagaccccacccaatggaaatctttcccctgccccaaggcttcggagggactattcgtatgaaagagtgggtcctacctcttgccggggtcggggccgaggcgagtattttgccagagggaggggttttcgggggacctatgggggacgagggcggggagcccgaagccgggaattccgcagttaccgagagtttcgaggagatgatgggcgtggaggtgggacagggggaccaaaccaccctcctgctccccgaggccgcactgccagcgagacacggagcgagggttcagagtatgaggaaatccccaagcggcgccggcagcggggctcagaaacaggcagcgagacccatgagagtgatctggctccttcagacaaggaggctcccacacccaaggagggaacactcacccaggtccctctcgctcccccaccaccaggagccccaccttcaccagccccagcccgcttcactgcccggggtgggcgagtcttcactcccagaggggtgccatctcgccggggccgaggaggagggaggccccctcctcaagtttgcccaggctggagccctccagccaagtctctggctcccaagaaacctcccacaggccctttgccaccaagtaaggagcctttgaaagagaagttgatcccagggcctctgtcccctgtggcgcgcggaggcagcaatggaggtagcaatgtgggcatggaagatggggagcgaccccgaaggaggcgacatgggagggctcagcagcaggataaaccgcctcgtttccggaggctgaagcaggaacgggagaatgccgcaagggggtctgagggcaagccctccctaacccttccagcctccgctcctggacctgaggaggccctcacaacagtcacagtggccccagcacctcgccgggcagctgccaagtctcctgatctgtcaaaccagaactcagaccaagccaatgaggaatgggagactgcatcagagagcagtgacttcaccagtgagcgccgaggggacaaagaggcacccccaccagtactgctgacacccaaggctgtgggaactcctgggggaggtggaggtggagccgtaccaggtatttcagccatgtcccgcggagatctgagccagagagccaaggatttgagtaaacggagcttctcaagtcagcggccaggcatggaacggcagaatcggcgccctggcccagggggcaaggctggcagcagtggcagcagcagtggaggaggcggtgggggtcctggaggaaggaccgggccaggacgaggcgacaagaggagctggccctctcccaagaaccgaagtcgtcctccagaggagcgtcccccggggcttcccctgcctcccccacctcccagcagttctgctgtcttccgcctggaccaagttatccacagcaaccctgctggcatccaacaggctctggcccagcttagtagccgtcaagggagtgtaactgcaccagggggtcatccaaggcacaagcctgggcctccccaagcccctcagggcccctctcctaggcccccaacccgatacgagccccagagggtcaacagcggcctcagttctgacccccactttgaggagccggggccaatggtgagaggggtgggtgggactcctcgggactctgccggggttagtccctttccccctaaacgtcgggagcggcctcccagaaaaccagagctgctacaggaggaatctttgccacctcctcatagctctggattcttgggctctaagcctgagggcccaggccctcaggcagagtccagagatacaggcacagaggccctgacccctcacatctggaaccgtttacatactgccactagccgaaagagttaccggcccagctccatggagccttggatggagcccctgagtccttttgaggatgtggctggcacagaaatgagtcagtctgacagtggggtggacctgagtggggattctcaggtgtcatcaggtccctgcagccagcgaagttcccctgatggaggactcaagggggcagcagagggaccccccaagaggcctggaggctcctcacccctgaatgctgttccttgtgagggtccacctggctctgaacctcctaggagaccaccacctgccccccacgatggggacagaaaggagctgccccgggagcagcctctgccccctggccccattggcacagaacgatcacagcgtacagaccgaggcacagagcctggccccattcggccatcccatcgacctggtcccccagtccagtttggcactagtgacaaggactcagacttacgcctagtggtaggagacagcttgaaagcagagaaggagctaacagcatcagtcactgaggccattcctgtatcacgagactgggagctgcttcccagtgctgctgcctctgctgagccacaatccaagaacctggattctgggcactgtgtcccggagcccagctcctcaggccagcgcctgtatcctgaggttttctatggcagtgctgggccttccagttctcagatctctgggggagccatggactctcaattacatccaaacagtggaggcttccgccctgggacaccctcactgcacccttacagatcacagcccctatacctaccccccggcccagcccctccctcagcactgctctctggggtagctctcaagggccagtttctggatttctccacaatgcaagctacagagctggggaagttgccggctggaggagttctctaccctccaccttccttcctctactctccggctttctgccccagtcctttgcctgacacatcgttgcttcaggtacgccaggatctgccatccccttcggatttttattctactcctctgcagcctggtggccaaagtggctttctcccttcaggggctcctgcccagcagatgcttctacccatggtagactcacagctgcctgtggtgaactttggctccctgccgccagcaccacctcctgccccacctcccctttctctgttacctgtgggccctgctctgcagccccccagcctggctgtgcggcccccacctgctcctgctactcgggtgctgccttcacctgccaggcccttccccgctagcttggggcgagcagagctgcatccagtggaactaaagccgttccaggattatcaaaaactgagcagcaaccttgggggacctggatcatcacggactcccccaactggaaggtccttctctggcctcaattcccgtctcaaggccacgccttccacctacagtggagtcttccgcacccagcgcgtcgacctttaccagcaggcctccccaccagatgccctgcgctggatacctaagccttgggagcggacagggccgccacctcgagaagggccctcccgacgggcagaggagcctgggtcccgaggggacaaggagcctgggttgcccccaccccgctgagggagttcctcttgccccctacccccggggcttgtatatagattataaatatataagggggaaaggggtgggcggggaggggttgtggggctggggcctcacttcccctcctcccccttcccctggtcccctgtccctggggctgtttgttaaaaaagagtaataaaaggatttaaaaaaaaaaacaaacacaacaaaaaaccaaaagccaaacacaaaccacaaaaataaaaaaaccatcaatcccacaaaaaaaacaaacacaaccaatag

SEQ ID NO: 314246 - DNA, 7165 bp, Homo sapiens
cgagccggcccggttcgagctgcaggtactcaggtgcgagctgctaactcaggggcgagctgctaactcaggggcgagctgctaactcaggcgcgagctgccaagggaaaggatggaaagaagtattcctcgctcaacctgtttgatacgtataagggcaagtccttagagatccagaaacccgctgttgcccctcgccatggcctgcagagtctcgggaaagttgccattgcccggcgtatgccacctccagccaaccttccaagcctgaaagccgagaacaaaggcaatgaccccaatgtctcactagtgccaaaagacggaacaggatgggcaagcaaacaggagcagtccgaccccaagagttccgatgcctcaaccgctcagccgccggaatcgcagccactgccggcttcacagacgcctgcctccaaccagccgaaacgacccccagcagcccccgagaacactcctttggttccaagcggggtaaagtcctgggcacaagccagcgtcacccatggagcacatggagatggtggaagggcatcaagcctactgtcacgattctctcgagaggaatttccgaccctgcaggcggctggcgaccaggacaaggctgccaaggaaagggagtctgccgaacagtcgtctgggcccggaccaagcctccgcccccaaaattctacaacttggagggacggaggtgggcgtggccctgatgagctggagggcccggactccaaacttcatcatggtcatgatccccggggtgggctacagccttcaggcccaccccagttccctccctaccgcggaatgatgccgcctttcatgtatcccccatatctcccgttccctccgccctatggaccccaggggccttaccgataccccactcctgatgggcccaggtgagcaatccaggtctgggtttgtggctgggggcaggggaagcttattgggggaggagatggttttctagccaggaggctcagtctaggatcagtctcgcatgtggttatacaacatgccatatttcattttcttttttgtgtacagccgttttccccgtgtggcgggcccccgaggctcagggccaccaatgcgcttagtagagcctgtgggtcgtccctctattctcaaagaggataatctcaaagagtttgatcagttggatcaggagaatgatgatggttgggcaggggcccatgaagaggttgactacactgaaaagctcaagttcagcgatgaggaagatgggcgagactctgatgaggagggagctgagggccacagggattcccaatcagcttctggtgaggaacggccccctgaagcagatggcaaaaagggcaactcccccaacagcgaaccgcccactcctaagacggcctgggcagaaacctctcggcctccagagacagagccgggacctcctgccccaaagcctcccctacccccacctcaccggggccccgccgggaactggggcccccctggggactacccagatcgtgggggtcctccctgcaagcccccagcacctgaagatgaggatgaggcatggcggcagcgacgaaagcagtcgtcatctgagatttccctggcagtggagcgggcccggcgacggcgagaagaagaggagcggcgcatgcaagaagagcgccgggcagcctgtgctgagaagctcaagcgactcgatgaaaagtttggggcacctgacaagcggctcaaagcagagcctgctgccccacctgctgccccttctaccccagctccaccacctgcagtccctaaagaactccctgcacctccagctccacctccagcatcagccccaacaccagagaaagaacctgaagagccagcacaggcccctcctgcccaatctactcctactccaggtgtggctgcggctcccactctggtgagtggtggtggcagtaccagtagcaccagcagtggcagcttcgaagccagcccagtggaaccacaactgccctcaaaagagggtcctgaaccaccagaagaggttcctcctcctaccacacccccagttccaaaggtggaacccaagggtgatgggattggtcccacccgccagccccctagtcagggcttgggctaccccaaatatcagaagtcgttgcctcctcgtttccagcggcagcagcaggagcagctcctgaagcagcagcagcagcaccagtggcagcagcatcaacagggctctgcccctcctaccccagtgcccccatcaccaccacagcctgtgaccctgggggctgtgccagctccacaggctccacccccgccccccaaggccctgtacccaggtgctctgggccggcccccacccatgcccccaatgaactttgatccccgatggatgatgattcctccttatgtggacccccggctcctccagggtcgtccccctctagacttctaccctcctggtgtgcatccctctggcctagttccccgagagcgttcagacagtgggggctcaagctcagagccatttgaccgtcatgcacctgctatgttacgggaacggggcactccaccggtggatccaaagttggcctgggtaggagatgtcttcaccgccacacccgctgaaccccgcccacttacctcacctctgcgccaggctgcggatgaggatgacaaggggatgaggagcgagactcctccagtacctcccccaccaccctatctggccagttatccaggctttcctgagaatggagcccctgggcccccaatctctcgctttcctctggaggaaccagggccccgtccactcccctggcccccaggcagtgatgaagtggccaagatacaaactccaccacccaagaaggagccccctaaggaggagactgcacagctgacggggccagaagcaggccgaaagcctgcccgcggagtcgggagtggaggccagggccccccaccaccacgcagagagagtcgcacagagacccgctggggccctcgtccagggagcagtcgtcgtggaatccctccagaggagccaggggccccaccccgccgggctgggcctataaagaaacctccaccacctacaaaagtagaagagctgcctcccaagcccctcgaacagggggatgaaacccccaaacccccaaagccagacccactcaagataaccaaggggaagctagggggccccaaggagaccccacccaatggaaatctttcccctgccccaaggcttcggagggactattcgtatgaaagagtgggtcctacctcttgccggggtcggggccgaggcgagtattttgccagagggaggggttttcgggggacctatgggggacgagggcggggagcccgaagccgggaattccgcagttaccgagagtttcgaggagatgatgggcgtggaggtgggacagggggaccaaaccaccctcctgctccccgaggccgcactgccagcgagacacggagcgagggttcagagtatgaggaaatccccaagcggcgccggcagcggggctcagaaacaggcagcgagacccatgagagtgatctggctccttcagacaaggaggctcccacacccaaggagggaacactcacccaggtccctctcgctcccccaccaccaggagccccaccttcaccagccccagcccgcttcactgcccggggtgggcgagtcttcactcccagaggggtgccatctcgccggggccgaggaggagggaggccccctcctcaagtttgcccaggctggagccctccagccaagtctctggctcccaagaaacctcccacaggccctttgccaccaagtaaggagcctttgaaagagaagttgatcccagggcctctgtcccctgtggcgcgcggaggcagcaatggaggtagcaatgtgggcatggaagatggggagcgaccccgaaggaggcgacatgggagggctcagcagcaggataaaccgcctcgtttccggaggctgaagcaggaacgggagaatgccgcaagggggtctgagggcaagccctccctaacccttccagcctccgctcctggacctgaggaggccctcacaacagtcacagtggccccagcacctcgccgggcagctgccaagtctcctgatctgtcaaaccagaactcagaccaagccaatgaggaatgggagactgcatcagagagcagtgacttcaccagtgagcgccgaggggacaaagaggcacccccaccagtactgctgacacccaaggctgtgggaactcctgggggaggtggaggtggagccgtaccaggtatttcagccatgtcccgcggagatctgagccagagagccaaggatttgagtaaacggagcttctcaagtcagcggccaggcatggaacggcagaatcggcgccctggcccagggggcaaggctggcagcagtggcagcagcagtggaggaggcggtgggggtcctggaggaaggaccgggccaggacgaggcgacaagaggagctggccctctcccaagaaccgaagtcgtcctccagaggagcgtcccccggggcttcccctgcctcccccacctcccagcagttctgctgtcttccgcctggaccaagttatccacagcaaccctgctggcatccaacaggctctggcccagcttagtagccgtcaagggagtgtaactgcaccagggggtcatccaaggcacaagcctgggcctccccaagcccctcagggcccctctcctaggcccccaacccgatacgagccccagagggtcaacagcggcctcagttctgacccccactttgaggagccggggccaatggtgagaggggtgggtgggactcctcgggactctgccggggttagtccctttccccctaaacgtcgggagcggcctcccagaaaaccagagctgctacaggaggaatctttgccacctcctcatagctctggattcttgggctctaagcctgagggcccaggccctcaggcagagtccagagatacaggcacagaggccctgacccctcacatctggaaccgtttacatactgccactagccgaaagagttaccggcccagctccatggagccttggatggagcccctgagtccttttgaggatgtggctggcacagaagtgagtgagggtgggagggtgtgtctgagctgggacttttttgagcactggtcataccccccacctgctctgggttgagtctggagctgttctctcacttggctgtcccctttctgcagtttgtatgtgtgcatcagtcaggtattggggtgctttctaccctgacttaactagctccttctccactcctctcagatgagtcagtctgacagtggggtggacctgagtggggattctcaggtgtcatcaggtccctgcagccagcgaagttcccctgatggaggactcaagggggcagcagagggaccccccaagaggcctggaggctcctcacccctgaatgctgttccttgtgagggtccacctggctctgaacctcctaggagaccaccacctgccccccacgatggggacagaaaggagctgccccgggagcagcctctgccccctggccccattggcacagaacgatcacagcgtacagaccgaggcacagagcctggccccattcggccatcccatcgacctggtcccccagtccagtttggcactagtgacaaggactcagacttacgcctagtggtaggagacagcttgaaagcagagaaggagctaacagcatcagtcactgaggccattcctgtatcacgagactgggagctgcttcccagtgctgctgcctctgctgagccacaatccaagaacctggattctgggcactgtgtcccggagcccagctcctcaggccagcgcctgtatcctgaggttttctatggcagtgctgggccttccagttctcagatctctgggggagccatggactctcaattacatccaaacagtggaggcttccgccctgggacaccctcactgcacccttacagatcacagcccctatacctaccccccggcccagcccctccctcagcactgctctctggggtagctctcaagggccagtttctggatttctccacaatgcaagctacagagctggggaagttgccggctggaggagttctctaccctccaccttccttcctctactctccggctttctgccccagtcctttgcctgacacatcgttgcttcaggtacgccaggatctgccatccccttcggatttttattctactcctctgcagcctggtggccaaagtggctttctcccttcaggggctcctgcccagcagatgcttctacccatggtagactcacagctgcctgtggtgaactttggctccctgccgccagcaccacctcctgccccacctcccctttctctgttacctgtgggccctgctctgcagccccccagcctggctgtgcggcccccacctgctcctgctactcgggtgctgccttcacctgccaggcccttccccgctagcttggggcgagcagagctgcatccagtggaactaaagccgttccaggattatcaaaaactgagcagcaaccttgggggacctggatcatcacggactcccccaactggaaggtccttctctggcctcaattcccgtctcaaggccacgccttccacctacagtggagtcttccgcacccagcgcgtcgacctttaccagcaggcctccccaccagatgccctgcgctggatacctaagccttgggagcggacagggccgccacctcgagaagggccctcccgacgggcagaggagcctgggtcccgaggggacaaggagcctgggttgcccccaccccgctgagggagttcctcttgccccctacccccggggcttgtatatagattataaatatataagggggaaaggggtgggcggggaggggttgtggggctggggcctcacttcccctcctcccccttcccctggtcccctgtccctggggctgtttgttaaaaaagagtaataaaaggatttaaaaaaaaaaacaaacacaacaaaaaaccaaaagccaaacacaaaccacaaaaataaaaaaaccatcaatcccacaaaaaaaacaaacacaaccaatag

SEQ ID NO: 314247 - DNA, 6925 bp, Homo sapiens
cgagccggcccggttcgagctgcaggtactcaggtgcgagctgctaactcaggggcgagctgctaactcaggggcgagctgctaactcaggcgcgagctgccaagggaaaggatggaaagaagtattcctcgctcaacctgtttgatacgtataagggcaagtccttagagatccagaaacccgctgttgcccctcgccatggcctgcagagtctcgggaaagttgccattgcccggcgtatgccacctccagccaaccttccaagcctgaaagccgagaacaaaggcaatgaccccaatgtctcactagtgccaaaagacggaacaggatgggcaagcaaacaggagcagtccgaccccaagagttccgatgcctcaaccgctcagccgccggaatcgcagccactgccggcttcacagacgcctgcctccaaccagccgaaacgacccccagcagcccccgagaacactcctttggttccaagcggggtaaagtcctgggcacaagccagcgtcacccatggagcacatggagatggtggaagggcatcaagcctactgtcacgattctctcgagaggaatttccgaccctgcaggcggctggcgaccaggacaaggctgccaaggaaagggagtctgccgaacagtcgtctgggcccggaccaagcctccgcccccaaaattctacaacttggagggacggaggtgggcgtggccctgatgagctggagggcccggactccaaacttcatcatggtcatgatccccggggtgggctacagccttcaggcccaccccagttccctccctaccgcggaatgatgccgcctttcatgtatcccccatatctcccgttccctccgccctatggaccccaggggccttaccgataccccactcctgatgggcccaggtgagcaatccaggtctgggtttgtggctgggggcaggggaagcttattgggggaggagatggttttctagccaggaggctcagtctaggatcagtctcgcatgtggttatacaacatgccatatttcattttcttttttgtgtacagccgttttccccgtgtggcgggcccccgaggctcagggccaccaatgcgcttagtagagcctgtgggtcgtccctctattctcaaagaggataatctcaaagagtttgatcagttggatcaggagaatgatgatggttgggcaggggcccatgaagaggttgactacactgaaaagctcaagttcagcgatgaggaagatgggcgagactctgatgaggagggagctgagggccacagggattcccaatcagcttctggtgaggaacggccccctgaagcagatggcaaaaagggcaactcccccaacagcgaaccgcccactcctaagacggcctgggcagaaacctctcggcctccagagacagagccgggacctcctgccccaaagcctcccctacccccacctcaccggggccccgccgggaactggggcccccctggggactacccagatcgtgggggtcctccctgcaagcccccagcacctgaagatgaggatgaggcatggcggcagcgacgaaagcagtcgtcatctgagatttccctggcagtggagcgggcccggcgacggcgagaagaagaggagcggcgcatgcaagaagagcgccgggcagcctgtgctgagaagctcaagcgactcgatgaaaagtttggggcacctgacaagcggctcaaagcagagcctgctgccccacctgctgccccttctaccccagctccaccacctgcagtccctaaagaactccctgcacctccagctccacctccagcatcagccccaacaccagagaaagaacctgaagagccagcacaggcccctcctgcccaatctactcctactccaggtgtggctgcggctcccactctggtgagtggtggtggcagtaccagtagcaccagcagtggcagcttcgaagccagcccagtggaaccacaactgccctcaaaagagggtcctgaaccaccagaagaggttcctcctcctaccacacccccagttccaaaggtggaacccaagggtgatgggattggtcccacccgccagccccctagtcagggcttgggctaccccaaatatcagaagtcgttgcctcctcgtttccagcggcagcagcaggagcagctcctgaagcagcagcagcagcaccagtggcagcagcatcaacagggctctgcccctcctaccccagtgcccccatcaccaccacagcctgtgaccctgggggctgtgccagctccacaggctccacccccgccccccaaggccctgtacccaggtgctctgggccggcccccacccatgcccccaatgaactttgatccccgatggatgatgattcctccttatgtggacccccggctcctccagggtcgtccccctctagacttctaccctcctggtgtgcatccctctggcctagttccccgagagcgttcagacagtgggggctcaagctcagagccatttgaccgtcatgcacctgctatgttacgggaacggggcactccaccggtggatccaaagttggcctgggtaggagatgtcttcaccgccacacccgctgaaccccgcccacttacctcacctctgcgccaggctgcggatgaggatgacaaggggatgaggagcgagactcctccagtacctcccccaccaccctatctggccagttatccaggctttcctgagaatggagcccctgggcccccaatctctcgctttcctctggaggaaccagggccccgtccactcccctggcccccaggcagtgatgaagtggccaagatacaaactccaccacccaagaaggagccccctaaggaggagactgcacagctgacggggccagaagcaggccgaaagcctgcccgcggagtcgggagtggaggccagggccccccaccaccacgcagagagagtcgcacagagacccgctggggccctcgtccagggagcagtcgtcgtggaatccctccagaggagccaggggccccaccccgccgggctgggcctataaagaaacctccaccacctacaaaagtagaagagctgcctcccaagcccctcgaacagggggatgaaacccccaaacccccaaagccagacccactcaagataaccaaggggaagctagggggccccaaggagaccccacccaatggaaatctttcccctgccccaaggcttcggagggactattcgtatgaaagagtgggtcctacctcttgccggggtcggggccgaggcgagtattttgccagagggaggggttttcgggggacctatgggggacgagggcggggagcccgaagccgggaattccgcagttaccgagagtttcgaggagatgatgggcgtggaggtgggacagggggaccaaaccaccctcctgctccccgaggccgcactgccagcgagacacggagcgagggttcagagtatgaggaaatccccaagcggcgccggcagcggggctcagaaacaggcagcgagacccatgagagtgatctggctccttcagacaaggaggctcccacacccaaggagggaacactcacccaggtccctctcgctcccccaccaccaggagccccaccttcaccagccccagcccgcttcactgcccggggtgggcgagtcttcactcccagaggggtgccatctcgccggggccgaggaggagggaggccccctcctcaagtttgcccaggctggagccctccagccaagtctctggctcccaagaaacctcccacaggccctttgccaccaagtaaggagcctttgaaagagaagttgatcccagggcctctgtcccctgtggcgcgcggaggcagcaatggaggtagcaatgtgggcatggaagatggggagcgaccccgaaggaggcgacatgggagggctcagcagcaggataaaccgcctcgtttccggaggctgaagcaggaacgggagaatgccgcaagggggtctgagggcaagccctccctaacccttccagcctccgctcctggacctgaggaggccctcacaacagtcacagtggccccagcacctcgccgggcagctgccaagtctcctgatctgtcaaaccagaactcagaccaagccaatgaggaatgggagactgcatcagagagcagtgacttcaccagtgagcgccgaggggacaaagaggcacccccaccagtactgctgacacccaaggctgtgggaactcctgggggaggtggaggtggagccgtaccaggtatttcagccatgtcccgcggagatctgagccagagagccaaggatttgagtaaacggagcttctcaagtcagcggccaggcatggaacggcagaatcggcgccctggcccagggggcaaggctggcagcagtggcagcagcagtggaggaggcggtgggggtcctggaggaaggaccgggccaggacgaggcgacaagaggagctggccctctcccaagaaccgaagtcgtcctccagaggagcgtcccccggggcttcccctgcctcccccacctcccagcagttctgctgtcttccgcctggaccaagttatccacagcaaccctgctggcatccaacaggctctggcccagcttagtagccgtcaagggagtgtaactgcaccagggggtcatccaaggcacaagcctgggcctccccaagcccctcagggcccctctcctaggcccccaacccgatacgagccccagagggtcaacagcggcctcagttctgacccccactttgaggagccggggccaatggtgagaggggtgggtgggactcctcgggactctgccggggttagtccctttccccctaaacgtcgggagcggcctcccagaaaaccagagctgctacaggaggaatctttgccacctcctcatagctctggattcttgggctctaagcctgagggcccaggccctcaggcagagtccagagatacaggcacagaggccctgacccctcacatctggaaccgtttacatactgccactagccgaaagagttaccggcccagctccatggagccttggatggagcccctgagtccttttgaggatgtggctggcacagaagtgtcatcaggtccctgcagccagcgaagttcccctgatggaggactcaagggggcagcagagggaccccccaagaggcctggaggctcctcacccctgaatgctgttccttgtgagggtccacctggctctgaacctcctaggagaccaccacctgccccccacgatggggacagaaaggagctgccccgggagcagcctctgccccctggccccattggcacagaacgatcacagcgtacagaccgaggcacagagcctggccccattcggccatcccatcgacctggtcccccagtccagtttggcactagtgacaaggactcagacttacgcctagtggtaggagacagcttgaaagcagagaaggagctaacagcatcagtcactgaggccattcctgtatcacgagactgggagctgcttcccagtgctgctgcctctgctgagccacaatccaagaacctggattctgggcactgtgtcccggagcccagctcctcaggccagcgcctgtatcctgaggttttctatggcagtgctgggccttccagttctcagatctctgggggagccatggactctcaattacatccaaacagtggaggcttccgccctgggacaccctcactgcacccttacagatcacagcccctatacctaccccccggcccagcccctccctcagcactgctctctggggtagctctcaagggccagtttctggatttctccacaatgcaagctacagagctggggaagttgccggctggaggagttctctaccctccaccttccttcctctactctccggctttctgccccagtcctttgcctgacacatcgttgcttcaggtacgccaggatctgccatccccttcggatttttattctactcctctgcagcctggtggccaaagtggctttctcccttcaggggctcctgcccagcagatgcttctacccatggtagactcacagctgcctgtggtgaactttggctccctgccgccagcaccacctcctgccccacctcccctttctctgttacctgtgggccctgctctgcagccccccagcctggctgtgcggcccccacctgctcctgctactcgggtgctgccttcacctgccaggcccttccccgctagcttggggcgagcagagctgcatccagtggaactaaagccgttccaggattatcaaaaactgagcagcaaccttgggggacctggatcatcacggactcccccaactggaaggtccttctctggcctcaattcccgtctcaaggccacgccttccacctacagtggagtcttccgcacccagcgcgtcgacctttaccagcaggcctccccaccagatgccctgcgctggatacctaagccttgggagcggacagggccgccacctcgagaagggccctcccgacgggcagaggagcctgggtcccgaggggacaaggagcctgggttgcccccaccccgctgagggagttcctcttgccccctacccccggggcttgtatatagattataaatatataagggggaaaggggtgggcggggaggggttgtggggctggggcctcacttcccctcctcccccttcccctggtcccctgtccctggggctgtttgttaaaaaagagtaataaaaggatttaaaaaaaaaaacaaacacaacaaaaaaccaaaagccaaacacaaaccacaaaaataaaaaaaccatcaatcccacaaaaaaaacaaacacaaccaatag

SEQ ID NO: 314248 - DNA, 7094 bp, Homo sapiens
cgagccggcccggttcgagctgcaggtactcaggtgcgagctgctaactcaggggcgagctgctaactcaggggcgagctgctaactcaggcgcgagctgccaagggaaaggatggaaagaagtattcctcgctcaacctgtttgatacgtataagggcaagtccttagagatccagaaacccgctgttgcccctcgccatggcctgcagagtctcgggaaagttgccattgcccggcgtatgccacctccagccaaccttccaagcctgaaagccgagaacaaaggcaatgaccccaatgtctcactagtgccaaaagacggaacaggatgggcaagcaaacaggagcagtccgaccccaagagttccgatgcctcaaccgctcagccgccggaatcgcagccactgccggcttcacagacgcctgcctccaaccagccgaaacgacccccagcagcccccgagaacactcctttggttccaagcggggtaaagtcctgggcacaagccagcgtcacccatggagcacatggagatggtggaagggcatcaagcctactgtcacgattctctcgagaggaatttccgaccctgcaggcggctggcgaccaggacaaggctgccaaggaaagggagtctgccgaacagtcgtctgggcccggaccaagcctccgcccccaaaattctacaacttggagggacggaggtgggcgtggccctgatgagctggagggcccggactccaaacttcatcatggtcatgatccccggggtgggctacagccttcaggcccaccccagttccctccctaccgcggaatgatgccgcctttcatgtatcccccatatctcccgttccctccgccctatggaccccaggggccttaccgataccccactcctgatgggcccaggtgagcaatccaggtctgggtttgtggctgggggcaggggaagcttattgggggaggagatggttttctagccaggaggctcagtctaggatcagtctcgcatgtggttatacaacatgccatatttcattttcttttttgtgtacagccgttttccccgtgtggcgggcccccgaggctcagggccaccaatgcgcttagtagagcctgtgggtcgtccctctattctcaaagaggataatctcaaagagtttgatcagttggatcaggagaatgatgatggttgggcaggggcccatgaagaggttgactacactgaaaagctcaagttcagcgatgaggaagatgggcgagactctgatgaggagggagctgagggccacagggattcccaatcagcttctggtgaggaacggccccctgaagcagatggcaaaaagggcaactcccccaacagcgaaccgcccactcctaagacggcctgggcagaaacctctcggcctccagagacagagccgggacctcctgccccaaagcctcccctacccccacctcaccggggccccgccgggaactggggcccccctggggactacccagatcgtgggggtcctccctgcaagcccccagcacctgaagatgaggatgaggcatggcggcagcgacgaaagcagtcgtcatctgagatttccctggcagtggagcgggcccggcgacggcgagaagaagaggagcggcgcatgcaagaagagcgccgggcagcctgtgctgagaagctcaagcgactcgatgaaaagtttggggcacctgacaagcggctcaaagcagagcctgctgccccacctgctgccccttctaccccagctccaccacctgcagtccctaaagaactccctgcacctccagctccacctccagcatcagccccaacaccagagaaagaacctgaagagccagcacaggcccctcctgcccaatctactcctactccaggtgtggctgcggctcccactctggtgagtggtggtggcagtaccagtagcaccagcagtggcagcttcgaagccagcccagtggaaccacaactgccctcaaaagagggtcctgaaccaccagaagaggttcctcctcctaccacacccccagttccaaaggtggaacccaagggtgatgggattggtcccacccgccagccccctagtcagggcttgggctaccccaaatatcagaagtcgttgcctcctcgtttccagcggcagcagcaggagcagctcctgaagcagcagcagcagcaccagtggcagcagcatcaacagggctctgcccctcctaccccagtgcccccatcaccaccacagcctgtgaccctgggggctgtgccagctccacaggctccacccccgccccccaaggccctgtacccaggtgctctgggccggcccccacccatgcccccaatgaactttgatccccgatggatgatgattcctccttatgtggacccccggctcctccagggtcgtccccctctagacttctaccctcctggtgtgcatccctctggcctagttccccgagagcgttcagacagtgggggctcaagctcagagccatttgaccgtcatgcacctgctatgttacgggaacggggcactccaccggtggatccaaagttggcctgggtaggagatgtcttcaccgccacacccgctgaaccccgcccacttacctcacctctgcgccaggctgcggatgaggatgacaaggggatgaggagcgagactcctccagtacctcccccaccaccctatctggccagttatccaggctttcctgagaatggagcccctgggcccccaatctctcgctttcctctggaggaaccagggccccgtccactcccctggcccccaggcagtgatgaagtggccaagatacaaactccaccacccaagaaggagccccctaaggaggagactgcacagctgacggggccagaagcaggccgaaagcctgcccgcggagtcgggagtggaggccagggccccccaccaccacgcagagagagtcgcacagagacccgctggggccctcgtccagggagcagtcgtcgtggaatccctccagaggagccaggggccccaccccgccgggctgggcctataaagaaacctccaccacctacaaaagtagaagagctgcctcccaagcccctcgaacagggggatgaaacccccaaacccccaaagccagacccactcaagataaccaaggggaagctagggggccccaaggagaccccacccaatggaaatctttcccctgccccaaggcttcggagggactattcgtatgaaagagtgggtcctacctcttgccggggtcggggccgaggcgagtattttgccagagggaggggttttcgggggacctatgggggacgagggcggggagcccgaagccgggaattccgcagttaccgagagtttcgaggagatgatgggcgtggaggtgggacagggggaccaaaccaccctcctgctccccgaggccgcactgccagcgagacacggagcgagggttcagagtatgaggaaatccccaagcggcgccggcagcggggctcagaaacaggcagcgagacccatgagagtgatctggctccttcagacaaggaggctcccacacccaaggagggaacactcacccaggtccctctcgctcccccaccaccaggagccccaccttcaccagccccagcccgcttcactgcccggggtgggcgagtcttcactcccagaggggtgccatctcgccggggccgaggaggagggaggccccctcctcaagtttgcccaggctggagccctccagccaagtctctggctcccaagaaacctcccacaggccctttgccaccaagtaaggagcctttgaaagagaagttgatcccagggcctctgtcccctgtggcgcgcggaggcagcaatggaggtagcaatgtgggcatggaagatggggagcgaccccgaaggaggcgacatgggagggctcagcagcaggataaaccgcctcgtttccggaggctgaagcaggaacgggagaatgccgcaagggggtctgagggcaagccctccctaacccttccagcctccgctcctggacctgaggaggccctcacaacagtcacagtggccccagcacctcgccgggcagctgccaagtctcctgatctgtcaaaccagaactcagaccaagccaatgaggaatgggagactgcatcagagagcagtgacttcaccagtgagcgccgaggggacaaagaggcacccccaccagtactgctgacacccaaggctgtgggaactcctgggggaggtggaggtggagccgtaccaggtatttcagccatgtcccgcggagatctgagccagagagccaaggatttgagtaaacggagcttctcaagtcagcggccaggcatggaacggcagaatcggcgccctggcccagggggcaaggctggcagcagtggcagcagcagtggaggaggcggtgggggtcctggaggaaggaccgggccaggacgaggcgacaagaggagctggccctctcccaagaaccgaagtcgtcctccagaggagcgtcccccggggcttcccctgcctcccccacctcccagcagttctgctgtcttccgcctggaccaagttatccacagcaaccctgctggcatccaacaggctctggcccagcttagtagccgtcaagggagtgtaactgcaccagggggtcatccaaggcacaagcctgggcctccccaagcccctcagggcccctctcctaggcccccaacccgatacgagccccagagggtcaacagcggcctcagttctgacccccactttgaggagccggggccaatggtgagaggggtgggtgggactcctcgggactctgccggggttagtccctttccccctaaacgtcgggagcggcctcccagaaaaccagagctgctacaggaggaatctttgccacctcctcatagctctggattcttgggctctaagcctgagggcccaggccctcaggcagagtccagagatacaggcacagaggccctgacccctcacatctggaaccgtttacatactgccactagccgaaagagttaccggcccagctccatggagccttggatggagcccctgagtccttttgaggatgtggctggcacagaaatgagtcagtctgacagtggggtggacctgagtggggattctcaggtgtcatcaggtccctgcagccagcgaagttcccctgatggaggactcaagggggcagcagagggaccccccaagaggcctggaggctcctcacccctgaatgctgttccttgtgagggtccacctggctctgaacctcctaggagaccaccacctgccccccacgatggggacagaaaggagctgccccgggagcagcctctgccccctggccccattggcacagaacgatcacagcgtacagaccgaggcacagagcctggccccattcggccatcccatcgacctggtcccccagtccagtttggcactagtgacaaggactcagacttacgcctagtggtaggagacagcttgaaagcagagaaggagctaacagcatcagtcactgaggccattcctgtatcacgagactgggagctgcttcccagtgctgctgcctctgctgagccacaatccaagaacctggattctgggcactgtgtcccggagcccagctcctcaggccagcgcctgtatcctgaggttttctatggcagtgctgggccttccagttctcagatctctgggggagccatggactctcaattacatccaaacagtggaggcttccgccctgggacaccctcactgcacccttacagatcacagcccctatacctaccccccggcccagcccctccctcagcactgctctctggggtagctctcaagggccagtttctggatttctccacaatgcaagctacagagctggggaagttgccggctggaggagttctctaccctccaccttccttcctctactctccggctttctgccccagtcctttgcctgacacatcgttgcttcaggtacgccaggatctgccatccccttcggatttttattctactcctctgcagcctggtggccaaagtggctttctcccttcaggggctcctgcccagcaggtatattgtatcttcacacttccccttcatttgatttctctgtccagttgctggctttgattttccctggttttctgacattcctccctgcccccaacatgcacacccaaatttcttgttacagatgcttctacccatggtagactcacagctgcctgtggtgaactttggctccctgccgccagcaccacctcctgccccacctcccctttctctgttacctgtgggccctgctctgcagccccccagcctggctgtgcggcccccacctgctcctgctactcgggtgctgccttcacctgccaggcccttccccgctagcttggggcgagcagagctgcatccagtggaactaaagccgttccaggattatcaaaaactgagcagcaaccttgggggacctggatcatcacggactcccccaactggaaggtccttctctggcctcaattcccgtctcaaggccacgccttccacctacagtggagtcttccgcacccagcgcgtcgacctttaccagcaggcctccccaccagatgccctgcgctggatacctaagccttgggagcggacagggccgccacctcgagaagggccctcccgacgggcagaggagcctgggtcccgaggggacaaggagcctgggttgcccccaccccgctgagggagttcctcttgccccctacccccggggcttgtatatagattataaatatataagggggaaaggggtgggcggggaggggttgtggggctggggcctcacttcccctcctcccccttcccctggtcccctgtccctggggctgtttgttaaaaaagagtaataaaaggatttaaaaaaaaaaacaaacacaacaaaaaaccaaaagccaaacacaaaccacaaaaataaaaaaaccatcaatcccacaaaaaaaacaaacacaaccaatag

SEQ ID NO: 314249 - DNA, 6740 bp, Homo sapiens
cgagccggcccggttcgagctgcaggtactcaggtgcgagctgctaactcaggggcgagctgctaactcaggggcgagctgctaactcaggcgcgagctgccaagggaaaggatggaaagaagtattcctcgctcaacctgtttgatacgtataagggcaagtccttagagatccagaaacccgctgttgcccctcgccatggcctgcagagtctcgggaaagttgccattgcccggcgtatgccacctccagccaaccttccaagcctgaaagccgagaacaaaggcaatgaccccaatgtctcactagtgccaaaagacggaacaggatgggcaagcaaacaggagcagtccgaccccaagagttccgatgcctcaaccgctcagccgccggaatcgcagccactgccggcttcacagacgcctgcctccaaccagccgaaacgacccccagcagcccccgagaacactcctttggttccaagcggggtaaagtcctgggcacaagccagcgtcacccatggagcacatggagatggtggaagggcatcaagcctactgtcacgattctctcgagaggaatttccgaccctgcaggcggctggcgaccaggacaaggctgccaaggaaagggagtctgccgaacagtcgtctgggcccggaccaagcctccgcccccaaaattctacaacttggagggacggaggtgggcgtggccctgatgagctggagggcccggactccaaacttcatcatggtcatgatccccggggtgggctacagccttcaggcccaccccagttccctccctaccgcggaatgatgccgcctttcatgtatcccccatatctcccgttccctccgccctatggaccccaggggccttaccgataccccactcctgatgggcccaggtgagcaatccaggtctgggtttgtggctgggggcaggggaagcttattgggggaggagatggttttctagccaggaggctcagtctaggatcagtctcgcatgtggttatacaacatgccatatttcattttcttttttgtgtacagccgttttccccgtgtggcgggcccccgaggctcagggccaccaatgcgcttagtagagcctgtgggtcgtccctctattctcaaagaggataatctcaaagagtttgatcagttggatcaggagaatgatgatggttgggcaggggcccatgaagaggttgactacactgaaaagctcaagttcagcgatgaggaagatgggcgagactctgatgaggagggagctgagggccacagggattcccaatcagcttctggtgaggaacggccccctgaagcagatggcaaaaagggcaactcccccaacagcgaaccgcccactcctaagacggcctgggcagaaacctctcggcctccagagacagagccgggacctcctgccccaaagcctcccctacccccacctcaccggggccccgccgggaactggggcccccctggggactacccagatcgtgggggtcctccctgcaagcccccagcacctgaagatgaggatgaggcatggcggcagcgacgaaagcagtcgtcatctgagatttccctggcagtggagcgggcccggcgacggcgagaagaagaggagcggcgcatgcaagaagagcgccgggcagcctgtgctgagaagctcaagcgactcgatgaaaagtttggggcacctgacaagcggctcaaagcagagcctgctgccccacctgctgccccttctaccccagctccaccacctgcagtccctaaagaactccctgcacctccagctccacctccagcatcagccccaacaccagagaaagaacctgaagagccagcacaggcccctcctgcccaatctactcctactccaggtgtggctgcggctcccactctggtgagtggtggtggcagtaccagtagcaccagcagtggcagcttcgaagccagcccagtggaaccacaactgccctcaaaagagggtcctgaaccaccagaagaggttcctcctcctaccacacccccagttccaaaggtggaacccaagggtgatgggattggtcccacccgccagccccctagtcagggcttgggctaccccaaatatcagaagtcgttgcctcctcgtttccagcggcagcagcaggagcagctcctgaagcagcagcagcagcaccagtggcagcagcatcaacagggctctgcccctcctaccccagtgcccccatcaccaccacagcctgtgaccctgggggctgtgccagctccacaggctccacccccgccccccaaggccctgtacccaggtgctctgggccggcccccacccatgcccccaatgaactttgatccccgatggatgatgattcctccttatgtggacccccggctcctccagggtcgtccccctctagacttctaccctcctggtgtgcatccctctggcctagttccccgagagcgttcagacagtgggggctcaagctcagagccatttgaccgtcatgcacctgctatgttacgggaacggggcactccaccggtggatccaaagttggcctgggtaggagatgtcttcaccgccacacccgctgaaccccgcccacttacctcacctctgcgccaggctgcggatgaggatgacaaggggatgaggagcgagactcctccagtacctcccccaccaccctatctggccagttatccaggctttcctgagaatggagcccctgggcccccaatctctcgctttcctctggaggaaccagggccccgtccactcccctggcccccaggcagtgatgaagtggccaagatacaaactccaccacccaagaaggagccccctaaggaggagactgcacagctgacggggccagaagcaggccgaaagcctgcccgcggagtcgggagtggaggccagggccccccaccaccacgcagagagagtcgcacagagacccgctggggccctcgtccagggagcagtcgtcgtggaatccctccagaggagccaggggccccaccccgccgggctgggcctataaagaaacctccaccacctacaaaagtagaagagctgcctcccaagcccctcgaacagggggatgaaacccccaaacccccaaagccagacccactcaagataaccaaggggaagctagggggccccaaggagaccccacccaatggaaatctttcccctgccccaaggcttcggagggactattcgtatgaaagagtgggtcctacctcttgccggggtcggggccgaggcgagtattttgccagagggaggggttttcgggggacctatgggggacgagggcggggagcccgaagccgggaattccgcagttaccgagagtttcgaggagatgatgggcgtggaggtgggacagggggaccaaaccaccctcctgctccccgaggccgcactgccagcgagacacggagcgagggttcagagtatgaggaaatccccaagcggcgccggcagcggggctcagaaacaggcagcgagacccatgagagtgatctggctccttcagacaaggaggctcccacacccaaggagggaacactcacccaggtccctctcgctcccccaccaccaggagccccaccttcaccagccccagcccgcttcactgcccggggtgggcgagtcttcactcccagaggggtgccatctcgccggggccgaggaggagggaggccccctcctcaagtttgcccaggctggagccctccagccaagtctctggctcccaagaaacctcccacaggccctttgccaccaagtaaggagcctttgaaagagaagttgatcccagggcctctgtcccctgtggcgcgcggaggcagcaatggaggtagcaatgtgggcatggaagatggggagcgaccccgaaggaggcgacatgggagggctcagcagcaggataaaccgcctcgtttccggaggctgaagcaggaacgggagaatgccgcaagggggtctgagggcaagccctccctaacccttccagcctccgctcctggacctgaggaggccctcacaacagtcacagtggccccagcacctcgccgggcagctgccaagtctcctgatctgtcaaaccagaactcagaccaagccaatgaggaatgggagactgcatcagagagcagtgacttcaccagtgagcgccgaggggacaaagaggcacccccaccagtactgctgacacccaaggctgtgggaactcctgggggaggtggaggtggagccgtaccaggtatttcagccatgtcccgcggagatctgagccagagagccaaggatttgagtaaacggagcttctcaagtcagcggccaggcatggaacggcagaatcggcgccctggcccagggggcaaggctggcagcagtggcagcagcagtggaggaggcggtgggggtcctggaggaaggaccgggccaggacgaggcgacaagaggagctggccctctcccaagaaccgaagtcgtcctccagaggagcgtcccccggggcttcccctgcctcccccacctcccagcagttctgctgtcttccgcctggaccaagttatccacagcaaccctgctggcatccaacaggctctggcccagcttagtagccgtcaagggagtgtaactgcaccagggggtcatccaaggcacaagcctgggcctccccaagcccctcagggcccctctcctaggcccccaacccgatacgagccccagagggtcaacagcggcctcagttctgacccccactttgaggagccggggccaatggtgagaggggtgggtgggactcctcgggactctgccggggttagtccctttccccctaaacgtcgggagcggcctcccagaaaaccagagctgctacaggaggaatctttgccacctcctcatagctctggattcttgggctctaagcctgagggcccaggccctcaggcagagtccagagatacaggcacagaggccctgacccctcacatctggaggctcctcacccctgaatgctgttccttgtgagggtccacctggctctgaacctcctaggagaccaccacctgccccccacgatggggacagaaaggagctgccccgggagcagcctctgccccctggccccattggcacagaacgatcacagcgtacagaccgaggcacagagcctggccccattcggccatcccatcgacctggtcccccagtccagtttggcactagtgacaaggactcagacttacgcctagtggtaggagacagcttgaaagcagagaaggagctaacagcatcagtcactgaggccattcctgtatcacgagactgggagctgcttcccagtgctgctgcctctgctgagccacaatccaagaacctggattctgggcactgtgtcccggagcccagctcctcaggccagcgcctgtatcctgaggttttctatggcagtgctgggccttccagttctcagatctctgggggagccatggactctcaattacatccaaacagtggaggcttccgccctgggacaccctcactgcacccttacagatcacagcccctatacctaccccccggcccagcccctccctcagcactgctctctggggtagctctcaagggccagtttctggatttctccacaatgcaagctacagagctggggaagttgccggctggaggagttctctaccctccaccttccttcctctactctccggctttctgccccagtcctttgcctgacacatcgttgcttcaggtacgccaggatctgccatccccttcggatttttattctactcctctgcagcctggtggccaaagtggctttctcccttcaggggctcctgcccagcagatgcttctacccatggtagactcacagctgcctgtggtgaactttggctccctgccgccagcaccacctcctgccccacctcccctttctctgttacctgtgggccctgctctgcagccccccagcctggctgtgcggcccccacctgctcctgctactcgggtgctgccttcacctgccaggcccttccccgctagcttggggcgagcagagctgcatccagtggaactaaagccgttccaggattatcaaaaactgagcagcaaccttgggggacctggatcatcacggactcccccaactggaaggtccttctctggcctcaattcccgtctcaaggccacgccttccacctacagtggagtcttccgcacccagcgcgtcgacctttaccagcaggcctccccaccagatgccctgcgctggatacctaagccttgggagcggacagggccgccacctcgagaagggccctcccgacgggcagaggagcctgggtcccgaggggacaaggagcctgggttgcccccaccccgctgagggagttcctcttgccccctacccccggggcttgtatatagattataaatatataagggggaaaggggtgggcggggaggggttgtggggctggggcctcacttcccctcctcccccttcccctggtcccctgtccctggggctgtttgttaaaaaagagtaataaaaggatttaaaaaaaaaaacaaacacaacaaaaaaccaaaagccaaacacaaaccacaaaaataaaaaaaccatcaatcccacaaaaaaaacaaacacaaccaatag

SEQ ID NO: 314250 - DNA, 7187 bp, Homo sapiens
cgagccggcccggttcgagctgcaggtactcaggtgcgagctgctaactcaggggcgagctgctaactcaggggcgagctgctaactcaggcgcgagctgccaagggaaaggatggaaagaagtattcctcgctcaacctgtttgatacgtataagggcaagtccttagagatccagaaacccgctgttgcccctcgccatggcctgcagagtctcgggaaagttgccattgcccggcgtatgccacctccagccaaccttccaagcctgaaagccgagaacaaaggcaatgaccccaatgtctcactagtgccaaaagacggaacaggatgggcaagcaaacaggagcagtccgaccccaagagttccgatgcctcaaccgctcagccgccggaatcgcagccactgccggcttcacagacgcctgcctccaaccagccgaaacgacccccagcagcccccgagaacactcctttggttccaagcggggtaaagtcctgggcacaagccagcgtcacccatggagcacatggagatggtggaagggcatcaagcctactgtcacgattctctcgagaggaatttccgaccctgcaggcggctggcgaccaggacaaggctgccaaggaaagggagtctgccgaacagtcgtctgggcccggaccaagcctccgcccccaaaattctacaacttggagggacggaggtgggcgtggccctgatgagctggagggcccggactccaaacttcatcatggtcatgatccccggggtgggctacagccttcaggcccaccccagttccctccctaccgcggaatgatgccgcctttcatgtatcccccatatctcccgttccctccgccctatggaccccaggggccttaccgataccccactcctgatgggcccaggtgagcaatccaggtctgggtttgtggctgggggcaggggaagcttattgggggaggagatggttttctagccaggaggctcagtctaggatcagtctcgcatgtggttatacaacatgccatatttcattttcttttttgtgtacagccgttttccccgtgtggcgggcccccgaggctcagggccaccaatgcgcttagtagagcctgtgggtcgtccctctattctcaaagaggataatctcaaagagtttgatcagttggatcaggagaatgatgatggttgggcaggggcccatgaagaggttgactacactgaaaagctcaagttcagcgatgaggaagatgggcgagactctgatgaggagggagctgagggccacagggattcccaatcagcttctggtgaggaacggccccctgaagcagatggcaaaaagggcaactcccccaacagcgaaccgcccactcctaagacggcctgggcagaaacctctcggcctccagagacagagccgggacctcctgccccaaagcctcccctacccccacctcaccggggccccgccgggaactggggcccccctggggactacccagatcgtgggggtcctccctgcaagcccccagcacctgaagatgaggatgaggcatggcggcagcgacgaaagcagtcgtcatctgagatttccctggcagtggagcgggcccggcgacggcgagaagaagaggagcggcgcatgcaagaagagcgccgggcagcctgtgctgagaagctcaagcgactcgatgaaaagtttggggcacctgacaagcggctcaaagcagagcctgctgccccacctgctgccccttctaccccagctccaccacctgcagtccctaaagaactccctgcacctccagctccacctccagcatcagccccaacaccagagaaagaacctgaagagccagcacaggcccctcctgcccaatctactcctactccaggtgtggctgcggctcccactctggtgagtggtggtggcagtaccagtagcaccagcagtggcagcttcgaagccagcccagtggaaccacaactgccctcaaaagagggtcctgaaccaccagaagaggttcctcctcctaccacacccccagttccaaaggtggaacccaagggtgatgggattggtcccacccgccagccccctagtcagggcttgggctaccccaaatatcagaagtcgttgcctcctcgtttccagcggcagcagcaggagcagctcctgaagcagcagcagcagcaccagtggcagcagcatcaacagggctctgcccctcctaccccagtgcccccatcaccaccacagcctgtgaccctgggggctgtgccagctccacaggctccacccccgccccccaaggccctgtacccaggtgctctgggccggcccccacccatgcccccaatgaactttgatccccgatggatgatgattcctccttatgtggacccccggctcctccagggtcgtccccctctagacttctaccctcctggtgtgcatccctctggcctagttccccgagagcgttcagacagtgggggctcaagctcagagccatttgaccgtcatgcacctgctatgttacgggaacggggcactccaccggtggatccaaagttggcctgggtaggagatgtcttcaccgccacacccgctgaaccccgcccacttacctcacctctgcgccaggctgcggatgaggatgacaaggggatgaggagcgagactcctccagtacctcccccaccaccctatctggccagttatccaggctttcctgagaatggagcccctgggcccccaatctctcgctttcctctggaggaaccagggccccgtccactcccctggcccccaggcagtgatgaagtggccaagatacaaactccaccacccaagaaggagccccctaaggaggagactgcacagctgacggggccagaagcaggccgaaagcctgcccgcggagtcgggagtggaggccagggccccccaccaccacgcagagagagtcgcacagagacccgctggggccctcgtccagggagcagtcgtcgtggaatccctccagaggagccaggggccccaccccgccgggctgggcctataaagaaacctccaccacctacaaaagtagaagagctgcctcccaagcccctcgaacagggggatgaaacccccaaacccccaaagccagacccactcaagataaccaaggggaagctagggggccccaaggagaccccacccaatggaaatctttcccctgccccaaggcttcggagggactattcgtatgaaagagtgggtcctacctcttgccggggtcggggccgaggcgagtattttgccagagggaggggttttcgggggacctatgggggacgagggcggggagcccgaagccgggaattccgcagttaccgagagtttcgaggagatgatgggcgtggaggtgggacagggggaccaaaccaccctcctgctccccgaggccgcactgccagcgagacacggagcgagggttcagagtatgaggaaatccccaagcggcgccggcagcggggctcagaaacaggcagcgagacccatgagagtgatctggctccttcagacaaggaggctcccacacccaaggagggaacactcacccaggtccctctcgctcccccaccaccaggagccccaccttcaccagccccagcccgcttcactgcccggggtgggcgagtcttcactcccagaggggtgccatctcgccggggccgaggaggagggaggccccctcctcaagtttgcccaggctggagccctccagccaagtctctggctcccaagaaacctcccacaggccctttgccaccaagtaaggagcctttgaaagagaagttgatcccagggcctctgtcccctgtggcgcgcggaggcagcaatggaggtagcaatgtgggcatggaagatggggagcgaccccgaaggaggcgacatgggagggctcagcagcaggataaaccgcctcgtttccggaggctgaagcaggaacgggagaatgccgcaagggggtctgagggcaagccctccctaacccttccagcctccgctcctggacctgaggaggccctcacaacagtcacagtggccccagcacctcgccgggcagctgccaagtctcctgatctgtcaaaccagaactcagaccaagccaatgaggaatgggagactgcatcagagagcagtgacttcaccagtgagcgccgaggggacaaagaggcacccccaccagtactgctgacacccaaggctgtgggaactcctgggggaggtggaggtggagccgtaccaggtatttcagccatgtcccgcggagatctgagccagagagccaaggatttgagtaaacggagcttctcaagtcagcggccaggcatggaacggcagaatcggcgccctggcccagggggcaaggctggcagcagtggcagcagcagtggaggaggcggtgggggtcctggaggaaggaccgggccaggacgaggcgacaagaggagctggccctctcccaagaaccgaagtcgtcctccagaggagcgtcccccggggcttcccctgcctcccccacctcccagcagttctgctgtcttccgcctggaccaagttatccacagcaaccctgctggcatccaacaggctctggcccagcttagtagccgtcaagggagtgtaactgcaccagggggtcatccaaggcacaagcctgggcctccccaagcccctcagggcccctctcctaggcccccaacccgatacgagccccagagggtcaacagcggcctcagttctgacccccactttgaggagccggggccaatggtgagaggggtgggtgggactcctcgggactctgccggggttagtccctttccccctaaacgtcgggagcggcctcccagaaaaccagagctgctacaggaggaatctttgccacctcctcatagctctggattcttgggctctaagcctgagggcccaggccctcaggcagagtccagagatacaggcacagaggccctgacccctcacatctggaaccgtttacatactgccactagccgaaagagttaccggcccagctccatggagccttggatggagcccctgagtccttttgaggatgtggctggcacagaaatgagtcagtctgacagtggggtggacctgagtggggattctcaggtgtcatcaggtccctgcagccagcgaagttcccctgatggaggactcaagggggcagcagagggaccccccaagaggcctggaggctcctcacccctgaatgctgttccttgtgagggtccacctggctctgaacctcctaggagaccaccacctgccccccacgatggggacagaaaggagctgccccgggagcagcctctgccccctggccccattggcacagaacgatcacagcgtacagaccgaggcacagagcctggccccattcggccatcccatcgacctggtcccccagtccagtttggcactagtgacaaggactcagacttacgcctagtggtaggagacagcttgaaagcagagaaggagctaacagcatcagtcactgaggccattcctgtatcacgagactgggagctgcttcccagtgctgctgcctctgctgagccacaatccaagaacctggattctgggcactgtgtcccggagcccagctcctcaggccagcgcctgtatcctgaggttttctatggcagtgctgggccttccagttctcaggtaggccccgcttcccattgcatgaccccttcagtgaataataatttttttctgcctggtatgtatttataatcaagcctttctacgttgcagagttgtgagataccactttgtcacatcatttttctccctactttttgcttctatgggtgggatggtgatcttttttcttgaccacagatactaaagctgtttcaaccgtgctcctctcctgcagatctctgggggagccatggactctcaattacatccaaacagtggaggcttccgccctgggacaccctcactgcacccttacagatcacagcccctatacctaccccccggcccagcccctccctcagcactgctctctggggtagctctcaagggccagtttctggatttctccacaatgcaagctacagagctggggaagttgccggctggaggagttctctaccctccaccttccttcctctactctccggctttctgccccagtcctttgcctgacacatcgttgcttcaggtacgccaggatctgccatccccttcggatttttattctactcctctgcagcctggtggccaaagtggctttctcccttcaggggctcctgcccagcagatgcttctacccatggtagactcacagctgcctgtggtgaactttggctccctgccgccagcaccacctcctgccccacctcccctttctctgttacctgtgggccctgctctgcagccccccagcctggctgtgcggcccccacctgctcctgctactcgggtgctgccttcacctgccaggcccttccccgctagcttggggcgagcagagctgcatccagtggaactaaagccgttccaggattatcaaaaactgagcagcaaccttgggggacctggatcatcacggactcccccaactggaaggtccttctctggcctcaattcccgtctcaaggccacgccttccacctacagtggagtcttccgcacccagcgcgtcgacctttaccagcaggcctccccaccagatgccctgcgctggatacctaagccttgggagcggacagggccgccacctcgagaagggccctcccgacgggcagaggagcctgggtcccgaggggacaaggagcctgggttgcccccaccccgctgagggagttcctcttgccccctacccccggggcttgtatatagattataaatatataagggggaaaggggtgggcggggaggggttgtggggctggggcctcacttcccctcctcccccttcccctggtcccctgtccctggggctgtttgttaaaaaagagtaataaaaggatttaaaaaaaaaaacaaacacaacaaaaaaccaaaagccaaacacaaaccacaaaaataaaaaaaccatcaatcccacaaaaaaaacaaacacaaccaatag

SEQ ID NO: 314251 - DNA, 7091 bp, Homo sapiens
cgagccggcccggttcgagctgcaggtactcaggtgcgagctgctaactcaggggcgagctgctaactcaggggcgagctgctaactcaggcgcgagctgccaagggaaaggatggaaagaagtattcctcgctcaacctgtttgatacgtataagggcaagtccttagagatccagaaacccgctgttgcccctcgccatggcctgcagagtctcgggaaagttgccattgcccggcgtatgccacctccagccaaccttccaagcctgaaagccgagaacaaaggcaatgaccccaatgtctcactagtgccaaaagacggaacaggatgggcaagcaaacaggagcagtccgaccccaagagttccgatgcctcaaccgctcagccgccggaatcgcagccactgccggcttcacagacgcctgcctccaaccagccgaaacgacccccagcagcccccgagaacactcctttggttccaagcggggtaaagtcctgggcacaagccagcgtcacccatggagcacatggagatggtggaagggcatcaagcctactgtcacgattctctcgagaggaatttccgaccctgcaggcggctggcgaccaggacaaggctgccaaggaaagggagtctgccgaacagtcgtctgggcccggaccaagcctccgcccccaaaattctacaacttggagggacggaggtgggcgtggccctgatgagctggagggcccggactccaaacttcatcatggtcatgatccccggggtgggctacagccttcaggcccaccccagttccctccctaccgcggaatgatgccgcctttcatgtatcccccatatctcccgttccctccgccctatggaccccaggggccttaccgataccccactcctgatgggcccaggtgagcaatccaggtctgggtttgtggctgggggcaggggaagcttattgggggaggagatggttttctagccaggaggctcagtctaggatcagtctcgcatgtggttatacaacatgccatatttcattttcttttttgtgtacagccgttttccccgtgtggcgggcccccgaggctcagggccaccaatgcgcttagtagagcctgtgggtcgtccctctattctcaaagaggataatctcaaagagtttgatcagttggatcaggagaatgatgatggttgggcaggggcccatgaagaggttgactacactgaaaagctcaagttcagcgatgaggaagatgggcgagactctgatgaggagggagctgagggccacagggattcccaatcagcttctggtgaggaacggccccctgaagcagatggcaaaaagggcaactcccccaacagcgaaccgcccactcctaagacggcctgggcagaaacctctcggcctccagagacagagccgggacctcctgccccaaagcctcccctacccccacctcaccggggccccgccgggaactggggcccccctggggactacccagatcgtgggggtcctccctgcaagcccccagcacctgaagatgaggatgaggcatggcggcagcgacgaaagcagtcgtcatctgagatttccctggcagtggagcgggcccggcgacggcgagaagaagaggagcggcgcatgcaagaagagcgccgggcagcctgtgctgagaagctcaagcgactcgatgaaaagtttggggcacctgacaagcggctcaaagcagagcctgctgccccacctgctgccccttctaccccagctccaccacctgcagtccctaaagaactccctgcacctccagctccacctccagcatcagccccaacaccagagaaagaacctgaagagccagcacaggcccctcctgcccaatctactcctactccaggtgtggctgcggctcccactctggtgagtggtggtggcagtaccagtagcaccagcagtggcagcttcgaagccagcccagtggaaccacaactgccctcaaaagagggtcctgaaccaccagaagaggttcctcctcctaccacacccccagttccaaaggtggaacccaagggtgatgggattggtcccacccgccagccccctagtcagggcttgggctaccccaaatatcagaagtcgttgcctcctcgtttccagcggcagcagcaggagcagctcctgaagcagcagcagcagcaccagtggcagcagcatcaacagggctctgcccctcctaccccagtgcccccatcaccaccacagcctgtgaccctgggggctgtgccagctccacaggctccacccccgccccccaaggccctgtacccaggtgctctgggccggcccccacccatgcccccaatgaactttgatccccgatggatgatgattcctccttatgtggacccccggctcctccagggtcgtccccctctagacttctaccctcctggtgtgcatccctctggcctagttccccgagagcgttcagacagtgggggctcaagctcagagccatttgaccgtcatgcacctgctatgttacgggaacggggcactccaccggtggatccaaagttggcctgggtaggagatgtcttcaccgccacacccgctgaaccccgcccacttacctcacctctgcgccaggctgcggatgaggatgacaaggggatgaggagcgagactcctccagtacctcccccaccaccctatctggccagttatccaggctttcctgagaatggagcccctgggcccccaatctctcgctttcctctggaggaaccagggccccgtccactcccctggcccccaggcagtgatgaagtggccaagatacaaactccaccacccaagaaggagccccctaaggaggagactgcacagctgacggggccagaagcaggccgaaagcctgcccgcggagtcgggagtggaggccagggccccccaccaccacgcagagagagtcgcacagagacccgctggggccctcgtccagggagcagtcgtcgtggaatccctccagaggagccaggggccccaccccgccgggctgggcctataaagaaacctccaccacctacaaaagtagaagagctgcctcccaagcccctcgaacagggggatgaaacccccaaacccccaaagccagacccactcaagataaccaaggggaagctagggggccccaaggagaccccacccaatggaaatctttcccctgccccaaggcttcggagggactattcgtatgaaagagtgggtcctacctcttgccggggtcggggccgaggcgagtattttgccagagggaggggttttcgggggacctatgggggacgagggcggggagcccgaagccgggaattccgcagttaccgagagtttcgaggagatgatgggcgtggaggtgggacagggggaccaaaccaccctcctgctccccgaggccgcactgccagcgagacacggagcgagggttcagagtatgaggaaatccccaagcggcgccggcagcggggctcagaaacaggcagcgagacccatgagagtgatctggctccttcagacaaggaggctcccacacccaaggagggaacactcacccaggtccctctcgctcccccaccaccaggagccccaccttcaccagccccagcccgcttcactgcccggggtgggcgagtcttcactcccagaggggtgccatctcgccggggccgaggaggagggaggccccctcctcaagtttgcccaggctggagccctccagccaagtctctggctcccaagaaacctcccacaggccctttgccaccaagtaaggagcctttgaaagagaagttgatcccagggcctctgtcccctgtggcgcgcggaggcagcaatggaggtagcaatgtgggcatggaagatggggagcgaccccgaaggaggcgacatgggagggctcagcagcaggataaaccgcctcgtttccggaggctgaagcaggaacgggagaatgccgcaagggggtctgagggcaagccctccctaacccttccagcctccgctcctggacctgaggaggccctcacaacagtcacagtggccccagcacctcgccgggcagctgccaagtctcctgatctgtcaaaccagaactcagaccaagccaatgaggaatgggagactgcatcagagagcagtgacttcaccagtgagcgccgaggggacaaagaggcacccccaccagtactgctgacacccaaggctgtgggaactcctgggggaggtggaggtggagccgtaccaggtatttcagccatgtcccgcggagatctgagccagagagccaaggatttgagtaaacggagcttctcaagtcagcggccaggcatggaacggcagaatcggcgccctggcccagggggcaaggctggcagcagtggcagcagcagtggaggaggcggtgggggtcctggaggaaggaccgggccaggacgaggcgacaagaggagctggccctctcccaagaaccgaagtcgtcctccagaggagcgtcccccggggcttcccctgcctcccccacctcccagcagttctgctgtcttccgcctggaccaagttatccacagcaaccctgctggcatccaacaggctctggcccagcttagtagccgtcaagggagtgtaactgcaccagggggtcatccaaggcacaagcctgggcctccccaagcccctcagggcccctctcctaggcccccaacccgatacgagccccagagggtcaacagcggcctcagttctgacccccactttgaggagccggggccaatggtgagaggggtgggtgggactcctcgggactctgccggggttagtccctttccccctaaacgtcgggagcggcctcccagaaaaccagagctgctacaggaggaatctttgccacctcctcatagctctggattcttgggctctaagcctgagggcccaggccctcaggcagagtccagagatacaggcacagaggccctgacccctcacatctggaaccgtttacatactgccactagccgaaagagttaccggcccagctccatggagccttggatggagcccctgagtccttttgaggatgtggctggcacagaaatgagtcagtctgacagtggggtggacctgagtggggattctcaggtgtcatcaggtccctgcagccagcgaagttcccctgatggaggactcaagggggcagcagagggaccccccaagaggcctggaggctcctcacccctgaatgctgttccttgtgagggtccacctggctctgaacctcctaggagaccaccacctgccccccacgatggggacagaaaggagctgccccgggagcagcctctgccccctggccccattggcacagaacgatcacagcgtacagaccgaggcacagagcctggccccattcggccatcccatcgacctggtcccccagtccagtttggcactagtgacaaggactcagacttacgcctagtggtaggagacagcttgaaagcagagaaggagctaacagcatcagtcactgaggccattcctgtatcacgagactgggagctgcttcccagtgctgctgcctctgctgagccacaatccaagaacctggattctgggcactgtgtcccggagcccagctcctcaggccagcgcctgtatcctgaggttttctatggcagtgctgggccttccagttctcagatctctgggggagccatggactctcaattacatccaaacagtggaggcttccgccctgggacaccctcactgcacccttacagatcacagcccctatacctaccccccggcccagcccctccctcagcactgctctctggggtagctctcaagggccagtttctggatttctccacaatgcaagctacagagctggggaagttgccggctggaggagttctctaccctccaccttccttcctctactctccggctttctgccccagtcctttgcctgacacatcgttgcttcaggtacgccaggatctgccatccccttcggatttttattctactcctctgcagcctggtggccaaagtggctttctcccttcaggggctcctgcccagcagatgcttctacccatggtagactcacagctgcctgtggtgaactttggctccctgccgccagcaccacctcctgccccacctcccctttctctgttacctgtgggccctgctctgcagccccccagcctggctgtgcggcccccacctgctcctgctactcgggtgctgccttcacctgccaggcccttccccgctagcttggggcgagcagagctgcatccagtggaactaaagccgttccaggattatcaaaaactgagcagcaaccttgggggacctggatcatcacggactcccccaactggaaggtccttctctggcctcaattcccgtctcaaggccacgccttccacctacagtggagtcttccgcacccagcgcgtcgacctttaccagcaggtgaaggagaaacccttgtggccccaactctaaattcgagttgccacctgatttcctgtccttccgtctcatcgctgacctctcactgtgactcactgtttaacacatgcctgtcccctaggcctccccaccagatgccctgcgctggatacctaagccttgggagcggacagggccgccacctcgagaagggccctcccgacgggcagaggagcctgggtcccgaggggacaaggagcctgggttgcccccaccccgctgagggagttcctcttgccccctacccccggggcttgtatatagattataaatatataagggggaaaggggtgggcggggaggggttgtggggctggggcctcacttcccctcctcccccttcccctggtcccctgtccctggggctgtttgttaaaaaagagtaataaaaggatttaaaaaaaaaaacaaacacaacaaaaaaccaaaagccaaacacaaaccacaaaaataaaaaaaccatcaatcccacaaaaaaaacaaacacaaccaatag

SEQ ID NO: 314252 - DNA, 7188 bp, Homo sapiens
cgagccggcccggttcgagctgcaggtactcaggtgcgagctgctaactcaggggcgagctgctaactcaggggcgagctgctaactcaggcgcgagctgccaagggaaaggatggaaagaagtattcctcgctcaacctgtttgatacgtataagggcaagtccttagagatccagaaacccgctgttgcccctcgccatggcctgcagagtctcgggaaagttgccattgcccggcgtatgccacctccagccaaccttccaagcctgaaagccgagaacaaaggcaatgaccccaatgtctcactagtgccaaaagacggaacaggatgggcaagcaaacaggagcagtccgaccccaagagttccgatgcctcaaccgctcagccgccggaatcgcagccactgccggcttcacagacgcctgcctccaaccagccgaaacgacccccagcagcccccgagaacactcctttggttccaagcggggtaaagtcctgggcacaagccagcgtcacccatggagcacatggagatggtggaagggcatcaagcctactgtcacgattctctcgagaggaatttccgaccctgcaggcggctggcgaccaggacaaggctgccaaggaaagggagtctgccgaacagtcgtctgggcccggaccaagcctccgcccccaaaattctacaacttggagggacggaggtgggcgtggccctgatgagctggagggcccggactccaaacttcatcatggtcatgatccccggggtgggctacagccttcaggcccaccccagttccctccctaccgcggaatgatgccgcctttcatgtatcccccatatctcccgttccctccgccctatggaccccaggggccttaccgataccccactcctgatgggcccaggtgagcaatccaggtctgggtttgtggctgggggcaggggaagcttattgggggaggagatggttttctagccaggaggctcagtctaggatcagtctcgcatgtggttatacaacatgccatatttcattttcttttttgtgtacagccgttttccccgtgtggcgggcccccgaggctcagggccaccaatgcgcttagtagagcctgtgggtcgtccctctattctcaaagaggataatctcaaagagtttgatcagttggatcaggagaatgatgatggttgggcaggggcccatgaagaggttgactacactgaaaagctcaagttcagcgatgaggaagatgggcgagactctgatgaggagggagctgagggccacagggattcccaatcagcttctggtgaggaacggccccctgaagcagatggcaaaaagggcaactcccccaacagcgaaccgcccactcctaagacggcctgggcagaaacctctcggcctccagagacagagccgggacctcctgccccaaagcctcccctacccccacctcaccggggccccgccgggaactggggcccccctggggactacccagatcgtgggggtcctccctgcaagcccccagcacctgaagatgaggatgaggcatggcggcagcgacgaaagcagtcgtcatctgagatttccctggcagtggagcgggcccggcgacggcgagaagaagaggagcggcgcatgcaagaagagcgccgggcagcctgtgctgagaagctcaagcgactcgatgaaaagtttggggcacctgacaagcggctcaaagcagagcctgctgccccacctgctgccccttctaccccagctccaccacctgcagtccctaaagaactccctgcacctccagctccacctccagcatcagccccaacaccagagaaagaacctgaagagccagcacaggcccctcctgcccaatctactcctactccaggtgtggctgcggctcccactctggtgagtggtggtggcagtaccagtagcaccagcagtggcagcttcgaagccagcccagtggaaccacaactgccctcaaaagagggtcctgaaccaccagaagaggttcctcctcctaccacacccccagttccaaaggtggaacccaagggtgatgggattggtcccacccgccagccccctagtcagggcttgggctaccccaaatatcagaagtcgttgcctcctcgtttccagcggcagcagcaggagcagctcctgaagcagcagcagcagcaccagtggcagcagcatcaacagggctctgcccctcctaccccagtgcccccatcaccaccacagcctgtgaccctgggggctgtgccagctccacaggctccacccccgccccccaaggccctgtacccaggtgctctgggccggcccccacccatgcccccaatgaactttgatccccgatggatgatgattcctccttatgtggacccccggctcctccagggtcgtccccctctagacttctaccctcctggtgtgcatccctctggcctagttccccgagagcgttcagacagtgggggctcaagctcagagccatttgaccgtcatgcacctgctatgttacgggaacggggcactccaccggtggatccaaagttggcctgggtaggagatgtcttcaccgccacacccgctgaaccccgcccacttacctcacctctgcgccaggctgcggatgaggatgacaaggggatgaggagcgagactcctccagtacctcccccaccaccctatctggccagttatccaggctttcctgagaatggagcccctgggcccccaatctctcgctttcctctggaggaaccagggccccgtccactcccctggcccccaggcagtgatgaagtggccaagatacaaactccaccacccaagaaggagccccctaaggaggagactgcacagctgacggggccagaagcaggccgaaagcctgcccgcggagtcgggagtggaggccagggccccccaccaccacgcagagagagtcgcacagagacccgctggggccctcgtccagggagcagtcgtcgtggaatccctccagaggagccaggggccccaccccgccgggctgggcctataaagaaacctccaccacctacaaaagtagaagagctgcctcccaagcccctcgaacagggggatgaaacccccaaacccccaaagccagacccactcaagataaccaaggggaagctagggggccccaaggagaccccacccaatggaaatctttcccctgccccaaggcttcggagggactattcgtatgaaagagtgggtcctacctcttgccggggtcggggccgaggcgagtattttgccagagggaggggttttcgggggacctatgggggacgagggcggggagcccgaagccgggaattccgcagttaccgagagtttcgaggagatgatgggcgtggaggtgggacagggggaccaaaccaccctcctgctccccgaggccgcactgccagcgagacacggagcgagggttcagagtatgaggaaatccccaagcggcgccggcagcggggctcagaaacaggcagcgagacccatgagagtgatctggctccttcagacaaggaggctcccacacccaaggagggaacactcacccaggtccctctcgctcccccaccaccaggagccccaccttcaccagccccagcccgcttcactgcccggggtgggcgagtcttcactcccagaggggtgccatctcgccggggccgaggaggagggaggccccctcctcaagtttgcccaggctggagccctccagccaagtctctggctcccaagaaacctcccacaggccctttgccaccaagtaaggagcctttgaaagagaagttgatcccagggcctctgtcccctgtggcgcgcggaggcagcaatggaggtagcaatgtgggcatggaagatggggagcgaccccgaaggaggcgacatgggagggctcagcagcaggataaaccgcctcgtttccggaggctgaagcaggaacgggagaatgccgcaagggggtctgagggcaagccctccctaacccttccagcctccgctcctggacctgaggaggccctcacaacagtcacagtggccccagcacctcgccgggcagctgccaagtctcctgatctgtcaaaccagaactcagaccaagccaatgaggaatgggagactgcatcagagagcagtgacttcaccagtgagcgccgaggggacaaagaggcacccccaccagtactgctgacacccaaggctgtgggaactcctgggggaggtggaggtggagccgtaccaggtatttcagccatgtcccgcggagatctgagccagagagccaaggatttgagtaaacggagcttctcaagtcagcggccaggcatggaacggcagaatcggcgccctggcccagggggcaaggctggcagcagtggcagcagcagtggaggaggcggtgggggtcctggaggaaggaccgggccaggacgaggcgacaagaggagctggccctctcccaagaaccgaagtcgtcctccagaggagcgtcccccggggcttcccctgcctcccccacctcccagcagttctgctgtcttccgcctggaccaagttatccacagcaaccctgctggcatccaacaggctctggcccagcttagtagccgtcaagggagtgtaactgcaccagggggtcatccaaggcacaagcctgggcctccccaagcccctcagggcccctctcctaggcccccaacccgatacgagccccagagggtcaacagcggcctcagttctgacccccactttgaggagccggggccaatggtgagaggggtgggtgggactcctcgggactctgccggggttagtccctttccccctaaacgtcgggagcggcctcccagaaaaccagagctgctacaggaggaatctttgccacctcctcatagctctggattcttgggctctaagcctgagggcccaggccctcaggcagagtccagagatacaggcacagaggccctgacccctcacatctggaaccgtttacatactgccactagccgaaagagttaccggcccagctccatggagccttggatggagcccctgagtccttttgaggatgtggctggcacagaaatgagtcagtctgacagtggggtggacctgagtggggattctcaggtgtcatcaggtccctgcagccagcgaagttcccctgatggaggactcaagggggcagcagagggaccccccaagaggcctggaggctcctcacccctgaatgctgttccttgtgagggtccacctggctctgaacctcctaggagaccaccacctgccccccacgatggggacagaaaggagctgccccgggagcagcctctgccccctggccccattggcacagaacgatcacagcgtacagaccgaggcacagagcctggccccattcggccatcccatcgacctggtcccccagtccagtttggcactagtgacaaggactcagacttacgcctagtggtaggagacagcttgaaagcagagaaggagctaacagcatcagtcactgaggccattcctgtatcacgagactgggagctgcttcccagtgctgctgcctctgctgagccacaatccaagaacctggattctgggcactgtgtcccggagcccagctcctcaggccagcgcctgtatcctgaggttttctatggcagtgctgggccttccagttctcagatctctgggggagccatggactctcaattacatccaaacagtggaggcttccgccctgggacaccctcactgcacccttacagatcacagcccctatacctaccccccggcccagcccctccctcagcactgctctctggggtagctctcaagggccagtttctggatttctccacaatgcaagctacagagctggggaagttgccggctggaggagttctctaccctccaccttccttcctctactctccggctttctgccccagtcctttgcctgacacatcgttgcttcaggtacgccaggatctgccatccccttcggatttttattctactcctctgcagcctggtggccaaagtggctttctcccttcaggggctcctgcccagcagatgcttctacccatggtagactcacagctgcctgtggtgaactttggctccctgccgccagcaccacctcctgccccacctcccctttctctgttacctgtgggccctgctctgcagccccccagcctggctgtgcggcccccacctgctcctgctactcgggtgctgccttcacctgccaggcccttccccgctagcttggggcgagcagagctgcatccagtggaactaaagccgttccaggattatcaaaaactgagcagcaaccttgggggacctggatcatcacggactcccccaactggaaggtgaaacggaatagggatgtggactttccaagtgcttccttactttggaaccagggtctggatcctaggcttgccttagacgcccttcttcccttaggtccttctctggcctcaattcccgtctcaaggccacgccttccacctacagtggagtcttccgcacccagcgcgtcgacctttaccagcaggtgaaggagaaacccttgtggccccaactctaaattcgagttgccacctgatttcctgtccttccgtctcatcgctgacctctcactgtgactcactgtttaacacatgcctgtcccctaggcctccccaccagatgccctgcgctggatacctaagccttgggagcggacagggccgccacctcgagaagggccctcccgacgggcagaggagcctgggtcccgaggggacaaggagcctgggttgcccccaccccgctgagggagttcctcttgccccctacccccggggcttgtatatagattataaatatataagggggaaaggggtgggcggggaggggttgtggggctggggcctcacttcccctcctcccccttcccctggtcccctgtccctggggctgtttgttaaaaaagagtaataaaaggatttaaaaaaaaaaacaaacacaacaaaaaaccaaaagccaaacacaaaccacaaaaataaaaaaaccatcaatcccacaaaaaaaacaaacacaaccaatag

SEQ ID NO: 314253 - DNA, 6669 bp, Homo sapiens
cgagccggcccggttcgagctgcaggtactcaggtgcgagctgctaactcaggggcgagctgctaactcaggggcgagctgctaactcaggcgcgagctgccaagggaaaggatggaaagaagtattcctcgctcaacctgtttgatacgtataagggcaagtccttagagatccagaaacccgctgttgcccctcgccatggcctgcagagtctcgggaaagttgccattgcccggcgtatgccacctccagccaaccttccaagcctgaaagccgagaacaaaggcaatgaccccaatgtctcactagtgccaaaagacggaacaggatgggcaagcaaacaggagcagtccgaccccaagagttccgatgcctcaaccgctcagccgccggaatcgcagccactgccggcttcacagacgcctgcctccaaccagccgaaacgacccccagcagcccccgagaacactcctttggttccaagcggggtaaagtcctgggcacaagccagcgtcacccatggagcacatggagatggtggaagggcatcaagcctactgtcacgattctctcgagaggaatttccgaccctgcaggcggctggcgaccaggacaaggctgccaaggaaagggagtctgccgaacagtcgtctgggcccggaccaagcctccgcccccaaaattctacaacttggagggacggaggtgggcgtggccctgatgagctggagggcccggactccaaacttcatcatggtcatgatccccggggtgggctacagccttcaggcccaccccagttccctccctaccgcggaatgatgccgcctttcatgtatcccccatatctcccgttccctccgccctatggaccccaggggccttaccgataccccactcctgatgggcccaggtgagcaatccaggtctgggtttgtggctgggggcaggggaagcttattgggggaggagatggttttctagccaggaggctcagtctaggatcagtctcgcatgtggttatacaacatgccatatttcattttcttttttgtgtacagccgttttccccgtgtggcgggcccccgaggctcagggccaccaatgcgcttagtagagcctgtgggtcgtccctctattctcaaagaggataatctcaaagagtttgatcagttggatcaggagaatgatgatggttgggcaggggcccatgaagaggttgactacactgaaaagctcaagttcagcgatgaggaagatgggcgagactctgatgaggagggagctgagggccacagggattcccaatcagcttctggtgaggaacggccccctgaagcagatggcaaaaagggcaactcccccaacagcgaaccgcccactcctaagacggcctgggcagaaacctctcggcctccagagacagagccgggacctcctgccccaaagcctcccctacccccacctcaccggggccccgccgggaactggggcccccctggggactacccagatcgtgggggtcctccctgcaagcccccagcacctgaagatgaggatgaggcatggcggcagcgacgaaagcagtcgtcatctgagatttccctggcagtggagcgggcccggcgacggcgagaagaagaggagcggcgcatgcaagaagagcgccgggcagcctgtgctgagaagctcaagcgactcgatgaaaagtttggggcacctgacaagcggctcaaagcagagcctgctgccccacctgctgccccttctaccccagctccaccacctgcagtccctaaagaactccctgcacctccagctccacctccagcatcagccccaacaccagagaaagaacctgaagagccagcacaggcccctcctgcccaatctactcctactccaggtgtggctgcggctcccactctggtgagtggtggtggcagtaccagtagcaccagcagtggcagcttcgaagccagcccagtggaaccacaactgccctcaaaagagggtcctgaaccaccagaagaggttcctcctcctaccacacccccagttccaaaggtggaacccaagggtgatgggattggtcccacccgccagccccctagtcagggcttgggctaccccaaatatcagaagtcgttgcctcctcgtttccagcggcagcagcaggagcagctcctgaagcagcagcagcagcaccagtggcagcagcatcaacagggctctgcccctcctaccccagtgcccccatcaccaccacagcctgtgaccctgggggctgtgccagctccacaggctccacccccgccccccaaggccctgtacccaggtgctctgggccggcccccacccatgcccccaatgaactttgatccccgatggatgatgattcctccttatgtggacccccggctcctccagggtcgtccccctctagacttctaccctcctggtgtgcatccctctggcctagttccccgagagcgttcagacagtgggggctcaagctcagagccatttgaccgtcatgcacctgctatgttacgggaacggggcactccaccggtggatccaaagttggcctgggtaggagatgtcttcaccgccacacccgctgaaccccgcccacttacctcacctctgcgccaggctgcggatgaggatgacaaggggatgaggagcgagactcctccagtacctcccccaccaccctatctggccagttatccaggctttcctgagaatggagcccctgggcccccaatctctcgctttcctctggaggaaccagggccccgtccactcccctggcccccaggcagtgatgaagtggccaagatacaaactccaccacccaagaaggagccccctaaggaggagactgcacagctgacggggccagaagcaggccgaaagcctgcccgcggagtcgggagtggaggccagggccccccaccaccacgcagagagagtcgcacagagacccgctggggccctcgtccagggagcagtcgtcgtggaatccctccagaggagccaggggccccaccccgccgggctgggcctataaagaaacctccaccacctacaaaagtagaagagctgcctcccaagcccctcgaacagggggatgaaacccccaaacccccaaagccagacccactcaagataaccaaggggaagctagggggccccaaggagaccccacccaatggaaatctttcccctgccccaaggcttcggagggactattcgtatgaaagagtgggtcctacctcttgccggggtcggggccgaggcgagtattttgccagagggaggggttttcgggggacctatgggggacgagggcggggagcccgaagccgggaattccgcagttaccgagagtttcgaggagatgatgggcgtggaggtgggacagggggaccaaaccaccctcctgctccccgaggccgcactgccagcgagacacggagcgagggttcagagtatgaggaaatccccaagcggcgccggcagcggggctcagaaacaggcagcgagacccatgagagtgatctggctccttcagacaaggaggctcccacacccaaggagggaacactcacccaggtccctctcgctcccccaccaccaggagccccaccttcaccagccccagcccgcttcactgcccggggtgggcgagtcttcactcccagaggggtgccatctcgccggggccgaggaggagggaggccccctcctcaagtttgcccaggctggagccctccagccaagtctctggctcccaagaaacctcccacaggccctttgccaccaagtaaggagcctttgaaagagaagttgatcccagggcctctgtcccctgtggcgcgcggaggcagcaatggaggtagcaatgtgggcatggaagatggggagcgaccccgaaggaggcgacatgggagggctcagcagcaggataaaccgcctcgtttccggaggctgaagcaggaacgggagaatgccgcaagggggtctgagggcaagccctccctaacccttccagcctccgctcctggacctgaggaggccctcacaacagtcacagtggccccagcacctcgccgggcagctgccaagtctcctgatctgtcaaaccagaactcagaccaagccaatgaggaatgggagactgcatcagagagcagtgacttcaccagtgagcgccgaggggacaaagaggcacccccaccagtactgctgacacccaaggctgtgggaactcctgggggaggtggaggtggagccgtaccaggtatttcagccatgtcccgcggagatctgagccagagagccaaggatttgagtaaacggagcttctcaagtcagcggccaggcatggaacggcagaatcggcgccctggcccagggggcaaggctggcagcagtggcagcagcagtggaggaggcggtgggggtcctggaggaaggaccgggccaggacgaggcgacaagaggagctggccctctcccaagaaccgaagtcgtcctccagaggagcgtcccccggggcttcccctgcctcccccacctcccagcagttctgctgtcttccgcctggaccaagttatccacagcaaccctgctggcatccaacaggctctggcccagcttagtagccgtcaagggagtgtaactgcaccagggggtcatccaaggcacaagcctgggcctccccaagcccctcagggcccctctcctaggcccccaacccgatacgagccccagagggtcaacagcggcctcagttctgacccccactttgaggagccggggccaatggtgagaggggtgggtgggactcctcgggactctgccggggttagtccctttccccctaaacgtcgggagcggcctcccagaaaaccagagctgctacaggaggaatctttgccacctcctcatagctctggattcttgggctctaagcctgagggcccaggccctcaggcagagtccagagatacaggcacagaggccctgacccctcacatctggaaccgtttacatactgccactagccgaaagagttaccggcccagctccatggagccttggatggagcccctgagtccttttgaggatgtggctggcacagaaatgagtcagtctgacagtggggtggacctgagtggggattctcaggtgtcatcaggtccctgcagccagcgaagttcccctgatggaggactcaagggggcagcagagggaccccccaagaggcctggaggctcctcacccctgaatgctgttccttgtgagggtccacctggctctgaacctcctaggagaccaccacctgccccccacgatggggacagaaaggagctgccccgggagcagcctctgccccctggccccattggcacagaacgatcacagcgtacagaccgaggcacagagcctggccccattcggccatcccatcgacctggtcccccagtccagtttggcactagtgacaaggactcagacttacgcctagtggtaggagacagcttgaaagcagagaaggagctaacagcatcagtcactgaggccattcctgtatcacgagactgggagctgcttcccagtgctgctgcctctgctgagccacaatccaagaacctggattctgggcactgtgtcccggagcccagctcctcaggccagcgcctgtatcctgaggttttctatggcagtgctgggccttccagttctcagatctctgggggagccatggactctcaattacatccaaacagtggaggcttccgccctgggacaccctcactgcacccttacagatcacagcccctatacctaccccccggcccagcccctccctcagcactgctctctggggtagctctcaagggccagtttctggatttctccacaatgcaagctacagagctggggaagttgccggctggaggagttctctaccctccaccttccttcctctactctccggctttctgccccaacctgccaggcccttccccgctagcttggggcgagcagagctgcatccagtggaactaaagccgttccaggattatcaaaaactgagcagcaaccttgggggacctggatcatcacggactcccccaactggaaggtccttctctggcctcaattcccgtctcaaggccacgccttccacctacagtggagtcttccgcacccagcgcgtcgacctttaccagcaggcctccccaccagatgccctgcgctggatacctaagccttgggagcggacagggccgccacctcgagaagggccctcccgacgggcagaggagcctgggtcccgaggggacaaggagcctgggttgcccccaccccgctgagggagttcctcttgccccctacccccggggcttgtatatagattataaatatataagggggaaaggggtgggcggggaggggttgtggggctggggcctcacttcccctcctcccccttcccctggtcccctgtccctggggctgtttgttaaaaaagagtaataaaaggatttaaaaaaaaaaacaaacacaacaaaaaaccaaaagccaaacacaaaccacaaaaataaaaaaaccatcaatcccacaaaaaaaacaaacacaaccaatag

SEQ ID NO: 314254 - DNA, 5901 bp, Homo sapiens
cgagccggcccggttcgagctgcaggtactcaggtgcgagctgctaactcaggggcgagctgctaactcaggggcgagctgctaactcaggcgcgagctgccaagggaaaggatggaaagaagtattcctcgctcaacctgtttgatacgtataagggcaagtccttagagatccagaaacccgctgttgcccctcgccatggcctgcagagtctcgggaaagttgccattgcccggcgtatgccacctccagccaaccttccaagcctgaaagccgagaacaaaggcaatgaccccaatgtctcactagtgccaaaagacggaacaggatgggcaagcaaacaggagcagtccgaccccaagagttccgatgcctcaaccgctcagccgccggaatcgcagccactgccggcttcacagacgcctgcctccaaccagccgaaacgacccccagcagcccccgagaacactcctttggttccaagcggggtaaagtcctgggcacaagccagcgtcacccatggagcacatggagatggtggaagggcatcaagcctactgtcacgattctctcgagaggaatttccgaccctgcaggcggctggcgaccaggacaaggctgccaaggaaagggagtctgccgaacagtcgtctgggcccggaccaagcctccgcccccaaaattctacaacttggagggacggaggtgggcgtggccctgatgagctggagggcccggactccaaacttcatcatggtcatgatccccggggtgggctacagccttcaggcccaccccagttccctccctaccgcggaatgatgccgcctttcatgtatcccccatatctcccgttccctccgccctatggaccccaggggccttaccgataccccactcctgatgggcccaggtgagcaatccaggtctgggtttgtggctgggggcaggggaagcttattgggggaggagatggttttctagccaggaggctcagtctaggatcagtctcgcatgtggttatacaacatgccatatttcattttcttttttgtgtacagccgttttccccgtgtggcgggcccccgaggctcagggccaccaatgcgcttagtagagcctgtgggtcgtccctctattctcaaagaggataatctcaaagagtttgatcagttggatcaggagaatgatgatggttgggcaggggcccatgaagaggttgactacactgaaaagctcaagttcagcgatgaggaagatgggcgagactctgatgaggagggagctgagggccacagggattcccaatcagcttctggtgaggaacggccccctgaagcagatggcaaaaagggcaactcccccaacagcgaaccgcccactcctaagacggcctgggcagaaacctctcggcctccagagacagagccgggacctcctgccccaaagcctcccctacccccacctcaccggggccccgccgggaactggggcccccctggggactacccagatcgtgggggtcctccctgcaagcccccagcacctgaagatgaggatgaggcatggcggcagcgacgaaagcagtcgtcatctgagatttccctggcagtggagcgggcccggcgacggcgagaagaagaggagcggcgcatgcaagaagagcgccgggcagcctgtgctgagaagctcaagcgactcgatgaaaagtttggggcacctgacaagcggctcaaagcagagcctgctgccccacctgctgccccttctaccccagctccaccacctgcagtccctaaagaactccctgcacctccagctccacctccagcatcagccccaacaccagagaaagaacctgaagagccagcacaggcccctcctgcccaatctactcctactccaggtgtggctgcggctcccactctggtgagtggtggtggcagtaccagtagcaccagcagtggcagcttcgaagccagcccagtggaaccacaactgccctcaaaagagggtcctgaaccaccagaagaggttcctcctcctaccacacccccagttccaaaggtggaacccaagggtgatgggattggtcccacccgccagccccctagtcagggcttgggctaccccaaatatcagaagtcgttgcctcctcgtttccagcggcagcagcaggagcagctcctgaagcagcagcagcagcaccagtggcagcagcatcaacagggctctgcccctcctaccccagtgcccccatcaccaccacagcctgtgaccctgggggctgtgccagctccacaggctccacccccgccccccaaggccctgtacccaggtgctctgggccggcccccacccatgcccccaatgaactttgatccccgatggatgatgattcctccttatgtggacccccggctcctccagggtcgtccccctctagacttctaccctcctggtgtgcatccctctggcctagttccccgagagcgttcagacagtgggggctcaagctcagagccatttgaccgtcatgcacctgctatgttacgggaacggggcactccaccggtggatccaaagttggcctgggtaggagatgtcttcaccgccacacccgctgaaccccgcccacttacctcacctctgcgccaggctgcggatgaggatgacaaggggatgaggagcgagactcctccagtacctcccccaccaccctatctggccagttatccaggctttcctgagaatggagcccctgggcccccaatctctcgctttcctctggaggaaccagggccccgtccactcccctggcccccaggcagtgatgaagtggccaagatacaaactccaccacccaagaaggagccccctaaggaggagactgcacagctgacggggccagaagcaggccgaaagcctgcccgcggagtcgggagtggaggccagggccccccaccaccacgcagagagagtcgcacagagacccgctggggccctcgtccagggagcagtcgtcgtggaatccctccagaggagccaggggccccaccccgccgggctgggcctataaagaaacctccaccacctacaaaagtagaagagctgcctcccaagcccctcgaacagggggatgaaacccccaaacccccaaagccagacccactcaagataaccaaggggaagctagggggccccaaggagaccccacccaatggaaatctttcccctgccccaaggcttcggagggactattcgtatgaaagagtgggtcctacctcttgccggggtcggggccgaggcgagtattttgccagagggaggggttttcgggggacctatgggggacgagggcggggagcccgaagccgggaattccgcagttaccgagagtttcgaggagatgatgggcgtggaggtgggacagggggaccaaaccaccctcctgctccccgaggccgcactgccagcgagacacggagcgagggttcagagtatgaggaaatccccaagcggcgccggcagcggggctcagaaacaggcagcgagacccatgagagtgatctggctccttcagacaaggaggctcccacacccaaggagggaacactcacccaggtccctctcgctcccccaccaccaggagccccaccttcaccagccccagcccgcttcactgcccggggtgggcgagtcttcactcccagaggggtgccatctcgccggggccgaggaggagggaggccccctcctcaagtttgcccaggctggagccctccagccaagtctctggctcccaagaaacctcccacaggccctttgccaccaagtaaggagcctttgaaagagaagttgatcccagggcctctgtcccctgtggcgcgcggaggcagcaatggaggtagcaatgtgggcatggaagatggggagcgaccccgaaggaggcgacatgggagggctcagcagcaggataaaccgcctcgtttccggaggctgaagcaggaacgggagaatgccgcaagggggtctgagggcaagccctccctaacccttccagcctccgctcctggacctgaggaggccctcacaacagtcacagtggccccagcacctcgccgggcagctgccaagtctcctgatctgtcaaaccagaactcagaccaagccaatgaggaatgggagactgcatcagagagcagtgacttcaccagtgagcgccgaggggacaaagaggcacccccaccagtactgctgacacccaaggctgtgggaactcctgggggaggtggaggtggagccgtaccaggtatttcagccatgtcccgcggagatctgagccagagagccaaggatttgagtaaacggagcttctcaagtcagcggccaggcatggaacggcagaatcggcgccctggcccagggggcaaggctggcagcagtggcagcagcagtggaggaggcggtgggggtcctggaggaaggaccgggccaggacgaggcgacaagaggagctggccctctcccaagaaccgaagtcgtcctccagaggagcgtcccccggggcttcccctgcctcccccacctcccagcagttctgctgtcttccgcctggaccaagttatccacagcaaccctgctggcatccaacaggctctggcccagcttagtagccgtcaagggagtgtaactgcaccagggggtcatccaaggcacaagcctgggcctccccaagcccctcagggcccctctcctaggcccccaacccgatacgagccccagagggtcaacagcggcctcagttctgacccccactttgaggagccggggccaatggtgagaggggtgggtgggactcctcgggactctgccggggttagtccctttccccctaaacgtcgggagcggcctcccagaaaaccagagctgctacaggaggaatctttgccacctcctcatagctctggattcttgggctctaagcctgagggcccaggccctcaggcagagtccagagatacaggcacagaggccctgacccctcacatctggaaccgtttacatactgccactagccgaaagagttaccggcccagctccatggagccttggatggagcccctgagtccttttgaggatgtggctggcacagaaatgagtcagtctgacagtggggtggacctgagtggggattctcaggtgtcatcaggtccctgcagccagcgaagttcccctgatggaggactcaagggggcagcagagggaccccccaagaggcctggaggctcctcacccctgaatgctgttccttgtgagggtccacctggctctgaacctcctaggagaccaccacctgccccccacgatggggacagaaaggagctgccccgggagcagcctctgccccctggccccattggcacagaacgatcacagcgtacagaccgaggcacagagcctggccccattcggccatcccatcgacctggtcccccagtccagtttggcactagtgacaaggactcagacttacgcctagtggtaggagacagcttgaaagcagagaaggagctaacagcatcagtcactgaggccattcctgtatcacgagactgggagctgcttcccagtgctgctgcctctgctgagccacaatccaagaacctggattctgggcactgtgtcccggagcccagctcctcaggccagcgcctgtatcctgaggttttctatggcagtgctgggccttccagttctcagatctctgggggagccatggactctcaattacatccaaacagtggaggcttccgccctgggacaccctcactgcacccttacagatcacagccccaccgccgctgcccagccagccagtgcattaaagatttaaaccg

SEQ ID NO: 314255 - DNA, 6217 bp, Homo sapiens
cgagccggcccggttcgagctgcaggtactcaggtgcgagctgctaactcaggggcgagctgctaactcaggggcgagctgctaactcaggcgcgagctgccaagggaaaggatggaaagaagtattcctcgctcaacctgtttgatacgtataagggcaagtccttagagatccagaaacccgctgttgcccctcgccatggcctgcagagtctcgggaaagttgccattgcccggcgtatgccacctccagccaaccttccaagcctgaaagccgagaacaaaggcaatgaccccaatgtctcactagtgccaaaagacggaacaggatgggcaagcaaacaggagcagtccgaccccaagagttccgatgcctcaaccgctcagccgccggaatcgcagccactgccggcttcacagacgcctgcctccaaccagccgaaacgacccccagcagcccccgagaacactcctttggttccaagcggggtaaagtcctgggcacaagccagcgtcacccatggagcacatggagatggtggaagggcatcaagcctactgtcacgattctctcgagaggaatttccgaccctgcaggcggctggcgaccaggacaaggctgccaaggaaagggagtctgccgaacagtcgtctgggcccggaccaagcctccgcccccaaaattctacaacttggagggacggaggtgggcgtggccctgatgagctggagggcccggactccaaacttcatcatggtcatgatccccggggtgggctacagccttcaggcccaccccagttccctccctaccgcggaatgatgccgcctttcatgtatcccccatatctcccgttccctccgccctatggaccccaggggccttaccgataccccactcctgatgggcccaggtgagcaatccaggtctgggtttgtggctgggggcaggggaagcttattgggggaggagatggttttctagccaggaggctcagtctaggatcagtctcgcatgtggttatacaacatgccatatttcattttcttttttgtgtacagccgttttccccgtgtggcgggcccccgaggctcagggccaccaatgcgcttagtagagcctgtgggtcgtccctctattctcaaagaggataatctcaaagagtttgatcagttggatcaggagaatgatgatggttgggcaggggcccatgaagaggttgactacactgaaaagctcaagttcagcgatgaggaagatgggcgagactctgatgaggagggagctgagggccacagggattcccaatcagcttctggtgaggaacggccccctgaagcagatggcaaaaagggcaactcccccaacagcgaaccgcccactcctaagacggcctgggcagaaacctctcggcctccagagacagagccgggacctcctgccccaaagcctcccctacccccacctcaccggggccccgccgggaactggggcccccctggggactacccagatcgtgggggtcctccctgcaagcccccagcacctgaagatgaggatgaggcatggcggcagcgacgaaagcagtcgtcatctgagatttccctggcagtggagcgggcccggcgacggcgagaagaagaggagcggcgcatgcaagaagagcgccgggcagcctgtgctgagaagctcaagcgactcgatgaaaagtttggggcacctgacaagcggctcaaagcagagcctgctgccccacctgctgccccttctaccccagctccaccacctgcagtccctaaagaactccctgcacctccagctccacctccagcatcagccccaacaccagagaaagaacctgaagagccagcacaggcccctcctgcccaatctactcctactccaggtgtggctgcggctcccactctggtgagtggtggtggcagtaccagtagcaccagcagtggcagcttcgaagccagcccagtggaaccacaactgccctcaaaagagggtcctgaaccaccagaagaggttcctcctcctaccacacccccagttccaaaggtggaacccaagggtgatgggattggtcccacccgccagccccctagtcagggcttgggctaccccaaatatcagaagtcgttgcctcctcgtttccagcggcagcagcaggagcagctcctgaagcagcagcagcagcaccagtggcagcagcatcaacagggctctgcccctcctaccccagtgcccccatcaccaccacagcctgtgaccctgggggctgtgccagctccacaggctccacccccgccccccaaggccctgtacccaggtgctctgggccggcccccacccatgcccccaatgaactttgatccccgatggatgatgattcctccttatgtggacccccggctcctccagggtcgtccccctctagacttctaccctcctggtgtgcatccctctggcctagttccccgagagcgttcagacagtgggggctcaagctcagagccatttgaccgtcatgcacctgctatgttacgggaacggggcactccaccggtggatccaaagttggcctgggtaggagatgtcttcaccgccacacccgctgaaccccgcccacttacctcacctctgcgccaggctgcggatgaggatgacaaggggatgaggagcgagactcctccagtacctcccccaccaccctatctggccagttatccaggctttcctgagaatggagcccctgggcccccaatctctcgctttcctctggaggaaccagggccccgtccactcccctggcccccaggcagtgatgaagtggccaagatacaaactccaccacccaagaaggagccccctaaggaggagactgcacagctgacggggccagaagcaggccgaaagcctgcccgcggagtcgggagtggaggccagggccccccaccaccacgcagagagagtcgcacagagacccgctggggccctcgtccagggagcagtcgtcgtggaatccctccagaggagccaggggccccaccccgccgggctgggcctataaagaaacctccaccacctacaaaagtagaagagctgcctcccaagcccctcgaacagggggatgaaacccccaaacccccaaagccagacccactcaagataaccaaggggaagctagggggccccaaggagaccccacccaatggaaatctttcccctgccccaaggcttcggagggactattcgtatgaaagagtgggtcctacctcttgccggggtcggggccgaggcgagtattttgccagagggaggggttttcgggggacctatgggggacgagggcggggagcccgaagccgggaattccgcagttaccgagagtttcgaggagatgatgggcgtggaggtgggacagggggaccaaaccaccctcctgctccccgaggccgcactgccagcgagacacggagcgagggttcagagtatgaggaaatccccaagcggcgccggcagcggggctcagaaacaggcagcgagacccatgagagtgatctggctccttcagacaaggaggctcccacacccaaggagggaacactcacccaggtccctctcgctcccccaccaccaggagccccaccttcaccagccccagcccgcttcactgcccggggtgggcgagtcttcactcccagaggggtgccatctcgccggggccgaggaggagggaggccccctcctcaagtttgcccaggctggagccctccagccaagtctctggctcccaagaaacctcccacaggccctttgccaccaagtaaggagcctttgaaagagaagttgatcccagggcctctgtcccctgtggcgcgcggaggcagcaatggaggtagcaatgtgggcatggaagatggggagcgaccccgaaggaggcgacatgggagggctcagcagcaggataaaccgcctcgtttccggaggctgaagcaggaacgggagaatgccgcaagggggtctgagggcaagccctccctaacccttccagcctccgctcctggacctgaggaggccctcacaacagtcacagtggccccagcacctcgccgggcagctgccaagtctcctgatctgtcaaaccagaactcagaccaagccaatgaggaatgggagactgcatcagagagcagtgacttcaccagtgagcgccgaggggacaaagaggcacccccaccagtactgctgacacccaaggctgtgggaactcctgggggaggtggaggtggagccgtaccaggtatttcagccatgtcccgcggagatctgagccagagagccaaggatttgagtaaacggagcttctcaagtcagcggccaggcatggaacggcagaatcggcgccctggcccagggggcaaggctggcagcagtggcagcagcagtggaggaggcggtgggggtcctggaggaaggaccgggccaggacgaggcgacaagaggagctggccctctcccaagaaccgaagtcgtcctccagaggagcgtcccccggggcttcccctgcctcccccacctcccagcagttctgctgtcttccgcctggaccaagttatccacagcaaccctgctggcatccaacaggctctggcccagcttagtagccgtcaagggagtgtaactgcaccagggggtcatccaaggcacaagcctgggcctccccaagcccctcagggcccctctcctaggcccccaacccgatacgagccccagagggtcaacagcggcctcagttctgacccccactttgaggagccggggccaatggtgagaggggtgggtgggactcctcgggactctgccggggttagtccctttccccctaaacgtcgggagcggcctcccagaaaaccagagctgctacaggaggaatctttgccacctcctcatagctctggattcttgggctctaagcctgagggcccaggccctcaggcagagtccagagatacaggcacagaggccctgacccctcacatctggaaccgtttacatactgccactagccgaaagagttaccggcccagctccatggagccttggatggagcccctgagtccttttgaggatgtggctggcacagaaatgagtcagtctgacagtggggtggacctgagtggggattctcaggtgtcatcaggtccctgcagccagcgaagttcccctgatggaggactcaagggggcagcagagggaccccccaagaggcctggaggctcctcacccctgaatgctgttccttgtgagggtccacctggctctgaacctcctaggagaccaccacctgccccccacgatggggacagaaaggagctgccccgggagcagcctctgccccctggccccattggcacagaacgatcacagcgtacagaccgaggcacagagcctggccccattcggccatcccatcgacctggtcccccagtccagtttggcactagtgacaaggactcagacttacgcctagtggtaggagacagcttgaaagcagagaaggagctaacagcatcagtcactgaggccattcctgtatcacgagactgggagctgcttcccagtgctgctgcctctgctgagccacaatccaagaacctggattctgggcactgtgtcccggagcccagctcctcaggccagcgcctgtatcctgaggttttctatggcagtgctgggccttccagttctcagatctctgggggagccatggactctcaattacatccaaacagtggaggcttccgccctgggacaccctcactgcacccttacagatcacagccttctaccccgccgccctcctcgcctgctctcggtagctctcaggcgtctggtctcccatgcgctacgagctgggagttgcggtgggggtctctactcccctcctctctctccggtttgcccgtcttgcctgcctcgtgttcggtcgccggtctgcatcccctcggatttatctactctcgcgctggggcaagggttctcctcgggctcctgcagcgatgtctacctggtgactccgtgctggggacttggtcctgcgcagacactctgcccctccttttctgtactgtggctgtctggccccgctgtggggccactgtctgtatcggtgtgctcactgcggcctccgtgtgggggggtgtc

SEQ ID NO: 314256 - DNA, 1181 bp, Homo sapiens
aatgcagcctgctgagggaggggctgggccctgggacaccctcactgcacccttacagatcacagcccctatacctaccccccggcccagcccctccctcagcactgctctctggggtagctctcaagggccagtttctggatttctccacaatgcaagctacagagctggggaagttgccggctggaggagttctctaccctccaccttccttcctctactctccggctttctgccccagtcctttgcctgacacatcgttgcttcaggtacgccaggatctgccatccccttcggatttttattctactcctctgcagcctggtggccaaagtggctttctcccttcaggggctcctgcccagcagatgcttctacccatggtagactcacagctgcctgtggtgaactttggctccctgccgccagcaccacctcctgccccacctcccctttctctgttacctgtgggccctgctctgcagccccccagcctggctgtgcggcccccacctgctcctgctactcgggtgctgccttcacctgccaggcccttccccgctagcttggggcgagcagagctgcatccagtggaactaaagccgttccaggattatcaaaaactgagcagcaaccttgggggacctggatcatcacggactcccccaactggaaggtccttctctggcctcaattcccgtctcaaggccacgccttccacctacagtggagtcttccgcacccagcgcgtcgacctttaccagcaggcctccccaccagatgccctgcgctggatacctaagccttgggagcggacagggccgccacctcgagaagggccctcccgacgggcagaggagcctgggtcccgaggggacaaggagcctgggttgcccccaccccgctgagggagttcctcttgccccctacccccggggcttgtatatagattataaatatataagggggaaaggggtgggcggggaggggttgtggggctggggcctcacttcccctcctcccccttcccctggtcccctgtccctggggctgtttgttaaaaaagagtaataaaaggatttaaaaaaaaaaacaaacacaacaaaaaaccaaaagccaaacacaaaccacaaaaataaaaaaaccatcaatcccacaaaaaaaacaaacacaaccaatag

SEQ ID NO: 314257 - DNA, 5336 bp, Homo sapiens
cgagccggcccggttcgagctgcaggtactcaggtgcgagctgctaactcaggggcgagctgctaactcaggggcgagctgctaactcaggcgcgagctgccaagggaaaggatggaaagaagtattcctcgctcaacctgtttgatacgtataagggcaagtccttagagatccagaaacccgctgttgcccctcgccatggcctgcagagtctcgggaaagttgccattgcccggcgtatgccacctccagccaaccttccaagcctgaaagccgagaacaaaggcaatgaccccaatgtctcactagtgccaaaagacggaacaggatgggcaagcaaacaggagcagtccgaccccaagagttccgatgcctcaaccgctcagccgccggaatcgcagccactgccggcttcacagacgcctgcctccaaccagccgaaacgacccccagcagcccccgagaacactcctttggttccaagcggggtaaagtcctgggcacaagccagcgtcacccatggagcacatggagatggtggaagggcatcaagcctactgtcacgattctctcgagaggaatttccgaccctgcaggcggctggcgaccaggacaaggctgccaaggaaagggagtctgccgaacagtcgtctgggcccggaccaagcctccgcccccaaaattctacaacttggagggacggaggtgggcgtggccctgatgagctggagggcccggactccaaacttcatcatggtcatgatccccggggtgggctacagccttcaggcccaccccagttccctccctaccgcggaatgatgccgcctttcatgtatcccccatatctcccgttccctccgccctatggaccccaggggccttaccgataccccactcctgatgggcccaggtgagcaatccaggtctgggtttgtggctgggggcaggggaagcttattgggggaggagatggttttctagccaggaggctcagtctaggatcagtctcgcatgtggttatacaacatgccatatttcattttcttttttgtgtacagccgttttccccgtgtggcgggcccccgaggctcagggccaccaatgcgcttagtagagcctgtgggtcgtccctctattctcaaagaggataatctcaaagagtttgatcagttggatcaggagaatgatgatggttgggcaggggcccatgaagaggttgactacactgaaaagctcaagttcagcgatgaggaagatgggcgagactctgatgaggagggagctgagggccacagggattcccaatcagcttctggtgaggaacggccccctgaagcagatggcaaaaagggcaactcccccaacagcgaaccgcccactcctaagacggcctgggcagaaacctctcggcctccagagacagagccgggacctcctgccccaaagcctcccctacccccacctcaccggggccccgccgggaactggggcccccctggggactacccagatcgtgggggtcctccctgcaagcccccagcacctgaagatgaggatgaggcatggcggcagcgacgaaagcagtcgtcatctgagatttccctggcagtggagcgggcccggcgacggcgagaagaagaggagcggcgcatgcaagaagagcgccgggcagcctgtgctgagaagctcaagcgactcgatgaaaagtttggggcacctgacaagcggctcaaagcagagcctgctgccccacctgctgccccttctaccccagctccaccacctgcagtccctaaagaactccctgcacctccagctccacctccagcatcagccccaacaccagagaaagaacctgaagagccagcacaggcccctcctgcccaatctactcctactccaggtgtggctgcggctcccactctggtgagtggtggtggcagtaccagtagcaccagcagtggcagcttcgaagccagcccagtggaaccacaactgccctcaaaagagggtcctgaaccaccagaagaggttcctcctcctaccacacccccagttccaaaggtggaacccaagggtgatgggattggtcccacccgccagccccctagtcagggcttgggctaccccaaatatcagaagtcgttgcctcctcgtttccagcggcagcagcaggagcagctcctgaagcagcagcagcagcaccagtggcagcagcatcaacagggctctgcccctcctaccccagtgcccccatcaccaccacagcctgtgaccctgggggctgtgccagctccacaggctccacccccgccccccaaggccctgtacccaggtgctctgggccggcccccacccatgcccccaatgaactttgatccccgatggatgatgattcctccttatgtggacccccggctcctccagggtcgtccccctctagacttctaccctcctggtgtgcatccctctggcctagttccccgagagcgttcagacagtgggggctcaagctcagagccatttgaccgtcatgcacctgctatgttacgggaacggggcactccaccggtggatccaaagttggcctgggtaggagatgtcttcaccgccacacccgctgaaccccgcccacttacctcacctctgcgccaggctgcggatgaggatgacaaggggatgaggagcgagactcctccagtacctcccccaccaccctatctggccagttatccaggctttcctgagaatggagcccctgggcccccaatctctcgctttcctctggaggaaccagggccccgtccactcccctggcccccaggcagtgatgaagtggccaagatacaaactccaccacccaagaaggagccccctaaggaggagactgcacagctgacggggccagaagcaggccgaaagcctgcccgcggagtcgggagtggaggccagggccccccaccaccacgcagagagagtcgcacagagacccgctggggccctcgtccagggagcagtcgtcgtggaatccctccagaggagccaggggccccaccccgccgggctgggcctataaagaaacctccaccacctacaaaagtagaagagctgcctcccaagcccctcgaacagggggatgaaacccccaaacccccaaagccagacccactcaagataaccaaggggaagctagggggccccaaggagaccccacccaatggaaatctttcccctgccccaaggcttcggagggactattcgtatgaaagagtgggtcctacctcttgccggggtcggggccgaggcgagtattttgccagagggaggggttttcgggggacctatgggggacgagggcggggagcccgaagccgggaattccgcagttaccgagagtttcgaggagatgatgggcgtggaggtgggacagggggaccaaaccaccctcctgctccccgaggccgcactgccagcgagacacggagcgagggttcagagtatgaggaaatccccaagcggcgccggcagcggggctcagaaacaggcagcgagacccatgagagtgatctggctccttcagacaaggaggctcccacacccaaggagggaacactcacccaggtccctctcgctcccccaccaccaggagccccaccttcaccagccccagcccgcttcactgcccggggtgggcgagtcttcactcccagaggggtgccatctcgccggggccgaggaggagggaggccccctcctcaagtttgcccaggctggagccctccagccaagtctctggctcccaagaaacctcccacaggccctttgccaccaagtaaggagcctttgaaagagaagttgatcccagggcctctgtcccctgtggcgcgcggaggcagcaatggaggtagcaatgtgggcatggaagatggggagcgaccccgaaggaggcgacatgggagggctcagcagcaggataaaccgcctcgtttccggaggctgaagcaggaacgggagaatgccgcaagggggtctgagggcaagccctccctaacccttccagcctccgctcctggacctgaggaggccctcacaacagtcacagtggccccagcacctcgccgggcagctgccaagtctcctgatctgtcaaaccagaactcagaccaagccaatgaggaatgggagactgcatcagagagcagtgacttcaccagtgagcgccgaggggacaaagaggcacccccaccagtactgctgacacccaaggctgtgggaactcctgggggaggtggaggtggagccgtaccaggtatttcagccatgtcccgcggagatctgagccagagagccaaggatttgagtaaacggagcttctcaagtcagcggccaggcatggaacggcagaatcggcgccctggcccagggggcaaggctggcagcagtggcagcagcagtggaggaggcggtgggggtcctggaggaaggaccgggccaggacgaggcgacaagaggagctggccctctcccaagaaccgaagtcgtcctccagaggagcgtcccccggggcttcccctgcctcccccacctcccagcagttctgctgtcttccgcctggaccaagttatccacagcaaccctgctggcatccaacaggctctggcccagcttagtagccgtcaagggagtgtaactgcaccagggggtcatccaaggcacaagcctgggcctccccaagcccctcagggcccctctcctaggcccccaacccgatacgagccccagagggtcaacagcggcctcagttctgacccccactttgaggagccggggccaatggtgagaggggtgggtgggactcctcgggactctgccggggttagtccctttccccctaaacgtcgggagcggcctcccagaaaaccagagctgctacaggaggaatctttgccacctcctcatagctctggattcttgggctctaagcctgagggcccaggccctcaggcagagtccagagatacaggcacagaggccctgacccctcacatctggaaccgtttacatactgccactagccgaaagagttaccggcccagctccatggagccttggatggagcccctgagtccttttgaggatgtggctggcacagaaatgagtcagtctgacagtggggtggacctgagtggggattctcaggtgtcatcaggtccctgcagccagcgaagttcccctgatggaggactcaagggggcagcagagggaccccccaagaggcaccctctccaactctgtgcttcacgctccacacatgcccagctgtttcactaac

SEQ ID NO: 314258 - DNA, 892 bp, Homo sapiens
  misc_feature (39)..(41): n is a, c, g, or t
agatccgcacaccttacggctaggtacgaggctgggtgnnncaaagtggctttctcccttcagggctcctgcccagcagatgcttctacccatggtagactcacagctgcctgtggtgaactttggctccctgccgccagcaccacctcctgccccacctcccctttctctgttacctgtgggccctgctctgcagccccccagcctggctgtgcggcccccacctgctcctgctactcgggtgctgccttcacctgccaggcccttccccgctagcttggggcgagcagagctgcatccagtggaactaaagccgttccaggattatcaaaaactgagcagcaaccttgggggacctggatcatcacggactcccccaactggaaggtccttctctggcctcaattcccgtctcaaggccacgccttccacctacagtggagtcttccgcacccagcgcgtcgacctttaccagcaggcctccccaccagatgccctgcgctggatacctaagccttgggagcggacagggccgccacctcgagaagggccctcccgacgggcagaggagcctgggtcccgaggggacaaggagcctgggttgcccccaccccgctgagggagttcctcttgccccctacccccggggcttgtatatagattataaatatataagggggaaaggggtgggcggggaggggttgtggggctggggcctcacttcccctcctcccccttcccctggtcccctgtccctggggctgtttgttaaaaaagagtaataaaaggatttaaaaaaaaaaacaaacacaacaaaaaaccaaaagccaaacacaaaccacaaaaataaaaaaaccatcaatcccacaaaaaaaacaaacacaaccaatag

SEQ ID NO: 314259 - DNA, 2962 bp, Homo sapiens
cgagccggcccggttcgagctgcaggtactcaggtgcgagctgctaactcaggggcgagctgctaactcaggggcgagctgctaactcaggcgcgagctgccaagggaaaggatggaaagaagtattcctcgctcaacctgtttgatacgtataagggcaagtccttagagatccagaaacccgctgttgcccctcgccatggcctgcagagtctcgggaaagttgccattgcccggcgtatgccacctccagccaaccttccaagcctgaaagccgagaacaaaggcaatgaccccaatgtctcactagtgccaaaagacggaacaggatgggcaagcaaacaggagcagtccgaccccaagagttccgatgcctcaaccgctcagccgccggaatcgcagccactgccggcttcacagacgcctgcctccaaccagccgaaacgacccccagcagcccccgagaacactcctttggttccaagcggggtaaagtcctgggcacaagccagcgtcacccatggagcacatggagatggtggaagggcatcaagcctactgtcacgattctctcgagaggaatttccgaccctgcaggcggctggcgaccaggacaaggctgccaaggaaagggagtctgccgaacagtcgtctgggcccggaccaagcctccgcccccaaaattctacaacttggagggacggaggtgggcgtggccctgatgagctggagggcccggactccaaacttcatcatggtcatgatccccggggtgggctacagccttcaggcccaccccagttccctccctaccgcggaatgatgccgcctttcatgtatcccccatatctcccgttccctccgccctatggaccccaggggccttaccgataccccactcctgatgggcccaggtgagcaatccaggtctgggtttgtggctgggggcaggggaagcttattgggggaggagatggttttctagccaggaggctcagtctaggatcagtctcgcatgtggttatacaacatgccatatttcattttcttttttgtgtacagccgttttccccgtgtggcgggcccccgaggctcagggccaccaatgcgcttagtagagcctgtgggtcgtccctctattctcaaagaggataatctcaaagagtttgatcagttggatcaggagaatgatgatggttgggcaggggcccatgaagaggttgactacactgaaaagctcaagttcagcgatgaggaagatgggcgagactctgatgaggagggagctgagggccacagggattcccaatcagcttctggtgaggaacggccccctgaagcagatggcaaaaagggcaactcccccaacagcgaaccgcccactcctaagacggcctgggcagaaacctctcggcctccagagacagagccgggacctcctgccccaaagcctcccctacccccacctcaccggggccccgccgggaactggggcccccctggggactacccagatcgtgggggtcctccctgcaagcccccagcacctgaagatgaggatgaggcatggcggcagcgacgaaagcagtcgtcatctgagatttccctggcagtggagcgggcccggcgacggcgagaagaagaggagcggcgcatgcaagaagagcgccgggcagcctgtgctgagaagctcaagcgactcgatgaaaagtttggggcacctgacaagcggctcaaagcagagcctgctgccccacctgctgccccttctaccccagctccaccacctgcagtccctaaagaactccctgcacctccagctccacctccagcatcagccccaacaccagagaaagaacctgaagagccagcacaggcccctcctgcccaatctactcctactccaggtgtggctgcggctcccactctggtgagtggtggtggcagtaccagtagcaccagcagtggcagcttcgaagccagcccagtggaaccacaactgccctcaaaagagggtcctgaaccaccagaagaggttcctcctcctaccacacccccagttccaaaggtggaacccaagggtgatgggattggtcccacccgccagccccctagtcagggcttgggctaccccaaatatcagaagtcgttgcctcctcgtttccagcggcagcagcaggagcagctcctgaagcagcagcagcagcaccagtggcagcagcatcaacagggctctgcccctcctaccccagtgcccccatcaccaccacagcctgtgaccctgggggctgtgccagctccacaggctccacccccgccccccaaggccctgtacccaggtgctctgggccggcccccacccatgcccccaatgaactttgatccccgatggatgatgattcctccttatgtggacccccggctcctccagggtcgtccccctctagacttctaccctcctggtgtgcatccctctggcctagttccccgagagcgttcagacagtgggggctcaagctcagagccatttgaccgtcatgcacctgctatgttacgggaacggggcactccaccggtggatccaaagttggcctgggtaggagatgtcttcaccgccacacccgctgaaccccgcccacttacctcacctctgcgccaggctgcggatgaggatgacaaggggatgaggtgagtcttggtcatgagaaatgggtgagttcacagtgaaaggatctaggcctgggagaaaggtactttgggttagtggtagggatagggatgaacgggaaaggagaggctggatggagtggctcatgcctgtaatcccagcattttgggaggctgaggcaagacgttcgttcgtgctttcctgctttcctccctcccccgcccctgttttttttttcttccttccctccttccttcctttaaaaaaaaaaaagaatcataccatcgtgcttta

SEQ ID NO: 314260 - DNA, 2297 bp, Homo sapiens
cgagccggcccggttcgagctgcaggtactcaggtgcgagctgctaactcaggggcgagctgctaactcaggggcgagctgctaactcaggcgcgagctgccaagggaaaggatggaaagaagtattcctcgctcaacctgtttgatacgtataagggcaagtccttagagatccagaaacccgctgttgcccctcgccatggcctgcagagtctcgggaaagttgccattgcccggcgtatgccacctccagccaaccttccaagcctgaaagccgagaacaaaggcaatgaccccaatgtctcactagtgccaaaagacggaacaggatgggcaagcaaacaggagcagtccgaccccaagagttccgatgcctcaaccgctcagccgccggaatcgcagccactgccggcttcacagacgcctgcctccaaccagccgaaacgacccccagcagcccccgagaacactcctttggttccaagcggggtaaagtcctgggcacaagccagcgtcacccatggagcacatggagatggtggaagggcatcaagcctactgtcacgattctctcgagaggaatttccgaccctgcaggcggctggcgaccaggacaaggctgccaaggaaagggagtctgccgaacagtcgtctgggcccggaccaagcctccgcccccaaaattctacaacttggagggacggaggtgggcgtggccctgatgagctggagggcccggactccaaacttcatcatggtcatgatccccggggtgggctacagccttcaggcccaccccagttccctccctaccgcggaatgatgccgcctttcatgtatcccccatatctcccgttccctccgccctatggaccccaggggccttaccgataccccactcctgatgggcccaggtgagcaatccaggtctgggtttgtggctgggggcaggggaagcttattgggggaggagatggttttctagccaggaggctcagtctaggatcagtctcgcatgtggttatacaacatgccatatttcattttcttttttgtgtacagccgttttccccgtgtggcgggcccccgaggctcagggccaccaatgcgcttagtagagcctgtgggtcgtccctctattctcaaagaggataatctcaaagagtttgatcagttggatcaggagaatgatgatggttgggcaggggcccatgaagaggttgactacactgaaaagctcaagttcagcgatgaggaagatgggcgagactctgatgaggagggagctgagggccacagggattcccaatcagcttctggtgaggaacggccccctgaagcagatggcaaaaagggcaactcccccaacagcgaaccgcccactcctaagacggcctgggcagaaacctctcggcctccagagacagagccgggacctcctgccccaaagcctcccctacccccacctcaccggggccccgccgggaactggggcccccctggggactacccagatcgtgggggtcctccctgcaagcccccagcacctgaagatgaggatgaggcatggcggcagcgacgaaagcagtcgtcatctgagatttccctggcagtggagcgggcccggcgacggcgagaagaagaggagcggcgcatgcaagaagagcgccgggcagcctgtgctgagaagctcaagcgactcgatgaaaagtttggggcacctgacaagcggctcaaagcagagcctgctgccccacctgctgccccttctaccccagctccaccacctgcagtccctaaagaactccctgcacctccagctccacctccagcatcagccccaacaccagagaaagaacctgaagagccagcacaggcccctcctgcccaatctactcctactccaggtgtggctgcggctcccactctggtgagtggtggtggcagtaccagtagcaccagcagtggcagcttcgaagccagcccagtggaaccacaactgccctcaaaagagggtcctgaaccaccagaagaggttcctcctcctaccacacccccagttccaaaggtggaacccaagggtgatgggattggtcccacccgccagccccctagtcagggcttgggctaccccaaatatcagaagtcgttgcctcctcgtttccagcggcagcagcaggtgaaatcaagttgtttaccctctaagggctgcttttcttcctggcttcggtccctaattctcttcataagttaccttctgggtccctttgcttctttgtccagttgtctccattgtc

SEQ ID NO: 314261 - DNA, 1640 bp, Homo sapiens
cgagccggcccggttcgagctgcaggtactcaggtgcgagctgctaactcaggggcgagctgctaactcaggggcgagctgctaactcaggcgcgagctgccaagggaaaggatggaaagaagtattcctcgctcaacctgtttgatacgtataagggcaagtccttagagatccagaaacccgctgttgcccctcgccatggcctgcagagtctcgggaaagttgccattgcccggcgtatgccacctccagccaaccttccaagcctgaaagccgagaacaaaggcaatgaccccaatgtctcactagtgccaaaagacggaacaggatgggcaagcaaacaggagcagtccgaccccaagagttccgatgcctcaaccgctcagccgccggaatcgcagccactgccggcttcacagacgcctgcctccaaccagccgaaacgacccccagcagcccccgagaacactcctttggttccaagcggggtaaagtcctgggcacaagccagcgtcacccatggagcacatggagatggtggaagggcatcaagcctactgtcacgattctctcgagaggaatttccgaccctgcaggcggctggcgaccaggacaaggctgccaaggaaagggagtctgccgaacagtcgtctgggcccggaccaagcctccgcccccaaaattctacaacttggagggacggaggtgggcgtggccctgatgagctggagggcccggactccaaacttcatcatggtcatgatccccggggtgggctacagccttcaggcccaccccagttccctccctaccgcggaatgatgccgcctttcatgtatcccccatatctcccgttccctccgccctatggaccccaggggccttaccgataccccactcctgatgggcccaggtgagcaatccaggtctgggtttgtggctgggggcaggggaagcttattgggggaggagatggttttctagccaggaggctcagtctaggatcagtctcgcatgtggttatacaacatgccatatttcattttcttttttgtgtacagccgttttccccgtgtggcgggcccccgaggctcagggccaccaatgcgcttagtagagcctgtgggtcgtccctctattctcaaagaggataatctcaaagagtttgatcagttggatcaggagaatgatgatggttgggcaggtaagtggatattaagggtcaagaatttggatcttgaaaggcaaaacctaatgaggaaaaaaaaatacagggttatgtgggtgaaaggcagacattgaagtgtaggaagaccaggcccaatggctcacatctgtaatcccagtgctttgggagtgttaggtgagaggatcgcttgaagccaggagttcaagaccagcctgggcaacacagcaagaccccccacctctacaaaaaaaaaaaaattttttagttgggtgtggactgtgcatctgtggtcccagctactctggaggttgtggtgggaggatcagttgagcccaggagttggaggtcacagtgagctatgatcgtgccactgaactccatcctgggcaacagagcgagacttttaaaaggaaaaaaaaaaaagagtaggggaggatggatggggaatac

SEQ ID NO: 314262 - DNA, 410 bp, Homo sapiens
gtagacagaggcttgggggacctagagtgatgggtattttaacttgaacttcagggagcattggggcttggtttagtccagccacgtctgagccagagacgaagaggtccctttcttacctattgcaggttccttgttaaatgactaaggaatggtactaaactttagctttttgtcttggagagagagcatgaaaaaatagacaacagcctacaaaggatgacaaaattaatttgtccttatatttgtaaatggtagcaatgggcatgatttcagtcctgagtctccaccagttggagaagtcagggaggcatctcaggtgtgaataaccttcccattctgtcccctcagttccgatgcctcaaccgctcagccgccggaatcgcagccactgccggcttcacagacgc

SEQ ID NO: 314263 - DNA, 281 bp, Homo sapiens
ttgtaagcagaagttgggaaacataacttgtgggaaaaagtaacgatttagtggatactggagctaatgctctgttttctccagtcgtcctccagaggagcgtcccccggggcttcccctgcctcccccacctcccagcagttctgctgtcttccgcctggaccaagttatccacagcaaccctgctggcatccaacaggctctggcccagcttagtagccgtcaagggagtgtaactgcaccagggggtcatccaaggcacaagcctgggcctccccaag

SEQ ID NO: 314264 - DNA, 843 bp, Homo sapiens
  misc_feature (39)..(41): n is a, c, g, or t
agatccgcacaccttacggctaggtacgaggctgggtgnnncaaagtggctttctcccttcagggctcctgcccagcagatgcttctacccatggtagactcacagctgcctgtggtgaactttggctccctgccgccagcaccacctcctgccccacctcccctttctctgttacctgtgggccctgctctgcagccccccagcctggctgtgcggcccccacctgctcctgctactcgggtgctgccttcacctgccaggcccttccccgctagcttggggcgagcagagctgcatccagtggaactaaagccgttccaggattatcaaaaactgagcagcaaccttgggggacctggatcatcacggactcccccaactggaaggtccttctctggcctcaattcccgtctcaaggccacgccttccacctacagtggagtcttccgcacccagcgcgtcgacctttaccagcaggcctccccaccagatgccctgcgctggatacctaagccttgggagcggacagggccgccacctcgagaagggccctcccgacgggcagaggagcctgggtcccgaggggacaaggagcctgggttgcccccaccccgctgagggagttcctcttgccccctacccccggggcttgtatatagattataaatatataagggggaaaggggtgggcggggaggggttgtggggctggggcctcacttcccctcctcccccttcccctggtcccctgtccctggggctgtttgtcacaccgcctccagcttccacaaaaaaccggcctttttcggcgcaaacgttaaggctgtcatgtcgccgtttga

SEQ ID NO: 314265 - DNA, 6970 bp, Homo sapiens
cgagccggcccggttcgagctgcaggtactcaggtgcgagctgctaactcaggggcgagctgctaactcaggggcgagctgctaactcaggcgcgagctgccaagggaaaggatggaaagaagtattcctcgctcaacctgtttgatacgtataagggcaagtccttagagatccagaaacccgctgttgcccctcgccatggcctgcagagtctcgggaaagttgccattgcccggcgtatgccacctccagccaaccttccaagcctgaaagccgagaacaaaggcaatgaccccaatgtctcactagtgccaaaagacggaacaggatgggcaagcaaacaggagcagtccgaccccaagagttccgatgcctcaaccgctcagccgccggaatcgcagccactgccggcttcacagacgcctgcctccaaccagccgaaacgacccccagcagcccccgagaacactcctttggttccaagcggggtaaagtcctgggcacaagccagcgtcacccatggagcacatggagatggtggaagggcatcaagcctactgtcacgattctctcgagaggaatttccgaccctgcaggcggctggcgaccaggacaaggctgccaaggaaagggagtctgccgaacagtcgtctgggcccggaccaagcctccgcccccaaaattctacaacttggagggacggaggtgggcgtggccctgatgagctggagggcccggactccaaacttcatcatggtcatgatccccggggtgggctacagccttcaggcccaccccagttccctccctaccgcggaatgatgccgcctttcatgtatcccccatatctcccgttccctccgccctatggaccccaggggccttaccgataccccactcctgatgggcccaggtgagcaatccaggtctgggtttgtggctgggggcaggggaagcttattgggggaggagatggttttctagccaggaggctcagtctaggatcagtctcgcatgtggttatacaacatgccatatttcattttcttttttgtgtacagccgttttccccgtgtggcgggcccccgaggctcagggccaccaatgcgcttagtagagcctgtgggtcgtccctctattctcaaagaggataatctcaaagagtttgatcagttggatcaggagaatgatgatggttgggcaggggcccatgaagaggttgactacactgaaaagctcaagttcagcgatgaggaagatgggcgagactctgatgaggagggagctgagggccacagggattcccaatcagcttctggtgaggaacggccccctgaagcagatggcaaaaagggcaactcccccaacagcgaaccgcccactcctaagacggcctgggcagaaacctctcggcctccagagacagagccgggacctcctgccccaaagcctcccctacccccacctcaccggggccccgccgggaactggggcccccctggggactacccagatcgtgggggtcctccctgcaagcccccagcacctgaagatgaggatgaggcatggcggcagcgacgaaagcagtcgtcatctgagatttccctggcagtggagcgggcccggcgacggcgagaagaagaggagcggcgcatgcaagaagagcgccgggcagcctgtgctgagaagctcaagcgactcgatgaaaagtttggggcacctgacaagcggctcaaagcagagcctgctgccccacctgctgccccttctaccccagctccaccacctgcagtccctaaagaactccctgcacctccagctccacctccagcatcagccccaacaccagagaaagaacctgaagagccagcacaggcccctcctgcccaatctactcctactccaggtgtggctgcggctcccactctggtgagtggtggtggcagtaccagtagcaccagcagtggcagcttcgaagccagcccagtggaaccacaactgccctcaaaagagggtcctgaaccaccagaagaggttcctcctcctaccacacccccagttccaaaggtggaacccaagggtgatgggattggtcccacccgccagccccctagtcagggcttgggctaccccaaatatcagaagtcgttgcctcctcgtttccagcggcagcagcaggagcagctcctgaagcagcagcagcagcaccagtggcagcagcatcaacagggctctgcccctcctaccccagtgcccccatcaccaccacagcctgtgaccctgggggctgtgccagctccacaggctccacccccgccccccaaggccctgtacccaggtgctctgggccggcccccacccatgcccccaatgaactttgatccccgatggatgatgattcctccttatgtggacccccggctcctccagggtcgtccccctctagacttctaccctcctggtgtgcatccctctggcctagttccccgagagcgttcagacagtgggggctcaagctcagagccatttgaccgtcatgcacctgctatgttacgggaacggggcactccaccggtggatccaaagttggcctgggtaggagatgtcttcaccgccacacccgctgaaccccgcccacttacctcacctctgcgccaggctgcggatgaggatgacaaggggatgaggagcgagactcctccagtacctcccccaccaccctatctggccagttatccaggctttcctgagaatggagcccctgggcccccaatctctcgctttcctctggaggaaccagggccccgtccactcccctggcccccaggcagtgatgaagtggccaagatacaaactccaccacccaagaaggagccccctaaggaggagactgcacagctgacggggccagaagcaggccgaaagcctgcccgcggagtcgggagtggaggccagggccccccaccaccacgcagagagagtcgcacagagacccgctggggccctcgtccagggagcagtcgtcgtggaatccctccagaggagccaggggccccaccccgccgggctgggcctataaagaaacctccaccacctacaaaagtagaagagctgcctcccaagcccctcgaacagggggatgaaacccccaaacccccaaagccagacccactcaagataaccaaggggaagctagggggccccaaggagaccccacccaatggaaatctttcccctgccccaaggcttcggagggactattcgtatgaaagagtgggtcctacctcttgccggggtcggggccgaggcgagtattttgccagagggaggggttttcgggggacctatgggggacgagggcggggagcccgaagccgggaattccgcagttaccgagagtttcgaggagatgatgggcgtggaggtgggacagggggaccaaaccaccctcctgctccccgaggccgcactgccagcgagacacggagcgagggttcagagtatgaggaaatccccaagcggcgccggcagcggggctcagaaacaggcagcgagacccatgagagtgatctggctccttcagacaaggaggctcccacacccaaggagggaacactcacccaggtccctctcgctcccccaccaccaggagccccaccttcaccagccccagcccgcttcactgcccggggtgggcgagtcttcactcccagaggggtgccatctcgccggggccgaggaggagggaggccccctcctcaagtttgcccaggctggagccctccagccaagtctctggctcccaagaaacctcccacaggccctttgccaccaagtaaggagcctttgaaagagaagttgatcccagggcctctgtcccctgtggcgcgcggaggcagcaatggaggtagcaatgtgggcatggaagatggggagcgaccccgaaggaggcgacatgggagggctcagcagcaggataaaccgcctcgtttccggaggctgaagcaggaacgggagaatgccgcaagggggtctgagggcaagccctccctaacccttccagcctccgctcctggacctgaggaggccctcacaacagtcacagtggccccagcacctcgccgggcagctgccaagtctcctgatctgtcaaaccagaactcagaccaagccaatgaggaatgggagactgcatcagagagcagtgacttcaccagtgagcgccgaggggacaaagaggcacccccaccagtactgctgacacccaaggctgtgggaactcctgggggaggtggaggtggagccgtaccaggtatttcagccatgtcccgcggagatctgagccagagagccaaggatttgagtaaacggagcttctcaagtcagcggccaggcatggaacggcagaatcggcgccctggcccagggggcaaggctggcagcagtggcagcagcagtggaggaggcggtgggggtcctggaggaaggaccgggccaggacgaggcgacaagaggagctggccctctcccaagaaccgaagtcgtcctccagaggagcgtcccccggggcttcccctgcctcccccacctcccagcagttctgctgtcttccgcctggaccaagttatccacagcaaccctgctggcatccaacaggctctggcccagcttagtagccgtcaagggagtgtaactgcaccagggggtcatccaaggcacaagcctgggcctccccaagcccctcagggcccctctcctaggcccccaacccgatacgagccccagagggtcaacagcggcctcagttctgacccccactttgaggagccggggccaatggtgagaggggtgggtgggactcctcgggactctgccggggttagtccctttccccctaaacgtcgggagcggcctcccagaaaaccagagctgctacaggaggaatctttgccacctcctcatagctctggattcttgggctctaagcctgagggcccaggccctcaggcagagtccagagatacaggcacagaggccctgacccctcacatctggaaccgtttacatactgccactagccgaaagagttaccggcccagctccatggagccttggatggagcccctgagtccttttgaggatgtggctggcacagaaatgagtcagtctgacagtggggtggacctgagtggggattctcaggtgtcatcaggtccctgcagccagcgaagttcccctgatggaggactcaagggggcagcagagggaccccccaagaggcctggaggctcctcacccctgaatgctgttccttgtgagggtccacctggctctgaacctcctaggagaccaccacctgccccccacgatggggacagaaaggagctgccccgggagcagcctctgccccctggccccattggcacagaacgatcacagcgtacagaccgaggcacagagcctggccccattcggccatcccatcgacctggtcccccagtccagtttggcactagtgacaaggactcagacttacgcctagtggtaggagacagcttgaaagcagagaaggagctaacagcatcagtcactgaggccattcctgtatcacgagactgggagctgcttcccagtgctgctgcctctgctgagccacaatccaagaacctggattctgggcactgtgtcccggagcccagctcctcaggccagcgcctgtatcctgaggttttctatggcagtgctgggccttccagttctcagatctctgggggagccatggactctcaattacatccaaacagtggaggcttccgccctgggacaccctcactgcacccttacagatcacagcccctatacctaccccccggcccagcccctccctcagcactgctctctggggtagctctcaagggccagtttctggatttctccacaatgcaagctacagagctggggaagttgccggctggaggagttctctaccctccaccttccttcctctactctccggctttctgccccagtcctttgcctgacacatcgttgcttcaggtacgccaggatctgccatccccttcggatttttattctactcctctgcagcctggtggccaaagtggctttctcccttcaggggctcctgcccagcagatgcttctacccatggtagactcacagctgcctgtggtgaactttggctccctgccgccagcaccacctcctgccccacctcccctttctctgttacctgtgggccctgctctgcagccccccagcctggctgtgcggcccccacctgctcctgctactcgggtgctgccttcacctgccaggcccttccccgctagcttggggcgagcagagctgcatccagtggaactaaagccgttccaggattatcaaaaactgagcagcaaccttgggggacctggatcatcacggactcccccaactggaaggtccttctctggcctcaattcccgtctcaaggccacgccttccacctacagtggagtcttccgcacccagcgcgtcgacctttaccagcaggcctccccaccagatgccctgcgctggatacctaagccttgggagcggacagggccgccacctcgagaagggccctcccgacgggcagaggagcctgggtcccgaggggacaaggagcctgggttgcccccaccccgctgagggagttcctcttgccccctacccccggggcttgtatatagattataaatatataagggggaaaggggtgggcggggaggggttgtggggctggggcctcacttcccctcctcccccttcccctggtcccctgtccctggggctgtttgttaaaaaagagtaataaaaggatttaaaaaaaaaaacaaacacaacaaaaaaccaaaagccaaacacaaaccacaaaaataaaaaaaccatcaatcccacaaaaaaaacaaacacaaccaatag

SEQ ID NO: 314266 - DNA, 6690 bp, Homo sapiens
cgagccggcccggttcgagctgcaggtactcaggtgcgagctgctaactcaggggcgagctgctaactcaggggcgagctgctaactcaggcgcgagctgccaagggaaaggatggaaagaagtattcctcgctcaacctgtttgatacgtataagggcaagtccttagagatccagaaacccgctgttgcccctcgccatggcctgcagagtctcgggaaagttgccattgcccggcgtatgccacctccagccaaccttccaagcctgaaagccgagaacaaaggcaatgaccccaatgtctcactagtgccaaaagacggaacaggatgggcaagcaaacaggagcagtccgaccccaagagttccgatgcctcaaccgctcagccgccggaatcgcagccactgccggcttcacagacgcctgcctccaaccagccgaaacgacccccagcagcccccgagaacactcctttggttccaagcggggtaaagtcctgggcacaagccagcgtcacccatggagcacatggagatggtggaagggcatcaagcctactgtcacgattctctcgagaggaatttccgaccctgcaggcggctggcgaccaggacaaggctgccaaggaaagggagtctgccgaacagtcgtctgggcccggaccaagcctccgcccccaaaattctacaacttggagggacggaggtgggcgtggccctgatgagctggagggcccggactccaaacttcatcatggtcatgatccccggggtgggctacagccttcaggcccaccccagttccctccctaccgcggaatgatgccgcctttcatgtatcccccatatctcccgttccctccgccctatggaccccaggggccttaccgataccccactcctgatgggcccaggtgagcaatccaggtctgggtttgtggctgggggcaggggaagcttattgggggaggagatggttttctagccaggaggctcagtctaggatcagtctcgcatgtggttatacaacatgccatatttcattttcttttttgtgtacagccgttttccccgtgtggcgggcccccgaggctcagggccaccaatgcgcttagtagagcctgtgggtcgtccctctattctcaaagaggataatctcaaagagtttgatcagttggatcaggagaatgatgatggttgggcaggggcccatgaagaggttgactacactgaaaagctcaagttcagcgatgaggaagatgggcgagactctgatgaggagggagctgagggccacagggattcccaatcagcttctggtgaggaacggccccctgaagcagatggcaaaaagggcaactcccccaacagcgaaccgcccactcctaagacggcctgggcagaaacctctcggcctccagagacagagccgggacctcctgccccaaagcctcccctacccccacctcaccggggccccgccgggaactggggcccccctggggactacccagatcgtgggggtcctccctgcaagcccccagcacctgaagatgaggatgaggcatggcggcagcgacgaaagcagtcgtcatctgagatttccctggcagtggagcgggcccggcgacggcgagaagaagaggagcggcgcatgcaagaagagcgccgggcagcctgtgctgagaagctcaagcgactcgatgaaaagtttggggcacctgacaagcggctcaaagcagagcctgctgccccacctgctgccccttctaccccagctccaccacctgcagtccctaaagaactccctgcacctccagctccacctccagcatcagccccaacaccagagaaagaacctgaagagccagcacaggcccctcctgcccaatctactcctactccaggtgtggctgcggctcccactctggtgagtggtggtggcagtaccagtagcaccagcagtggcagcttcgaagccagcccagtggaaccacaactgccctcaaaagagggtcctgaaccaccagaagaggttcctcctcctaccacacccccagttccaaaggtggaacccaagggtgatgggattggtcccacccgccagccccctagtcagggcttgggctaccccaaatatcagaagtcgttgcctcctcgtttccagcggcagcagcaggagcagctcctgaagcagcagcagcagcaccagtggcagcagcatcaacagggctctgcccctcctaccccagtgcccccatcaccaccacagcctgtgaccctgggggctgtgccagctccacaggctccacccccgccccccaaggccctgtacccaggtgctctgggccggcccccacccatgcccccaatgaactttgatccccgatggatgatgattcctccttatgtggacccccggctcctccagggtcgtccccctctagacttctaccctcctggtgtgcatccctctggcctagttccccgagagcgttcagacagtgggggctcaagctcagagccatttgaccgtcatgcacctgctatgttacgggaacggggcactccaccggtggatccaaagttggcctgggtaggagatgtcttcaccgccacacccgctgaaccccgcccacttacctcacctctgcgccaggctgcggatgaggatgacaaggggatgaggagcgagactcctccagtacctcccccaccaccctatctggccagttatccaggctttcctgagaatggagcccctgggcccccaatctctcgctttcctctggaggaaccagggccccgtccactcccctggcccccaggcagtgatgaagtggccaagatacaaactccaccacccaagaaggagccccctaaggaggagactgcacagctgacggggccagaagcaggccgaaagcctgcccgcggagtcgggagtggaggccagggccccccaccaccacgcagagagagtcgcacagagacccgctggggccctcgtccagggagcagtcgtcgtggaatccctccagaggagccaggggccccaccccgccgggctgggcctataaagaaacctccaccacctacaaaagtagaagagctgcctcccaagcccctcgaacagggggatgaaacccccaaacccccaaagccagacccactcaagataaccaaggggaagctagggggccccaaggagaccccacccaatggaaatctttcccctgccccaaggcttcggagggactattcgtatgaaagagtgggtcctacctcttgccggggtcggggccgaggcgagtattttgccagagggaggggttttcgggggacctatgggggacgagggcggggagcccgaagccgggaattccgcagttaccgagagtttcgaggagatgatgggcgtggaggtgggacagggggaccaaaccaccctcctgctccccgaggccgcactgccagcgagacacggagcgagggttcagagtatgaggaaatccccaagcggcgccggcagcggggctcagaaacaggcagcgagacccatgagagtgatctggctccttcagacaaggaggctcccacacccaaggagggaacactcacccaggtccctctcgctcccccaccaccaggagccccaccttcaccagccccagcccgcttcactgcccggggtgggcgagtcttcactcccagaggggtgccatctcgccggggccgaggaggagggaggccccctcctcaagtttgcccaggctggagccctccagccaagtctctggctcccaagaaacctcccacaggccctttgccaccaagtaaggagcctttgaaagagaagttgatcccagggcctctgtcccctgtggcgcgcggaggcagcaatggaggtagcaatgtgggcatggaagatggggagcgaccccgaaggaggcgacatgggagggctcagcagcaggataaaccgcctcgtttccggaggctgaagcaggaacgggagaatgccgcaagggggtctgagggcaagccctccctaacccttccagcctccgctcctggacctgaggaggccctcacaacagtcacagtggccccagcacctcgccgggcagctgccaagtctcctgatctgtcaaaccagaactcagaccaagccaatgaggaatgggagactgcatcagagagcagtgacttcaccagtgagcgccgaggggacaaagaggcacccccaccagtactgctgacacccaaggctgtgggaactcctgggggaggtggaggtggagccgtaccaggtatttcagccatgtcttccgcctggaccaagttatccacagcaaccctgctggcatccaacaggctctggcccagcttagtagccgtcaagggagtgtaactgcaccagggggtcatccaaggcacaagcctgggcctccccaagcccctcagggcccctctcctaggcccccaacccgatacgagccccagagggtcaacagcggcctcagttctgacccccactttgaggagccggggccaatggtgagaggggtgggtgggactcctcgggactctgccggggttagtccctttccccctaaacgtcgggagcggcctcccagaaaaccagagctgctacaggaggaatctttgccacctcctcatagctctggattcttgggctctaagcctgagggcccaggccctcaggcagagtccagagatacaggcacagaggccctgacccctcacatctggaaccgtttacatactgccactagccgaaagagttaccggcccagctccatggagccttggatggagcccctgagtccttttgaggatgtggctggcacagaaatgagtcagtctgacagtggggtggacctgagtggggattctcaggtgtcatcaggtccctgcagccagcgaagttcccctgatggaggactcaagggggcagcagagggaccccccaagaggcctggaggctcctcacccctgaatgctgttccttgtgagggtccacctggctctgaacctcctaggagaccaccacctgccccccacgatggggacagaaaggagctgccccgggagcagcctctgccccctggccccattggcacagaacgatcacagcgtacagaccgaggcacagagcctggccccattcggccatcccatcgacctggtcccccagtccagtttggcactagtgacaaggactcagacttacgcctagtggtaggagacagcttgaaagcagagaaggagctaacagcatcagtcactgaggccattcctgtatcacgagactgggagctgcttcccagtgctgctgcctctgctgagccacaatccaagaacctggattctgggcactgtgtcccggagcccagctcctcaggccagcgcctgtatcctgaggttttctatggcagtgctgggccttccagttctcagatctctgggggagccatggactctcaattacatccaaacagtggaggcttccgccctgggacaccctcactgcacccttacagatcacagcccctatacctaccccccggcccagcccctccctcagcactgctctctggggtagctctcaagggccagtttctggatttctccacaatgcaagctacagagctggggaagttgccggctggaggagttctctaccctccaccttccttcctctactctccggctttctgccccagtcctttgcctgacacatcgttgcttcaggtacgccaggatctgccatccccttcggatttttattctactcctctgcagcctggtggccaaagtggctttctcccttcaggggctcctgcccagcagatgcttctacccatggtagactcacagctgcctgtggtgaactttggctccctgccgccagcaccacctcctgccccacctcccctttctctgttacctgtgggccctgctctgcagccccccagcctggctgtgcggcccccacctgctcctgctactcgggtgctgccttcacctgccaggcccttccccgctagcttggggcgagcagagctgcatccagtggaactaaagccgttccaggattatcaaaaactgagcagcaaccttgggggacctggatcatcacggactcccccaactggaaggtccttctctggcctcaattcccgtctcaaggccacgccttccacctacagtggagtcttccgcacccagcgcgtcgacctttaccagcaggcctccccaccagatgccctgcgctggatacctaagccttgggagcggacagggccgccacctcgagaagggccctcccgacgggcagaggagcctgggtcccgaggggacaaggagcctgggttgcccccaccccgctgagggagttcctcttgccccctacccccggggcttgtatatagattataaatatataagggggaaaggggtgggcggggaggggttgtggggctggggcctcacttcccctcctcccccttcccctggtcccctgtccctggggctgtttgttaaaaaagagtaataaaaggatttaaaaaaaaaaacaaacacaacaaaaaaccaaaagccaaacacaaaccacaaaaataaaaaaaccatcaatcccacaaaaaaaacaaacacaaccaatag

SEQ ID NO: 314267 - DNA, 2829 bp, Homo sapiens
cgagcacaatgttatcagtcgtccgtgtattcatccttggctgccttatattacatacagagcagtgacttcaccagtgagcgccgaggggacaaagaggcacccccaccagtactgctgacacccaaggctgtgggaactcctgggggaggtggaggtggagccgtaccaggtatttcagccatgtcccgcggagatctgagccagagagccaaggatttgagtaaacggagcttctcaagtcagcggccaggcatggaacggcagaatcggcgccctggcccagggggcaaggctggcagcagtggcagcagcagtggaggaggcggtgggggtcctggaggaaggaccgggccaggacgaggcgacaagaggagctggccctctcccaagaaccgaagtcgtcctccagaggagcgtcccccggggcttcccctgcctcccccacctcccagcagttctgctgtcttccgcctggaccaagttatccacagcaaccctgctggcatccaacaggctctggcccagcttagtagccgtcaagggagtgtaactgcaccagggggtcatccaaggcacaagcctgggcctccccaagcccctcagggcccctctcctaggcccccaacccgatacgagccccagagggtcaacagcggcctcagttctgacccccactttgaggagccggggccaatggtgagaggggtgggtgggactcctcgggactctgccggggttagtccctttccccctaaacgtcgggagcggcctcccagaaaaccagagctgctacaggaggaatctttgccacctcctcatagctctggattcttgggctctaagcctgagggcccaggccctcaggcagagtccagagatacaggcacagaggccctgacccctcacatctggaaccgtttacatactgccactagccgaaagagttaccggcccagctccatggagccttggatggagcccctgagtccttttgaggatgtggctggcacagaaatgagtcagtctgacagtggggtggacctgagtggggattctcaggtgtcatcaggtccctgcagccagcgaagttcccctgatggaggactcaagggggcagcagagggaccccccaagaggcctggaggctcctcacccctgaatgctgttccttgtgagggtccacctggctctgaacctcctaggagaccaccacctgccccccacgatggggacagaaaggagctgccccgggagcagcctctgccccctggccccattggcacagaacgatcacagcgtacagaccgaggcacagagcctggccccattcggccatcccatcgacctggtcccccagtccagtttggcactagtgacaaggactcagacttacgcctagtggtaggagacagcttgaaagcagagaaggagctaacagcatcagtcactgaggccattcctgtatcacgagactgggagctgcttcccagtgctgctgcctctgctgagccacaatccaagaacctggattctgggcactgtgtcccggagcccagctcctcaggccagcgcctgtatcctgaggttttctatggcagtgctgggccttccagttctcagatctctgggggagccatggactctcaattacatccaaacagtggaggcttccgccctgggacaccctcactgcacccttacagatcacagcccctatacctaccccccggcccagcccctccctcagcactgctctctggggtagctctcaagggccagtttctggatttctccacaatgcaagctacagagctggggaagttgccggctggaggagttctctaccctccaccttccttcctctactctccggctttctgccccagtcctttgcctgacacatcgttgcttcaggtacgccaggatctgccatccccttcggatttttattctactcctctgcagcctggtggccaaagtggctttctcccttcaggggctcctgcccagcagatgcttctacccatggtagactcacagctgcctgtggtgaactttggctccctgccgccagcaccacctcctgccccacctcccctttctctgttacctgtgggccctgctctgcagccccccagcctggctgtgcggcccccacctgctcctgctactcgggtgctgccttcacctgccaggcccttccccgctagcttggggcgagcagagctgcatccagtggaactaaagccgttccaggattatcaaaaactgagcagcaaccttgggggacctggatcatcacggactcccccaactggaaggtccttctctggcctcaattcccgtctcaaggccacgccttccacctacagtggagtcttccgcacccagcgcgtcgacctttaccagcaggcctccccaccagatgccctgcgctggatacctaagccttgggagcggacagggccgccacctcgagaagggccctcccgacgggcagaggagcctgggtcccgaggggacaaggagcctgggttgcccccaccccgctgagggagttcctcttgccccctacccccggggcttgtatatagattataaatatataagggggaaaggggtgggcggggaggggttgtggggctggggcctcacttcccctcctcccccttcccctggtcccctgtccctggggctgtttgttaaaaaagagtaataaaaggatttaaaaaaaaaaacaaacacaacaaaaaaccaaaagccaaacacaaaccacaaaaataaaaaaaccatcaatcccacaaaaaaaacaaacacaaccaatag

SEQ ID NO: 314268 - DNA, 7066 bp, Homo sapiens
cgagccggcccggttcgagctgcaggtactcaggtgcgagctgctaactcaggggcgagctgctaactcaggggcgagctgctaactcaggcgcgagctgccaagggaaaggatggaaagaagtattcctcgctcaacctgtttgatacgtataagggcaagtccttagagatccagaaacccgctgttgcccctcgccatggcctgcagagtctcgggaaagttgccattgcccggcgtatgccacctccagccaaccttccaagcctgaaagccgagaacaaaggcaatgaccccaatgtctcactagtgccaaaagacggaacaggatgggcaagcaaacaggagcagtccgaccccaagagttccgatgcctcaaccgctcagccgccggaatcgcagccactgccggcttcacagacgcctgcctccaaccagccgaaacgacccccagcagcccccgagaacactcctttggttccaagcggggtaaagtcctgggcacaagccagcgtcacccatggagcacatggagatggtggaagggcatcaagcctactgtcacgattctctcgagaggaatttccgaccctgcaggcggctggcgaccaggacaaggctgccaaggaaagggagtctgccgaacagtcgtctgggcccggaccaagcctccgcccccaaaattctacaacttggagggacggaggtgggcgtggccctgatgagctggagggcccggactccaaacttcatcatggtcatgatccccggggtgggctacagccttcaggcccaccccagttccctccctaccgcggaatgatgccgcctttcatgtatcccccatatctcccgttccctccgccctatggaccccaggggccttaccgataccccactcctgatgggcccaggtgagcaatccaggtctgggtttgtggctgggggcaggggaagcttattgggggaggagatggttttctagccaggaggctcagtctaggatcagtctcgcatgtggttatacaacatgccatatttcattttcttttttgtgtacagccgttttccccgtgtggcgggcccccgaggctcagggccaccaatgcgcttagtagagcctgtgggtcgtccctctattctcaaagaggataatctcaaagagtttgatcagttggatcaggagaatgatgatggttgggcaggggcccatgaagaggttgactacactgaaaagctcaagttcagcgatgaggaagatgggcgagactctgatgaggagggagctgagggccacagggattcccaatcagcttctggtgaggaacggccccctgaagcagatggcaaaaagggcaactcccccaacagcgaaccgcccactcctaagacggcctgggcagaaacctctcggcctccagagacagagccgggacctcctgccccaaagcctcccctacccccacctcaccggggccccgccgggaactggggcccccctggggactacccagatcgtgggggtcctccctgcaagcccccagcacctgaagatgaggatgaggcatggcggcagcgacgaaagcagtcgtcatctgagatttccctggcagtggagcgggcccggcgacggcgagaagaagaggagcggcgcatgcaagaagagcgccgggcagcctgtgctgagaagctcaagcgactcgatgaaaagtttggggcacctgacaagcggctcaaagcagagcctgctgccccacctgctgccccttctaccccagctccaccacctgcagtccctaaagaactccctgcacctccagctccacctccagcatcagccccaacaccagagaaagaacctgaagagccagcacaggcccctcctgcccaatctactcctactccaggtgtggctgcggctcccactctggtgagtggtggtggcagtaccagtagcaccagcagtggcagcttcgaagccagcccagtggaaccacaactgccctcaaaagagggtcctgaaccaccagaagaggttcctcctcctaccacacccccagttccaaaggtggaacccaagggtgatgggattggtcccacccgccagccccctagtcagggcttgggctaccccaaatatcagaagtcgttgcctcctcgtttccagcggcagcagcaggagcagctcctgaagcagcagcagcagcaccagtggcagcagcatcaacagggctctgcccctcctaccccagtgcccccatcaccaccacagcctgtgaccctgggggctgtgccagctccacaggctccacccccgccccccaaggccctgtacccaggtgctctgggccggcccccacccatgcccccaatgaactttgatccccgatggatgatgattcctccttatgtggacccccggctcctccagggtcgtccccctctagacttctaccctcctggtgtgcatccctctggcctagttccccgagagcgttcagacagtgggggctcaagctcagagccatttgaccgtcatgcacctgctatgttacgggaacggggcactccaccggtggatccaaagttggcctgggtaggagatgtcttcaccgccacacccgctgaaccccgcccacttacctcacctctgcgccaggctgcggatgaggatgacaaggggatgaggagcgagactcctccagtacctcccccaccaccctatctggccagttatccaggctttcctgagaatggagcccctgggcccccaatctctcgctttcctctggaggaaccagggccccgtccactcccctggcccccaggcagtgatgaagtggccaagatacaaactccaccacccaagaaggagccccctaaggaggagactgcacagctgacggggccagaagcaggccgaaagcctgcccgcggagtcgggagtggaggccagggccccccaccaccacgcagagagagtcgcacagagacccgctggggccctcgtccagggagcagtcgtcgtggaatccctccagaggagccaggggccccaccccgccgggctgggcctataaagaaacctccaccacctacaaaagtagaagagctgcctcccaagcccctcgaacagggggatgaaacccccaaacccccaaagccagacccactcaagataaccaaggggaagctagggggccccaaggagaccccacccaatggaaatctttcccctgccccaaggcttcggagggactattcgtatgaaagagtgggtcctacctcttgccggggtcggggccgaggcgagtattttgccagagggaggggttttcgggggacctatgggggacgagggcggggagcccgaagccgggaattccgcagttaccgagagtttcgaggagatgatgggcgtggaggtgggacagggggaccaaaccaccctcctgctccccgaggccgcactgccagcgagacacggagcgagggttcagagtatgaggaaatccccaagcggcgccggcagcggggctcagaaacaggcagcgagacccatgagagtgatctggctccttcagacaaggaggctcccacacccaaggagggaacactcacccaggtccctctcgctcccccaccaccaggagccccaccttcaccagccccagcccgcttcactgcccggggtgggcgagtcttcactcccagaggggtgccatctcgccggggccgaggaggagggaggccccctcctcaagtttgcccaggctggagccctccagccaagtctctggctcccaagaaacctcccacaggccctttgccaccaagtaaggagcctttgaaagagaagttgatcccagggcctctgtcccctgtggcgcgcggaggcagcaatggaggtagcaatgtgggcatggaagatggggagcgaccccgaaggaggcgacatgggagggctcagcagcaggataaaccgcctcgtttccggaggctgaagcaggaacgggagaatgccgcaagggggtctgagggcaagccctccctaacccttccagcctccgctcctggacctgaggaggccctcacaacagtcacagtggccccagcacctcgccgggcagctgccaagtctcctgatctgtcaaaccagaactcagaccaagccaatgaggaatgggagactgcatcagagagcagtgacttcaccagtgagcgccgaggggacaaagaggcacccccaccagtactgctgacacccaaggctgtgggaactcctgggggaggtggaggtggagccgtaccaggtatttcagccatgtcccgcggagatctgagccagagagccaaggatttgagtaaacggagcttctcaagtcagcggccaggcatggaacggcagaatcggcgccctggcccagggggcaaggctggcagcagtggcagcagcagtggaggaggcggtgggggtcctggaggaaggaccgggccaggacgaggcgacaagaggagctggccctctcccaagaaccgaagtcgtcctccagaggagcgtcccccggggcttcccctgcctcccccacctcccagcagttctgctgtcttccgcctggaccaagttatccacagcaaccctgctggcatccaacaggctctggcccagcttagtagccgtcaagggagtgtaactgcaccagggggtcatccaaggcacaagcctgggcctccccaagcccctcagggcccctctcctaggcccccaacccgatacgagccccagagggtcaacagcggcctcagttctgacccccactttgaggagccggggccaatggtgagaggggtgggtgggactcctcgggactctgccggggttagtccctttccccctaaacgtcgggagcggcctcccagaaaaccagagctgctacaggaggaatctttgccacctcctcatagctctggattcttgggctctaagcctgagggcccaggccctcaggcagagtccagagatacaggcacagaggccctgacccctcacatctggaaccgtttacatactgccactagccgaaagagttaccggcccagctccatggagccttggatggagcccctgagtccttttgaggatgtggctggcacagaaatgagtcagtctgacagtggggtggacctgagtggggattctcaggtgtcatcaggtccctgcagccagcgaagttcccctgatggaggactcaagggggcagcagagggaccccccaagaggcctggaggctcctcacccctgaatgctgttccttgtgagggtccacctggctctgaacctcctaggagaccaccacctgccccccacgatggggacagaaaggagctgccccgggagcagcctctgccccctggccccattggcacagaacgatcacagcgtacagaccgaggcacagagcctggccccattcggccatcccatcgacctggtcccccagtccagtttggcactagtgacaaggactcagacttacgcctagtggtaggagacagcttgaaagcagagaaggagctaacagcatcagtcactgaggccattcctgtatcacgagactgggagctgcttcccagtgctgctgcctctgctgagccacaatccaagaacctggattctgggcactgtgtcccggagcccagctcctcaggccagcgcctgtatcctgaggttttctatggcagtgctgggccttccagttctcagatctctgggggagccatggactctcaattacatccaaacagtggaggcttccgccctgggacaccctcactgcacccttacagatcacagcccctatacctaccccccggcccagcccctccctcagcactgctctctggggtagctctcaagggccagtttctggatttctccacaatgcaagctacagagctggggaagttgccggctggaggagttctctaccctccaccttccttcctctactctccggctttctgccccagtcctttgcctgacacatcgttgcttcaggtacgccaggatctgccatccccttcggatttttattctactcctctgcagcctggtggccaaagtggctttctcccttcaggggctcctgcccagcagatgcttctacccatggtagactcacagctgcctgtggtgaactttggctccctgccgccagcaccacctcctgccccacctcccctttctctgttacctgtgggccctgctctgcagccccccagcctggctgtgcggcccccacctgctcctgctactcgggtgctgccttcacctgccaggcccttccccgctagcttggggcgagcagaggtaaggtacaggaactgaggggctagggagcgccaagacttgggagtagggattctgtatttcaaggtaggcagctcatgatttttttcccctcagctgcatccagtggaactaaagccgttccaggattatcaaaaactgagcagcaaccttgggggacctggatcatcacggactcccccaactggaaggtccttctctggcctcaattcccgtctcaaggccacgccttccacctacagtggagtcttccgcacccagcgcgtcgacctttaccagcaggcctccccaccagatgccctgcgctggatacctaagccttgggagcggacagggccgccacctcgagaagggccctcccgacgggcagaggagcctgggtcccgaggggacaaggagcctgggttgcccccaccccgctgagggagttcctcttgccccctacccccggggcttgtatatagattataaatatataagggggaaaggggtgggcggggaggggttgtggggctggggcctcacttcccctcctcccccttcccctggtcccctgtccctggggctgtttgttaaaaaagagtaataaaaggatttaaaaaaaaaaacaaacacaacaaaaaaccaaaagccaaacacaaaccacaaaaataaaaaaaccatcaatcccacaaaaaaaacaaacacaaccaatag

SEQ ID NO: 314269 - DNA, 2677 bp, Homo sapiens
agtcgtaaaaaacaaatagggctagtcgaggcctggggttacgagtcttactcccagagccaaggatttgagtaaacggagcttctcaagtcagcggccaggcatggaacggcagaatcggcgccctggcccagggggcaaggctggcagcagtggcagcagcagtggaggaggcggtgggggtcctggaggaaggaccgggccaggacgaggcgacaagaggagctggccctctcccaagaaccgaagtcgtcctccagaggagcgtcccccggggcttcccctgcctcccccacctcccagcagttctgctgtcttccgcctggaccaagttatccacagcaaccctgctggcatccaacaggctctggcccagcttagtagccgtcaagggagtgtaactgcaccagggggtcatccaaggcacaagcctgggcctccccaagcccctcagggcccctctcctaggcccccaacccgatacgagccccagagggtcaacagcggcctcagttctgacccccactttgaggagccggggccaatggtgagaggggtgggtgggactcctcgggactctgccggggttagtccctttccccctaaacgtcgggagcggcctcccagaaaaccagagctgctacaggaggaatctttgccacctcctcatagctctggattcttgggctctaagcctgagggcccaggccctcaggcagagtccagagatacaggcacagaggccctgacccctcacatctggaaccgtttacatactgccactagccgaaagagttaccggcccagctccatggagccttggatggagcccctgagtccttttgaggatgtggctggcacagaaatgagtcagtctgacagtggggtggacctgagtggggattctcaggtgtcatcaggtccctgcagccagcgaagttcccctgatggaggactcaagggggcagcagagggaccccccaagaggcctggaggctcctcacccctgaatgctgttccttgtgagggtccacctggctctgaacctcctaggagaccaccacctgccccccacgatggggacagaaaggagctgccccgggagcagcctctgccccctggccccattggcacagaacgatcacagcgtacagaccgaggcacagagcctggccccattcggccatcccatcgacctggtcccccagtccagtttggcactagtgacaaggactcagacttacgcctagtggtaggagacagcttgaaagcagagaaggagctaacagcatcagtcactgaggccattcctgtatcacgagactgggagctgcttcccagtgctgctgcctctgctgagccacaatccaagaacctggattctgggcactgtgtcccggagcccagctcctcaggccagcgcctgtatcctgaggttttctatggcagtgctgggccttccagttctcagatctctgggggagccatggactctcaattacatccaaacagtggaggcttccgccctgggacaccctcactgcacccttacagatcacagcccctatacctaccccccggcccagcccctccctcagcactgctctctggggtagctctcaagggccagtttctggatttctccacaatgcaagctacagagctggggaagttgccggctggaggagttctctaccctccaccttccttcctctactctccggctttctgccccagtcctttgcctgacacatcgttgcttcaggtacgccaggatctgccatccccttcggatttttattctactcctctgcagcctggtggccaaagtggctttctcccttcaggggctcctgcccagcagatgcttctacccatggtagactcacagctgcctgtggtgaactttggctccctgccgccagcaccacctcctgccccacctcccctttctctgttacctgtgggccctgctctgcagccccccagcctggctgtgcggcccccacctgctcctgctactcgggtgctgccttcacctgccaggcccttccccgctagcttggggcgagcagagctgcatccagtggaactaaagccgttccaggattatcaaaaactgagcagcaaccttgggggacctggatcatcacggactcccccaactggaaggtccttctctggcctcaattcccgtctcaaggccacgccttccacctacagtggagtcttccgcacccagcgcgtcgacctttaccagcaggcctccccaccagatgccctgcgctggatacctaagccttgggagcggacagggccgccacctcgagaagggccctcccgacgggcagaggagcctgggtcccgaggggacaaggagcctgggttgcccccaccccgctgagggagttcctcttgccccctacccccggggcttgtatatagattataaatatataagggggaaaggggtgggcggggaggggttgtggggctggggcctcacttcccctcctcccccttcccctggtcccctgtccctggggctgtttgttaaaaaagagtaataaaaggatttaaaaaaaaaaacaaacacaacaaaaaaccaaaagccaaacacaaaccacaaaaataaaaaaaccatcaatcccacaaaaaaaacaaacacaaccaatag

SEQ ID NO: 314270 - DNA, 6988 bp, Homo sapiens
cgagccggcccggttcgagctgcaggtactcaggtgcgagctgctaactcaggggcgagctgctaactcaggggcgagctgctaactcaggcgcgagctgccaagggaaaggatggaaagaagtattcctcgctcaacctgtttgatacgtataagggcaagtccttagagatccagaaacccgctgttgcccctcgccatggcctgcagagtctcgggaaagttgccattgcccggcgtatgccacctccagccaaccttccaagcctgaaagccgagaacaaaggcaatgaccccaatgtctcactagtgccaaaagacggaacaggatgggcaagcaaacaggagcagtccgaccccaagagttccgatgcctcaaccgctcagccgccggaatcgcagccactgccggcttcacagacgcctgcctccaaccagccgaaacgacccccagcagcccccgagaacactcctttggttccaagcggggtaaagtcctgggcacaagccagcgtcacccatggagcacatggagatggtggaagggcatcaagcctactgtcacgattctctcgagaggaatttccgaccctgcaggcggctggcgaccaggacaaggctgccaaggaaagggagtctgccgaacagtcgtctgggcccggaccaagcctccgcccccaaaattctacaacttggagggacggaggtgggcgtggccctgatgagctggagggcccggactccaaacttcatcatggtcatgatccccggggtgggctacagccttcaggcccaccccagttccctccctaccgcggaatgatgccgcctttcatgtatcccccatatctcccgttccctccgccctatggaccccaggggccttaccgataccccactcctgatgggcccaggtgagcaatccaggtctgggtttgtggctgggggcaggggaagcttattgggggaggagatggttttctagccaggaggctcagtctaggatcagtctcgcatgtggttatacaacatgccatatttcattttcttttttgtgtacagccgttttccccgtgtggcgggcccccgaggctcagggccaccaatgcgcttagtagagcctgtgggtcgtccctctattctcaaagaggataatctcaaagagtttgatcagttggatcaggagaatgatgatggttgggcaggggcccatgaagaggttgactacactgaaaagctcaagttcagcgatgaggaagatgggcgagactctgatgaggagggagctgagggccacagggattcccaatcagcttctggtgaggaacggccccctgaagcagatggcaaaaagggcaactcccccaacagcgaaccgcccactcctaagacggcctgggcagaaacctctcggcctccagagacagagccgggacctcctgccccaaagcctcccctacccccacctcaccggggccccgccgggaactggggcccccctggggactacccagatcgtgggggtcctccctgcaagcccccagcacctgaagatgaggatgaggcatggcggcagcgacgaaagcagtcgtcatctgagatttccctggcagtggagcgggcccggcgacggcgagaagaagaggagcggcgcatgcaagaagagcgccgggcagcctgtgctgagaagctcaagcgactcgatgaaaagtttggggcacctgacaagcggctcaaagcagagcctgctgccccacctgctgccccttctaccccagctccaccacctgcagtccctaaagaactccctgcacctccagctccacctccagcatcagccccaacaccagagaaagaacctgaagagccagcacaggcccctcctgcccaatctactcctactccaggtgtggctgcggctcccactctggtgagtggtggtggcagtaccagtagcaccagcagtggcagcttcgaagccagcccagtggaaccacaactgccctcaaaagagggtcctgaaccaccagaagaggttcctcctcctaccacacccccagttccaaaggtggaacccaagggtgatgggattggtcccacccgccagccccctagtcagggcttgggctaccccaaatatcagaagtcgttgcctcctcgtttccagcggcagcagcaggagcagctcctgaagcagcagcagcagcaccagtggcagcagcatcaacagggctctgcccctcctaccccagtgcccccatcaccaccacagcctgtgaccctgggggctgtgccagctccacaggctccacccccgccccccaaggccctgtacccaggtgctctgggccggcccccacccatgcccccaatgaactttgatccccgatggatgatgattcctccttatgtggacccccggctcctccagggtcgtccccctctagacttctaccctcctggtgtgcatccctctggcctagttccccgagagcgttcagacagtgggggctcaagctcagagccatttgaccgtcatgcacctgctatgttacgggaacggggcactccaccggtggatccaaagttggcctgggtaggagatgtcttcaccgccacacccgctgaaccccgcccacttacctcacctctgcgccaggctgcggatgaggatgacaaggggatgaggagcgagactcctccagtacctcccccaccaccctatctggccagttatccaggctttcctgagaatggagcccctgggcccccaatctctcgctttcctctggaggaaccagggccccgtccactcccctggcccccaggcagtgatgaagtggccaagatacaaactccaccacccaagaaggagccccctaaggaggagactgcacagctgacggggccagaagcaggccgaaagcctgcccgcggagtcgggagtggaggccagggccccccaccaccacgcagagagagtcgcacagagacccgctggggccctcgtccagggagcagtcgtcgtggaatccctccagaggagccaggggccccaccccgccgggctgggcctataaagaaacctccaccacctacaaaagtagaagagctgcctcccaagcccctcgaacagggggatgaaacccccaaacccccaaagccagacccactcaagataaccaaggggaagctagggggccccaaggagaccccacccaatggaaatctttcccctgccccaaggcttcggagggactattcgtatgaaagagtgggtcctacctcttgccggggtcggggccgaggcgagtattttgccagagggaggggttttcgggggacctatgggggacgagggcggggagcccgaagccgggaattccgcagttaccgagagtttcgaggagatgatgggcgtggaggtgggacagggggaccaaaccaccctcctgctccccgaggccgcactgccagcgagacacggagcgagggttcagagtatgaggaaatccccaagcggcgccggcagcggggctcagaaacaggcagcgagacccatgagagtgatctggctccttcagacaaggaggctcccacacccaaggagggaacactcacccaggtccctctcgctcccccaccaccaggagccccaccttcaccagccccagcccgcttcactgcccggggtgggcgagtcttcactcccagaggggtgccatctcgccggggccgaggaggagggaggccccctcctcaagtttgcccaggctggagccctccagccaagtctctggctcccaagaaacctcccacaggccctttgccaccaagtaaggagcctttgaaagagaagttgatcccagggcctctgtcccctgtggcgcgcggaggcagcaatggaggtagcaatgtgggcatggaagatggggagcgaccccgaaggaggcgacatgggagggctcagcagcaggataaaccgcctcgtttccggaggctgaagcaggaacgggagaatgccgcaagggggtctgagggcaagccctccctaacccttccagcctccgctcctggacctgaggaggccctcacaacagtcacagtggccccagcacctcgccgggcagctgccaagtctcctgatctgtcaaaccagaactcagaccaagccaatgaggaatgggagactgcatcagagagcagtgacttcaccagtgagcgccgaggggacaaagaggcacccccaccagtactgctgacacccaaggctgtgggaactcctgggggaggtggaggtggagccgtaccaggtatttcagccatgtcccgcggagatctgagccagagagccaaggatttgagtaaacggagcttctcaagtcagcggccaggcatggaacggcagaatcggcgccctggcccagggggcaaggctggcagcagtggcagcagcagtggaggaggcggtgggggtcctggaggaaggaccgggccaggacgaggcgacaagaggagctggccctctcccaagaaccgaagtcgtcctccagaggagcgtcccccggggcttcccctgcctcccccacctcccagcagttctgctgtcttccgcctggaccaagttatccacagcaaccctgctggcatccaacaggctctggcccagcttagtagccgtcaagggagtgtaactgcaccagggggtcatccaaggcacaagcctgggcctccccaagcccctcagggcccctctcctaggcccccaacccgatacgagccccagagggtcaacagcggcctcagttctgacccccactttgaggagccggggccaatggtgagaggggtgggtgggactcctcgggactctgccggggttagtccctttccccctaaacgtcgggagcggcctcccagaaaaccagagctgctacaggaggaatctttgccacctcctcatagctctggattcttgggctctaagcctgagggcccaggccctcaggcagagtccagagatacaggcacagaggccctgacccctcacatctggaaccgtttacatactgccactagccgaaagagttaccggcccagctccatggagccttggatggagcccctgagtccttttgaggatgtggctggcacagaaatgagtcagtctgacagtggggtggacctgagtggggattctcaggtgtcatcaggtccctgcagccagcgaagttcccctgatggaggactcaagggggcagcagagggaccccccaagaggcctggaggctcctcacccctgaatgctgttccttgtgagggtccacctggctctgaacctcctaggagaccaccacctgccccccacgatggggacagaaaggagctgccccgggagcagcctctgccccctggccccattggcacagaacgatcacagcgtacagaccgaggcacagagcctggccccattcggccatcccatcgacctggtcccccagtccagtttggcactagtgacaaggactcagacttacgcctagtggtaggagacagcttgaaagcagagaaggagctaacagcatcagtcactgaggccattcctgtatcacgagactgggagctgcttcccagtgctgctgcctctgctgagccacaatccaagaacctggattctgggcactgtgtcccggagcccagctcctcaggccagcgcctgtatcctgaggttttctatggcagtgctgggccttccagttctcagatctctgggggagccatggactctcaattacatccaaacagtggaggcttccgccctgggacaccctcactgcacccttacagatcacagcccctatacctaccccccggcccagcccctccctcagcactgctctctggggtagctctcaagggccagtttctggatttctccacaatgcaagctacagagctggggaagttgccggctggaggagttctctaccctccaccttccttcctctactctccggctttctgccccagtcctttgcctgacacatcgttgcttcaggtacgccaggatctgccatccccttcggatttttattctactcctctgcagcctggtggccaaagtggctttctcccttcaggggctcctgcccagcagatgcttctacccatggtagactcacagctgcctgtggtgaactttggctccctgccgccagcaccacctcctgccccacctcccctttctctgttacctgtgggccctgctctgcagccccccagcctggctgtgcggcccccacctgctcctgctactcgggtgctgccttcacctgccaggcccttccccgctagcttggggcgagcagagctgcatccagtggaactaaagccgttccaggattatcaaaaactgagcagcaaccttgggggacctggatcatcacggactcccccaactggaagacgcccttcttcccttaggtccttctctggcctcaattcccgtctcaaggccacgccttccacctacagtggagtcttccgcacccagcgcgtcgacctttaccagcaggcctccccaccagatgccctgcgctggatacctaagccttgggagcggacagggccgccacctcgagaagggccctcccgacgggcagaggagcctgggtcccgaggggacaaggagcctgggttgcccccaccccgctgagggagttcctcttgccccctacccccggggcttgtatatagattataaatatataagggggaaaggggtgggcggggaggggttgtggggctggggcctcacttcccctcctcccccttcccctggtcccctgtccctggggctgtttgttaaaaaagagtaataaaaggatttaaaaaaaaaaacaaacacaacaaaaaaccaaaagccaaacacaaaccacaaaaataaaaaaaccatcaatcccacaaaaaaaacaaacacaaccaatag

SEQ ID NO: 314271 - DNA, 7163 bp, Homo sapiens
cgagccggcccggttcgagctgcaggtactcaggtgcgagctgctaactcaggggcgagctgctaactcaggggcgagctgctaactcaggcgcgagctgccaagggaaaggatggaaagaagtattcctcgctcaacctgtttgatacgtataagggcaagtccttagagatccagaaacccgctgttgcccctcgccatggcctgcagagtctcgggaaagttgccattgcccggcgtatgccacctccagccaaccttccaagcctgaaagccgagaacaaaggcaatgaccccaatgtctcactagtgccaaaagacggaacaggatgggcaagcaaacaggagcagtccgaccccaagagttccgatgcctcaaccgctcagccgccggaatcgcagccactgccggcttcacagacgcctgcctccaaccagccgaaacgacccccagcagcccccgagaacactcctttggttccaagcggggtaaagtcctgggcacaagccagcgtcacccatggagcacatggagatggtggaagggcatcaagcctactgtcacgattctctcgagaggaatttccgaccctgcaggcggctggcgaccaggacaaggctgccaaggaaagggagtctgccgaacagtcgtctgggcccggaccaagcctccgcccccaaaattctacaacttggagggacggaggtgggcgtggccctgatgagctggagggcccggactccaaacttcatcatggtcatgatccccggggtgggctacagccttcaggcccaccccagttccctccctaccgcggaatgatgccgcctttcatgtatcccccatatctcccgttccctccgccctatggaccccaggggccttaccgataccccactcctgatgggcccaggtgagcaatccaggtctgggtttgtggctgggggcaggggaagcttattgggggaggagatggttttctagccaggaggctcagtctaggatcagtctcgcatgtggttatacaacatgccatatttcattttcttttttgtgtacagccgttttccccgtgtggcgggcccccgaggctcagggccaccaatgcgcttagtagagcctgtgggtcgtccctctattctcaaagaggataatctcaaagagtttgatcagttggatcaggagaatgatgatggttgggcaggggcccatgaagaggttgactacactgaaaagctcaagttcagcgatgaggaagatgggcgagactctgatgaggagggagctgagggccacagggattcccaatcagcttctggtgaggaacggccccctgaagcagatggcaaaaagggcaactcccccaacagcgaaccgcccactcctaagacggcctgggcagaaacctctcggcctccagagacagagccgggacctcctgccccaaagcctcccctacccccacctcaccggggccccgccgggaactggggcccccctggggactacccagatcgtgggggtcctccctgcaagcccccagcacctgaagatgaggatgaggcatggcggcagcgacgaaagcagtcgtcatctgagatttccctggcagtggagcgggcccggcgacggcgagaagaagaggagcggcgcatgcaagaagagcgccgggcagcctgtgctgagaagctcaagcgactcgatgaaaagtttggggcacctgacaagcggctcaaagcagagcctgctgccccacctgctgccccttctaccccagctccaccacctgcagtccctaaagaactccctgcacctccagctccacctccagcatcagccccaacaccagagaaagaacctgaagagccagcacaggcccctcctgcccaatctactcctactccaggtgtggctgcggctcccactctggtgagtggtggtggcagtaccagtagcaccagcagtggcagcttcgaagccagcccagtggaaccacaactgccctcaaaagagggtcctgaaccaccagaagaggttcctcctcctaccacacccccagttccaaaggtggaacccaagggtgatgggattggtcccacccgccagccccctagtcagggcttgggctaccccaaatatcagaagtcgttgcctcctcgtttccagcggcagcagcaggagcagctcctgaagcagcagcagcagcaccagtggcagcagcatcaacagggctctgcccctcctaccccagtgcccccatcaccaccacagcctgtgaccctgggggctgtgccagctccacaggctccacccccgccccccaaggccctgtacccaggtgctctgggccggcccccacccatgcccccaatgaactttgatccccgatggatgatgattcctccttatgtggacccccggctcctccagggtcgtccccctctagacttctaccctcctggtgtgcatccctctggcctagttccccgagagcgttcagacagtgggggctcaagctcagagccatttgaccgtcatgcacctgctatgttacgggaacggggcactccaccggtggatccaaagttggcctgggtaggagatgtcttcaccgccacacccgctgaaccccgcccacttacctcacctctgcgccaggctgcggatgaggatgacaaggggatgaggagcgagactcctccagtacctcccccaccaccctatctggccagttatccaggctttcctgagaatggagcccctgggcccccaatctctcgctttcctctggaggaaccagggccccgtccactcccctggcccccaggcagtgatgaagtggccaagatacaaactccaccacccaagaaggagccccctaaggaggagactgcacagctgacggggccagaagcaggccgaaagcctgcccgcggagtcgggagtggaggccagggccccccaccaccacgcagagagagtcgcacagagacccgctggggccctcgtccagggagcagtcgtcgtggaatccctccagaggagccaggggccccaccccgccgggctgggcctataaagaaacctccaccacctacaaaagtagaagagctgcctcccaagcccctcgaacagggggatgaaacccccaaacccccaaagccagacccactcaagataaccaaggggaagctagggggccccaaggagaccccacccaatggaaatctttcccctgccccaaggcttcggagggactattcgtatgaaagagtgggtcctacctcttgccggggtcggggccgaggcgagtattttgccagagggaggggttttcgggggacctatgggggacgagggcggggagcccgaagccgggaattccgcagttaccgagagtttcgaggagatgatgggcgtggaggtgggacagggggaccaaaccaccctcctgctccccgaggccgcactgccagcgagacacggagcgagggttcagagtatgaggaaatccccaagcggcgccggcagcggggctcagaaacaggcagcgagacccatgagagtgatctggctccttcagacaaggaggctcccacacccaaggagggaacactcacccaggtccctctcgctcccccaccaccaggagccccaccttcaccagccccagcccgcttcactgcccggggtgggcgagtcttcactcccagaggggtgccatctcgccggggccgaggaggagggaggccccctcctcaagtttgcccaggctggagccctccagccaagtctctggctcccaagaaacctcccacaggccctttgccaccaagtaaggagcctttgaaagagaagttgatcccagggcctctgtcccctgtggcgcgcggaggcagcaatggaggtagcaatgtgggcatggaagatggggagcgaccccgaaggaggcgacatgggagggctcagcagcaggataaaccgcctcgtttccggaggctgaagcaggaacgggagaatgccgcaagggggtctgagggcaagccctccctaacccttccagcctccgctcctggacctgaggaggccctcacaacagtcacagtggccccagcacctcgccgggcagctgccaagtctcctgatctgtcaaaccagaactcagaccaagccaatgaggaatgggagactgcatcagagagcagtgacttcaccagtgagcgccgaggggacaaagaggcacccccaccagtactgctgacacccaaggctgtgggaactcctgggggaggtggaggtggagccgtaccaggtatttcagccatgtcccgcggagatctgagccagagagccaaggatttgagtaaacggagcttctcaagtcagcggccaggcatggaacggcagaatcggcgccctggcccagggggcaaggctggcagcagtggcagcagcagtggaggaggcggtgggggtcctggaggaaggaccgggccaggacgaggcgacaagaggagctggccctctcccaagaaccgaagtcgtcctccagaggagcgtcccccggggcttcccctgcctcccccacctcccagcagttctgctgtcttccgcctggaccaagttatccacagcaaccctgctggcatccaacaggctctggcccagcttagtagccgtcaagggagtgtaactgcaccagggggtcatccaaggcacaagcctgggcctccccaagcccctcagggcccctctcctaggcccccaacccgatacgagccccagagggtcaacagcggcctcagttctgacccccactttgaggagccggggccaatggtgagaggggtgggtgggactcctcgggactctgccggggttagtccctttccccctaaacgtcgggagcggcctcccagaaaaccagagctgctacaggaggaatctttgccacctcctcatagctctggattcttgggctctaagcctgagggcccaggccctcaggcagagtccagagatacaggcacagaggccctgacccctcacatctggaaccgtttacatactgccactagccgaaagagttaccggcccagctccatggagccttggatggagcccctgagtccttttgaggatgtggctggcacagaaatgagtcagtctgacagtggggtggacctgagtggggattctcaggtgtcatcaggtccctgcagccagcgaagttcccctgatggaggactcaagggggcagcagagggaccccccaagaggcctggaggctcctcacccctgaatgctgttccttgtgagggtccacctggctctgaacctcctaggagaccaccacctgccccccacgatggggacagaaaggagctgccccgggagcagcctctgccccctggccccattggcacagaacgatcacagcgtacagaccgaggcacagagcctggccccattcggccatcccatcgacctggtcccccagtccagtttggcactagtgacaaggactcagacttacgcctagtggtaggagacagcttgaaagcagagaaggagctaacagcatcagtcactgaggccattcctgtatcacgagactgggagctgcttcccagtgctgctgcctctgctgagccacaatccaagaacctggattctgggcactgtgtcccggagcccagctcctcaggccagcgcctgtatcctgaggttttctatggcagtgctgggccttccagttctcagatctctgggggagccatggactctcaattacatccaaacagtggaggcttccgccctgggacaccctcactgcacccttacagatcacagcccctatacctaccccccggcccagcccctccctcagcactgctctctggggtagctctcaagggccagtttctggatttctccacaatgcaagctacagagctggggaagttgccggctggaggagttctctaccctccaccttccttcctctactctccggctttctgccccagtcctttgcctgacacatcgttgcttcaggtacgccaggatctgccatccccttcggatttttattctactcctctgcagcctggtggccaaagtggctttctcccttcaggggctcctgcccagcagatgcttctacccatggtagactcacagctgcctgtggtgaactttggctccctgccgccagcaccacctcctgccccacctcccctttctctgttacctgtgggccctgctctgcagccccccagcctggctgtgcggcccccacctgctcctgctactcgggtgctgccttcacctgccaggcccttccccgctagcttggggcgagcagaggtaaggtacaggaactgaggggctagggagcgccaagacttgggagtagggattctgtatttcaaggtaggcagctcatgatttttttcccctcagctgcatccagtggaactaaagccgttccaggattatcaaaaactgagcagcaaccttgggggacctggatcatcacggactcccccaactggaaggtgaaacggaatagggatgtggactttccaagtgcttccttactttggaaccagggtctggatcctaggcttgccttagacgcccttcttcccttaggtccttctctggcctcaattcccgtctcaaggccacgccttccacctacagtggagtcttccgcacccagcgcgtcgacctttaccagcaggcctccccaccagatgccctgcgctggatacctaagccttgggagcggacagggccgccacctcgagaagggccctcccgacgggcagaggagcctgggtcccgaggggacaaggagcctgggttgcccccaccccgctgagggagttcctcttgccccctacccccggggcttgtatatagattataaatatataagggggaaaggggtgggcggggaggggttgtggggctggggcctcacttcccctcctcccccttcccctggtcccctgtccctggggctgtttgttaaaaaagagtaataaaaggatttaaaaaaaaaaacaaacacaacaaaaaaccaaaagccaaacacaaaccacaaaaataaaaaaaccatcaatcccacaaaaaaaacaaacacaaccaatag

SEQ ID NO: 314272 - DNA, 5713 bp, Homo sapiens
cgagccggcccggttcgagctgcaggtactcaggtgcgagctgctaactcaggggcgagctgctaactcaggggcgagctgctaactcaggcgcgagctgccaagggaaaggatggaaagaagtattcctcgctcaacctgtttgatacgtataagggcaagtccttagagatccagaaacccgctgttgcccctcgccatggcctgcagagtctcgggaaagttgccattgcccggcgtatgccacctccagccaaccttccaagcctgaaagccgagaacaaaggcaatgaccccaatgtctcactagtgccaaaagacggaacaggatgggcaagcaaacaggagcagtccgaccccaagagttccgatgcctcaaccgctcagccgccggaatcgcagccactgccggcttcacagacgcctgcctccaaccagccgaaacgacccccagcagcccccgagaacactcctttggttccaagcggggtaaagtcctgggcacaagccagcgtcacccatggagcacatggagatggtggaagggcatcaagcctactgtcacgattctctcgagaggaatttccgaccctgcaggcggctggcgaccaggacaaggctgccaaggaaagggagtctgccgaacagtcgtctgggcccggaccaagcctccgcccccaaaattctacaacttggagggacggaggtgggcgtggccctgatgagctggagggcccggactccaaacttcatcatggtcatgatccccggggtgggctacagccttcaggcccaccccagttccctccctaccgcggaatgatgccgcctttcatgtatcccccatatctcccgttccctccgccctatggaccccaggggccttaccgataccccactcctgatgggcccaggtgagcaatccaggtctgggtttgtggctgggggcaggggaagcttattgggggaggagatggttttctagccaggaggctcagtctaggatcagtctcgcatgtggttatacaacatgccatatttcattttcttttttgtgtacagccgttttccccgtgtggcgggcccccgaggctcagggccaccaatgcgcttagtagagcctgtgggtcgtccctctattctcaaagaggataatctcaaagagtttgatcagttggatcaggagaatgatgatggttgggcaggggcccatgaagaggttgactacactgaaaagctcaagttcagcgatgaggaagatgggcgagactctgatgaggagggagctgagggccacagggattcccaatcagcttctggtgaggaacggccccctgaagcagatggcaaaaagggcaactcccccaacagcgaaccgcccactcctaagacggcctgggcagaaacctctcggcctccagagacagagccgggacctcctgccccaaagcctcccctacccccacctcaccggggccccgccgggaactggggcccccctggggactacccagatcgtgggggtcctccctgcaagcccccagcacctgaagatgaggatgaggcatggcggcagcgacgaaagcagtcgtcatctgagatttccctggcagtggagcgggcccggcgacggcgagaagaagaggagcggcgcatgcaagaagagcgccgggcagcctgtgctgagaagctcaagcgactcgatgaaaagtttggggcacctgacaagcggctcaaagcagagcctgctgccccacctgctgccccttctaccccagctccaccacctgcagtccctaaagaactccctgcacctccagctccacctccagcatcagccccaacaccagagaaagaacctgaagagccagcacaggcccctcctgcccaatctactcctactccaggtgtggctgcggctcccactctggtgagtggtggtggcagtaccagtagcaccagcagtggcagcttcgaagccagcccagtggaaccacaactgccctcaaaagagggtcctgaaccaccagaagaggttcctcctcctaccacacccccagttccaaaggtggaacccaagggtgatgggattggtcccacccgccagccccctagtcagggcttgggctaccccaaatatcagaagtcgttgcctcctcgtttccagcggcagcagcaggagcagctcctgaagcagcagcagcagcaccagtggcagcagcatcaacagggctctgcccctcctaccccagtgcccccatcaccaccacagcctgtgaccctgggggctgtgccagctccacaggctccacccccgccccccaaggccctgtacccaggtgctctgggccggcccccacccatgcccccaatgaactttgatccccgatggatgatgattcctccttatgtggacccccggctcctccagggtcgtccccctctagacttctaccctcctggtgtgcatccctctggcctagttccccgagagcgttcagacagtgggggctcaagctcagagccatttgaccgtcatgcacctgctatgttacgggaacggggcactccaccggtggatccaaagttggcctgggtaggagatgtcttcaccgccacacccgctgaaccccgcccacttacctcacctctgcgccaggctgcggatgaggatgacaaggggatgaggagcgagactcctccagtacctcccccaccaccctatctggccagttatccaggctttcctgagaatggagcccctgggcccccaatctctcgctttcctctggaggaaccagggccccgtccactcccctggcccccaggcagtgatgaagtggccaagatacaaactccaccacccaagaaggagccccctaaggaggagactgcacagctgacggggccagaagcaggccgaaagcctgcccgcggagtcgggagtggaggccagggccccccaccaccacgcagagagagtcgcacagagacccgctggggccctcgtccagggagcagtcgtcgtggaatccctccagaggagccaggggccccaccccgccgggctgggcctataaagaaacctccaccacctacaaaagtagaagagctgcctcccaagcccctcgaacagggggatgaaacccccaaacccccaaagccagacccactcaagataaccaaggggaagctagggggccccaaggagaccccacccaatggaaatctttcccctgccccaaggcttcggagggactattcgtatgaaagagtgggtcctacctcttgccggggtcggggccgaggcgagtattttgccagagggaggggttttcgggggacctatgggggacgagggcggggagcccgaagccgggaattccgcagttaccgagagtttcgaggagatgatgggcgtggaggtgggacagggggaccaaaccaccctcctgctccccgaggccgcactgccagcgagacacggagcgagggttcagagtatgaggaaatccccaagcggcgccggcagcggggctcagaaacaggcagcgagacccatgagagtgatctggctccttcagacaaggaggctcccacacccaaggagggaacactcacccaggtccctctcgctcccccaccaccaggagccccaccttcaccagccccagcccgcttcactgcccggggtgggcgagtcttcactcccagaggggtgccatctcgccggggccgaggaggagggaggccccctcctcaagtttgcccaggctggagccctccagccaagtctctggctcccaagaaacctcccacaggccctttgccaccaagtaaggagcctttgaaagagaagttgatgcccctgagtccttttgaggatgtggctggcacagaaatgagtcagtctgacagtggggtggacctgagtggggattctcaggtgtcatcaggtccctgcagccagcgaagttcccctgatggaggactcaagggggcagcagagggaccccccaagaggcctggaggctcctcacccctgaatgctgttccttgtgagggtccacctggctctgaacctcctaggagaccaccacctgccccccacgatggggacagaaaggagctgccccgggagcagcctctgccccctggccccattggcacagaacgatcacagcgtacagaccgaggcacagagcctggccccattcggccatcccatcgacctggtcccccagtccagtttggcactagtgacaaggactcagacttacgcctagtggtaggagacagcttgaaagcagagaaggagctaacagcatcagtcactgaggccattcctgtatcacgagactgggagctgcttcccagtgctgctgcctctgctgagccacaatccaagaacctggattctgggcactgtgtcccggagcccagctcctcaggccagcgcctgtatcctgaggttttctatggcagtgctgggccttccagttctcagatctctgggggagccatggactctcaattacatccaaacagtggaggcttccgccctgggacaccctcactgcacccttacagatcacagcccctatacctaccccccggcccagcccctccctcagcactgctctctggggtagctctcaagggccagtttctggatttctccacaatgcaagctacagagctggggaagttgccggctggaggagttctctaccctccaccttccttcctctactctccggctttctgccccagtcctttgcctgacacatcgttgcttcaggtacgccaggatctgccatccccttcggatttttattctactcctctgcagcctggtggccaaagtggctttctcccttcaggggctcctgcccagcagatgcttctacccatggtagactcacagctgcctgtggtgaactttggctccctgccgccagcaccacctcctgccccacctcccctttctctgttacctgtgggccctgctctgcagccccccagcctggctgtgcggcccccacctgctcctgctactcgggtgctgccttcacctgccaggcccttccccgctagcttggggcgagcagagctgcatccagtggaactaaagccgttccaggattatcaaaaactgagcagcaaccttgggggacctggatcatcacggactcccccaactggaaggtccttctctggcctcaattcccgtctcaaggccacgccttccacctacagtggagtcttccgcacccagcgcgtcgacctttaccagcaggcctccccaccagatgccctgcgctggatacctaagccttgggagcggacagggccgccacctcgagaagggccctcccgacgggcagaggagcctgggtcccgaggggacaaggagcctgggttgcccccaccccgctgagggagttcctcttgccccctacccccggggcttgtatatagattataaatatataagggggaaaggggtgggcggggaggggttgtggggctggggcctcacttcccctcctcccccttcccctggtcccctgtccctggggctgtttgttaaaaaagagtaataaaaggatttaaaaaaaaaaacaaacacaacaaaaaaccaaaagccaaacacaaaccacaaaaataaaaaaaccatcaatcccacaaaaaaaacaaacacaaccaatag

SEQ ID NO: 314273 - DNA, 4335 bp, Homo sapiens
cgagccggcccggttcgagctgcaggtactcaggtgcgagctgctaactcaggggcgagctgctaactcaggggcgagctgctaactcaggcgcgagctgccaagggaaaggatggaaagaagtattcctcgctcaacctgtttgatacgtataagggcaagtccttagagatccagaaacccgctgttgcccctcgccatggcctgcagagtctcgggaaagttgccattgcccggcgtatgccacctccagccaaccttccaagcctgaaagccgagaacaaaggcaatgaccccaatgtctcactagtgccaaaagacggaacaggatgggcaagcaaacaggagcagtccgaccccaagagttccgatgcctcaaccgctcagccgccggaatcgcagccactgccggcttcacagacgcctgcctccaaccagccgaaacgacccccagcagcccccgagaacactcctttggttccaagcggggtaaagtcctgggcacaagccagcgtcacccatggagcacatggagatggtggaagggcatcaagcctactgtcacgattctctcgagaggaatttccgaccctgcaggcggctggcgaccaggacaaggctgccaaggaaagggagtctgccgaacagtcgtctgggcccggaccaagcctccgcccccaaaattctacaacttggagggacggaggtgggcgtggccctgatgagctggagggcccggactccaaacttcatcatggtcatgatccccggggtgggctacagccttcaggcccaccccagttccctccctaccgcggaatgatgccgcctttcatgtatcccccatatctcccgttccctccgccctatggaccccaggggccttaccgataccccactcctgatgggcccaggtgagcaatccaggtctgggtttgtggctgggggcaggggaagcttattgggggaggagatggttttctagccaggaggctcagtctaggatcagtctcgcatgtggttatacaacatgccatatttcattttcttttttgtgtacagccgttttccccgtgtggcgggcccccgaggctcagggccaccaatgcgcttagtagagcctgtgggtcgtccctctattctcaaagaggataatctcaaagagtttgatcagttggatcaggagaatgatgatggttgggcaggggcccatgaagaggttgactacactgaaaagctcaagttcagcgatgaggaagatgggcgagactctgatgaggagggagctgagggccacagggattcccaatcagcttctggtgaggaacggccccctgaagcagatggcaaaaagggcaactcccccaacagcgaaccgcccactcctaagacggcctgggcagaaacctctcggcctccagagacagagccgggacctcctgccccaaagcctcccctacccccacctcaccggggccccgccgggaactggggcccccctggggactacccagatcgtgggggtcctccctgcaagcccccagcacctgaagatgaggatgaggcatggcggcagcgacgaaagcagtcgtcatctgagatttccctggcagtggagcgggcccggcgacggcgagaagaagaggagcggcgcatgcaagaagagcgccgggcagcctgtgctgagaagctcaagcgactcgatgaaaagtttggggcacctgacaagcggctcaaagcagagcctgctgccccacctgctgccccttctaccccagctccaccacctgcagtccctaaagaactccctgcacctccagctccacctccagcatcagccccaacaccagagaaagaacctgaagagccagcacaggcccctcctgcccaatctactcctactccaggtgtggctgcggctcccactctggtgagtggtggtggcagtaccagtagcaccagcagtggcagcttcgaagccagcccagtggaaccacaactgccctcaaaagagggtcctgaaccaccagaagaggttcctcctcctaccacacccccagttccaaaggtggaacccaagggtgatgggattggtcccacccgccagccccctagtcagggcttgggctaccccaaatatcagaagtcgttgcctcctcgtttccagcggcagcagcaggagcagctcctgaagcagcagcagcagcaccagtggcagcagcatcaacagggctctgcccctcctaccccagtgcccccatcaccaccacagcctgtgaccctgggggctgtgccagctccacaggctccacccccgccccccaaggccctgtacccaggtgctctgggccggcccccacccatgcccccaatgaactttgatccccgatggatgatgattcctccttatgtggacccccggctcctccagggtcgtccccctctagacttctaccctcctggtgtgcatccctctggcctagttccccgagagcgttcagacagtgggggctcaagctcagagccatttgaccgtcatgcacctgctatgttacgggaacggggcactccaccggtggatccaaagttggcctgggtaggagatgtcttcaccgccacacccgctgaaccccgcccacttacctcacctctgcgccaggctgcggatgaggatgacaaggggatgaggagcgagactcctccagtacctcccccaccaccctatctggccagttatccaggctttcctgagaatggagcccctgggcccccaatctctcgctttcctctggaggaaccagggccccgtccactcccctggcccccaggcagtgatgaagtggccaagatacaaactccaccacccaagaaggagccccctaaggaggagactgcacagctgacggggccagaagcaggccgaaagcctgcccgcggagtcgggagtggaggccagggccccccaccaccacgcagagggtcaacagcggcctcagttctgacccccactttgaggagccggggccaatggtgagaggggtgggtgggactcctcgggactctgccggggttagtccctttccccctaaacgtcgggagcggcctcccagaaaaccagagctgctacaggaggaatctttgccacctcctcatagctctggattcttgggctctaagcctgagggcccaggccctcaggcagagtccagagatacaggcacagaggccctgacccctcacatctggaaccgtttacatactgtctctggggtagctctcaagggccagtttctggatttctccacaatgcaagctacagagctggggaagttgccggctggaggagttctctaccctccaccttccttcctctactctccggctttctgccccagtcctttgcctgacacatcgttgcttcaggtacgccaggatctgccatccccttcggatttttattctactcctctgcagcctggtggccaaagtggctttctcccttcaggggctcctgcccagcagatgcttctacccatggtagactcacagctgcctgtggtgaactttggctccctgccgccagcaccacctcctgccccacctcccctttctctgttacctgtgggccctgctctgcagccccccagcctggctgtgcggcccccacctgctcctgctactcgggtgctgccttcacctgccaggcccttccccgctagcttggggcgagcagagctgcatccagtggaactaaagccgttccaggattatcaaaaactgagcagcaaccttgggggacctggatcatcacggactcccccaactggaaggtccttctctggcctcaattcccgtctcaaggccacgccttccacctacagtggagtcttccgcacccagcgcgtcgacctttaccagcaggcctccccaccagatgccctgcgctggatacctaagccttgggagcggacagggccgccacctcgagaagggccctcccgacgggcagaggagcctgggtcccgaggggacaaggagcctgggttgcccccaccccgctgagggagttcctcttgccccctacccccggggcttgtatatagattataaatatataagggggaaaggggtgggcggggaggggttgtggggctggggcctcacttcccctcctcccccttcccctggtcccctgtccctggggctgtttgttaaaaaagagtaataaaaggatttaaaaaaaaaaacaaacacaacaaaaaaccaaaagccaaacacaaaccacaaaaataaaaaaaccatcaatcccacaaaaaaaacaaacacaaccaatag

SEQ ID NO: 314274 - DNA, 1131 bp, Homo sapiens
tgtgcccttttagatcacagaggacctcagctccaaagaagtcaaggatgtctatcagtctctggggtagctctcaagggccagtttctggatttctccacaatgcaagctacagagctggggaagttgccggctggaggagttctctaccctccaccttccttcctctactctccggctttctgccccagtcctttgcctgacacatcgttgcttcaggtacgccaggatctgccatccccttcggatttttattctactcctctgcagcctggtggccaaagtggctttctcccttcaggggctcctgcccagcagatgcttctacccatggtagactcacagctgcctgtggtgaactttggctccctgccgccagcaccacctcctgccccacctcccctttctctgttacctgtgggccctgctctgcagccccccagcctggctgtgcggcccccacctgctcctgctactcgggtgctgccttcacctgccaggcccttccccgctagcttggggcgagcagagctgcatccagtggaactaaagccgttccaggattatcaaaaactgagcagcaaccttgggggacctggatcatcacggactcccccaactggaaggtccttctctggcctcaattcccgtctcaaggccacgccttccacctacagtggagtcttccgcacccagcgcgtcgacctttaccagcaggcctccccaccagatgccctgcgctggatacctaagccttgggagcggacagggccgccacctcgagaagggccctcccgacgggcagaggagcctgggtcccgaggggacaaggagcctgggttgcccccaccccgctgagggagttcctcttgccccctacccccggggcttgtatatagattataaatatataagggggaaaggggtgggcggggaggggttgtggggctggggcctcacttcccctcctcccccttcccctggtcccctgtccctggggctgtttgttaaaaaagagtaataaaaggatttaaaaaaaaaaacaaacacaacaaaaaaccaaaagccaaacacaaaccacaaaaataaaaaaaccatcaatcccacaaaaaaaacaaacacaaccaatag

SEQ ID NO: 314275 - DNA, 5254 bp, Homo sapiens
cgagccggcccggttcgagctgcaggtactcaggtgcgagctgctaactcaggggcgagctgctaactcaggggcgagctgctaactcaggcgcgagctgccaagggaaaggatggaaagaagtattcctcgctcaacctgtttgatacgtataagggcaagtccttagagatccagaaacccgctgttgcccctcgccatggcctgcagagtctcgggaaagttgccattgcccggcgtatgccacctccagccaaccttccaagcctgaaagccgagaacaaaggcaatgaccccaatgtctcactagtgccaaaagacggaacaggatgggcaagcaaacaggagcagtccgaccccaagagttccgatgcctcaaccgctcagccgccggaatcgcagccactgccggcttcacagacgcctgcctccaaccagccgaaacgacccccagcagcccccgagaacactcctttggttccaagcggggtaaagtcctgggcacaagccagcgtcacccatggagcacatggagatggtggaagggcatcaagcctactgtcacgattctctcgagaggaatttccgaccctgcaggcggctggcgaccaggacaaggctgccaaggaaagggagtctgccgaacagtcgtctgggcccggaccaagcctccgcccccaaaattctacaacttggagggacggaggtgggcgtggccctgatgagctggagggcccggactccaaacttcatcatggtcatgatccccggggtgggctacagccttcaggcccaccccagttccctccctaccgcggaatgatgccgcctttcatgtatcccccatatctcccgttccctccgccctatggaccccaggggccttaccgataccccactcctgatgggcccaggtgagcaatccaggtctgggtttgtggctgggggcaggggaagcttattgggggaggagatggttttctagccaggaggctcagtctaggatcagtctcgcatgtggttatacaacatgccatatttcattttcttttttgtgtacagccgttttccccgtgtggcgggcccccgaggctcagggccaccaatgcgcttagtagagcctgtgggtcgtccctctattctcaaagaggataatctcaaagagtttgatcagttggatcaggagaatgatgatggttgggcaggggcccatgaagaggttgactacactgaaaagctcaagttcagcgatgaggaagatgggcgagactctgatgaggagggagctgagggccacagggattcccaatcagcttctggtgaggaacggccccctgaagcagatggcaaaaagggcaactcccccaacagcgaaccgcccactcctaagacggcctgggcagaaacctctcggcctccagagacagagccgggacctcctgccccaaagcctcccctacccccacctcaccggggccccgccgggaactggggcccccctggggactacccagatcgtgggggtcctccctgcaagcccccagcacctgaagatgaggatgaggcatggcggcagcgacgaaagcagtcgtcatctgagatttccctggcagtggagcgggcccggcgacggcgagaagaagaggagcggcgcatgcaagaagagcgccgggcagcctgtgctgagaagctcaagcgactcgatgaaaagtttggggcacctgacaagcggctcaaagcagagcctgctgccccacctgctgccccttctaccccagctccaccacctgcagtccctaaagaactccctgcacctccagctccacctccagcatcagccccaacaccagagaaagaacctgaagagccagcacaggcccctcctgcccaatctactcctactccaggtgtggctgcggctcccactctggtgagtggtggtggcagtaccagtagcaccagcagtggcagcttcgaagccagcccagtggaaccacaactgccctcaaaagagggtcctgaaccaccagaagaggttcctcctcctaccacacccccagttccaaaggtggaacccaagggtgatgggattggtcccacccgccagccccctagtcagggcttgggctaccccaaatatcagaagtcgttgcctcctcgtttccagcggcagcagcaggagcagctcctgaagcagcagcagcagcaccagtggcagcagcatcaacagggctctgcccctcctaccccagtgcccccatcaccaccacagcctgtgaccctgggggctgtgccagctccacaggctccacccccgccccccaaggccctgtacccaggtgctctgggccggcccccacccatgcccccaatgaactttgatccccgatggatgatgattcctccttatgtggacccccggctcctccagggtcgtccccctctagacttctaccctcctggtgtgcatccctctggcctagttccccgagagcgttcagacagtgggggctcaagctcagagccatttgaccgtcatgcacctgctatgttacgggaacggggcactccaccggtggatccaaagttggcctgggtaggagatgtcttcaccgccacacccgctgaaccccgcccacttacctcacctctgcgccaggctgcggatgaggatgacaaggggatgaggagcgagactcctccagtacctcccccaccaccctatctggccagttatccaggctttcctgagaatggagcccctgggcccccaatctctcgctttcctctggaggaaccagggccccgtccactcccctggcccccaggcagtgatgaagtggccaagatacaaactccaccacccaagaaggagccccctaaggaggagactgcacagctgacggggccagaagcaggccgaaagcctgcccgcggagtcgggagtggaggccagggccccccaccaccacgcagagagagtcgcacagagacccgctggggccctcgtccagggagcagtcgtcgtggaatccctccagaggagccaggggccccaccccgccgggctgggcctataaagaaacctccaccacctacaaaagtagaagagctgcctcccaagcccctcgaacagggggatgaaacccccaaacccccaaagccagacccactcaagataaccaaggggaagctagggggccccaaggagaccccacccaatggaaatctttcccctgccccaaggcttcggagggactattcgtatgaaagagtgggtcctacctcttgccggggtcggggccgaggcgagtattttgccagagggaggggttttcgggggacctatgggggacgagggcggggagcccgaagccgggaattccgcagttaccgagagtttcgaggagatgatgggcgtggaggtgggacagggggaccaaaccaccctcctgctccccgaggccgcactgccagcgagacacggagcgagggttcagagtatgaggaaatccccaagcggcgccggcagcggggctcagaaacaggcagcgagacccatgagagtgatctggctccttcagacaaggaggctcccacacccaaggagggaacactcacccaggtccctctcgctcccccaccaccaggagccccaccttcaccagccccagcccgcttcactgcccggggtgggcgagtcttcactcccagaggggtgccatctcgccggggccgaggaggagggaggccccctcctcaagtttgcccaggctggagccctccagccaagtctctggctcccaagaaacctcccacaggccctttgccaccaagtaaggagcctttgaaagagaagttgatcccagggcctctgtcccctgtggcgcgcggaggcagcaatggaggtagcaatgtgggcatggaagatggggagcgaccccgaaggaggcgacatgggagggctcagcagcaggataaaccgcctcgtttccggaggctgaagcaggaacgggagaatgccgcaagggggtctgagggcaagccctccctaacccttccagcctccgctcctggacctgaggaggccctcacaacagtcacagtggccccagcacctcgccgggcagctgccaagtctcctgatctgtcaaaccagaactcagaccaagccaatgaggaatgggagactgcatcagagagcagtgacttcaccagtgagcgccgaggggacaaagaggcacccccaccagtactgctgacacccaaggctgtgggaactcctgggggaggtggaggtggagccgtaccaggtatttcagccatgtcccgcggagatctgagccagagagccaaggatttgagtaaacggagcttctcaagtcagcggccaggcatggaacggcagaatcggcgccctggcccagggggcaaggctggcagcagtggcagcagcagtggaggaggcggtgggggtcctggaggaaggaccgggccaggacgaggcgacaagaggagctggccctctcccaagaaccgaagtcgtcctccagaggagcgtcccccggggcttcccctgcctcccccacctcccagcagttctgctgtcttccgcctggaccaagttatccacagcaaccctgctggcatccaacaggctctggcccagcttagtagccgtcaagggagtgtaactgcaccagggggtcatccaaggcacaagcctgggcctccccaagcccctcagggcccctctcctaggcccccaacccgatacgagccccagagggtcaacagcggcctcagttctgacccccactttgaggagccggggccaatggtgagaggggtgggtgggactcctcgggactctgccggggttagtccctttccccctaaacgtcgggagcggcctcccagaaaaccagagctgctacaggaggaatctttgccacctcctcatagctctggattcttgggctctaagcctgagggcccaggccctcaggcagagtccagagatacaggcacagaggccctgacccctcacatctggaaccgtttacatactgccactagccgaaagagttaccggcccagctccatctccaccaccctcagatttgaacagcggtagcaccacctcctctccaggtcttcagccccacgtccctccctgaacaatcccttctcatgaaattcagcagtcaagaaatctgcagcggaagtaaatgaataaatgttttgttttcca

SEQ ID NO: 314276 - DNA, 2300 bp, Homo sapiens
cgagccggcccggttcgagctgcaggtactcaggtgcgagctgctaactcaggggcgagctgctaactcaggggcgagctgctaactcaggcgcgagctgccaagggaaaggatggaaagaagtattcctcgctcaacctgtttgatacgtataagggcaagtccttagagatccagaaacccgctgttgcccctcgccatggcctgcagagtctcgggaaagttgccattgcccggcgtatgccacctccagccaaccttccaagcctgaaagccgagaacaaaggcaatgaccccaatgtctcactagtgccaaaagacggaacaggatgggcaagcaaacaggagcagtccgaccccaagagttccgatgcctcaaccgctcagccgccggaatcgcagccactgccggcttcacagacgcctgcctccaaccagccgaaacgacccccagcagcccccgagaacactcctttggttccaagcggggtaaagtcctgggcacaagccagcgtcacccatggagcacatggagatggtggaagggcatcaagcctactgtcacgattctctcgagaggaatttccgaccctgcaggcggctggcgaccaggacaaggctgccaaggaaagggagtctgccgaacagtcgtctgggcccggaccaagcctccgcccccaaaattctacaacttggagggacggaggtgggcgtggccctgatgagctggagggcccggactccaaacttcatcatggtcatgatccccggggtgggctacagccttcaggcccaccccagttccctccctaccgcggaatgatgccgcctttcatgtatcccccatatctcccgttccctccgccctatggaccccaggggccttaccgataccccactcctgatgggcccaggtgagcaatccaggtctgggtttgtggctgggggcaggggaagcttattgggggaggagatggttttctagccaggaggctcagtctaggatcagtctcgcatgtggttatacaacatgccatatttcattttcttttttgtgtacagccgttttccccgtgtggcgggcccccgaggctcagggccaccaatgcgcttagtagagcctgtgggtcgtccctctattctcaaagaggataatctcaaagagtttgatcagttggatcaggagaatgatgatggttgggcaggggcccatgaagaggttgactacactgaaaagctcaagttcagcgatgaggaagatgggcgagactctgatgaggagggagctgagggccacagggattcccaatcagcttctggtgaggaacggccccctgaagcagatggcaaaaagggcaactcccccaacagcgaaccgcccactcctaagacggcctgggcagaaacctctcggcctccagagacagagccgggacctcctgccccaaagcctcccctacccccacctcaccggggccccgccgggaactggggcccccctggggactacccagatcgtgggggtcctccctgcaagcccccagcacctgaagatgaggatgaggcatggcggcagcgacgaaagcagtcgtcatctgagatttccctggcagtggagcgggcccggcgacggcgagaagaagaggagcggcgcatgcaagaagagcgccgggcagcctgtgctgagaagctcaagcgactcgatgaaaagtttggggcacctgacaagcggctcaaagcagagcctgctgccccacctgctgccccttctaccccagctccaccacctgcagtccctaaagaactccctgcacctccagctccacctccagcatcagccccaacaccagagaaagaacctgaagagccagcacaggcccctcctgcccaatctactcctactccaggtgtggctgcggctcccactctggtgagtggtggtggcagtaccagtagcaccagcagtggcagcttcgaagccagcccagtggaaccacaactgccctcaaaagagggtcctgaaccaccagaagaggttcctcctcctaccaccggggcttgtatatagattataaatatataagggggaaaggggtgggcggggaggggttgtggggctggggcctcacttcccctcctcccccttcccctggtcccctgtccctggggctgtttgttaaaaaagagtaataaaaggatttaaaaaaaaaaacaaacacaacaaaaaaccaaaagccaaacacaaaccacaaaaataaaaaaaccatcaatcccacaaaaaaaacaaacacaaccaatag

SEQ ID NO: 314277 - DNA, 2161 bp, Homo sapiens
cgagccggcccggttcgagctgcaggtactcaggtgcgagctgctaactcaggggcgagctgctaactcaggggcgagctgctaactcaggcgcgagctgccaagggaaaggatggaaagaagtattcctcgctcaacctgtttgatacgtataagggcaagtccttagagatccagaaacccgctgttgcccctcgccatggcctgcagagtctcgggaaagttgccattgcccggcgtatgccacctccagccaaccttccaagcctgaaagccgagaacaaaggcaatgaccccaatgtctcactagtgccaaaagacggaacaggatgggcaagcaaacaggagcagtccgaccccaagagttccgatgcctcaaccgctcagccgccggaatcgcagccactgccggcttcacagacgcctgcctccaaccagccgaaacgacccccagcagcccccgagaacactcctttggttccaagcggggtaaagtcctgggcacaagccagcgtcacccatggagcacatggagatggtggaagggcatcaagcctactgtcacgattctctcgagaggaatttccgaccctgcaggcggctggcgaccaggacaaggctgccaaggaaagggagtctgccgaacagtcgtctgggcccggaccaagcctccgcccccaaaattctacaacttggagggacggaggtgggcgtggccctgatgagctggagggcccggactccaaacttcatcatggtcatgatccccggggtgggctacagccttcaggcccaccccagttccctccctaccgcggaatgatgccgcctttcatgtatcccccatatctcccgttccctccgccctatggaccccaggggccttaccgataccccactcctgatgggcccaggtgagcaatccaggtctgggtttgtggctgggggcaggggaagcttattgggggaggagatggttttctagccaggaggctcagtctaggatcagtctcgcatgtggttatacaacatgccatatttcattttcttttttgtgtacagccgttttccccgtgtggcgggcccccgaggctcagggccaccaatgcgcttagtagagcctgtgggtcgtccctctattctcaaagaggataatctcaaagagtttgatcagttggatcaggagaatgatgatggttgggcaggggcccatgaagaggttgactacactgaaaagctcaagttcagcgatgaggaagatgggcgagactctgatgaggagggagctgagggccacagggattcccaatcagcttctggtgaggaacggccccctgaagcagatggcaaaaagggcaactcccccaacagcgaaccgcccactcctaagacggcctgggcagaaacctctcggcctccagagacagagccgggacctcctgccccaaagcctcccctacccccacctcaccggggccccgccgggaactggggcccccctggggactacccagatcgtgggggtcctccctgcaagcccccagcacctgaagatgaggatgaggcatggcggcagcgacgaaagcagtcgtcatctgagatttccctggcagtggagcgggcccggcgacggcgagaagaagaggagcggcgcatgcaagaagagcgccgggcagcctgtgctgagaagctcaagcgactcgatgaaaagtttggggcacctgacaagcggctcaaagcagagcctgctgccccacctgctgccccttctaccccagctccaccacctgcagtccctaaagaactccctgcacctccagctccacctccagcatcagccccaacaccagagaaagaacctgaagagccagcacaggcccctcctgcccaatctactcctactccaggtgtggctgcggctcccactctggtgagtggtggtggcagtaccagtagcaccagcagtggcagcttcgaagccagcccaggtatggagatggggataggtactaccagatgtcagatcactgcttcaaggtgcttaaaggtgcagggtggtaaggctggggataaatgaagtagaaggcagttgttttggtttattggactatcagtgatagtgttctatcatttgtatatctgaaggagggaaggttttgtc

SEQ ID NO: 314278 - DNA, 492 bp, Homo sapiens
gttccccgagagcgttcagacagtgggggctcaagctcagagccatttgaccgtcatgcacctgctatgttacgggaacggggcactccaccggtggatccaaagttggcctgggtaggagatgtcttcaccgccacacccgctgaaccccgcccacttacctcacctctgcgccaggctgcggatgaggatgacaaggggatgaggtgagtcttggtcatgagaaatgggtgagttcacagtgaaaggatctaggcctgggagaaaggtactttgggttagtggtagggatagggatgaacgggaaaggagaggctggatggagtggctcatgcctgtaatcccagcattttgggaggctgaggcaagaagattgcttgagcccagcagttcgagactagcctcggcaactggatgccatctctgccaaaacaaacagaaaaatagtaaaagagagtctgcatcataataaagtgttcttttcccacctag

SEQ ID NO: 314279 - DNA, 2704 bp, Homo sapiens
  misc_feature (307)..(307): n is a, c, g, or t
  misc_feature (761)..(761): n is a, c, g, or t
  misc_feature (845)..(845): n is a, c, g, or t
  misc_feature (2079)..(2079): n is a, c, g, or t
ggatgtttaatggggatgtggagattcattgtactgtttctatatttttgtggatgttgaaaaatattttcttcttttttttttttgagatggagtctccctctattgcccaggctggagtgcagttgtgcaatctctgttcactgcaacctccgcctcccgggttcaagtggttctcctgcctcagcctcccaagtagctgggactacaggcatgtgccaccatgcctggctaacttttgcatctttagtagagatggggttttaccatgttggccaggctggtatcgaactcctgaccttgtganccgcccaccttggcttcccaaagtactggaattacaggcataagccaccacacccggccgaaaaatatatttaaaaaggtaagaaacacacaagacaagcagcttggacttatcttctccatgatacctacccagtatccctgtgagcagctgacattcctttctccaagcagttgctgtattttgaacattgctcgagcaagaaactttttataatgggtttatttatccatgtcacctgctatactatgtttattgtagctcagcatgatttccaggtaccaagcacagtacttggtgtgtaatagtgctaactgaatgttggatggatggagggattaaaaaaaagaaaaacacctgaatatcagacacttaataaatgtttcttgggaggccgagatgggcggatcacgaggtcagaagttcgagaccagcctggccaacatggtaaaangccgtctctactaaaaatacaaaaattagctaggtgtggtggcaggcacctgtaatccccactgctcaggaggctgaggcaggngaatcacttgagcccgggaggcagaggttgcagtgagccgagatcacgccattgcactccagcctgggtgacagagcaagactctgtctcaaaaaaaataaaaaataaaataaataaatgttttctgaactgtattctctatctgttcttagttaatttgtgtttgccatttttaaagtcaaaaaccagggagagttctctacacaatgtaaatatttgataagtacttattaattgcttattgtgctagtctattctttaaatatcagaggttccaaaacaaagagctccaatagtaggatcacagtcaggtaaccaattatccgagtaggaaggttgccttagttgaagtaactggaggtgaatggggatttgtcaggcaggctcttccagataaaggtgaaccttccctgttgttttgatagaaggaggaaatggaatgaccatcaagagaaaggtagttgctggcttgagaggatcatctgtgcaacaggcagctaagcagaagaagactttatatatatttttaataccacccacactgttgctagtattccccaccactccattggcctggtgaactcttattcatccttcaaaacccagcttaaccatggccttcaggaaatcttgagctggcttcccaggacagagtgggtcagtcctctgcatgctcctgctgctgtgctgtactcaccatactgtactgtaatttactggtttgtaagtcatttccactgctgggttgtgagctcctccaaggcaggggctttgccttatctgcctatgttcccaggacttacacagtgcctgatgtgtagtaggtaccccatgaatgttttacataattagcaggagcgtatcaggtaaattagcaaagcaaactgtgggatgtgggatgtcagacaataggagtaggtgggcttatgggagctgaagagcacatgctcctcagctctgattgattgctctgtgcgataggggcccagtggtggtggatctaacaactttttaagagattctgacaattcagactttacatgttgaatattccggattttcaacattagcaactaattccatttggaggaaaaaatgtagcatgggtctacagacaagatctggctgtaattcatgttcagaggtaatcaggaaacgattagtttactgaaaatgtagtcgacaatcaaatggctgctaggttgccaataaaatgtgttgagtggaattcacntgccccagaaagctcctcctggtgctgtgggcaaggaagagggcccaagtgtgggaagaaggattcaggaggcagagccaactctcccagtgctgccggagccactcttgcttgagctgaagtactgtggactgttttgcagccttcttgatattgctcaaactgagccacccttgatattgtgcctatcagaatgatggattaaatgttattgtttccttatattccataggcatcagatatcaactgtcattgtgaaacatattacaatgtaagagatttgatattgtcctaacagctttagtctctggtggctttactgagctcttctggtttagaggtgaaacaacccagagaaaggatttatttatgtattcgtttttggtctgaagaccaaaaaggatgtttgcaagatattaacagtaatcattcattcaacaactgtttttaaagcacctgctgtacgatacctgctacagatacagtgatggtgaaagtatagttgtctcagtgttattatagaagcttttactctgtattttcctcgatttctattttctgtactgatcatgcataattttttacaatcattaaaaaaacaagaaagcaatgtctttttgcaaaa

SEQ ID NO: 314280 - DNA, 2494 bp, Homo sapiens
  misc_feature (97)..(97): n is a, c, g, or t
  misc_feature (551)..(551): n is a, c, g, or t
  misc_feature (635)..(635): n is a, c, g, or t
  misc_feature (1869)..(1869): n is a, c, g, or t
ggtgtgtaatagtgctaactgaatgttggatggatggagggattaaaaaaaagaaaaacacctgaatatcagacacttaataaatgtttcttgtganccgcccaccttggcttcccaaagtactggaattacaggcataagccaccacacccggccgaaaaatatatttaaaaaggtaagaaacacacaagacaagcagcttggacttatcttctccatgatacctacccagtatccctgtgagcagctgacattcctttctccaagcagttgctgtattttgaacattgctcgagcaagaaactttttataatgggtttatttatccatgtcacctgctatactatgtttattgtagctcagcatgatttccaggtaccaagcacagtacttggtgtgtaatagtgctaactgaatgttggatggatggagggattaaaaaaaagaaaaacacctgaatatcagacacttaataaatgtttcttgggaggccgagatgggcggatcacgaggtcagaagttcgagaccagcctggccaacatggtaaaangccgtctctactaaaaatacaaaaattagctaggtgtggtggcaggcacctgtaatccccactgctcaggaggctgaggcaggngaatcacttgagcccgggaggcagaggttgcagtgagccgagatcacgccattgcactccagcctgggtgacagagcaagactctgtctcaaaaaaaataaaaaataaaataaataaatgttttctgaactgtattctctatctgttcttagttaatttgtgtttgccatttttaaagtcaaaaaccagggagagttctctacacaatgtaaatatttgataagtacttattaattgcttattgtgctagtctattctttaaatatcagaggttccaaaacaaagagctccaatagtaggatcacagtcaggtaaccaattatccgagtaggaaggttgccttagttgaagtaactggaggtgaatggggatttgtcaggcaggctcttccagataaaggtgaaccttccctgttgttttgatagaaggaggaaatggaatgaccatcaagagaaaggtagttgctggcttgagaggatcatctgtgcaacaggcagctaagcagaagaagactttatatatatttttaataccacccacactgttgctagtattccccaccactccattggcctggtgaactcttattcatccttcaaaacccagcttaaccatggccttcaggaaatcttgagctggcttcccaggacagagtgggtcagtcctctgcatgctcctgctgctgtgctgtactcaccatactgtactgtaatttactggtttgtaagtcatttccactgctgggttgtgagctcctccaaggcaggggctttgccttatctgcctatgttcccaggacttacacagtgcctgatgtgtagtaggtaccccatgaatgttttacataattagcaggagcgtatcaggtaaattagcaaagcaaactgtgggatgtgggatgtcagacaataggagtaggtgggcttatgggagctgaagagcacatgctcctcagctctgattgattgctctgtgcgataggggcccagtggtggtggatctaacaactttttaagagattctgacaattcagactttacatgttgaatattccggattttcaacattagcaactaattccatttggaggaaaaaatgtagcatgggtctacagacaagatctggctgtaattcatgttcagaggtaatcaggaaacgattagtttactgaaaatgtagtcgacaatcaaatggctgctaggttgccaataaaatgtgttgagtggaattcacntgccccagaaagctcctcctggtgctgtgggcaaggaagagggcccaagtgtgggaagaaggattcaggaggcagagccaactctcccagtgctgccggagccactcttgcttgagctgaagtactgtggactgttttgcagccttcttgatattgctcaaactgagccacccttgatattgtgcctatcagaatgatggattaaatgttattgtttccttatattccataggcatcagatatcaactgtcattgtgaaacatattacaatgtaagagatttgatattgtcctaacagctttagtctctggtggctttactgagctcttctggtttagaggtgaaacaacccagagaaaggatttatttatgtattcgtttttggtctgaagaccaaaaaggatgtttgcaagatattaacagtaatcattcattcaacaactgtttttaaagcacctgctgtacgatacctgctacagatacagtgatggtgaaagtatagttgtctcagtgttattatagaagcttttactctgtattttcctcgatttctattttctgtactgatcatgcataattttttacaatcattaaaaaaacaagaaagcaatgtctttttgcaaaa

SEQ ID NO: 314281 - DNA, 2064 bp, Homo sapiens
gcgcctgcgcgctgtgtcctgcgcgctccttccctcgcgcgcgctctccgtggaagagcaggggcagcgtgggaggcgccaagggagcgcgaacctgaggaggaagaaacggggctagcgcgcaggcccagaacggtccgagccgcggcagtcggcgacgcctcagagcggaagagggaagtgaatcaggcgccgggtagtgggttgctgggctgggcttgctgaggtagaggcagcgccaagaagaggcctttgccgctggtcgggattgggatgtcgaagaacacagtgtcgtcggcccgcttccggaaggtggacgtggatgaatatgacgagaacaagttcgtggacgaagaagatgggggcgacggccaggccgggcccgacgagggcgaggtggactcctgcctgcggcaaggaaacatgacagctgccctacaggcagctctgaagaacccccctatcaacaccaagagtcaggcagtgaaggaccgggcaggcagcattgtcttgaaggtgctcatctcttttaaagctaatgatatagaaaaggcagttcaatctctggacaagaatggtgtggatctcctaatgaagtatatttataaaggatttgagagcccgtctgacaatagcagtgctatgttactgcaatggcatgaaaaggcacttgctgctggaggagtagggtccattgttcgtgtcttgactgcaagaaaaactgtgtagtctggcaggaagtggattatctgcctcgggagtgggaattgctggtacaaagaccaaaacaaccaaatgccaccgctgccctgtgggtagcatctgtttctctcagctttgccttcttgctttttcatatctgtaaagaaaaaaattacatatcagttgtcctttaatgaaaattgggataatatagaagaaattgtgttaaaatagaagtgtttcatcctttcaaaaccatttcagtgatgtttataccaatctgtatatagtataatttacattcaagtttaattgtgcaacttttaacccctgttggctggttttttgttctgttttgttttgtattatttttaactaatactgagagatttggtcagaatttgaggccagtttcctagctcattgctagtcaggaaatgatatttataaaaaatatgagagactggcagctattaacattgcaaaactggaccatatttcccttatttaataagcaaaatatgtttttggaataagtggtgggtgaataccactgctaagttatagctttgtttttgcttgcctcctgattatctgtactgtgggtttaagtatgctactttctctcagcatccaataatcatggcccctcaatttatttgtggtcacccagggttcagagcaagaagtcttgctttatacaaatgtatccataaaatatcagagcttgttgggcatgaacatcaaacttttgttccactaatatggctctgtttggaaaaaactgcaaatcagaaagaatgatttgcagaaagaaagaaaaactatggtgtaatttaaactctgggcagcctctgaatgaaatgctactttctttagaaatataatagctgccttagacattatgaggtatacaactagtatttaagataccatttaatatgccccgtaaatgtcttcagtgttcttcagggtagttgggatctcaaaagatttggttcagatccaaacaaatacacattctgtgttttagctcagtgttttctaaaaaaagaaactgccacacagcaaaaaattgtttactttgttggacaaaccaaatcagttctcaaaaaatgaccggtgcttataaaaagttataaatatcgagtagctctaaaacaaaccacctgaccaagagggaagtgagcttgtgcttagtatttacattggatgccagttttgtaatcactgacttatgtgcaaactggtgcagaaattctataaactctttgctgtttttgatacctgctttttgtttcattttgttttgttttgtaaaaatgataaaacttcagaaaataaaatgtcagtgttgaataa

SEQ ID NO: 314282 - DNA, 951 bp, Homo sapiens
  misc_feature (939)..(939): n is a, c, g, or t
  misc_feature (945)..(945): n is a, c, g, or t
gcgcctgcgcgctgtgtcctgcgcgctccttccctcgcgcgcgctctccgtggaagagcaggggcagcgtgggaggcgccaagggagcgcgaacctgaggaggaagaaacggggctagcgcgcaggcccagaacggtccgagccgcggcagtcggcgacgcctcagagcggaagagggaagtgaatcaggcgccgggtagtgggttgctgggctgggcttgctgaggtagaggcagcgccaagaagaggcctttgccgctggtcgggattgggatgtcgaagaacacagtgtcgtcggcccgcttccggaaggtggacgtggatgaatatgacgagaacaagttcgtggacgaagaagatgggggcgacggccaggccgggcccgacgagggcgaggtggactcctgcctgcggcaaggaaacatgacagctgccctacaggcagctctgaagaacccccctatcaacaccaagagtcaggcagtgaaggaccgggcaggcagcattgtcttgaaggtgctcatctcttttaaagctaatgatatagaaaaggcagttcaatctctggacaagaatggtgtggatctcctaatgaagtatatttataaaggatttgagagcccgtctgacaatagcagtgctatgttactgcaatggcatgaaaaggcacttgctgctggaggagtagggtccattgttcgtgtcttgactgcaagaaaaactgtgtagtctggcaggaagtggattatctgcctcgggagtgggaattgctggtacaaagaccaaaacaaccaaatgccaccgctgccctgtgggtagcatctgtttctctcagctttgccttcttgctttttcatatctgtaaagaaaaaaattacatatcagttgtcctttaatggatataggaagaatggtaaataaatgttaccttcaaacatnaggggnggggag

SEQ ID NO: 314283 - DNA, 989 bp, Homo sapiens
catcaatattgagagattgctaatgtgtatcattcagattgctaatctgccagcatgttctaccagcatttcagataatacagaatatggttctagcaaaagtttggtctttattttttcaattagaatcacaggaaaagacatattttggttgataataggttatttcatttgggggactaataattctgatatatattttaggatttctttaacaccactctaggtaatgtttgcatatgtatctcactgggaaatgaaagactatcaaggtgttcacttgatagttagaaccaagggtgaaacagtctttgctttattaaaaaaaagtctaatgttctattttgcttttgatattttgcctttgattaacatcctggaaaccaacacattgaatttccagtattgaacatagtgaccaaagtaattttctttttatatgtaaatcaagtcataagaaccagtggttataatgctttcctgggggccatcctttgctgttacacccttaacttccatcacaggaaacatgacagctgccctacaggcagctctgaagaacccccctatcaacaccaagagtcaggcagtgaaggtgagtcgcagactacaacacagtgatctctgctgatatcttattcttagtaaaatcctctgcagttgcaaaaaaaaatcaatattttaactgtttgctatctttgacatagaagagtttataatgtagtttgataggtaaaaatttcacgtgaaaaaatagccctataatgtagttatgataatgctgcatggtaagatacagtaagttcaaacgatagtgaaatcatttgtgtgtgtttttagaggagaccactcaggctgaatttgagcaaaggtttgaaaaataagttaaacctttacaaaaataaacagattgtaattgctttttaaagattttttaaaaccatacaaatactaaatacttattatagaaagctcagacatatgagaag

SEQ ID NO: 314284 - DNA, 641 bp, Homo sapiens
tcaagagtcccccctagattgggaaaaatttggcaattctcaaaccattttccgtcaaagagtaaacaggacagtaaacttagagccgtagactccggttgatcggcagttatggcggcctctgagtcctggtggtatttctggcgcacctgcgaggtggactcctgcctgcgcaggaaacatgacagctgccctacaggcagctctgaagaacccccctatcaacaccaagagtcaggcagtgaaggtgagtcgcagactacaacacagtgatctctgctgatatcttattcttagtaaaatcctctgcagttgcaaaaaaaaatcaatattttaactgtttgctatctttgacatagaagagtttataatgtagtttgataggtaaaaatttcacgtgaaaaaatagccctataatgtagttatgataatgctgcatggtaagatacagtaagttcaaacgatagtgaaatcatttgtgtgtgtttttagaggagaccactcaggctgaatttgagcaaaggtttgaaaaataagttaaacctttacaaaaataaacagattgtaattgctttttaaagattttttaaaaccatacaaatactaaatacttattatagaaagctcagacatatgagaag

SEQ ID NO: 314285 - DNA, 2289 bp, Homo sapiens
gcgcctgcgcgctgtgtcctgcgcgctccttccctcgcgcgcgctctccgtggaagagcaggggcagcgtgggaggcgccaagggagcgcgaacctgaggaggaagaaacggggctagcgcgcaggcccagaacggtccgagccgcggcagtcggcgacgcctcagagcggaagagggaagtgaatcaggcgccgggtagtgggttgctgggctgggcttgctgaggtagaggcagcgccaagaagaggcctttgccgctggtcgggattgggatgtcgaagaacacagtgtcgtcggcccgcttccggaaggtggacgtggatgaatatgacgagaacaagttcgtggacgaagaagatgggggcgacggccaggccgggcccgacgagggcgaggtggactcctgcctgcggcaaggaaacatgacagctgccctacaggcagctctgaagaacccccctatcaacaccaagagtcaggcagtgaaggaccgggcaggcagcattgtcttgaaggtgctcatctcttttaaagctaatgatatagaaaaggcagttcaatctctggacaagaatggtgtggatctcctaatgaagtatatttataaaggatttgagagcccgtctgacaatagcagtgctatgttactgcaatggcatgaaaaggcacttgctgctggaggagtagggtccattgttcgtgtcttgactgcaagaaaaactgtgtagtctggcaggaagtggattatctgcctcgggagtgggaattgctggtacaaagaccaaaacaaccaaatgccaccgctgccctgtgggtagcatctgtttctctcagctttgccttcttgctttttcatatctgtaaagaaaaaaattacatatcagttgtcctttaatgaaaattgggataatatagaagaaattgtgttaaaatagaagtgtttcatcctttcaaaaccatttcagtgatgtttataccaatctgtatatagtataatttacattcaagtttaattgtgcaacttttaacccctgttggctggttttttgttctgttttgttttgtattatttttaactaatactgagagatttggtcagaatttgaggccagtttcctagctcattgctagtcaggaaatgatatttataaaaaatatgagagactggcagctattaacattgcaaaactggaccatatttcccttatttaataagcaaaatatgtttttggaataagtggtgggtgaataccactgctaagttatagctttgtttttgcttgcctcctgattatctgtactgtgggtttaagtatgctactttctctcagcatccaataatcatggcccctcaatttatttgtggtcacccagggttcagagcaagaagtcttgctttatacaaatgtatccataaaatatcagagcttgttgggcatgaacatcaaacttttgttccactaatatggctctgtttggaaaaaactgcaaatcagaaagaatgatttgcagaaagaaagaaaaactatggtgtaatttaaactctgggcagcctctgaatgaaatgctactttctttagaaatataatagctgccttagacattatgaggtatacaactagtatttaagataccatttaatatgccccgtaaatgtcttcagtgttcttcagggtagttgggatctcaaaagatttggttcagatccaaacaaatacacattctgtgttttagctcagtgttttctaaaaaaagaaactgccacacagcaaaaaattgtttactttgttggacaaaccaaatcagttctcaaaaaatgaccggtgcttataaaaagttataaatatcgagtagctctaaaacaaaccacctgaccaagagggaagtgagcttgtgcttagtatttacattggatgccagttttgtaatcactgacttatgtgcaaactggtgcagaaattctataaactctttgctgtttttgatacctgctttttgtttcattttgttttgttttgtaaaaatgataaaacttcagaaaataaaatgtcagtgttgaataaatttaaaaaaaaaacaaacaaaaacaaaaacacaaaaaaacaacaacaacaaaaaaaaaaaaaagaaaaagaagagaaacaaaacacaaaaaagaaagagcgaggaggaggggagcgagagaaacagagagagataccaccaccacggggagggagcggggaggggggcgggagaaaacagaggggggaggaggggggagaagcgagggggaggagggagacggg

SEQ ID NO: 314286 - DNA, 2010 bp, Homo sapiens
gcgcctgcgcgctgtgtcctgcgcgctccttccctcgcgcgcgctctccgtggaagagcaggggcagcgtgggaggcgccaagggagcgcgaacctgaggaggaagaaacggggctagcgcgcaggcccagaacggtccgagccgcggcagtcggcgacgcctcagagcggaagagggaagtgaatcaggcgccgggtagtgggttgctgggctgggcttgctgaggtagaggcagcgccaagaagaggcctttgccgctggtcgggattgggatgtcgaagaacacagtgtcgtcggcccgcttccggaaggtggacgtggatgaatatgacgagaacaagttcgtggacgaagaagatgggggcgacggccaggccgggcccgacgagggcgaggtggactcctgcctgcggcaaggaaacatgacagctgccctacaggcagctctgaagaacccccctatcaacaccaagagtcaggcagtgaaggaccgggcaggcagcattgtcttgaaggtgctcatctcttttaaagctaatgatatagaaaaggcagttcaatctctggacaagaatggtgtggatctcctaatgaagtatatttataaaggatttgagagcccgtctgacaatagcagtgctatgttactgcaatggcatgaaaaggcacttgctgctggaggagtagggtccattgttcgtgtcttgactgcaagaaaaactgtgtagtctggcaggaagtggattatctgcctcgggagtgggaattgctggtacaaagaccaaaacaaccaaatgccaccgctgccctgtgggtagcatctgtttctctcagctttgccttcttgctttttcatatctgtaaagaaaaaaattacatatcagttgtcctttaatgaaaattgggataatatagaagaaattgtgttaaaatagaagtgtttcatcctttcaaaaccatttcagtgatgtttataccaatctgtatatagtataatttacattcaagtttaattgtgcaacttttaacccctgttggctggttttttgttctgttttgttttgtattatttttaactaatactgagagatttggtcagaatttgaggccagtttcctagctcattgctagtcaggaaatgatatttataaaaaatatgagagactggcagctattaacattgcaaaactggaccatatttcccttatttaataagctgtttttgcttgcctcctgattatctgtactgtgggtttaagtatgctactttctctcagcatccaataatcatggcccctcaatttatttgtggtcacccagggttcagagcaagaagtcttgctttatacaaatgtatccataaaatatcagagcttgttgggcatgaacatcaaacttttgttccactaatatggctctgtttggaaaaaactgcaaatcagaaagaatgatttgcagaaagaaagaaaaactatggtgtaatttaaactctgggcagcctctgaatgaaatgctactttctttagaaatataatagctgccttagacattatgaggtatacaactagtatttaagataccatttaatatgccccgtaaatgtcttcagtgttcttcagggtagttgggatctcaaaagatttggttcagatccaaacaaatacacattctgtgttttagctcagtgttttctaaaaaaagaaactgccacacagcaaaaaattgtttactttgttggacaaaccaaatcagttctcaaaaaatgaccggtgcttataaaaagttataaatatcgagtagctctaaaacaaaccacctgaccaagagggaagtgagcttgtgcttagtatttacattggatgccagttttgtaatcactgacttatgtgcaaactggtgcagaaattctataaactctttgctgtttttgatacctgctttttgtttcattttgttttgttttgtaaaaatgataaaacttcagaaaataaaatgtcagtgttgaataa

SEQ ID NO: 314287 - DNA, 1829 bp, Homo sapiens
gcgcctgcgcgctgtgtcctgcgcgctccttccctcgcgcgcgctctccgtggaagagcaggggcagcgtgggaggcgccaagggagcgcgaacctgaggaggaagaaacggggctagcgcgcaggcccagaacggtccgagccgcggcagtcggcgacgcctcagagcggaagagggaagtgaatcaggcgccgggtagtgggttgctgggctgggcttgctgaggtagaggcagcgccaagaagaggcctttgccgctggtcgggattgggatgtcgaagaacacagtgtcgtcggcccgcttccggaaggtggacgtggatgaatatgacgagaacaagttcgtggacgaagaagatgggggcgacggccaggccgggcccgacgagggcgaggtggactcctgcctgcggcaaggaaacatgacagctgccctacaggcagctctgaagaacccccctatcaacaccaagagtcaggcagtgaaggaccgggcaggcagcattgtcttgaaggtgctcatctcttttaaagctaatgatatagaaaaggcagttcaatctctggacaagaatggtgtggatctcctaatgaagtatatttataaaggatttgagagcccgtctgacaatagcagtgctatgttactgcaatggcatgaaaaggcacttgctgctggaggagtagggtccattgttcgtgtcttgactgcaagaaaaactgtgtagtctggcaggaagtggattatctgcctcgggagtgggaattgctggtacaaagaccaaaacaaccaaatgccaccgctgccctgtgggtagcatctgtttctctcagctttgccttcttgctttttcatatctgtaaagaaaaaaattacatatcagttgtcctttaatgaaaattgggataatatagaagaaattgtgttaaaatagaagtgtttcatcctttcaaaaccatttcagtgatgtttataccaatctgtatatagtataatttacattcaagtttaattgtgcaacttttaacccctgttggctggttttttgttctgttttgttttgtattatttttaactaatactgagagatttggtcagaatttgaggccagtttcctagctcattgctagtcaggaaatgatatttataaaaaatatgagagactggcagctattaacattgcaaaactggaccatatttcccttatttaataagcaaaatatgtttttggaataagtggtgggtgaataccactgctaagttatagctttgtttttgcttgcctcctgattatctgtactgtgggtttaagtatgctactttctctcagcatccaataatcatggcccctcaatttatttgtggtcacccagggttcagagcaagaagtcttgctttatacaaatgtatccataaaatatcagagcttgttgggcatgaacatcaaacttttgttccactaatatggctctgtttggaaaaaactgcaaatcagaaagaatgatttgcagaaagaaagaaactgccacacagcaaaaaattgtttactttgttggacaaaccaaatcagttctcaaaaaatgaccggtgcttataaaaagttataaatatcgagtagctctaaaacaaaccacctgaccaagagggaagtgagcttgtgcttagtatttacattggatgccagttttgtaatcactgacttatgtgcaaactggtgcagaaattctataaactctttgctgtttttgatacctgctttttgtttcattttgttttgttttgtaaaaatgataaaacttcagaaaataaaatgtcagtgttgaataa

SEQ ID NO: 314288 - DNA, 2077 bp, Homo sapiens
  misc_feature (1425)..(1425): n is a, c, g, or t
  misc_feature (1429)..(1429): n is a, c, g, or t
  misc_feature (1438)..(1438): n is a, c, g, or t
  misc_feature (1447)..(1447): n is a, c, g, or t
  misc_feature (1450)..(1450): n is a, c, g, or t
  misc_feature (1455)..(1455): n is a, c, g, or t
  misc_feature (1461)..(1461): n is a, c, g, or t
  misc_feature (1475)..(1475): n is a, c, g, or t
  misc_feature (1497)..(1497): n is a, c, g, or t
  misc_feature (1502)..(1502): n is a, c, g, or t
  misc_feature (1508)..(1508): n is a, c, g, or t
  misc_feature (1512)..(1512): n is a, c, g, or t
  misc_feature (1518)..(1518): n is a, c, g, or t
  misc_feature (1524)..(1524): n is a, c, g, or t
  misc_feature (1539)..(1539): n is a, c, g, or t
  misc_feature (1557)..(1557): n is a, c, g, or t
  misc_feature (1572)..(1572): n is a, c, g, or t
  misc_feature (1577)..(1577): n is a, c, g, or t
  misc_feature (1582)..(1582): n is a, c, g, or t
  misc_feature (1586)..(1586): n is a, c, g, or t
  misc_feature (1610)..(1610): n is a, c, g, or t
  misc_feature (1621)..(1621): n is a, c, g, or t
  misc_feature (1630)..(1630): n is a, c, g, or t
  misc_feature (1648)..(1648): n is a, c, g, or t
  misc_feature (1663)..(1663): n is a, c, g, or t
  misc_feature (1669)..(1670): n is a, c, g, or t
  misc_feature (1672)..(1672): n is a, c, g, or t
  misc_feature (1674)..(1674): n is a, c, g, or t
  misc_feature (1679)..(1680): n is a, c, g, or t
  misc_feature (1688)..(1688): n is a, c, g, or t
gcgcctgcgcgctgtgtcctgcgcgctccttccctcgcgcgcgctctccgtggaagagcaggggcagcgtgggaggcgccaagggagcgcgaacctgaggaggaagaaacggggctagcgcgcaggcccagaacggtccgagccgcggcagtcggcgacgcctcagagcggaagagggaagtgaatcaggcgccgggtagtgggttgctgggctgggcttgctgaggtagaggcagcgccaagaagaggcctttgccgctggtcgggattgggatgtcgaagaacacagtgtcgtcggcccgcttccggaaggtggacgtggatgaatatgacgagaacaagttcgtggacgaagaagatgggggcgacggccaggccgggcccgacgagggcgaggtggactcctgcctgcggcaaggaaacatgacagctgccctacaggcagctctgaagaacccccctatcaacaccaagagtcaggcagtgaaggaccgggcaggcagcattgtcttgaaggtgctcatctcttttaaagctaatgatatagaaaaggcagttcaatctctggacaagaatggtgtggatctcctaatgaagtatatttataaaggatttgagagcccgtctgacaatagcagtgctatgttactgcaatggcatgaaaaggcacttgctgctggaggagtagggtccattgttcgtgtcttgactgcaagaaaaactgtgtagtctggcaggaagtggattatctgcctcgggagtgggaattgctggtacaaagaccaaaacaaccaaatgccaccgctgccctgtgggtagcatctgtttctctcagctttgccttcttgctttttcatatctgtaaagaaaaaaattacatatcagttgtcctttaatgaaaattgggataatatagaagaaattgtgttaaaatagaagtgtttcatcctttcaaaaccatttcagtgatgtttataccaatctgtatatagtataatttacattcaagtttaattgtgcaacttttaacccctgttggctggttttttgttctgttttgttttgtattatttttaactaatactgagagatttggtcagaatttgaggccagtttcctagctcattgctagtcaggaaatgatatttataaaaaatatgagagactggcagctattaacattgcaaaactggaccatatttcccttatttaataagcaaaatatgtttttggaataagtggtgggtgaataccactgctaagttatagctttgtttttgcttgcctcctgattatctgtactgtgggtttaagtatgctactttctctcagcatccaataatcatggcccctcaatttatttgtggtcacccagggttcagagcaagaagtcttgcaaaaaacaaaagaaacacaaaaaaaaanaganaaaaaaagnaaaaaaaanaanaaaanataaanaaccaacaaaaaanacacaaaaaaggaaaaaacagnaaaanagaaanaaanaaaaanaaaaanaaagaaaaaaaaagnaaaaaaaaaaacacaagngcagccacaagaaanaaaancaaanaaanaaaagaaaaaaaaagcaaccaaanacataaagagnaaaacaacnagaaaaaaagaaacacanaaaaaaagaccccgnaaatanncnanagtanncaaacagnaaagttgggatctcaaaagatttggttcagatccaaacaaatacacattctgtgttttagctcagtgttttctaaaaaaagaaactgccacacagcaaaaaattgtttactttgttggacaaaccaaatcagttctcaaaaaatgaccggtgcttataaaaagttataaatatcgagtagctctaaaacaaaccacctgaccaagagggaagtgagcttgtgcttagtatttacattggatgccagttttgtaatcactgacttatgtgcaaactggtgcagaaattctataaactctttgctgtttttgatacctgctttttgtttcattttgttttgttttgtaaaaatgataaaacttcagaaaataaaatgtcagtgttgaataa

SEQ ID NO: 314289 - DNA, 1755 bp, Homo sapiens
ggccccagagagcaggcgctgggcagtgtggaggtcgttggagtcacttccgcgtcaccagctcctgtgcctgccagtcggtgcccctcccgctcctgcctgcggcaaggaaacatgacagctgccctacaggcagctctgaagaacccccctatcaacaccaagagtcaggcagtgaaggaccgggcaggcagcattgtcttgaaggtgctcatctcttttaaagctaatgatatagaaaaggcagttcaatctctggacaagaatggtgtggatctcctaatgaagtatatttataaaggatttgagagcccgtctgacaatagcagtgctatgttactgcaatggcatgaaaaggcacttgctgctggaggagtagggtccattgttcgtgtcttgactgcaagaaaaactgtgtagtctggcaggaagtggattatctgcctcgggagtgggaattgctggtacaaagaccaaaacaaccaaatgccaccgctgccctgtgggtagcatctgtttctctcagctttgccttcttgctttttcatatctgtaaagaaaaaaattacatatcagttgtcctttaatgaaaattgggataatatagaagaaattgtgttaaaatagaagtgtttcatcctttcaaaaccatttcagtgatgtttataccaatctgtatatagtataatttacattcaagtttaattgtgcaacttttaacccctgttggctggttttttgttctgttttgttttgtattatttttaactaatactgagagatttggtcagaatttgaggccagtttcctagctcattgctagtcaggaaatgatatttataaaaaatatgagagactggcagctattaacattgcaaaactggaccatatttcccttatttaataagcaaaatatgtttttggaataagtggtgggtgaataccactgctaagttatagctttgtttttgcttgcctcctgattatctgtactgtgggtttaagtatgctactttctctcagcatccaataatcatggcccctcaatttatttgtggtcacccagggttcagagcaagaagtcttgctttatacaaatgtatccataaaatatcagagcttgttgggcatgaacatcaaacttttgttccactaatatggctctgtttggaaaaaactgcaaatcagaaagaatgatttgcagaaagaaagaaaaactatggtgtaatttaaactctgggcagcctctgaatgaaatgctactttctttagaaatataatagctgccttagacattatgaggtatacaactagtatttaagataccatttaatatgccccgtaaatgtcttcagtgttcttcagggtagttgggatctcaaaagatttggttcagatccaaacaaatacacattctgtgttttagctcagtgttttctaaaaaaagaaactgccacacagcaaaaaattgtttactttgttggacaaaccaaatcagttctcaaaaaatgaccggtgcttataaaaagttataaatatcgagtagctctaaaacaaaccacctgaccaagagggaagtgagcttgtgcttagtatttacattggatgccagttttgtaatcactgacttatgtgcaaactggtgcagaaattctataaactctttgctgtttttgatacctgctttttgtttcattttgttttgttttgtaaaaatgataaaacttcagaaaataaaatgtcagtgttgaataa

SEQ ID NO: 314290 - DNA, 2170 bp, Homo sapiens
catcaatattgagagattgctaatgtgtatcattcagattgctaatctgccagcatgttctaccagcatttcagataatacagaatatggttctagcaaaagtttggtctttattttttcaattagaatcacaggaaaagacatattttggttgataataggttatttcatttgggggactaataattctgatatatattttaggatttctttaacaccactctaggtaatgtttgcatatgtatctcactgggaaatgaaagactatcaaggtgttcacttgatagttagaaccaagggtgaaacagtctttgctttattaaaaaaaagtctaatgttctattttgcttttgatattttgcctttgattaacatcctggaaaccaacacattgaatttccagtattgaacatagtgaccaaagtaattttctttttatatgtaaatcaagtcataagaaccagtggttataatgctttcctgggggccatcctttgctgttacacccttaacttccatcacaggaaacatgacagctgccctacaggcagctctgaagaacccccctatcaacaccaagagtcaggcagtgaaggaccgggcaggcagcattgtcttgaaggtgctcatctcttttaaagctaatgatatagaaaaggcagttcaatctctggacaagaatggtgtggatctcctaatgaagtatatttataaaggatttgagagcccgtctgacaatagcagtgctatgttactgcaatggcatgaaaaggcacttgctgctggaggagtagggtccattgttcgtgtcttgactgcaagaaaaactgtgtagtctggcaggaagtggattatctgcctcgggagtgggaattgctggtacaaagaccaaaacaaccaaatgccaccgctgccctgtgggtagcatctgtttctctcagctttgccttcttgctttttcatatctgtaaagaaaaaaattacatatcagttgtcctttaatgaaaattgggataatatagaagaaattgtgttaaaatagaagtgtttcatcctttcaaaaccatttcagtgatgtttataccaatctgtatatagtataatttacattcaagtttaattgtgcaacttttaacccctgttggctggttttttgttctgttttgttttgtattatttttaactaatactgagagatttggtcagaatttgaggccagtttcctagctcattgctagtcaggaaatgatatttataaaaaatatgagagactggcagctattaacattgcaaaactggaccatatttcccttatttaataagcaaaatatgtttttggaataagtggtgggtgaataccactgctaagttatagctttgtttttgcttgcctcctgattatctgtactgtgggtttaagtatgctactttctctcagcatccaataatcatggcccctcaatttatttgtggtcacccagggttcagagcaagaagtcttgctttatacaaatgtatccataaaatatcagagcttgttgggcatgaacatcaaacttttgttccactaatatggctctgtttggaaaaaactgcaaatcagaaagaatgatttgcagaaagaaagaaaaactatggtgtaatttaaactctgggcagcctctgaatgaaatgctactttctttagaaatataatagctgccttagacattatgaggtatacaactagtatttaagataccatttaatatgccccgtaaatgtcttcagtgttcttcagggtagttgggatctcaaaagatttggttcagatccaaacaaatacacattctgtgttttagctcagtgttttctaaaaaaagaaactgccacacagcaaaaaattgtttactttgttggacaaaccaaatcagttctcaaaaaatgaccggtgcttataaaaagttataaatatcgagtagctctaaaacaaaccacctgaccaagagggaagtgagcttgtgcttagtatttacattggatgccagttttgtaatcactgacttatgtgcaaactggtgcagaaattctataaactctttgctgtttttgatacctgctttttgtttcattttgttttgttttgtaaaaatgataaaacttcagaaaataaaatgtcagtgttgaataa

SEQ ID NO: 314291 - DNA, 495 bp, Homo sapiens
ttagacattatgaggtatacaactagtatttaagataccatttaatatgccccgtaaatgtcttcagtgttcttcagggtagttgggatctcaaaagatttggttcagatccaaacaaatacacattctgtgttttagctcagtgttttctaaaaaaagaaactgccacacagcaaaaaattgtttactttgttggacaaaccaaatcagttctcaaaaaatgaccggtgcttataaaaagttataaatatcgagtagctctaaaacaaaccacctgaccaagagggaagtgagcttgtgcttagtatttacattggatgccagttttgtaatcactgacttatgtgcaaactggtgcagaaattctataaactctttgctgtttttgatacctgctttttgtttcattttgttttgttttgtaaaaatgataaaacttcagaaaataaaatgtcagtgttgaataaaatttatttttctctgactttaacaatt

SEQ ID NO: 314292 - DNA, 1023 bp, Homo sapiens
gcgcctgcgcgctgtgtcctgcgcgctccttccctcgcgcgcgctctccgtggaagagcaggggcagcgtgggaggcgccaagggagcgcgaacctgaggaggaagaaacggggctagcgcgcaggcccagaacggtccgagccgcggcagtcggcgacgcctcagagcggaagagggaagtgaatcaggcgccgggtagtgggttgctgggctgggcttgctgaggtagaggcagcgccaagaagaggcctttgccgctggtcgggattgggatgtcgaagaacacagtgtcgtcggcccgcttccggaaggtggacgtggatgaatatgacgagaacaagttcgtggacgaagaagatgggggcgacggccaggccgggcccgacgagggcgaggtggactcctgcctgcggcaaggaaacatgacagctgccctacaggcagctctgaagaacccccctatcaacaccaagagtcaggcagtgaaggaccgggcaggcagcattgtcttgaaggtgctcatctcttttaaagctaatgatatagaaaaggcagttcaatctctggacaagaatggtgtggatctcctaatgaagtatatttataaaggatttgagagcccgtctgacaatagcagtgctatgttactgcaatggcatgaaaaggcacttgctgctggaggagtagggtccattgttcgtgtcttgactgcaagaaaaactgtgtagtctggcaggaagtggattatctgcctcgggagtgggaattgctggtacaaagaccaaaacaaccaaatgccaccgctgccctgtgggtagcatctgtttctctcaggttgctcttgtttttatttggagaaaaatctttagtgcttatgaatgggtaacttgagacctggtgctgacggttttcgtaacgttggtgttacagtttagaagcgcgggatggataacgggggtggtggggattaacggaggaaggggcctgagattagaggaaaggataaaagggggataggtgaa

SEQ ID NO: 314293 - DNA, 2226 bp, Homo sapiens
gcgcctgcgcgctgtgtcctgcgcgctccttccctcgcgcgcgctctccgtggaagagcaggggcagcgtgggaggcgccaagggagcgcgaacctgaggaggaagaaacggggctagcgcgcaggcccagaacggtccgagccgcggcagtcggcgacgcctcagagcggaagagggaagtgaatcaggcgccgggtagtgggttgctgggctgggcttgctgaggtagaggcagcgccaagaagaggcctttgccgctggtcgggattgggatgtcgaagaacacagtgtcgtcggcccgcttccggaaggtggacgtggatgaatatgacgagaacaagttcgtggacgaagaagatgggggcgacggccaggccgggcccgacgagggcgaggtggactcctgcctgcggcaaggaaacatgacagctgccctacaggcagctctgaagaacccccctatcaacaccaagagtcaggcagtgaaggaccgggcaggcagcattgtcttgaaggtgctcatctcttttaaagctaatgatatagaaaaggcagttcaatctctggacaagaatggtgtggatctcctaatgaagtatatttataaaggatttgagagcccgtctgacaatagcagtgctatgttactgcaatggcatgaaaaggcacttgctgctggaggagtagggtccattgttcgtgtcttgactgcaagaaaaactgtgtagtctggcaggaagtggattatctgcctcgggagtgggaattgctggtacaaagaccaaaacaaccaaatgccaccgctgccctgtgggtagcatctgtttctctcagctttgccttcttgctttttcatatctgtaaagaaaaaaattacatatcagttgtcctttaatgaaaattgggataatatagaagaaattgtgttaaaatagaagtgtttcatcctttcaaaaccatttcagtgatgtttataccaatctgtatatagtataatttacattcaagtttaattgtgcaacttttaacccctgttggctggttttttgttctgttttgttttgtattatttttaactaatactgagagatttggtcagaatttgaggccagtttcctagctcattgctagtcaggaaatgatatttataaaaaatatgagagactggcagctattaacattgcaaaactggaccatatttcccttatttaataagcaaaatatgtttttggaataagtggtgggtgaataccactgctaagttatagctttgtttttgcttgcctcctgattatctgtactgtgggtttaagtatgctactttctctcagcatccaataatcatggcccctcaatttatttgtggtcacccagggttcagagcaagaagtcttgctttatacaaatgtatccataaaatatcagagcttgttgggcatgaacatcaaacttttgttccactaatatggctctgtttggaaaaaactgcaaatcagaaagaatgatttgcagaaagaaagaaaaactatggtgtaatttaaactctgggcagcctctgaatgaaatgctactttctttagaaatataatagctgccttagacattatgaggtatacaactagtatttaagataccatttaatatgccccgtaaatgtcttcagtgttcttcagggtagttgggatctcaaaagatttggttcagatccaaacaaatacacattctgtgttttagctcagtgttttctaaaaaaagaaactgccacacagcaaaaaattgtttactttgttggacaaaccaaatcagttctcaaaaaatgaccggtgcttataaaaagttataaatatcgagtagctctaaaacaaaccacctgaccaagagggaagtgagcttgtgcttagtatttacattggatgccagttttgtaatcactgacttatgtgcaaactggtgcagaaattctataaactctttgctgtttttgatacctgctttttgtttcattttgttttgttttgtaaaaatgataaaacttcagaaaataaaatgtcagtgttgaataaaaaataataaaaaaaaaataaattaaaacaaaaaaacaataaaaatacaatagtaaaattaactgatagtataaaatggaaccagcttttttgacactaggaaaaaaaccttgtagagagaagttaacataaaatggagctttttggggccttttgtcttcg

SEQ ID NO: 314294 - DNA, 2009 bp, Homo sapiens
gcgcctgcgcgctgtgtcctgcgcgctccttccctcgcgcgcgctctccgtggaagagcaggggcagcgtgggaggcgccaagggagcgcgaacctgaggaggaagaaacggggctagcgcgcaggcccagaacggtccgagccgcggcagtcggcgacgcctcagagcggaagagggaagtgaatcaggcgccgggtagtgggttgctgggctgggcttgctgaggtagaggcagcgccaagaagaggcctttgccgctggtcgggattgggatgtcgaagaacacagtgtcgtcggcccgcttccggaaggtggacgtggatgaatatgacgagaacaagttcgtggacgaagaagatgggggcgacggccaggccgggcccgacgagggcgaggtggactcctgcctgcggcaaggaaacatgacagctgccctacaggcagctctgaagaacccccctatcaacaccaagagtcaggcagtgaaggaccgggcaggcagcattgtcttgaaggtgctcatctcttttaaagctaatgatatagaaaaggcagttcaatctctggacaagaatggtgtggatctcctaatgaagtatatttataaaggatttgagagcccgtctgacaatagcagtgctatgttactgcaatggcatgaaaaggcacttgctgctggaggagtagggtccattgttcgtgtcttgactgcaagaaaaactgtgtagtctggcaggaagtggattatctgcctcgggagtgggaattgctggtacaaagaccaaaacaaccaaatgccaccgctgccctgtgggtagcatctgtttctctcagctttgccttcttgctttttcatatctgtaaagaaaaaaattacatatcagttgtcctttaatgaaaattgggataatatagaagaaattgtgttaaaatagaagtgtttcatcctttcaaaaccatttcagtgatgtttataccaatctgtatatagtataatttacattcaagtttaattgtgcaacttttaacccctgttggctggttttttgttctgttttgttttgtattatttttaactaatactgagagatttggtcagaatttgaggccagtttcctagctcattgctagtcaggaaatgatatttataaaaaatatgagagactggcagctattaacattgcaaaactggaccatatttcccttatttaataagcaaaatatgtttttggaataagtggtgggtgaataccactgctaagttatagctttgtttttgcttgcctcctgattatctgtactgtgggtttaagtatgctactttctctcagcatccaataatcatggcccctcaatttatttgtggtcacccagggttcagagcaagaagtcttgctttatacaaatgtatccataaaatatcagagcttgttgggcatgaacatcaaacttttgttccactaatatggctctgtttggaaaaaactgcaaatcagaaagaatgatttgcagaaagaaagtttagaaatataatagctgccttagacattatgaggtatacaactagtatttaagataccatttaatatgccccgtaaatgtcttcagtgttcttcagggtagttgggatctcaaaagatttggttcagatccaaacaaatacacattctgtgttttagctcagtgttttctaaaaaaagaaactgccacacagcaaaaaattgtttactttgttggacaaaccaaatcagttctcaaaaaatgaccggtgcttataaaaagttataaatatcgagtagctctaaaacaaaccacctgaccaagagggaagtgagcttgtgcttagtatttacattggatgccagttttgtaatcactgacttatgtgcaaactggtgcagaaattctataaactctttgctgtttttgatacctgctttttgtttcattttgttttgttttgtaaaaatgataaaacttcagaaaataaaatgtcagtgttgaataa

SEQ ID NO: 314295 - DNA, 1800 bp, Homo sapiens
  misc_feature (3)..(3): n is a, c, g, or t
ccngctgacatttttttagtatggaatgcaccttagcgatcagctaatttgaccttccatgaatatgacgagaacaagttcgtggacgaagaagatgggggcgacggccaggccgggcccgacgagggcgaggtggactcctgcctgcggcaaggaaacatgacagctgccctacaggcagctctgaagaacccccctatcaacaccaagagtcaggcagtgaaggaccgggcaggcagcattgtcttgaaggtgctcatctcttttaaagctaatgatatagaaaaggcagttcaatctctggacaagaatggtgtggatctcctaatgaagtatatttataaaggatttgagagcccgtctgacaatagcagtgctatgttactgcaatggcatgaaaaggcacttgctgctggaggagtagggtccattgttcgtgtcttgactgcaagaaaaactgtgtagtctggcaggaagtggattatctgcctcgggagtgggaattgctggtacaaagaccaaaacaaccaaatgccaccgctgccctgtgggtagcatctgtttctctcagctttgccttcttgctttttcatatctgtaaagaaaaaaattacatatcagttgtcctttaatgaaaattgggataatatagaagaaattgtgttaaaatagaagtgtttcatcctttcaaaaccatttcagtgatgtttataccaatctgtatatagtataatttacattcaagtttaattgtgcaacttttaacccctgttggctggttttttgttctgttttgttttgtattatttttaactaatactgagagatttggtcagaatttgaggccagtttcctagctcattgctagtcaggaaatgatatttataaaaaatatgagagactggcagctattaacattgcaaaactggaccatatttcccttatttaataagcaaaatatgtttttggaataagtggtgggtgaataccactgctaagttatagctttgtttttgcttgcctcctgattatctgtactgtgggtttaagtatgctactttctctcagcatccaataatcatggcccctcaatttatttgtggtcacccagggttcagagcaagaagtcttgctttatacaaatgtatccataaaatatcagagcttgttgggcatgaacatcaaacttttgttccactaatatggctctgtttggaaaaaactgcaaatcagaaagaatgatttgcagaaagaaagaaaaactatggtgtaatttaaactctgggcagcctctgaatgaaatgctactttctttagaaatataatagctgccttagacattatgaggtatacaactagtatttaagataccatttaatatgccccgtaaatgtcttcagtgttcttcagggtagttgggatctcaaaagatttggttcagatccaaacaaatacacattctgtgttttagctcagtgttttctaaaaaaagaaactgccacacagcaaaaaattgtttactttgttggacaaaccaaatcagttctcaaaaaatgaccggtgcttataaaaagttataaatatcgagtagctctaaaacaaaccacctgaccaagagggaagtgagcttgtgcttagtatttacattggatgccagttttgtaatcactgacttatgtgcaaactggtgcagaaattctataaactctttgctgtttttgatacctgctttttgtttcattttgttttgttttgtaaaaatgataaaacttcagaaaataaaatgtcagtgttgaataa

SEQ ID NO: 314296 - DNA, 1659 bp, Homo sapiens
  misc_feature (62)..(62): n is a, c, g, or t
gtggcggcccggggacgagtcgggggggggcgtggggatcgggatcgatcgctgctgccggngacgcagcacgggggtaggggcgaccgggcaggcagcattgtcttgaaggtgctcatctcttttaaagctaatgatatagaaaaggcagttcaatctctggacaagaatggtgtggatctcctaatgaagtatatttataaaggatttgagagcccgtctgacaatagcagtgctatgttactgcaatggcatgaaaaggcacttgctgctggaggagtagggtccattgttcgtgtcttgactgcaagaaaaactgtgtagtctggcaggaagtggattatctgcctcgggagtgggaattgctggtacaaagaccaaaacaaccaaatgccaccgctgccctgtgggtagcatctgtttctctcagctttgccttcttgctttttcatatctgtaaagaaaaaaattacatatcagttgtcctttaatgaaaattgggataatatagaagaaattgtgttaaaatagaagtgtttcatcctttcaaaaccatttcagtgatgtttataccaatctgtatatagtataatttacattcaagtttaattgtgcaacttttaacccctgttggctggttttttgttctgttttgttttgtattatttttaactaatactgagagatttggtcagaatttgaggccagtttcctagctcattgctagtcaggaaatgatatttataaaaaatatgagagactggcagctattaacattgcaaaactggaccatatttcccttatttaataagcaaaatatgtttttggaataagtggtgggtgaataccactgctaagttatagctttgtttttgcttgcctcctgattatctgtactgtgggtttaagtatgctactttctctcagcatccaataatcatggcccctcaatttatttgtggtcacccagggttcagagcaagaagtcttgctttatacaaatgtatccataaaatatcagagcttgttgggcatgaacatcaaacttttgttccactaatatggctctgtttggaaaaaactgcaaatcagaaagaatgatttgcagaaagaaagaaaaactatggtgtaatttaaactctgggcagcctctgaatgaaatgctactttctttagaaatataatagctgccttagacattatgaggtatacaactagtatttaagataccatttaatatgccccgtaaatgtcttcagtgttcttcagggtagttgggatctcaaaagatttggttcagatccaaacaaatacacattctgtgttttagctcagtgttttctaaaaaaagaaactgccacacagcaaaaaattgtttactttgttggacaaaccaaatcagttctcaaaaaatgaccggtgcttataaaaagttataaatatcgagtagctctaaaacaaaccacctgaccaagagggaagtgagcttgtgcttagtatttacattggatgccagttttgtaatcactgacttatgtgcaaactggtgcagaaattctataaactctttgctgtttttgatacctgctttttgtttcattttgttttgttttgtaaaaatgataaaacttcagaaaataaaatgtcagtgttgaataa

SEQ ID NO: 314297 - DNA, 336 bp, Homo sapiens
gcggccgcctactactactactgctcgaattcaagcttctaacgatgtacggggataccagatacaggtgaatacataggaactatctgcctgtgtcctcaatctcccttcaaacaagatgctgatttgtagggtacttggcaggttaaattaaaccagaagaggtgacttaataaaaaagggaatgacatttagggtataaagatctcataagaaatgtaatatgtaaattatatcttgctttatgttgtaaaatatacattgtttgcgctagaatagaaatgatttcttttcaataaaaagaaagaaggactctaccatgtcttttgttatata

SEQ ID NO: 314298 - DNA, 5081 bp, Homo sapiens
ggaaaggaggaagaaggagattgtgatggagaaagggggtctgtgaaacgtcaggcacagcacaaaggctttgccacgtaattacaggctcctattaagtcgagatctgccctcccaggggtctccaattttcttgtattccctacaaagcctcctctgcatgccagtttgtgccttttgaagtgccagagagcttcttgatccaactgagaaggaaaaaggagcccagcaagaagagggggagagagagaaggggaaaggggggaacccaccagcaccctccgtcggactcttgaagccttttttttttaattcttaatttttttttttactctttacaaaaagtaaagtgagaatcctgctctctaatacatctgcaagacatcaccctctcctcctgaaactttagtcactcctgagaatccacaggagtgcagagaggggggaacacgttttcttgaagatgttttaaagctggaacaagccttcttctgttggtgcttgaactcttgcctgggaataacttttttaacctttaaaaaaaccattcactttgattcttctctcccaccccttcttctctcttcttctgtttgcctaactcccccgccctgctggcctccgctttcctctctcccccttgttgttatttttagtctgtgcgtgtggacacttttggagagttggaagggatttttttctcctgacttgaacatagggtgactttttaatattgtattttagtgtggattatctctttggaccgcgccggacttggcctcaggaaagcaaccaaggctgcggaaggcggctggtgcagaacgctctgctctacagaagggggtcccccgccctcttttccaattttttttttttggccttcctctccttccctccctcttcctccctctctctctctctctctccactacccccctctttcttccccactcggctcctctcccccctcgcgcccacagcgtttggtgttgattcgagcgggaagaggggggtgggtgggatcggtgggggagaccatgacctccagctacgggcacgttctggagcggcaaccggcgctgggcggccgcttggacagcccgggcaacctcgacaccctgcaggcgaaaaagaacttctccgtcagtcacctgctagacctggaggaagccggggacatggtggcggcacaggcggatgagaacgtgggcgaggctggccggagcctgctggagtcgccgggactcaccagcggcagcgacaccccgcagcaggacaatgaccagctgaactcagaagaaaaaaagaagagaaagcagcgaaggaataggacaaccttcaatagcagccagctgcaggctttggagcgtgtctttgagcggacacactatcctgatgcttttgtgcgagaagaccttgcccgccgggtgaacctcaccgaggcgagagtgcaggtgtggtttcagaaccgaagagccaagttccgcaggaatgagagagccatgctagccaataaaaacgcttccctcctcaaatcctactcaggagacgtgactgctgtggagcagcccatcgtacctcgtcctgctccgagacccaccgattatctctcctgggggacagcgtctccgtacagatcctcgtccctcccaagatgttgtttacacgaggggcttcataacggattctaacggaagacactgaaaagcgccatggctacttattctgccacatgtgccaacaatagccctgcacagggcatcaacatggccaacagcattgccaacctgagactgaaggccaaggaatatagtttacagaggaaccaggtgccaacagtcaactgaggaaaaaaaataattaaacaggcctaagaagaaatcaaaaaccataagacacctatcctgctctgttatttcttcatctgctggggggaaaaagtaaattacaaacaaacaaacaaagcagaactaaaatattgggaccatggcagagaaaagcaggagaggagcaaaatgaaaattagttaacaaatgttcctcctccctctgggataccaccaccacttgtttctgtgtgtgtttattttgtttttctttcattcatgctttgcttaatgtactccaggcttcttcagataggttcagcccacccacccccatgattgtatgaagttttaaaaaaaactacagcagccaaagaaactatatatatatatatatatatatatatccagaatgattgcctctactgtcctcattgacttgtttgaaccttagtgccttaccctgtcctcttcccagttctctttatagaagctctaggagctttcgaaaagccaaagtctttctgaagaatctgtgctggacagacataattccctttctcattgtctccatctttgttggtcatggtaaggtttttccatcagcctctgaaaaaatagttgtgcacaacatctgctcactggactgtctgatccaatgtaattggctgcgtctggctaattctaagcactaaagtctacatctaagctatagatttaagcttgaagctacagattatatcactatcaccaccacccctcaccctatgcaatcaatcaatcaatcatcttaagttaaagatatttgttgtctttgaatgatttgctgtcacagactatttggtagaagaaatatttttcacctgagagaggaagagaaatttctctagtaacacaaagagtgagttctaaaaggcatgcccacatctctttcgtgccttaaggatagtgagatgcacacttatatatatactgtatatatttatatatttatatatatatttcatatatatatataatattgcaagcttaagtttgcaatttcccaaacaatacaaaaagcaaattacacaccctcaccactgttcttatctctatagtgatgaaacattaattagggatcttgctgcttttctttttctacacgaagttttcattaaagccacagaataattgatagggcagctgtttgagaacaggtcccattttcacattagggctttaaatgaattagaaactatttgaggctataaaaatgtccttgagtttggagcctgagctctggtgaaatgctgatacatctgatctatcatgggaattgcagttagagagagtaaggaataccatttagtcatctatccgttcttcacttagcaggaatatgaaagaaaggcacatgtttaagaggaatacctaaaggtttttctaaattccaacatttaaaaggcaattgtgggctatttttattttttaatattttgaaataaagtttagtgtctagggctgggagccaggactgatcttccatttctttttctttgttcccagccatgcttttgtaacttgccaggtggacttgaccaactacattaccatgctgtgcctcagtttacccatttgtaaaatgggattaataatacttacctacctcacaggggtgttgtgaggctctattcatttgctcctttattctttcctgtattctctgtatgtccagcactttgtagccatgggaggaaagggactataaaagtgtacaatgttaatggaatgatacggtacctgaaagccttgttttctagtaagaaaatgctaccttgctgtacatacttataaccttgtatttggaaatgagaaataggtttatattttcagatctctcaaaaatcacatcatttgaccaaagaataatttaagacacatagaacagatttttttaatttatattttcatcctgaccagcttagttctaataatttttagttgtgagtgattaaaaaactttggatcaattttggtcaaacatgccaactttgtagtctgagtgacaggcaagggatttttgggtttaagatgcacttttagcacacatttgtatttcccttggcatatcagattgagctaatggtgatgttatttcaatctaacagccaccaatctgaaattgtatttcaaatgttgattctgtagttctttaaataataatgaagctcatcttatacattttgctttcaccaattgattccttcttcttttagcccactattaaaacatttcttactgaatggttcatgtaggcttgctgaacagcacgcattacttgcttcctgaagagttcccccattcatccatttgtcccattagttgctgtggattatcaagttttgaaggaactgtacatcccaacagactgaaacattctaagtgaaatgagtataatccaagtaactggtgaactttggaggtttggagcttgaagagaatggctaagaagatttgaattatagggagggaacagaaatcatacatgaaaaggttttactgagaaggggaaaaccttagatagagggacatgtgaaacaaaatcatttgaaattttgattcagacatccatttccagtggcaaacagcaaagcctgaacccataaacccaaatgataggtgaagttgggtggttttatccaatgtctcaagcaagcaatgtctgggaatatcatagagtaacaagtgctggtcagccaaagaaacattcactgctggtgaaccaataccataagcatgtattatctaagcacttgatcaagaaatatacatgttgtacaagctctcaattttgttcatttattatcaaatttttaaaatacaagtttggtatgtgatttggaaaagatgccttctggatcttaagccagttgtcagtggaggtcctcagggctgcaaatgtcaagacataaccctgttcctcaccatcatgataccagatacaggtgaatacataggaactatctgcctgtgtcctcaatctcccttcaaacaagatgctgatttgtagggtacttggcaggttaaattaaaccagaagaggtgacttaataaaaaagggaatgacatttagggtataaagatctcataagaaatgtaatatgtaaattatatcttgctttatgttgtaaaatatacattgtttgcgctagaatagaaatgatttcttttcaataaaaagaaagaaggactctaccatgtcttttgttatata

SEQ ID NO: 314299 - DNA, 4680 bp, Homo sapiens
ggaaaggaggaagaaggagattgtgatggagaaagggggtctgtgaaacgtcaggcacagcacaaaggctttgccacgtaattacaggctcctattaagtcgagatctgccctcccaggggtctccaattttcttgtattccctacaaagcctcctctgcatgccagtttgtgccttttgaagtgccagagagcttcttgatccaactgagaaggaaaaaggagcccagcaagaagagggggagagagagaaggggaaaggggggaacccaccagcaccctccgtcggactcttgaagccttttttttttaattcttaatttttttttttactctttacaaaaagtaaagtgagaatcctgctctctaatacatctgcaagacatcaccctctcctcctgaaactttagtcactcctgagaatccacaggagtgcagagaggggggaacacgttttcttgaagatgttttaaagctggaacaagccttcttctgttggtgcttgaactcttgcctgggaataacttttttaacctttaaaaaaaccattcactttgatccttccctccctcttcctccctctctctctctctctctccactacccccctctttcttccccactcggctcctctcccccctcgcgcccacagcgtttggtgttgattcgagcgggaagaggggggtgggtgggatcggtgggggagaccatgacctccagctacgggcacgttctggagcggcaaccggcgctgggcggccgcttggacagcccgggcaacctcgacaccctgcaggcgaaaaagaacttctccgtcagtcacctgctagacctggaggaagccggggacatggtggcggcacaggcggatgagaacgtgggcgaggctggccggagcctgctggagtcgccgggactcaccagcggcagcgacaccccgcagcaggacaatgaccagctgaactcagaagaaaaaaagaagagaaagcagcgaaggaataggacaaccttcaatagcagccagctgcaggctttggagcgtgtctttgagcggacacactatcctgatgcttttgtgcgagaagaccttgcccgccgggtgaacctcaccgaggcgagagtgcaggtgtggtttcagaaccgaagagccaagttccgcaggaatgagagagccatgctagccaataaaaacgcttccctcctcaaatcctactcaggagacgtgactgctgtggagcagcccatcgtacctcgtcctgctccgagacccaccgattatctctcctgggggacagcgtctccgtacagcgccatggctacttattctgccacatgtgccaacaatagccctgcacagggcatcaacatggccaacagcattgccaacctgagactgaaggccaaggaatatagtttacagaggaaccaggtgccaacagtcaactgaggaaaaaaaataattaaacaggcctaagaagaaatcaaaaaccataagacacctatcctgctctgttatttcttcatctgctggggggaaaaagtaaattacaaacaaacaaacaaagcagaactaaaatattgggaccatggcagagaaaagcaggagaggagcaaaatgaaaattagttaacaaatgttcctcctccctctgggataccaccaccacttgtttctgtgtgtgtttattttgtttttctttcattcatgctttgcttaatgtactccaggcttcttcagataggttcagcccacccacccccatgattgtatgaagttttaaaaaaaactacagcagccaaagaaactatatatatatatatatatatatatatccagaatgattgcctctactgtcctcattgacttgtttgaaccttagtgccttaccctgtcctcttcccagttctctttatagaagctctaggagctttcgaaaagccaaagtctttctgaagaatctgtgctggacagacataattccctttctcattgtctccatctttgttggtcatggtaaggtttttccatcagcctctgaaaaaatagttgtgcacaacatctgctcactggactgtctgatccaatgtaattggctgcgtctggctaattctaagcactaaagtctacatctaagctatagatttaagcttgaagctacagattatatcactatcaccaccacccctcaccctatgcaatcaatcaatcaatcatcttaagttaaagatatttgttgtctttgaatgatttgctgtcacagactatttggtagaagaaatatttttcacctgagagaggaagagaaatttctctagtaacacaaagagtgagttctaaaaggcatgcccacatctctttcgtgccttaaggatagtgagatgcacacttatatatatactgtatatatttatatatttatatatatatttcatatatatatataatattgcaagcttaagtttgcaatttcccaaacaatacaaaaagcaaattacacaccctcaccactgttcttatctctatagtgatgaaacattaattagggatcttgctgcttttctttttctacacgaagttttcattaaagccacagaataattgatagggcagctgtttgagaacaggtcccattttcacattagggctttaaatgaattagaaactatttgaggctataaaaatgtccttgagtttggagcctgagctctggtgaaatgctgatacatctgatctatcatgggaattgcagttagagagagtaaggaataccatttagtcatctatccgttcttcacttagcaggaatatgaaagaaaggcacatgtttaagaggaatacctaaaggtttttctaaattccaacatttaaaaggcaattgtgggctatttttattttttaatattttgaaataaagtttagtgtctagggctgggagccaggactgatcttccatttctttttctttgttcccagccatgcttttgtaacttgccaggtggacttgaccaactacattaccatgctgtgcctcagtttacccatttgtaaaatgggattaataatacttacctacctcacaggggtgttgtgaggctctattcatttgctcctttattctttcctgtattctctgtatgtccagcactttgtagccatgggaggaaagggactataaaagtgtacaatgttaatggaatgatacggtacctgaaagccttgttttctagtaagaaaatgctaccttgctgtacatacttataaccttgtatttggaaatgagaaataggtttatattttcagatctctcaaaaatcacatcatttgaccaaagaataatttaagacacatagaacagatttttttaatttatattttcatcctgaccagcttagttctaataatttttagttgtgagtgattaaaaaactttggatcaattttggtcaaacatgccaactttgtagtctgagtgacaggcaagggatttttgggtttaagatgcacttttagcacacatttgtatttcccttggcatatcagattgagctaatggtgatgttatttcaatctaacagccaccaatctgaaattgtatttcaaatgttgattctgtagttctttaaataataatgaagctcatcttatacattttgctttcaccaattgattccttcttcttttagcccactattaaaacatttcttactgaatggttcatgtaggcttgctgaacagcacgcattacttgcttcctgaagagttcccccattcatccatttgtcccattagttgctgtggattatcaagttttgaaggaactgtacatcccaacagactgaaacattctaagtgaaatgagtataatccaagtaactggtgaactttggaggtttggagcttgaagagaatggctaagaagatttgaattatagggagggaacagaaatcatacatgaaaaggttttactgagaaggggaaaaccttagatagagggacatgtgaaacaaaatcatttgaaattttgattcagacatccatttccagtggcaaacagcaaagcctgaacccataaacccaaatgataggtgaagttgggtggttttatccaatgtctcaagcaagcaatgtctgggaatatcatagagtaacaagtgctggtcagccaaagaaacattcactgctggtgaaccaataccataagcatgtattatctaagcacttgatcaagaaatatacatgttgtacaagctctcaattttgttcatttattatcaaatttttaaaatacaagtttggtatgtgatttggaaaagatgccttctggatcttaagccagttgtcagtggaggtcctcagggctgcaaatgtcaagacataaccctgttcctcaccatcatgataccagatacaggtgaatacataggaactatctgcctgtgtcctcaatctcccttcaaacaagatgctgatttgtagggtacttggcaggttaaattaaaccagaagaggtgacttaataaaaaagggaatgacatttagggtataaagatctcataagaaatgtaatatgtaaattatatcttgctttatgttgtaaaatatacattgtttgcgctagaatagaaatgatttcttttcaataaaaagaaagaaggactctaccatgtcttttgttatata

SEQ ID NO: 314300 - DNA, 3679 bp, Homo sapiens
agaatttatgtttattaggcactaattctgggccaattctcaaaactatcctgtgtggtttcagaaccgaagagccaagttccgcaggaatgagagagccatgctagccaataaaaacgcttccctcctcaaatcctactcaggagacgtgactgctgtggagcagcccatcgtacctcgtcctgctccgagacccaccgattatctctcctgggggacagcgtctccgtacagatcctcgtccctcccaagatgttgtttacacgaggggcttcataacggattctaacggaagacactgaaaagcgccatggctacttattctgccacatgtgccaacaatagccctgcacagggcatcaacatggccaacagcattgccaacctgagactgaaggccaaggaatatagtttacagaggaaccaggtgccaacagtcaactgaggaaaaaaaataattaaacaggcctaagaagaaatcaaaaaccataagacacctatcctgctctgttatttcttcatctgctggggggaaaaagtaaattacaaacaaacaaacaaagcagaactaaaatattgggaccatggcagagaaaagcaggagaggagcaaaatgaaaattagttaacaaatgttcctcctccctctgggataccaccaccacttgtttctgtgtgtgtttattttgtttttctttcattcatgctttgcttaatgtactccaggcttcttcagataggttcagcccacccacccccatgattgtatgaagttttaaaaaaaactacagcagccaaagaaactatatatatatatatatatatatatatccagaatgattgcctctactgtcctcattgacttgtttgaaccttagtgccttaccctgtcctcttcccagttctctttatagaagctctaggagctttcgaaaagccaaagtctttctgaagaatctgtgctggacagacataattccctttctcattgtctccatctttgttggtcatggtaaggtttttccatcagcctctgaaaaaatagttgtgcacaacatctgctcactggactgtctgatccaatgtaattggctgcgtctggctaattctaagcactaaagtctacatctaagctatagatttaagcttgaagctacagattatatcactatcaccaccacccctcaccctatgcaatcaatcaatcaatcatcttaagttaaagatatttgttgtctttgaatgatttgctgtcacagactatttggtagaagaaatatttttcacctgagagaggaagagaaatttctctagtaacacaaagagtgagttctaaaaggcatgcccacatctctttcgtgccttaaggatagtgagatgcacacttatatatatactgtatatatttatatatttatatatatatttcatatatatatataatattgcaagcttaagtttgcaatttcccaaacaatacaaaaagcaaattacacaccctcaccactgttcttatctctatagtgatgaaacattaattagggatcttgctgcttttctttttctacacgaagttttcattaaagccacagaataattgatagggcagctgtttgagaacaggtcccattttcacattagggctttaaatgaattagaaactatttgaggctataaaaatgtccttgagtttggagcctgagctctggtgaaatgctgatacatctgatctatcatgggaattgcagttagagagagtaaggaataccatttagtcatctatccgttcttcacttagcaggaatatgaaagaaaggcacatgtttaagaggaatacctaaaggtttttctaaattccaacatttaaaaggcaattgtgggctatttttattttttaatattttgaaataaagtttagtgtctagggctgggagccaggactgatcttccatttctttttctttgttcccagccatgcttttgtaacttgccaggtggacttgaccaactacattaccatgctgtgcctcagtttacccatttgtaaaatgggattaataatacttacctacctcacaggggtgttgtgaggctctattcatttgctcctttattctttcctgtattctctgtatgtccagcactttgtagccatgggaggaaagggactataaaagtgtacaatgttaatggaatgatacggtacctgaaagccttgttttctagtaagaaaatgctaccttgctgtacatacttataaccttgtatttggaaatgagaaataggtttatattttcagatctctcaaaaatcacatcatttgaccaaagaataatttaagacacatagaacagatttttttaatttatattttcatcctgaccagcttagttctaataatttttagttgtgagtgattaaaaaactttggatcaattttggtcaaacatgccaactttgtagtctgagtgacaggcaagggatttttgggtttaagatgcacttttagcacacatttgtatttcccttggcatatcagattgagctaatggtgatgttatttcaatctaacagccaccaatctgaaattgtatttcaaatgttgattctgtagttctttaaataataatgaagctcatcttatacattttgctttcaccaattgattccttcttcttttagcccactattaaaacatttcttactgaatggttcatgtaggcttgctgaacagcacgcattacttgcttcctgaagagttcccccattcatccatttgtcccattagttgctgtggattatcaagttttgaaggaactgtacatcccaacagactgaaacattctaagtgaaatgagtataatccaagtaactggtgaactttggaggtttggagcttgaagagaatggctaagaagatttgaattatagggagggaacagaaatcatacatgaaaaggttttactgagaaggggaaaaccttagatagagggacatgtgaaacaaaatcatttgaaattttgattcagacatccatttccagtggcaaacagcaaagcctgaacccataaacccaaatgataggtgaagttgggtggttttatccaatgtctcaagcaagcaatgtctgggaatatcatagagtaacaagtgctggtcagccaaagaaacattcactgctggtgaaccaataccataagcatgtattatctaagcacttgatcaagaaatatacatgttgtacaagctctcaattttgttcatttattatcaaatttttaaaatacaagtttggtatgtgatttggaaaagatgccttctggatcttaagccagttgtcagtggaggtcctcagggctgcaaatgtcaagacataaccctgttcctcaccatcatgataccagatacaggtgaatacataggaactatctgcctgtgtcctcaatctcccttcaaacaagatgctgatttgtagggtacttggcaggttaaattaaaccagaagaggtgacttaataaaaaagggaatgacatttagggtataaagatctcataagaaatgtaatatgtaaattatatcttgctttatgttgtaaaatatacattgtttgcgctagaatagaaatgatttcttttcaataaaaagaaagaaggactctaccatgtcttttgttatata

SEQ ID NO: 314301 - DNA, 3607 bp, Homo sapiens
agaatttatgtttattaggcactaattctgggccaattctcaaaactatcctgtgtggtttcagaaccgaagagccaagttccgcaggaatgagagagccatgctagccaataaaaacgcttccctcctcaaatcctactcaggagacgtgactgctgtggagcagcccatcgtacctcgtcctgctccgagacccaccgattatctctcctgggggacagcgtctccgtacagcgccatggctacttattctgccacatgtgccaacaatagccctgcacagggcatcaacatggccaacagcattgccaacctgagactgaaggccaaggaatatagtttacagaggaaccaggtgccaacagtcaactgaggaaaaaaaataattaaacaggcctaagaagaaatcaaaaaccataagacacctatcctgctctgttatttcttcatctgctggggggaaaaagtaaattacaaacaaacaaacaaagcagaactaaaatattgggaccatggcagagaaaagcaggagaggagcaaaatgaaaattagttaacaaatgttcctcctccctctgggataccaccaccacttgtttctgtgtgtgtttattttgtttttctttcattcatgctttgcttaatgtactccaggcttcttcagataggttcagcccacccacccccatgattgtatgaagttttaaaaaaaactacagcagccaaagaaactatatatatatatatatatatatatatccagaatgattgcctctactgtcctcattgacttgtttgaaccttagtgccttaccctgtcctcttcccagttctctttatagaagctctaggagctttcgaaaagccaaagtctttctgaagaatctgtgctggacagacataattccctttctcattgtctccatctttgttggtcatggtaaggtttttccatcagcctctgaaaaaatagttgtgcacaacatctgctcactggactgtctgatccaatgtaattggctgcgtctggctaattctaagcactaaagtctacatctaagctatagatttaagcttgaagctacagattatatcactatcaccaccacccctcaccctatgcaatcaatcaatcaatcatcttaagttaaagatatttgttgtctttgaatgatttgctgtcacagactatttggtagaagaaatatttttcacctgagagaggaagagaaatttctctagtaacacaaagagtgagttctaaaaggcatgcccacatctctttcgtgccttaaggatagtgagatgcacacttatatatatactgtatatatttatatatttatatatatatttcatatatatatataatattgcaagcttaagtttgcaatttcccaaacaatacaaaaagcaaattacacaccctcaccactgttcttatctctatagtgatgaaacattaattagggatcttgctgcttttctttttctacacgaagttttcattaaagccacagaataattgatagggcagctgtttgagaacaggtcccattttcacattagggctttaaatgaattagaaactatttgaggctataaaaatgtccttgagtttggagcctgagctctggtgaaatgctgatacatctgatctatcatgggaattgcagttagagagagtaaggaataccatttagtcatctatccgttcttcacttagcaggaatatgaaagaaaggcacatgtttaagaggaatacctaaaggtttttctaaattccaacatttaaaaggcaattgtgggctatttttattttttaatattttgaaataaagtttagtgtctagggctgggagccaggactgatcttccatttctttttctttgttcccagccatgcttttgtaacttgccaggtggacttgaccaactacattaccatgctgtgcctcagtttacccatttgtaaaatgggattaataatacttacctacctcacaggggtgttgtgaggctctattcatttgctcctttattctttcctgtattctctgtatgtccagcactttgtagccatgggaggaaagggactataaaagtgtacaatgttaatggaatgatacggtacctgaaagccttgttttctagtaagaaaatgctaccttgctgtacatacttataaccttgtatttggaaatgagaaataggtttatattttcagatctctcaaaaatcacatcatttgaccaaagaataatttaagacacatagaacagatttttttaatttatattttcatcctgaccagcttagttctaataatttttagttgtgagtgattaaaaaactttggatcaattttggtcaaacatgccaactttgtagtctgagtgacaggcaagggatttttgggtttaagatgcacttttagcacacatttgtatttcccttggcatatcagattgagctaatggtgatgttatttcaatctaacagccaccaatctgaaattgtatttcaaatgttgattctgtagttctttaaataataatgaagctcatcttatacattttgctttcaccaattgattccttcttcttttagcccactattaaaacatttcttactgaatggttcatgtaggcttgctgaacagcacgcattacttgcttcctgaagagttcccccattcatccatttgtcccattagttgctgtggattatcaagttttgaaggaactgtacatcccaacagactgaaacattctaagtgaaatgagtataatccaagtaactggtgaactttggaggtttggagcttgaagagaatggctaagaagatttgaattatagggagggaacagaaatcatacatgaaaaggttttactgagaaggggaaaaccttagatagagggacatgtgaaacaaaatcatttgaaattttgattcagacatccatttccagtggcaaacagcaaagcctgaacccataaacccaaatgataggtgaagttgggtggttttatccaatgtctcaagcaagcaatgtctgggaatatcatagagtaacaagtgctggtcagccaaagaaacattcactgctggtgaaccaataccataagcatgtattatctaagcacttgatcaagaaatatacatgttgtacaagctctcaattttgttcatttattatcaaatttttaaaatacaagtttggtatgtgatttggaaaagatgccttctggatcttaagccagttgtcagtggaggtcctcagggctgcaaatgtcaagacataaccctgttcctcaccatcatgataccagatacaggtgaatacataggaactatctgcctgtgtcctcaatctcccttcaaacaagatgctgatttgtagggtacttggcaggttaaattaaaccagaagaggtgacttaataaaaaagggaatgacatttagggtataaagatctcataagaaatgtaatatgtaaattatatcttgctttatgttgtaaaatatacattgtttgcgctagaatagaaatgatttcttttcaataaaaagaaagaaggactctaccatgtcttttgttatata

SEQ ID NO: 314302 - DNA, 3549 bp, Homo sapiens
tcagcagtgaagtcctcaagtgaggaatattattggtaaccagagctgcaagaaagcatgtccactaaatgaagcatagtgtgatactaatctagagcagggctcttcagagattgctgtgcacaggaaacatctgggatcgcgtgactgtgcaaactctgattcactaattccagcgccatggctacttattctgccacatgtgccaacaatagccctgcacagggcatcaacatggccaacagcattgccaacctgagactgaaggccaaggaatatagtttacagaggaaccaggtgccaacagtcaactgaggaaaaaaaataattaaacaggcctaagaagaaatcaaaaaccataagacacctatcctgctctgttatttcttcatctgctggggggaaaaagtaaattacaaacaaacaaacaaagcagaactaaaatattgggaccatggcagagaaaagcaggagaggagcaaaatgaaaattagttaacaaatgttcctcctccctctgggataccaccaccacttgtttctgtgtgtgtttattttgtttttctttcattcatgctttgcttaatgtactccaggcttcttcagataggttcagcccacccacccccatgattgtatgaagttttaaaaaaaactacagcagccaaagaaactatatatatatatatatatatatatatccagaatgattgcctctactgtcctcattgacttgtttgaaccttagtgccttaccctgtcctcttcccagttctctttatagaagctctaggagctttcgaaaagccaaagtctttctgaagaatctgtgctggacagacataattccctttctcattgtctccatctttgttggtcatggtaaggtttttccatcagcctctgaaaaaatagttgtgcacaacatctgctcactggactgtctgatccaatgtaattggctgcgtctggctaattctaagcactaaagtctacatctaagctatagatttaagcttgaagctacagattatatcactatcaccaccacccctcaccctatgcaatcaatcaatcaatcatcttaagttaaagatatttgttgtctttgaatgatttgctgtcacagactatttggtagaagaaatatttttcacctgagagaggaagagaaatttctctagtaacacaaagagtgagttctaaaaggcatgcccacatctctttcgtgccttaaggatagtgagatgcacacttatatatatactgtatatatttatatatttatatatatatttcatatatatatataatattgcaagcttaagtttgcaatttcccaaacaatacaaaaagcaaattacacaccctcaccactgttcttatctctatagtgatgaaacattaattagggatcttgctgcttttctttttctacacgaagttttcattaaagccacagaataattgatagggcagctgtttgagaacaggtcccattttcacattagggctttaaatgaattagaaactatttgaggctataaaaatgtccttgagtttggagcctgagctctggtgaaatgctgatacatctgatctatcatgggaattgcagttagagagagtaaggaataccatttagtcatctatccgttcttcacttagcaggaatatgaaagaaaggcacatgtttaagaggaatacctaaaggtttttctaaattccaacatttaaaaggcaattgtgggctatttttattttttaatattttgaaataaagtttagtgtctagggctgggagccaggactgatcttccatttctttttctttgttcccagccatgcttttgtaacttgccaggtggacttgaccaactacattaccatgctgtgcctcagtttacccatttgtaaaatgggattaataatacttacctacctcacaggggtgttgtgaggctctattcatttgctcctttattctttcctgtattctctgtatgtccagcactttgtagccatgggaggaaagggactataaaagtgtacaatgttaatggaatgatacggtacctgaaagccttgttttctagtaagaaaatgctaccttgctgtacatacttataaccttgtatttggaaatgagaaataggtttatattttcagatctctcaaaaatcacatcatttgaccaaagaataatttaagacacatagaacagatttttttaatttatattttcatcctgaccagcttagttctaataatttttagttgtgagtgattaaaaaactttggatcaattttggtcaaacatgccaactttgtagtctgagtgacaggcaagggatttttgggtttaagatgcacttttagcacacatttgtatttcccttggcatatcagattgagctaatggtgatgttatttcaatctaacagccaccaatctgaaattgtatttcaaatgttgattctgtagttctttaaataataatgaagctcatcttatacattttgctttcaccaattgattccttcttcttttagcccactattaaaacatttcttactgaatggttcatgtaggcttgctgaacagcacgcattacttgcttcctgaagagttcccccattcatccatttgtcccattagttgctgtggattatcaagttttgaaggaactgtacatcccaacagactgaaacattctaagtgaaatgagtataatccaagtaactggtgaactttggaggtttggagcttgaagagaatggctaagaagatttgaattatagggagggaacagaaatcatacatgaaaaggttttactgagaaggggaaaaccttagatagagggacatgtgaaacaaaatcatttgaaattttgattcagacatccatttccagtggcaaacagcaaagcctgaacccataaacccaaatgataggtgaagttgggtggttttatccaatgtctcaagcaagcaatgtctgggaatatcatagagtaacaagtgctggtcagccaaagaaacattcactgctggtgaaccaataccataagcatgtattatctaagcacttgatcaagaaatatacatgttgtacaagctctcaattttgttcatttattatcaaatttttaaaatacaagtttggtatgtgatttggaaaagatgccttctggatcttaagccagttgtcagtggaggtcctcagggctgcaaatgtcaagacataaccctgttcctcaccatcatgataccagatacaggtgaatacataggaactatctgcctgtgtcctcaatctcccttcaaacaagatgctgatttgtagggtacttggcaggttaaattaaaccagaagaggtgacttaataaaaaagggaatgacatttagggtataaagatctcataagaaatgtaatatgtaaattatatcttgctttatgttgtaaaatatacattgtttgcgctagaatagaaatgatttcttttcaataaaaagaaagaaggactctaccatgtcttttgttatata

SEQ ID NO: 314303 - DNA, 3518 bp, Homo sapiens
cgtggtcatggtgctgcctgacatctgctgaacgcatttggcttatttctccctttcacactttcaaaaatagatcctcgtccctcccaagatgttgtttacacgaggggcttcataacggattctaacggaagacactgaaaagcgccatggctacttattctgccacatgtgccaacaatagccctgcacagggcatcaacatggccaacagcattgccaacctgagactgaaggccaaggaatatagtttacagaggaaccaggtgccaacagtcaactgaggaaaaaaaataattaaacaggcctaagaagaaatcaaaaaccataagacacctatcctgctctgttatttcttcatctgctggggggaaaaagtaaattacaaacaaacaaacaaagcagaactaaaatattgggaccatggcagagaaaagcaggagaggagcaaaatgaaaattagttaacaaatgttcctcctccctctgggataccaccaccacttgtttctgtgtgtgtttattttgtttttctttcattcatgctttgcttaatgtactccaggcttcttcagataggttcagcccacccacccccatgattgtatgaagttttaaaaaaaactacagcagccaaagaaactatatatatatatatatatatatatatccagaatgattgcctctactgtcctcattgacttgtttgaaccttagtgccttaccctgtcctcttcccagttctctttatagaagctctaggagctttcgaaaagccaaagtctttctgaagaatctgtgctggacagacataattccctttctcattgtctccatctttgttggtcatggtaaggtttttccatcagcctctgaaaaaatagttgtgcacaacatctgctcactggactgtctgatccaatgtaattggctgcgtctggctaattctaagcactaaagtctacatctaagctatagatttaagcttgaagctacagattatatcactatcaccaccacccctcaccctatgcaatcaatcaatcaatcatcttaagttaaagatatttgttgtctttgaatgatttgctgtcacagactatttggtagaagaaatatttttcacctgagagaggaagagaaatttctctagtaacacaaagagtgagttctaaaaggcatgcccacatctctttcgtgccttaaggatagtgagatgcacacttatatatatactgtatatatttatatatttatatatatatttcatatatatatataatattgcaagcttaagtttgcaatttcccaaacaatacaaaaagcaaattacacaccctcaccactgttcttatctctatagtgatgaaacattaattagggatcttgctgcttttctttttctacacgaagttttcattaaagccacagaataattgatagggcagctgtttgagaacaggtcccattttcacattagggctttaaatgaattagaaactatttgaggctataaaaatgtccttgagtttggagcctgagctctggtgaaatgctgatacatctgatctatcatgggaattgcagttagagagagtaaggaataccatttagtcatctatccgttcttcacttagcaggaatatgaaagaaaggcacatgtttaagaggaatacctaaaggtttttctaaattccaacatttaaaaggcaattgtgggctatttttattttttaatattttgaaataaagtttagtgtctagggctgggagccaggactgatcttccatttctttttctttgttcccagccatgcttttgtaacttgccaggtggacttgaccaactacattaccatgctgtgcctcagtttacccatttgtaaaatgggattaataatacttacctacctcacaggggtgttgtgaggctctattcatttgctcctttattctttcctgtattctctgtatgtccagcactttgtagccatgggaggaaagggactataaaagtgtacaatgttaatggaatgatacggtacctgaaagccttgttttctagtaagaaaatgctaccttgctgtacatacttataaccttgtatttggaaatgagaaataggtttatattttcagatctctcaaaaatcacatcatttgaccaaagaataatttaagacacatagaacagatttttttaatttatattttcatcctgaccagcttagttctaataatttttagttgtgagtgattaaaaaactttggatcaattttggtcaaacatgccaactttgtagtctgagtgacaggcaagggatttttgggtttaagatgcacttttagcacacatttgtatttcccttggcatatcagattgagctaatggtgatgttatttcaatctaacagccaccaatctgaaattgtatttcaaatgttgattctgtagttctttaaataataatgaagctcatcttatacattttgctttcaccaattgattccttcttcttttagcccactattaaaacatttcttactgaatggttcatgtaggcttgctgaacagcacgcattacttgcttcctgaagagttcccccattcatccatttgtcccattagttgctgtggattatcaagttttgaaggaactgtacatcccaacagactgaaacattctaagtgaaatgagtataatccaagtaactggtgaactttggaggtttggagcttgaagagaatggctaagaagatttgaattatagggagggaacagaaatcatacatgaaaaggttttactgagaaggggaaaaccttagatagagggacatgtgaaacaaaatcatttgaaattttgattcagacatccatttccagtggcaaacagcaaagcctgaacccataaacccaaatgataggtgaagttgggtggttttatccaatgtctcaagcaagcaatgtctgggaatatcatagagtaacaagtgctggtcagccaaagaaacattcactgctggtgaaccaataccataagcatgtattatctaagcacttgatcaagaaatatacatgttgtacaagctctcaattttgttcatttattatcaaatttttaaaatacaagtttggtatgtgatttggaaaagatgccttctggatcttaagccagttgtcagtggaggtcctcagggctgcaaatgtcaagacataaccctgttcctcaccatcatgataccagatacaggtgaatacataggaactatctgcctgtgtcctcaatctcccttcaaacaagatgctgatttgtagggtacttggcaggttaaattaaaccagaagaggtgacttaataaaaaagggaatgacatttagggtataaagatctcataagaaatgtaatatgtaaattatatcttgctttatgttgtaaaatatacattgtttgcgctagaatagaaatgatttcttttcaataaaaagaaagaaggactctaccatgtcttttgttatata

SEQ ID NO: 314304 - DNA, 970 bp, Homo sapiens
tatgaggattctccccctcttctctcaccacctggctaaaataatatgatagggtctccatgataccactatagtatctatgcttatatggctgggcctcctggtggctcttggcactgtaatttctagtactgtttagattagtattatatgagaataagcttcctgaatagtccacatgtatccaagcatttcctgagaaaagggttagtattatatgaggagggaacagaaatcatacatgaaaaggttttactgagaaggggaaaaccttagatagagggacatgtgaaacaaaatcatttgaaattttgattcagacatccatttccagtggcaaacagcaaagcctgaacccataaacccaaatgataggtgaagttgggtggttttatccaatgtctcaagcaagcaatgtctgggaatatcatagagtaacaagtgctggtcagccaaagaaacattcactgctggtgaaccaataccataagcatgtattatctaagcacttgatcaagaaatatacatgttgtacaagctctcaattttgttcatttattatcaaatttttaaaatacaagtttggtatgtgatttggaaaagatgccttctggatcttaagccagttgtcagtggaggtcctcagggctgcaaatgtcaagacataaccctgttcctcaccatcatgataccagatacaggtgaatacataggaactatctgcctgtgtcctcaatctcccttcaaacaagatgctgatttgtagggtacttggcaggttaaattaaaccagaagaggtgacttaataaaaaagggaatgacatttagggtataaagatctcataagaaatgtaatatgtaaattatatcttgctttatgttgtaaaatatacattgtttgcgctagaatagaaatgatttcttttcaataaaaagaaagaaggactctaccatgtcttttgttatata

SEQ ID NO: 314305 - DNA, 2525 bp, Homo sapiens
ggaaaggaggaagaaggagattgtgatggagaaagggggtctgtgaaacgtcaggcacagcacaaaggctttgccacgtaattacaggctcctattaagtcgagatctgccctcccaggggtctccaattttcttgtattccctacaaagcctcctctgcatgccagtttgtgccttttgaagtgccagagagcttcttgatccaactgagaaggaaaaaggagcccagcaagaagagggggagagagagaaggggaaaggggggaacccaccagcaccctccgtcggactcttgaagccttttttttttaattcttaatttttttttttactctttacaaaaagtaaagtgagaatcctgctctctaatacatctgcaagacatcaccctctcctcctgaaactttagtcactcctgagaatccacaggagtgcagagaggggggaacacgttttcttgaagatgttttaaagctggaacaagccttcttctgttggtgcttgaactcttgcctgggaataacttttttaacctttaaaaaaaccattcactttgattcttctctcccaccccttcttctctcttcttctgtttgcctaactcccccgccctgctggcctccgctttcctctctcccccttgttgttatttttagtctgtgcgtgtggacacttttggagagttggaagggatttttttctcctgacttgaacatagggtgactttttaatattgtattttagtgtggattatctctttggaccgcgccggacttggcctcaggaaagcaaccaaggctgcggaaggcggctggtgcagaacgctctgctctacagaagggggtcccccgccctcttttccaattttttttttttggccttcctctccttccctccctcttcctccctctctctctctctctctccactacccccctctttcttccccactcggctcctctcccccctcgcgcccacagcgtttggtgttgattcgagcgggaagaggggggtgggtgggatcggtgggggagaccatgacctccagctacgggcacgttctggagcggcaaccggcgctgggcggccgcttggacagcccgggcaacctcgacaccctgcaggcgaaaaagaacttctccgtcagtcacctgctagacctggaggaagccggggacatggtggcggcacaggcggatgagaacgtgggcgaggctggccggagcctgctggagtcgccgggactcaccagcggcagcgacaccccgcagcaggacaatgaccagctgaactcagaagaaaaaaagaagagaaagcagcgaaggaataggacaaccttcaatagcagccagctgcaggctttggagcgtgtctttgagcggacacactatcctgatgcttttgtgcgagaagaccttgcccgccgggtgaacctcaccgaggcgagagtgcaggtgtggtttcagaaccgaagagccaagttccgcaggaatgagagagccatgctagccaataaaaacgcttccctcctcaaatcctactcaggagacgtgactgctgtggagcagcccatcgtacctcgtcctgctccgagacccaccgattatctctcctgggggacagcgtctccgtacagatcctcgtccctcccaagatgttgtttacacgaggggcttcataacggattctaacggaagacactgaaaagcgccatggctacttattctgccacatgtgccaacaatagccctgcacagggcatcaacatggccaacagcattgccaacctgagactgaaggccaaggaatatagtttacagaggaaccaggtgccaacagtcaactgaggaaaaaaaataattaaacaggcctaagaagaaatcaaaaaccataagacacctatcctgctctgttatttcttcatctgctggggggaaaaagtaaattacaaacaaacaaacaaagcagaactaaaatattgggaccatggcagagaaaagcaggagaggagcaaaatgaaaattagttaacaaatgttcctcctccctctgggataccaccaccacttgtttctgtgtgtgtttattttgtttttctttcattcatgctttgcttaatgtactccaggcttcttcagataggttcagcccacccacccccatgattgtaatcccagtgctttgggaggccaaggcaggtggatcacctgaggtcaggagttcgagactagcctgttccactgacatttcttagacattcagcaaaacccccaccttaacctcttttctttcttgagggttggtcctgtccccacctccaccctcccaccccctggaagaggaagggcccgggcatcagtggctagtccaaataaaatatgggcttggggatggaatgggtggtggtaagttcacagagtgtagttagatcccaactcccatgacctctggcttcagtggtgggtggggcagggcagatgaaagggcttcagtgggaacctctgagagcattttcctgttcccaat

SEQ ID NO: 314306 - DNA, 5009 bp, Homo sapiens
ggaaaggaggaagaaggagattgtgatggagaaagggggtctgtgaaacgtcaggcacagcacaaaggctttgccacgtaattacaggctcctattaagtcgagatctgccctcccaggggtctccaattttcttgtattccctacaaagcctcctctgcatgccagtttgtgccttttgaagtgccagagagcttcttgatccaactgagaaggaaaaaggagcccagcaagaagagggggagagagagaaggggaaaggggggaacccaccagcaccctccgtcggactcttgaagccttttttttttaattcttaatttttttttttactctttacaaaaagtaaagtgagaatcctgctctctaatacatctgcaagacatcaccctctcctcctgaaactttagtcactcctgagaatccacaggagtgcagagaggggggaacacgttttcttgaagatgttttaaagctggaacaagccttcttctgttggtgcttgaactcttgcctgggaataacttttttaacctttaaaaaaaccattcactttgattcttctctcccaccccttcttctctcttcttctgtttgcctaactcccccgccctgctggcctccgctttcctctctcccccttgttgttatttttagtctgtgcgtgtggacacttttggagagttggaagggatttttttctcctgacttgaacatagggtgactttttaatattgtattttagtgtggattatctctttggaccgcgccggacttggcctcaggaaagcaaccaaggctgcggaaggcggctggtgcagaacgctctgctctacagaagggggtcccccgccctcttttccaattttttttttttggccttcctctccttccctccctcttcctccctctctctctctctctctccactacccccctctttcttccccactcggctcctctcccccctcgcgcccacagcgtttggtgttgattcgagcgggaagaggggggtgggtgggatcggtgggggagaccatgacctccagctacgggcacgttctggagcggcaaccggcgctgggcggccgcttggacagcccgggcaacctcgacaccctgcaggcgaaaaagaacttctccgtcagtcacctgctagacctggaggaagccggggacatggtggcggcacaggcggatgagaacgtgggcgaggctggccggagcctgctggagtcgccgggactcaccagcggcagcgacaccccgcagcaggacaatgaccagctgaactcagaagaaaaaaagaagagaaagcagcgaaggaataggacaaccttcaatagcagccagctgcaggctttggagcgtgtctttgagcggacacactatcctgatgcttttgtgcgagaagaccttgcccgccgggtgaacctcaccgaggcgagagtgcaggtgtggtttcagaaccgaagagccaagttccgcaggaatgagagagccatgctagccaataaaaacgcttccctcctcaaatcctactcaggagacgtgactgctgtggagcagcccatcgtacctcgtcctgctccgagacccaccgattatctctcctgggggacagcgtctccgtacagcgccatggctacttattctgccacatgtgccaacaatagccctgcacagggcatcaacatggccaacagcattgccaacctgagactgaaggccaaggaatatagtttacagaggaaccaggtgccaacagtcaactgaggaaaaaaaataattaaacaggcctaagaagaaatcaaaaaccataagacacctatcctgctctgttatttcttcatctgctggggggaaaaagtaaattacaaacaaacaaacaaagcagaactaaaatattgggaccatggcagagaaaagcaggagaggagcaaaatgaaaattagttaacaaatgttcctcctccctctgggataccaccaccacttgtttctgtgtgtgtttattttgtttttctttcattcatgctttgcttaatgtactccaggcttcttcagataggttcagcccacccacccccatgattgtatgaagttttaaaaaaaactacagcagccaaagaaactatatatatatatatatatatatatatccagaatgattgcctctactgtcctcattgacttgtttgaaccttagtgccttaccctgtcctcttcccagttctctttatagaagctctaggagctttcgaaaagccaaagtctttctgaagaatctgtgctggacagacataattccctttctcattgtctccatctttgttggtcatggtaaggtttttccatcagcctctgaaaaaatagttgtgcacaacatctgctcactggactgtctgatccaatgtaattggctgcgtctggctaattctaagcactaaagtctacatctaagctatagatttaagcttgaagctacagattatatcactatcaccaccacccctcaccctatgcaatcaatcaatcaatcatcttaagttaaagatatttgttgtctttgaatgatttgctgtcacagactatttggtagaagaaatatttttcacctgagagaggaagagaaatttctctagtaacacaaagagtgagttctaaaaggcatgcccacatctctttcgtgccttaaggatagtgagatgcacacttatatatatactgtatatatttatatatttatatatatatttcatatatatatataatattgcaagcttaagtttgcaatttcccaaacaatacaaaaagcaaattacacaccctcaccactgttcttatctctatagtgatgaaacattaattagggatcttgctgcttttctttttctacacgaagttttcattaaagccacagaataattgatagggcagctgtttgagaacaggtcccattttcacattagggctttaaatgaattagaaactatttgaggctataaaaatgtccttgagtttggagcctgagctctggtgaaatgctgatacatctgatctatcatgggaattgcagttagagagagtaaggaataccatttagtcatctatccgttcttcacttagcaggaatatgaaagaaaggcacatgtttaagaggaatacctaaaggtttttctaaattccaacatttaaaaggcaattgtgggctatttttattttttaatattttgaaataaagtttagtgtctagggctgggagccaggactgatcttccatttctttttctttgttcccagccatgcttttgtaacttgccaggtggacttgaccaactacattaccatgctgtgcctcagtttacccatttgtaaaatgggattaataatacttacctacctcacaggggtgttgtgaggctctattcatttgctcctttattctttcctgtattctctgtatgtccagcactttgtagccatgggaggaaagggactataaaagtgtacaatgttaatggaatgatacggtacctgaaagccttgttttctagtaagaaaatgctaccttgctgtacatacttataaccttgtatttggaaatgagaaataggtttatattttcagatctctcaaaaatcacatcatttgaccaaagaataatttaagacacatagaacagatttttttaatttatattttcatcctgaccagcttagttctaataatttttagttgtgagtgattaaaaaactttggatcaattttggtcaaacatgccaactttgtagtctgagtgacaggcaagggatttttgggtttaagatgcacttttagcacacatttgtatttcccttggcatatcagattgagctaatggtgatgttatttcaatctaacagccaccaatctgaaattgtatttcaaatgttgattctgtagttctttaaataataatgaagctcatcttatacattttgctttcaccaattgattccttcttcttttagcccactattaaaacatttcttactgaatggttcatgtaggcttgctgaacagcacgcattacttgcttcctgaagagttcccccattcatccatttgtcccattagttgctgtggattatcaagttttgaaggaactgtacatcccaacagactgaaacattctaagtgaaatgagtataatccaagtaactggtgaactttggaggtttggagcttgaagagaatggctaagaagatttgaattatagggagggaacagaaatcatacatgaaaaggttttactgagaaggggaaaaccttagatagagggacatgtgaaacaaaatcatttgaaattttgattcagacatccatttccagtggcaaacagcaaagcctgaacccataaacccaaatgataggtgaagttgggtggttttatccaatgtctcaagcaagcaatgtctgggaatatcatagagtaacaagtgctggtcagccaaagaaacattcactgctggtgaaccaataccataagcatgtattatctaagcacttgatcaagaaatatacatgttgtacaagctctcaattttgttcatttattatcaaatttttaaaatacaagtttggtatgtgatttggaaaagatgccttctggatcttaagccagttgtcagtggaggtcctcagggctgcaaatgtcaagacataaccctgttcctcaccatcatgataccagatacaggtgaatacataggaactatctgcctgtgtcctcaatctcccttcaaacaagatgctgatttgtagggtacttggcaggttaaattaaaccagaagaggtgacttaataaaaaagggaatgacatttagggtataaagatctcataagaaatgtaatatgtaaattatatcttgctttatgttgtaaaatatacattgtttgcgctagaatagaaatgatttcttttcaataaaaagaaagaaggactctaccatgtcttttgttatata

SEQ ID NO: 314307 - DNA, 1776 bp, Homo sapiens
ggaaaggaggaagaaggagattgtgatggagaaagggggtctgtgaaacgtcaggcacagcacaaaggctttgccacgtaattacaggctcctattaagtcgagatctgccctcccaggggtctccaattttcttgtattccctacaaagcctcctctgcatgccagtttgtgccttttgaagtgccagagagcttcttgatccaactgagaaggaaaaaggagcccagcaagaagagggggagagagagaaggggaaaggggggaacccaccagcaccctccgtcggactcttgaagccttttttttttaattcttaatttttttttttactctttacaaaaagtaaagtgagaatcctgctctctaatacatctgcaagacatcaccctctcctcctgaaactttagtcactcctgagaatccacaggagtgcagagaggggggaacacgttttcttgaagatgttttaaagctggaacaagccttcttctgttggtgcttgaactcttgcctgggaataacttttttaacctttaaaaaaaccattcactttgattcttctctcccaccccttcttctctcttcttctgtttgcctaactcccccgccctgctggcctccgctttcctctctcccccttgttgttatttttagtctgtgcgtgtggacacttttggagagttggaagggatttttttctcctgacttgaacatagggtgactttttaatattgtattttagtgtggattatctctttggaccgcgccggacttggcctcaggaaagcaaccaaggctgcggaaggcggctggtgcagaacgctctgctctacagaagggggtcccccgccctcttttccaattttttttttttggccttcctctccttccctccctcttcctccctctctctctctctctctccactacccccctctttcttccccactcggctcctctcccccctcgcgcccacagcgtttggtgttgattcgagcgggaagaggggggtgggtgggatcggtgggggagaccatgacctccagctacgggcacgttctggagcggcaaccggcgctgggcggccgcttggacagcccgggcaacctcgacaccctgcaggcgaaaaagaacttctccgtcagtcacctgctagacctggaggaagccggggacatggtggcggcacaggcggatgagaacgtgggcgaggctggccggagcctgctggagtcgccgggactcaccagcggcagcgacaccccgcagcaggacaatgaccagctgaactcagaagaaaaaaagaagagaaagcagcgaaggaataggacaaccttcaatagcagccagctgcaggctttggagcgtgtctttgagcggacacactatcctgatgcttttgtgcgagaagaccttgcccgccgggtgaacctcaccgaggcgagagtgcaggtgtggtttcagaaccgaagagccaagttccgcaggaatgagagagccatgctagccaataaaaacgcttccctcctcaaatcctactcaggagacgtgactgctgtggagcagcccatcgtacctcgtcctgctccgagacccaccgattatctctcctgggggacagcgtctccgtacaggtgaatgactggcccactctcccttgctccacttccacatgtttctcagcggtcggtcatgtttcaagctgcttgtgcagctcaccgacatttcttactgggttaatctcttcagagacattcaacttgctgacatcccc

SEQ ID NO: 314308 - DNA, 741 bp, Homo sapiens
ggcttcagacaagtcggaggggagggagacgcagaggcggacaagatggcggcggcagctgtacagggcgggagaagcggtggtagcggaggctgtagtggggctggtggtgcttccaactgcgggacaggaagtggccgtagcggcttgttggataagtggaagatagatgataagcctgtaaaaattgacaagtgggatggatcagctgtgaaaaactctttggatgattctgccaaaaaggtacttctggaaaaatacaaatatgtggagaattttggtctaattgatggtcgcctcaccatctgtacaatctcctgtttctttgccatagtggctttgatttgggattatatgcacccctttccagagtccaaacccgttttggctttgtgtgtcatatcctattttgtgatgatggggattctgaccatttatacctcatataaggagaagagcatctttctcgtggcccacaggaaagatcctacaggaatggatcctgatgatatttggcagctgtcctccagtcttaaaaggtttgatgacaaatacaccttgaagctgaccttcatcagtgggagaacaaagcagcagcgggaagccgagttcacaaagtccattgctaagttttttgaccacagtgggacactggtcatggatgcatatgagcctgaaatatccaggctccatgacagtcttgccatagaaagaaaaataaagtagccaattctaaaagta

SEQ ID NO: 314309 - DNA, 491 bp, Homo sapiens
gagatgagagaagatggtccacgtggtttaaaagtctacaacaaggtaaaggaggtacacagtaattaaagtaggaaagatatgtcaacacctaagaatcagaactagtatcttgaaaagttaggagccctggggttttgtttttgcttttgcttttaaaggatgtgtttgttccctgtatcaccgtgcccagcttactccttttcttcggaaacacttggtgccgtattgttactggttgaatctctgtgtttggtttttaatttgttatctttgcccccatgcttaggtttgatgacaaatacaccttgaagctgaccttcatcagtgggagaacaaagcagcagcgggaagccgagttcacaaagtccattgctaagttttttgaccacagtgggacactggtcatggatgcatatgagcctgaaatatccaggctccatgacagtcttgccatagaaagaaaaataaagtagccaattctaaaagta

SEQ ID NO: 314310 - DNA, 1424 bp, Homo sapiens
ggcttcagacaagtcggaggggagggagacgcagaggcggacaagatggcggcggcagctgtacagggcgggagaagcggtggtagcggaggctgtagtggggctggtggtgcttccaactgcgggacaggaagtggccgtagcggcttgttggataagtggaagatagatgataagcctgtaaaaattgacaagtgggatggatcagctgtgaaaaactctttggatgattctgccaaaaaggtacttctggaaaaatacaaatatgtggagaattttggtctaattgatggtcgcctcaccatctgtacaatctcctgtttctttgccatagtggctttgatttgggattatatgcacccctttccagagtccaaacccgttttggctttgtgtgtcatatcctattttgtgatgatggggattctgaccatttatacctcatataaggagaagagcatctttctcgtggcccacaggaaagatcctacaggaatggatcctgatgatatttggcagctgtcctccagtcttaaaaggtttgatgacaaatacaccttgaagctgaccttcatcagtgggagaacaaagcagcagcgggaagccgagttcacaaagtccattgctaagttttttgaccacagtgggacactggtcatggatgcatatgagcctgaaatatccaggctccatgacagtcttgccatagaaagaaaaataaagtagccaattctaaaagtagccctctttctcctggatcttgctgaattagtggcttggggggtgggggagataaaaagaacttaaaatgggtaaagtaagaaatgttaaaaagtccctgttttgtcctgaaattttagtctattctgggtaaataggattttctgacacagatatgagaagttgtagctctgatgtctagctgtagtctccttgatctgctgattgcattattttaatttgcttttctgggaaagcagttttgctaaaagctgtacagactttttcttttgtacctagcagtactttatatagtatagctttgggccatgtagcattttaagactcaattttaaaaaattattaatctgttgctgactcttaattcctatttcaatatgtgtttccttgaagaattcaggatacaacttcttgtgtatgacagctttccttcacacactatttttgtgggtgtgtatatatctgatttgggaagaatttaaaaaacacatagctttttaatttgtttgaaacagactttctgcctgttacatttttgcttttaaccaattaaagaagccaatggcattttagttttatattgtgttttccactagtatatccctgttgatttgtttgtgccttttattaactgccattttctaaaatttttttcaataaaaggaaggaagatgtgaaaaaaa

SEQ ID NO: 314311 - DNA, 1486 bp, Homo sapiens
ggcttcagacaagtcggaggggagggagacgcagaggcggacaagatggcggcggcagctgtacagggcgggagaagcggtggtagcggaggctgtagtggggctggtggtgcttccaactgcgggacaggaagtggccgtagcggcttgttggataagtggaagatagatgataagcctgtaaaaattgacaagtgggatggatcagctgtgaaaaactctttggatgattctgccaaaaaggtacttctggaaaaatacaaatatgtggagaattttggtctaattgatggtcgcctcaccatctgtacaatctcctgtttctttgccatagtggctttgatttgggattatatgcacccctttccagagtccaaacccgttttggctttgtgtgtcatatcctattttgtgatgatggggattctgaccatttatacctcatataaggagaagagcatctttctcgtggcccacaggaaagatcctacaggaatggatcctgatgatatttggcagctgtcctccagtcttaaaaggtttgatgacaaatacaccttgaagctgaccttcatcagtgggagaacaaagcagcagcgggaagccgagttcacaaagtccattgctaagttttttgaccacagtgggacactggtcatggatgcatatgagcctgaaatatccaggctccatgacagtcttgccatagaaagaaaaataaagtagccaattctaaaagtagccctctttctcctggatcttgctgaattagtggcttggggggtgggggagataaaaagaacttaaaatgggtaaagtaagaaatgttaaaaagtccctgttttgtcctgaaattttagtctattctgggtaaataggattttctgacacagatatgagaagttgtagctctgatgtctagctgtagtctccttgatctgctgattgcattattttaatttgcttttctgggaaagcagttttgctaaaagctgtacagactttttcttttgtacctagcagtactttatatagtatagctttgggccatgtagcattttaagactcaattttaaaaaattattaatctgttgctgactcttaattcctatttcaatatgtgtttccttgaagaattcaggatacaacttcttgtgtatgacagctttccttcacacactatttttgtgggtgtgtatatatctgatttgggaagaatttaaaaaacacatagctttttaatttgtttgaaacagactttctgcctgttacatttttgcttttaaccaattaaagaagccaatggcattttagttttatattgtgttttccactagtatatccctgttgatttgtttgtgccttttattaactgccattttctaaaatttttttcaataaaaggaaggaagatgtgaaaaaaaaaaaagcaaaaaaaaaaggggggggcggcaaaaaaatacccggggggggcccatttgggttc

SEQ ID NO: 314312 - DNA, 1319 bp, Homo sapiens
ggcttcagacaagtcggaggggagggagacgcagaggcggacaagatggcggcggcagctgtacagggcgggagaagcggtggtagcggaggctgtagtggggctggtggtgcttccaactgcgggacaggaagtggccgtagcggcttgttggataagtggaagatagatgataagcctgtaaaaattgacaagtgggatggatcagctgtgaaaaactctttggatgattctgccaaaaaggtacttctggaaaaatacaaatatgtggagaattttggtctaattgatggtcgcctcaccatctgtacaatctcctgtttctttgccatagtggctttgatttgggattatatgcacccctttccagagtccaaacccgttttggctttgtgtgtcatatcctattttgtgatgatggggattctgaccatttatacctcatataaggagaagagcatctttctcgtggcccacaggaaagatcctacaggaatggatcctgatgatatttggcagctgtcctccagtcttaaaaggtttgatgacaaatacaccttgaagctgaccttcatcagtgggagaacaaagcagcagcgggaagccgagttcacaaagtccattgctaagttttttgaccacagtgggacactggtcatggatgcatatgagcctgaaatatccaggctccatgacagtcttgccatagaaagaaaaataaagtagccaattctaaaagtagccctctttctcctggatcttgctgaattagtggcttggggggtgggggagataaaaagaacttaaaatgggtaaagtaagaaatgttaaaaagtccctgttttgtcctgaaattttagtctattctgggtaaataggattttctgacacagatatgagaagttgtagctctgatgtctagctgtagtctccttgatctgctgattgcattattttaatttgcttttctgggaaagcagttttgctaaaagctgtacagactttttcttttgtacctagcagtactttatatagtatagctttgggccatgtagcattttaagactcaattttaaaaaattattaatctgttgctgactcttaattcctatttcaatatgtgtttccttgaagaattcaggatacaacttcttgtgtatgacagctttccttcacacactatttttgtgggtgtgtatatatctgatttgggaagaatttaaaaaacacatagctttttaatttgtttgaaacagactttctgcctgttacatttttgcttttaaccaattaaagaagccaatggcattttagtttta

SEQ ID NO: 314313 - DNA, 1084 bp, Homo sapiens
  misc_feature (1068)..(1069): n is a, c, g, or t
ggcttcagacaagtcggaggggagggagacgcagaggcggacaagatggcggcggcagctgtacagggcgggagaagcggtggtagcggaggctgtagtggggctggtggtgcttccaactgcgggacaggaagtggccgtagcggcttgttggataagtggaagatagatgataagcctgtaaaaattgacaagtgggatggatcagctgtgaaaaactctttggatgattctgccaaaaaggtacttctggaaaaatacaaatatgtggagaattttggtctaattgatggtcgcctcaccatctgtacaatctcctgtttctttgccatagtggctttgatttgggattatatgcacccctttccagagtccaaacccgttttggctttgtgtgtcatatcctattttgtgatgatggggattctgaccatttatacctcatataaggagaagagcatctttctcgtggcccacaggaaagatcctacaggaatggatcctgatgatatttggcagctgtcctccagtcttaaaaggtttgatgacaaatacaccttgaagctgaccttcatcagtgggagaacaaagcagcagcgggaagccgagttcacaaagtccattgctaagttttttgaccacagtgggacactggtcatggatgcatatgagcctgaaatatccaggctccatgacagtcttgccatagaaagaaaaataaagtagccaattctaaaagtagccctctttctcctggatcttgctgaattagtggcttggggggtgggggagataaaaagaacttaaaatgggtaaagtaagaaatgttaaaaagtccctgttttgtcctgaaattttagtctattctgggtaaataggattttctgacacagatatgagaagttgtagctctgatgtctagctgtagtctccttgatctgctgattgcattattttaatttgcttttctgggaaagcagttttgctaaaagctgtacagactttttcttttgtacctagcagtactttatatagtatagctttgggccatgtagcattttaagggtnntgtgggtgcagctca

SEQ ID NO: 314314 - DNA, 1949 bp, Homo sapiens
  misc_feature (301)..(301): n is a, c, g, or t
ggggcacacattttatatacagacctctgagaaacctctcagcagaaaacctgcaggaaggaagtcttcagttaactaaagaagagttaatgtcctagaagagtattctaggcagagattacagcaaatgcaaaagctctcaagtgggagagtacttggggtgtttgaggactatcaaggattgaagaggctgttgtggctggagggaccagggcgagtgaggattgctgagaggtgaggtcagagtgcaaagggccttagggctgggcgaggtgctcacgcctgtaatcccagcactttnagacgcagaggcggacaagatggcggcggcagctgtacagggcgggagaagcggtggtagcggaggctgtagtggggctggtggtgcttccaactgcgggacaggaagtggccgtagcggcttgttggataaggtgaggagccggttcttgggaacagttgaatcctggggaggcctgggaggcggcgagccaaccttcccatcccggtctcccttattttctacggccttttgaggggagcccttgtgtgaccactatcacaaccctacgcacgcttggagcctgcccttgccctcatcacacttcaaacctggacccggtcctctttagaacttcttcttttctcgcaagtgttctggtcctggtcgccacacctttttcgtggaagatagatgataagcctgtaaaaattgacaagtgggatggatcagctgtgaaaaactctttggatgattctgccaaaaaggtacttctggaaaaatacaaatatgtggagaattttggtctaattgatggtcgcctcaccatctgtacaatctcctgtttctttgccatagtggctttgatttgggattatatgcacccctttccagagtccaaacccgttttggctttgtgtgtcatatcctattttgtgatgatggggattctgaccatttatacctcatataaggagaagagcatctttctcgtggcccacaggaaagatcctacaggaatggatcctgatgatatttggcagctgtcctccagtcttaaaaggtttgatgacaaatacaccttgaagctgaccttcatcagtgggagaacaaagcagcagcgggaagccgagttcacaaagtccattgctaagttttttgaccacagtgggacactggtcatggatgcatatgagcctgaaatatccaggctccatgacagtcttgccatagaaagaaaaataaagtagccaattctaaaagtagccctctttctcctggatcttgctgaattagtggcttggggggtgggggagataaaaagaacttaaaatgggtaaagtaagaaatgttaaaaagtccctgttttgtcctgaaattttagtctattctgggtaaataggattttctgacacagatatgagaagttgtagctctgatgtctagctgtagtctccttgatctgctgattgcattattttaatttgcttttctgggaaagcagttttgctaaaagctgtacagactttttcttttgtacctagcagtactttatatagtatagctttgggccatgtagcattttaagactcaattttaaaaaattattaatctgttgctgactcttaattcctatttcaatatgtgtttccttgaagaattcaggatacaacttcttgtgtatgacagctttccttcacacactatttttgtgggtgtgtatatatctgatttgggaagaatttaaaaaacacatagctttttaatttgtttgaaacagactttctgcctgttacatttttgcttttaaccaattaaagaagccaatggcattttagttttatattgtgttttccactagtatatccctgttgatttgtttgtgccttttattaactgccattttctaaaatttttttcaataaaaggaaggaagatgtgaaaaaaa

SEQ ID NO: 314315 - DNA, 1863 bp, Homo sapiens
  misc_feature (301)..(301): n is a, c, g, or t
ggggcacacattttatatacagacctctgagaaacctctcagcagaaaacctgcaggaaggaagtcttcagttaactaaagaagagttaatgtcctagaagagtattctaggcagagattacagcaaatgcaaaagctctcaagtgggagagtacttggggtgtttgaggactatcaaggattgaagaggctgttgtggctggagggaccagggcgagtgaggattgctgagaggtgaggtcagagtgcaaagggccttagggctgggcgaggtgctcacgcctgtaatcccagcactttnagacgcagaggcggacaagatggcggcggcagctgtacagggcgggagaagcggtggtagcggaggctgtagtggggctggtggtgcttccaactgcgggacaggaagtggccgtagcggcttgttggataaggtgaggagccggttcttgggaacagttgaatcctggggaggcctgggaggcggcgagccaaccttcccatcccggtctcccttattttctacggccttttgaggggagcccttgtgtgaccactatcacaaccctacgcacgcttggagcctgcccttgccctcatcacacttcaaacctggacccggtcctctttagaacttcttcttttctcgcaagtgttctggtcctggtcgccacacctttttcgtggaagatagatgataagcctgtaaaaattgacaagtgggatggatcagctgtgaaaaactctttggatgattctgccaaaaagcatagtggctttgatttgggattatatgcacccctttccagagtccaaacccgttttggctttgtgtgtcatatcctattttgtgatgatggggattctgaccatttatacctcatataaggagaagagcatctttctcgtggcccacaggaaagatcctacaggaatggatcctgatgatatttggcagctgtcctccagtcttaaaaggtttgatgacaaatacaccttgaagctgaccttcatcagtgggagaacaaagcagcagcgggaagccgagttcacaaagtccattgctaagttttttgaccacagtgggacactggtcatggatgcatatgagcctgaaatatccaggctccatgacagtcttgccatagaaagaaaaataaagtagccaattctaaaagtagccctctttctcctggatcttgctgaattagtggcttggggggtgggggagataaaaagaacttaaaatgggtaaagtaagaaatgttaaaaagtccctgttttgtcctgaaattttagtctattctgggtaaataggattttctgacacagatatgagaagttgtagctctgatgtctagctgtagtctccttgatctgctgattgcattattttaatttgcttttctgggaaagcagttttgctaaaagctgtacagactttttcttttgtacctagcagtactttatatagtatagctttgggccatgtagcattttaagactcaattttaaaaaattattaatctgttgctgactcttaattcctatttcaatatgtgtttccttgaagaattcaggatacaacttcttgtgtatgacagctttccttcacacactatttttgtgggtgtgtatatatctgatttgggaagaatttaaaaaacacatagctttttaatttgtttgaaacagactttctgcctgttacatttttgcttttaaccaattaaagaagccaatggcattttagttttatattgtgttttccactagtatatccctgttgatttgtttgtgccttttattaactgccattttctaaaatttttttcaataaaaggaaggaagatgtgaaaaaaa

SEQ ID NO: 314316 - DNA, 1492 bp, Homo sapiens
  misc_feature (301)..(301): n is a, c, g, or t
ggggcacacattttatatacagacctctgagaaacctctcagcagaaaacctgcaggaaggaagtcttcagttaactaaagaagagttaatgtcctagaagagtattctaggcagagattacagcaaatgcaaaagctctcaagtgggagagtacttggggtgtttgaggactatcaaggattgaagaggctgttgtggctggagggaccagggcgagtgaggattgctgagaggtgaggtcagagtgcaaagggccttagggctgggcgaggtgctcacgcctgtaatcccagcactttnagacgcagaggcggacaagatggcggcggcagctgtacagggcgggagaagcggtggtagcggaggctgtagtggggctggtggtgcttccaactgcgggacaggaagtggccgtagcggcttgttggataagtggaagatagatgataagcctgtaaaaattgacaagtgggatggatcagctgtgaaaaactctttggatgattctgccaaaaaggagaagagcatctttctcgtggcccacaggaaagatcctacaggaatggatcctgatgatatttggcagctgtcctccagtcttaaaaggtttgatgacaaatacaccttgaagctgaccttcatcagtgggagaacaaagcagcagcgggaagccgagttcacaaagtccattgctaagttttttgaccacagtgggacactggtcatggatgcatatgagcctgaaatatccaggctccatgacagtcttgccatagaaagaaaaataaagtagccaattctaaaagtagccctctttctcctggatcttgctgaattagtggcttggggggtgggggagataaaaagaacttaaaatgggtaaagtaagaaatgttaaaaagtccctgttttgtcctgaaattttagtctattctgggtaaataggattttctgacacagatatgagaagttgtagctctgatgtctagctgtagtctccttgatctgctgattgcattattttaatttgcttttctgggaaagcagttttgctaaaagctgtacagactttttcttttgtacctagcagtactttatatagtatagctttgggccatgtagcattttaagactcaattttaaaaaattattaatctgttgctgactcttaattcctatttcaatatgtgtttccttgaagaattcaggatacaacttcttgtgtatgacagctttccttcacacactatttttgtgggtgtgtatatatctgatttgggaagaatttaaaaaacacatagctttttaatttgtttgaaacagactttctgcctgttacatttttgcttttaaccaattaaagaagccaatggcattttagttttatattgtgttttccactagtatatccctgttgatttgtttgtgccttttattaactgccattttctaaaatttttttcaataaaaggaaggaagatgtgaaaaaaa

SEQ ID NO: 314317 - DNA, 1463 bp, Homo sapiens
  misc_feature (301)..(301): n is a, c, g, or t
ggggcacacattttatatacagacctctgagaaacctctcagcagaaaacctgcaggaaggaagtcttcagttaactaaagaagagttaatgtcctagaagagtattctaggcagagattacagcaaatgcaaaagctctcaagtgggagagtacttggggtgtttgaggactatcaaggattgaagaggctgttgtggctggagggaccagggcgagtgaggattgctgagaggtgaggtcagagtgcaaagggccttagggctgggcgaggtgctcacgcctgtaatcccagcactttnagacgcagaggcggacaagatggcggcggcagctgtacagggcgggagaagcggtggtagcggaggctgtagtggggctggtggtgcttccaactgcgggacaggaagtggccgtagcggcttgttggataagtggaagatagatgataagcctgtaaaaattgacaagtgggatggatcagctgtgaaaaactctttggatgattctgccaaaaaggaaagatcctacaggaatggatcctgatgatatttggcagctgtcctccagtcttaaaaggtttgatgacaaatacaccttgaagctgaccttcatcagtgggagaacaaagcagcagcgggaagccgagttcacaaagtccattgctaagttttttgaccacagtgggacactggtcatggatgcatatgagcctgaaatatccaggctccatgacagtcttgccatagaaagaaaaataaagtagccaattctaaaagtagccctctttctcctggatcttgctgaattagtggcttggggggtgggggagataaaaagaacttaaaatgggtaaagtaagaaatgttaaaaagtccctgttttgtcctgaaattttagtctattctgggtaaataggattttctgacacagatatgagaagttgtagctctgatgtctagctgtagtctccttgatctgctgattgcattattttaatttgcttttctgggaaagcagttttgctaaaagctgtacagactttttcttttgtacctagcagtactttatatagtatagctttgggccatgtagcattttaagactcaattttaaaaaattattaatctgttgctgactcttaattcctatttcaatatgtgtttccttgaagaattcaggatacaacttcttgtgtatgacagctttccttcacacactatttttgtgggtgtgtatatatctgatttgggaagaatttaaaaaacacatagctttttaatttgtttgaaacagactttctgcctgttacatttttgcttttaaccaattaaagaagccaatggcattttagttttatattgtgttttccactagtatatccctgttgatttgtttgtgccttttattaactgccattttctaaaatttttttcaataaaaggaaggaagatgtgaaaaaaa

SEQ ID NO: 314318 - DNA, 1836 bp, Homo sapiens
  misc_feature (301)..(301): n is a, c, g, or t
ggggcacacattttatatacagacctctgagaaacctctcagcagaaaacctgcaggaaggaagtcttcagttaactaaagaagagttaatgtcctagaagagtattctaggcagagattacagcaaatgcaaaagctctcaagtgggagagtacttggggtgtttgaggactatcaaggattgaagaggctgttgtggctggagggaccagggcgagtgaggattgctgagaggtgaggtcagagtgcaaagggccttagggctgggcgaggtgctcacgcctgtaatcccagcactttnagacgcagaggcggacaagatggcggcggcagctgtacagggcgggagaagcggtggtagcggaggctgtagtggggctggtggtgcttccaactgcgggacaggaagtggccgtagcggcttgttggataagctgtgcaagcataggatcgactcaagcctcgtacaaacatggacaagtgcgcgcatggatcaggctcgtgcacaaagactctttgggatgatctctgccaagaacaggtagcttctgggaacacaataccaaattatggtgcgagcacattataggatcgtagagttggagtggctcgccgtcgacacatcgtggtacgaagtctccgtggttgtcgtgttgcacactagatggacttatgcatcttgggcgtattaattagtgcgactcgcctatatgcgcaggagtgcgccaaaggcccgttctctggcattctgtagtgtgcataagtcctacatgttgatggatgatcgcggggatatcttgactcgattatatgatccttcattagtatagggacgaaggagctagtctgttctacgatggacccatcgacgcgaaatgattccttaccagtgaatgggagtccgtggatgactatgttggtcagactgtgtcctccagatctgtacaaacggtttgatgacaaatacaccttgaagctgaccttcatcagtgggagaacaaagcagcagcgggaagccgagttcacaaagtccattgctaagttttttgaccacagtgggacactggtcatggatgcatatgagcctgaaatatccaggctccatgacagtcttgccatagaaagaaaaataaagtagccaattctaaaagtagccctctttctcctggatcttgctgaattagtggcttggggggtgggggagataaaaagaacttaaaatgggtaaagtaagaaatgttaaaaagtccctgttttgtcctgaaattttagtctattctgggtaaataggattttctgacacagatatgagaagttgtagctctgatgtctagctgtagtctccttgatctgctgattgcattattttaatttgcttttctgggaaagcagttttgctaaaagctgtacagactttttcttttgtacctagcagtactttatatagtatagctttgggccatgtagcattttaagactcaattttaaaaaattattaatctgttgctgactcttaattcctatttcaatatgtgtttccttgaagaattcaggatacaacttcttgtgtatgacagctttccttcacacactatttttgtgggtgtgtatatatctgatttgggaagaatttaaaaaacacatagctttttaatttgtttgaaacagactttctgcctgttacatttttgcttttaaccaattaaagaagccaatggcattttagttttatattgtgttttccactagtatatccctgttgatttgtttgtgccttttattaactgccattttctaaaatttttttcaataaaaggaaggaagatgtgaaaaaaa

SEQ ID NO: 314319 - DNA, 1156 bp, Homo sapiens
  misc_feature (301)..(301): n is a, c, g, or t
ggggcacacattttatatacagacctctgagaaacctctcagcagaaaacctgcaggaaggaagtcttcagttaactaaagaagagttaatgtcctagaagagtattctaggcagagattacagcaaatgcaaaagctctcaagtgggagagtacttggggtgtttgaggactatcaaggattgaagaggctgttgtggctggagggaccagggcgagtgaggattgctgagaggtgaggtcagagtgcaaagggccttagggctgggcgaggtgctcacgcctgtaatcccagcactttnagacgcagaggcggacaagatggcggcggcagctgtacagggcgggagaagcggtggtagcggaggctgtagtggggctggtggtgcttccaactgcgggacaggaagtggccgtagcggcttgttggataagtggaagatagatgataagcctgtaaaaattgacaagtgggatggatcagctgtgaaaaactctttggatgattctgccaaaaaggtacttctggaaaaatacaaatatgtggagaattttggtctaattgatggtcgcctcaccatctgtacaatctcctgtttctttgccatagtggctttgatttgggattatatgcacccctttccagagtccaaacccgttttggctttgtgtgtcatatcctattttgtgatgatggggattctgaccatttatacctcatataaggagaagagcatctttctcgtggcccacaggaaagatcctacaggaatggatcctgatgatatttggcagctgtcctccagtcttaaaaggtttgatgacaaatacaccttgaagctgaccttcatcagtgggagaacaaagcagcagcgggaagccgagttcacaaagtccattgcatgagaccaatgaaatcgcaatggcaactcccgtcaggcagatccggaagctcatcagagatgggctgatcatccgcaagccctgtgacggtccattccgggctcgattgccggaaaaacaccttgggccgcggaagggcaggccatgggctaggtagggaaggtacagcatggccgatgcaagaggtccttgtggggacagaggatttggcgtgaaaacgggattaaaaaaggtgttacttcgaagggggtctc

SEQ ID NO: 314320 - DNA, 914 bp, Homo sapiens
  misc_feature (301)..(301): n is a, c, g, or t
ggggcacacattttatatacagacctctgagaaacctctcagcagaaaacctgcaggaaggaagtcttcagttaactaaagaagagttaatgtcctagaagagtattctaggcagagattacagcaaatgcaaaagctctcaagtgggagagtacttggggtgtttgaggactatcaaggattgaagaggctgttgtggctggagggaccagggcgagtgaggattgctgagaggtgaggtcagagtgcaaagggccttagggctgggcgaggtgctcacgcctgtaatcccagcactttnagacgcagaggcggacaagatggcggcggcagctgtacagggcgggagaagcggtggtagcggaggctgtagtgggggtgggggagataaaaagaacttaaaatgggtaaagtaagaaatgttaaaaagtccctgttttgtcctgaaattttagtctattctgggtaaataggattttctgacacagatatgagaagttgtagctctgatgtctagctgtagtctccttgatctgctgattgcattattttaatttgcttttctgggaaagcagttttgctaaaagctgtacagactttttcttttgtacctagcagtactttatatagtatagctttgggccatgtagcattttaagactcaattttaaaaaattattaatctgttgctgactcttaattcctatttcaatatgtgtttccttgaagaattcaggatacaacttcttgtgtatgacagctttccttcacacactatttttgtgggtgtgtatatatctgatttgggaagaatttaaaaaacacatagctttttaatttgtttgaaacagactttctgcctgttacatttttgcttttaaccaattaaagaagccaatggcattttagtttta

SEQ ID NO: 314321 - DNA, 1699 bp, Homo sapiens
  misc_feature (301)..(301): n is a, c, g, or t
ggggcacacattttatatacagacctctgagaaacctctcagcagaaaacctgcaggaaggaagtcttcagttaactaaagaagagttaatgtcctagaagagtattctaggcagagattacagcaaatgcaaaagctctcaagtgggagagtacttggggtgtttgaggactatcaaggattgaagaggctgttgtggctggagggaccagggcgagtgaggattgctgagaggtgaggtcagagtgcaaagggccttagggctgggcgaggtgctcacgcctgtaatcccagcactttnagacgcagaggcggacaagatggcggcggcagctgtacagggcgggagaagcggtggtagcggaggctgtagtggggctggtggtgcttccaactgcgggacaggaagtggccgtagcggcttgttggataagtggaagatagatgataagcctgtaaaaattgacaagtgggatggatcagctgtgaaaaactctttggatgattctgccaaaaaggtacttctggaaaaatacaaatatgtggagaattttggtctaattgatggtcgcctcaccatctgtacaatctcctgtttctttgccatagtggctttgatttgggattatatgcacccctttccagagtccaaacccgttttggctttgtgtgtcatatcctattttgtgatgatggggattctgaccatttatacctcatataaggagaagagcatctttctcgtggcccacaggaaagatcctacaggaatggatcctgatgatatttggcagctgtcctccagtcttaaaaggtttgatgacaaatacaccttgaagctgaccttcatcagtgggagaacaaagcagcagcgggaagccgagttcacaaagtccattgctaagttttttgaccacagtgggacactggtcatggatgcatatgagcctgaaatatccaggctccatgacagtcttgccatagaaagaaaaataaagtagccaattctaaaagtagccctctttctcctggatcttgctgaattagtggcttggggggtgggggagataaaaagaacttaaaatgggtaaagtaagaaatgttaaaaagtccctgttttgtcctgaaattttagtctattctgggtaaataggattttctgacacagatatgagaagttgtagctctgatgtctagctgtagtctccttgatctgctgattgcattattttaatttgcttttctgggaaagcagttttgctaaaagctgtacagactttttcttttgtacctagcagtactttatatagtatagctttgggccatgtagcattttaagactcaattttaaaaaattattaatctgttgctgactcttaattcctatttcaatatgtgtttccttgaagaattcaggatacaacttcttgtgtatgacagctttccttcacacactatttttgtgggtgtgtatatatctgatttgggaagaatttaaaaaacacatagctttttaatttgtttgaaacagactttctgcctgttacatttttgcttttaaccaattaaagaagccaatggcattttagttttatattgtgttttccactagtatatccctgttgatttgtttgtgccttttattaactgccattttctaaaatttttttcaataaaaggaaggaagatgtgaaaaaaa

SEQ ID NO: 314322 - DNA, 1403 bp, Homo sapiens
ggcttcagacaagtcggaggggagggagacgcagaggcggacaagatggcggcggcagctgtacagggcgggagaagcggtggtagcggaggctgtagtggggctggtggtgcttccaactgcgggacaggaagtggccgtagcggcttgttggataagtggaagatagatgataagcctgtaaaaattgacaagtgggatggatcagctgtgaaaaactctttggatgattctgccaaaaaggtacttctggaaaaatacaaatatgtggagaattttggtctaattgatggtcgcctcaccatctgtacaatctcctgtttctttgccatagtggctttgatttgggattatatgcacccctttccagagtccaaacccgttttggctttgtgtgtcatatcctattttgtgatgatggggattctgaccatttatacctcatataaggagaagagcatctttctcgtggcccacaggaaagatcctacaggaatggatcctgatgatatttggcagctgtcctccagtcttaaaaggtttgatgacaaatacaccttgaagctgaccttcatcagtgggagaacaaagcagcagcgggaagccgagttcacaaagtccattgctaagttttttgaccacagtgggacactggtcatggatgcatatgagcctgaaatatccaggctccatgacagtcttgccatagaaagaaaaataaagtagccaattctaaaagtagccctctttctcctggatcttgctgaattagtggcttggggggtgggggagataaaaagaacttaaaatgggtaaagtaagaaatgttaaaaagtccctgttttgtcctgaaattttagtctattctgggtaaataggattttctgacacagatatgagaagttgtagctctgatgtctagctgtagtctccttgatctgctgattgcattattttaatttgcttttctgggaaagcagttttgctaaaagctgtacagactttttcttttgtacctagcagtactttatatagtatagctttgggccatgtagcattttaagactcaattttaaaaaattattaatctgttgctgactcttaattcctatttcaatatgtgtttccttgaagaattcaggatacaacttcttgtgtatgacagctttccttcacacactatttttgtgggtgtgtatatatctgatttgggaagaatttaaaaaacacatagctttttaatttgtttgaaacagactttctgcctgttacatttttgcttttaaccaattaaagaagccaatggcattttagttttatattgtgttttccactagtatatccctgttgatttgtttgtgccttttattaactgcttggggatcctctagagtcagacccga

SEQ ID NO: 314323 - DNA, 1792 bp, Homo sapiens
  misc_feature (301)..(301): n is a, c, g, or t
ggggcacacattttatatacagacctctgagaaacctctcagcagaaaacctgcaggaaggaagtcttcagttaactaaagaagagttaatgtcctagaagagtattctaggcagagattacagcaaatgcaaaagctctcaagtgggagagtacttggggtgtttgaggactatcaaggattgaagaggctgttgtggctggagggaccagggcgagtgaggattgctgagaggtgaggtcagagtgcaaagggccttagggctgggcgaggtgctcacgcctgtaatcccagcactttnagacgcagaggcggacaagatggcggcggcagctgtacagggcgggagaagcggtggtagcggaggctgtagtggggctggtggtgcttccaactgcgggacaggaagtggccgtagcggcttgttggataagagacaagctctcactatattgcccaggctggactcgagctcctgggctcaagctgttctgccacctcagcctcccaagtatctgggatggcagtggaagatagatgataagcctgtaaaaattgacaagtgggatggatcagctgtgaaaaactctttggatgattctgccaaaaaggtacttctggaaaaatacaaatatgtggagaattttggtctaattgatggtcgcctcaccatctgtacaatctcctgtttctttgccatagtggctttgatttgggattatatgcacccctttccagagtccaaacccgttttggctttgtgtgtcatatcctattttgtgatgatggggattctgaccatttatacctcatataaggagaagagcatctttctcgtggcccacaggaaagatcctacaggaatggatcctgatgatatttggcagctgtcctccagtcttaaaaggtttgatgacaaatacaccttgaagctgaccttcatcagtgggagaacaaagcagcagcgggaagccgagttcacaaagtccattgctaagttttttgaccacagtgggacactggtcatggatgcatatgagcctgaaatatccaggctccatgacagtcttgccatagaaagaaaaataaagtagccaattctaaaagtagccctctttctcctggatcttgctgaattagtggcttggggggtgggggagataaaaagaacttaaaatgggtaaagtaagaaatgttaaaaagtccctgttttgtcctgaaattttagtctattctgggtaaataggattttctgacacagatatgagaagttgtagctctgatgtctagctgtagtctccttgatctgctgattgcattattttaatttgcttttctgggaaagcagttttgctaaaagctgtacagactttttcttttgtacctagcagtactttatatagtatagctttgggccatgtagcattttaagactcaattttaaaaaattattaatctgttgctgactcttaattcctatttcaatatgtgtttccttgaagaattcaggatacaacttcttgtgtatgacagctttccttcacacactatttttgtgggtgtgtatatatctgatttgggaagaatttaaaaaacacatagctttttaatttgtttgaaacagactttctgcctgttacatttttgcttttaaccaattaaagaagccaatggcattttagttttatattgtgttttccactagtatatccctgttgatttgtttgtgccttttattaactgccattttctaaaatttttttcaataaaaggaaggaagatgtgaaaaaaa

SEQ ID NO: 314324 - DNA, 1612 bp, Homo sapiens
gcaccgcagtggagcggctccgagatccccggggggctcgcaggcgcgcatccctcctgactgggacgtcgcctccgcagacccctcggaggctgaagcgacgccggaggcaggccaaggacactggttagtggttcagaaaggtaacctcaatgaagaagcccaagggtttggttggagcacaagctgaacgtcgggaaagcctgaaggcgacttcttttgagttcaaggggaagaaagagtctcggcgggaaaatcaggtggaccttcctggacatatcctggaccaggcttttctgctgaagcaccactgtgtgaggaagccatcagatctgtgcaccattaattggaagatagatgataagcctgtaaaaattgacaagtgggatggatcagctgtgaaaaactctttggatgattctgccaaaaaggtacttctggaaaaatacaaatatgtggagaattttggtctaattgatggtcgcctcaccatctgtacaatctcctgtttctttgccatagtggctttgatttgggattatatgcacccctttccagagtccaaacccgttttggctttgtgtgtcatatcctattttgtgatgatggggattctgaccatttatacctcatataaggagaagagcatctttctcgtggcccacaggaaagatcctacaggaatggatcctgatgatatttggcagctgtcctccagtcttaaaaggtttgatgacaaatacaccttgaagctgaccttcatcagtgggagaacaaagcagcagcgggaagccgagttcacaaagtccattgctaagttttttgaccacagtgggacactggtcatggatgcatatgagcctgaaatatccaggctccatgacagtcttgccatagaaagaaaaataaagtagccaattctaaaagtagccctctttctcctggatcttgctgaattagtggcttggggggtgggggagataaaaagaacttaaaatgggtaaagtaagaaatgttaaaaagtccctgttttgtcctgaaattttagtctattctgggtaaataggattttctgacacagatatgagaagttgtagctctgatgtctagctgtagtctccttgatctgctgattgcattattttaatttgcttttctgggaaagcagttttgctaaaagctgtacagactttttcttttgtacctagcagtactttatatagtatagctttgggccatgtagcattttaagactcaattttaaaaaattattaatctgttgctgactcttaattcctatttcaatatgtgtttccttgaagaattcaggatacaacttcttgtgtatgacagctttccttcacacactatttttgtgggtgtgtatatatctgatttgggaagaatttaaaaaacacatagctttttaatttgtttgaaacagactttctgcctgttacatttttgcttttaaccaattaaagaagccaatggcattttagttttatattgtgttttccactagtatatccctgttgatttgtttgtgccttttattaactgccattttctaaaatttttttcaataaaaggaaggaagatgtgaaaaaaa

SEQ ID NO: 314325 - DNA, 1082 bp, Homo sapiens
acaattcagctcggacccacaccacctgagtccaaacccgttttggctttgtgtgtcatatcctattttgtgatgatggggattctgaccatttatacctcatataaggagaagagcatctttctcgtggcccacaggaaagatcctacaggaatggatcctgatgatatttggcagctgtcctccagtcttaaaaggtttgatgacaaatacaccttgaagctgaccttcatcagtgggagaacaaagcagcagcgggaagccgagttcacaaagtccattgctaagttttttgaccacagtgggacactggtcatggatgcatatgagcctgaaatatccaggctccatgacagtcttgccatagaaagaaaaataaagtagccaattctaaaagtagccctctttctcctggatcttgctgaattagtggcttggggggtgggggagataaaaagaacttaaaatgggtaaagtaagaaatgttaaaaagtccctgttttgtcctgaaattttagtctattctgggtaaataggattttctgacacagatatgagaagttgtagctctgatgtctagctgtagtctccttgatctgctgattgcattattttaatttgcttttctgggaaagcagttttgctaaaagctgtacagactttttcttttgtacctagcagtactttatatagtatagctttgggccatgtagcattttaagactcaattttaaaaaattattaatctgttgctgactcttaattcctatttcaatatgtgtttccttgaagaattcaggatacaacttcttgtgtatgacagctttccttcacacactatttttgtgggtgtgtatatatctgatttgggaagaatttaaaaaacacatagctttttaatttgtttgaaacagactttctgcctgttacatttttgcttttaaccaattaaagaagccaatggcattttagttttatattgtgttttccactagtatatccctgttgatttgtttgtgccttttattaactgccattttctaaaatttttttcaataaaaggaaggaagatgtgaaaaaaa

SEQ ID NO: 314326 - DNA, 923 bp, Homo sapiens
  misc_feature (923)..(923): n is a, c, g, or t
ggcttcagacaagtcggaggggagggagacgcagaggcggacaagatggcggcggcagctgtacagggcgggagaagcggtggtagcggaggctgtagtggggctggtggtgcttccaactgcgggacaggaagtggccgtagcggcttgttggataagtggaagatagatgataagcctgtaaaaattgacaagtgggatggatcagctgtgaaaaactctttggatgattctgccaaaaaggtacttctggaaaaatacaaatatgtggagaattttggtctaattgatggtcgcctcaccatctgtacaatctcctgtttctttgccatagtggctttgatttgggattatatgcacccctttccagagtccaaacccgttttggctttgtgtgtcatatcctattttgtgatgatggggattctgaccatttatacctcatataaggagaagagcatctttctcgtggcccacaggaaagatcctacaggaatggatcctgatgatatttggcagctgtcctccagtcttaaaaggtttgatgacaaatacaccttgaagctgaccttcatcagtgggagaacaaagcagcagcgggaagccgagttcacaaagtccattgctaagttttttgaccacagtgggacactggtcatggatgcatatgagcctgaaatatccaggctccatgacagtcttgccatagaaagaaaaataaagtagccaattctaaaagtagccctctttctcctggattgtgataggtgggggggggggtaacgacttcatggtcgtgaagtaagccgtgccggattgcttccgggaagatttgaaaattaagggcgtagggcgaacgggggataaggggagaggagatttgccatattgggtacaggcctgtggagcctggggggaaatgn

SEQ ID NO: 314327 - DNA, 814 bp, Homo sapiens
ggcttcagacaagtcggaggggagggagacgcagaggcggacaagatggcggcggcagctgtacagggcgggagaagcggtggtagcggaggctgtagtggggctggtggtgcttccaactgcgggacaggaagtggccgtagcggcttgttggataagtggaagatagatgataagcctgtaaaaattgacaagtgggatggatcagctgtgaaaaactctttggatgattctgccaaaaaggtacttctggaaaaatacaaatatgtggagaattttggtctaattgatggtcgcctcaccatctgtacaatctcctgtttctttgccatagtggctttgatttgggattatatgcacccctttccagagtccaaacccgttttggctttgtgtgtcatatcctattttgtgatgatggggattctgaccatttatacctcatataaggagaagagcatctttctcgtggcccacaggaaagatcctacaggaatggatcctgatgatatttggcagctgtcctccagtcttaaaaggtttgatgacaaatacaccttgaagctgaccttcatcagtgggagaacaaagcagcagcgggaagccgagttcacaaagtccattgctaagttttttgaccacagtgggacactggtcatggatgcatatgagcctgaaatatccaggctccatgacagtcttgccatagaaagaaaaataaagtagccaattctaaaagtaaaaaaaacacacacaaaaaattttgggcgctcgccctgaaagtttaaacactgtggggcgcggcccctagagt

SEQ ID NO: 314328 - DNA, 1060 bp, Homo sapiens
  misc_feature (301)..(301): n is a, c, g, or t
ggggcacacattttatatacagacctctgagaaacctctcagcagaaaacctgcaggaaggaagtcttcagttaactaaagaagagttaatgtcctagaagagtattctaggcagagattacagcaaatgcaaaagctctcaagtgggagagtacttggggtgtttgaggactatcaaggattgaagaggctgttgtggctggagggaccagggcgagtgaggattgctgagaggtgaggtcagagtgcaaagggccttagggctgggcgaggtgctcacgcctgtaatcccagcactttnagacgcagaggcggacaagatggcggcggcagctgtacagggcgggagctggtggtgcttccaactgcgggacaggaagtggccgtagcggcttgttggataagtggaagatagatgataagcctgtaaaaattgacaagtgggatggatcagctgtgaaaaactctttggatgattctgccaaaaaggtacttctggaaaaatacaaatatgtggagaattttggtctaattgatggtcgcctcaccatctgtacaatctcctgtttctttgccatagtggctttgatttgggattatatgcacccctttccagagtccaaacccgttttggctttgtgtgtcatatcctattttgtgatgatggggattctgaccatttatacctcatataaggagaagagcatctttctcgtggcccacaggaaagatcctacaggaatggatcctgatgatatttggcagctgtcctccagtcttaaaaggtttgatgacaaatacaccttgaagctgaccttcatcagtgggagaacaaagcagcagcgggaagccgagttcacaaagtccattgctaagttttttgaccacagtgggacactggtcatggatgcatatgagcctgaaatatccaggctccatgacagtcttgccatagaaagaaaaataaagtagccaattctaaaagtaaaaaaaacacacacaaaaaattttgggcgctcgccctgaaagtttaaacactgtggggcgcggcccctagagt

SEQ ID NO: 314329 - DNA, 750 bp, Homo sapiens
  misc_feature (718)..(718): n is a, c, g, or t
ggcgtttccacggacgcccaggagacagccggttgctgagccgggagcgctgactggcccggctgggcaggtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaaggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattgttcggtttggaagtagtaaaattgacaaagagctaataaaccgaatagagagagccaccggccaaagaccacaccacttcctgcgcagaggcatcttcttctcacacagagatatgaatcaggttcttgatgcctatgaaaataagaagccattttatctgtacacgggccggggcccctcttctgaagcaatgcatgtaggtcacctcattccatttattttcacaaaaagttggctcccaggaatgttattttaaccgnttgcccctttgggttccatcccaaaaattaaa

SEQ ID NO: 314330 - DNA, 490 bp, Homo sapiens
ttgctgcccgccgcgttctggcactgtgaggcgcggagcctgccaccgacccctcgcccctttcctctgagcgccgccgacccaccccgtctccctttcccactggcacccttcatcgtctccgcctgttcgcttttcccgaggagagaggcccccatttttatttagcgcctgccatgtgccagaggctttgcgtagtgttgcacttagtcccctcaacggtaatgttagcaggcttctccatgcccattccacagatgaggaaaccgaaggggaagcagaaaagtaatgcgacccttgcccaaggtttcgaataagtccaagctgggattgaaacccaggcgtctgtgaccccagaactcctgatctttccactgcactgtgccgcctcggtgaacagatgcggggaatttacagtttctctttccaccgcccacgactacacaaaatcagtcacactgacgctgagggtggggaacgggaagagggt

SEQ ID NO: 314331 - DNA, 2813 bp, Homo sapiens
caatgaccagctaatggctcgattctcaagagggtttcattggtctcaacctggccccccaggcaacccacccctgattggacagtctcatcaagaagaagggaaactgaaagaaagaggggaagagtattaaagaccatttctggctgggcagggcactctcagcagctcaactgcccagcgtgaccagtggccacctctgcagtgtcttccacaacctggtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaaggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattgttcggtttggaagtagtaaaattgacaaagagctaataaaccgaatagagagagccaccggccaaagaccacaccacttcctgcgcagaggcatcttcttctcacacagagatatgaatcaggttcttgatgcctatgaaaataagaagccattttatctgtacacgggccggggcccctcttctgaagcaatgcatgtaggtcacctcattccatttattttcacaaagtggctccaggatgtatttaacgtgcccttggtcatccagatgacggatgacgagaagtatctgtggaaggacctgaccctggaccaggcctatagctatgctgtggagaatgccaaggacatcatcgcctgtggctttgacatcaacaagactttcatattctctgacctggactacatggggatgagctcaggtttctacaaaaatgtggtgaagattcaaaagcatgttaccttcaaccaagtgaaaggcattttcggcttcactgacagcgactgcattgggaagatcagttttcctgccatccaggctgctccctccttcagcaactcattcccacagatcttccgagacaggacggatatccagtgccttatcccatgtgccattgaccaggatccttactttagaatgacaagggacgtcgcccccaggatcggctatcctaaaccagccctgttgcactccaccttcttcccagccctgcagggcgcccagaccaaaatgagtgccagcgaccccaactcctccatcttcctcaccgacacggccaagcagatcaaaaccaaggtcaataagcatgcgttttctggagggagagacaccatcgaggagcacaggcagtttgggggcaactgtgatgtggacgtgtctttcatgtacctgaccttcttcctcgaggacgacgacaagctcgagcagatcaggaaggattacaccagcggagccatgctcaccggtgagctcaagaaggcactcatagaggttctgcagcccttgatcgcagagcaccaggcccggcgcaaggaggtcacggatgagatagtgaaagagttcatgactccccggaagctgtccttcgactttcagtagcactcgttttacatatgcttataaaagaagtgatgtatcagtaatgtatcaataatcccagcccagtcaaagcaccgccacctgtaggcttctgtctcatggtaattactgggcctggcctctgtaagcctgtgtatgttatcaatactgtttcttcctgtgagttccattatttctatctcttatgggcaaagcattgtgggtaattggtgctggctaacattgcatggtcggatagagaagtccagctgtgagtctctccccaaagcagccccacagtggagcctttggctggaagtccatgggccaccctgttcttgtccatggaggactccgagggttccaagtatactcttaagacccactctgtttaaaaatatatattctatgtatgcgtatatggaattgaaatgtcattattgtaacctagaaagtgctttgaaatattgatgtggggaggtttattgagcacaagatgtatttcagcccatgccccctcccaaaaagaaattgataagtaaaagcttcgttatacatttgactaagaaatcacccagctttaaagctgcttttaacaatgaagattgaacagagttcagcaattttgattaaattaagacttgggggtgaaactttccagtttactgaactccagaccatgcatgtagtccactccagaaatcatgctcgcttcccttggcacaccagtgttctcctgccaaatgaccctagaccctctgtcctgcagagtcagggtggcttttcccctgactgtgtccgatgccaaggagtcctggcctccgcagatgcttcattttgacccttggctgcagtggaagtcagcacagagcagtgccctggctgtgtccctggacgggtggacttagctagggagaaagtcgaggcagcagccctcgaggccctcacagatgtctaggcaggcctcatttcatcacgcagcatgtgcaggcctggaagagcaaagccaaatctcagggaagtccttggttgatgtatctgggtctcctctggagcactctgccctcctgtcacccagtagagtaaataaacttccttggctcctgaactcttgtcattgtgc

SEQ ID NO: 314332 - DNA, 2662 bp, Homo sapiens
ggcgtttccacggacgcccaggagacagccggttgctgagccgggagcgctgactggcccggctgggcaggtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaaggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattgttcggtttggaagtagtaaaattgacaaagagctaataaaccgaatagagagagccaccggccaaagaccacaccacttcctgcgcagaggcatcttcttctcacacagagatatgaatcaggttcttgatgcctatgaaaataagaagccattttatctgtacacgggccggggcccctcttctgaagcaatgcatgtaggtcacctcattccatttattttcacaaagtggctccaggatgtatttaacgtgcccttggtcatccagatgacggatgacgagaagtatctgtggaaggacctgaccctggaccaggcctatagctatgctgtggagaatgccaaggacatcatcgcctgtggctttgacatcaacaagactttcatattctctgacctggactacatggggatgagctcaggtttctacaaaaatgtggtgaagattcaaaagcatgttaccttcaaccaagtgaaaggcattttcggcttcactgacagcgactgcattgggaagatcagttttcctgccatccaggctgctccctccttcagcaactcattcccacagatcttccgagacaggacggatatccagtgccttatcccatgtgccattgaccaggatccttactttagaatgacaagggacgtcgcccccaggatcggctatcctaaaccagccctgttgcactccaccttcttcccagccctgcagggcgcccagaccaaaatgagtgccagcgaccccaactcctccatcttcctcaccgacacggccaagcagatcaaaaccaaggtcaataagcatgcgttttctggagggagagacaccatcgaggagcacaggcagtttgggggcaactgtgatgtggacgtgtctttcatgtacctgaccttcttcctcgaggacgacgacaagctcgagcagatcaggaaggattacaccagcggagccatgctcaccggtgagctcaagaaggcactcatagaggttctgcagcccttgatcgcagagcaccaggcccggcgcaaggaggtcacggatgagatagtgaaagagttcatgactccccggaagctgtccttcgactttcagtagcactcgttttacatatgcttataaaagaagtgatgtatcagtaatgtatcaataatcccagcccagtcaaagcaccgccacctgtaggcttctgtctcatggtaattactgggcctggcctctgtaagcctgtgtatgttatcaatactgtttcttcctgtgagttccattatttctatctcttatgggcaaagcattgtgggtaattggtgctggctaacattgcatggtcggatagagaagtccagctgtgagtctctccccaaagcagccccacagtggagcctttggctggaagtccatgggccaccctgttcttgtccatggaggactccgagggttccaagtatactcttaagacccactctgtttaaaaatatatattctatgtatgcgtatatggaattgaaatgtcattattgtaacctagaaagtgctttgaaatattgatgtggggaggtttattgagcacaagatgtatttcagcccatgccccctcccaaaaagaaattgataagtaaaagcttcgttatacatttgactaagaaatcacccagctttaaagctgcttttaacaatgaagattgaacagagttcagcaattttgattaaattaagacttgggggtgaaactttccagtttactgaactccagaccatgcatgtagtccactccagaaatcatgctcgcttcccttggcacaccagtgttctcctgccaaatgaccctagaccctctgtcctgcagagtcagggtggcttttcccctgactgtgtccgatgccaaggagtcctggcctccgcagatgcttcattttgacccttggctgcagtggaagtcagcacagagcagtgccctggctgtgtccctggacgggtggacttagctagggagaaagtcgaggcagcagccctcgaggccctcacagatgtctaggcaggcctcatttcatcacgcagcatgtgcaggcctggaagagcaaagccaaatctcagggaagtccttggttgatgtatctgggtctcctctggagcactctgccctcctgtcacccagtagagtaaataaacttccttggctcctgaactcttgtcattgtgc

SEQ ID NO: 314333 - DNA, 2723 bp, Homo sapiens
ggcgtttccacggacgcccaggagacagccggttgctgagccgggagcgctgactggcccggctgggcaggtcagcagctcaactgcccagcgtgaccagtggccacctctgcagtgtcttccacaacctggtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaaggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattgttcggtttggaagtagtaaaattgacaaagagctaataaaccgaatagagagagccaccggccaaagaccacaccacttcctgcgcagaggcatcttcttctcacacagagatatgaatcaggttcttgatgcctatgaaaataagaagccattttatctgtacacgggccggggcccctcttctgaagcaatgcatgtaggtcacctcattccatttattttcacaaagtggctccaggatgtatttaacgtgcccttggtcatccagatgacggatgacgagaagtatctgtggaaggacctgaccctggaccaggcctatagctatgctgtggagaatgccaaggacatcatcgcctgtggctttgacatcaacaagactttcatattctctgacctggactacatggggatgagctcaggtttctacaaaaatgtggtgaagattcaaaagcatgttaccttcaaccaagtgaaaggcattttcggcttcactgacagcgactgcattgggaagatcagttttcctgccatccaggctgctccctccttcagcaactcattcccacagatcttccgagacaggacggatatccagtgccttatcccatgtgccattgaccaggatccttactttagaatgacaagggacgtcgcccccaggatcggctatcctaaaccagccctgttgcactccaccttcttcccagccctgcagggcgcccagaccaaaatgagtgccagcgaccccaactcctccatcttcctcaccgacacggccaagcagatcaaaaccaaggtcaataagcatgcgttttctggagggagagacaccatcgaggagcacaggcagtttgggggcaactgtgatgtggacgtgtctttcatgtacctgaccttcttcctcgaggacgacgacaagctcgagcagatcaggaaggattacaccagcggagccatgctcaccggtgagctcaagaaggcactcatagaggttctgcagcccttgatcgcagagcaccaggcccggcgcaaggaggtcacggatgagatagtgaaagagttcatgactccccggaagctgtccttcgactttcagtagcactcgttttacatatgcttataaaagaagtgatgtatcagtaatgtatcaataatcccagcccagtcaaagcaccgccacctgtaggcttctgtctcatggtaattactgggcctggcctctgtaagcctgtgtatgttatcaatactgtttcttcctgtgagttccattatttctatctcttatgggcaaagcattgtgggtaattggtgctggctaacattgcatggtcggatagagaagtccagctgtgagtctctccccaaagcagccccacagtggagcctttggctggaagtccatgggccaccctgttcttgtccatggaggactccgagggttccaagtatactcttaagacccactctgtttaaaaatatatattctatgtatgcgtatatggaattgaaatgtcattattgtaacctagaaagtgctttgaaatattgatgtggggaggtttattgagcacaagatgtatttcagcccatgccccctcccaaaaagaaattgataagtaaaagcttcgttatacatttgactaagaaatcacccagctttaaagctgcttttaacaatgaagattgaacagagttcagcaattttgattaaattaagacttgggggtgaaactttccagtttactgaactccagaccatgcatgtagtccactccagaaatcatgctcgcttcccttggcacaccagtgttctcctgccaaatgaccctagaccctctgtcctgcagagtcagggtggcttttcccctgactgtgtccgatgccaaggagtcctggcctccgcagatgcttcattttgacccttggctgcagtggaagtcagcacagagcagtgccctggctgtgtccctggacgggtggacttagctagggagaaagtcgaggcagcagccctcgaggccctcacagatgtctaggcaggcctcatttcatcacgcagcatgtgcaggcctggaagagcaaagccaaatctcagggaagtccttggttgatgtatctgggtctcctctggagcactctgccctcctgtcacccagtagagtaaataaacttccttggctcctgaactcttgtcattgtgc

SEQ ID NO: 314334 - DNA, 3026 bp, Homo sapiens
caatgaccagctaatggctcgattctcaagagggtttcattggtctcaacctggccccccaggcaacccacccctgattggacagtctcatcaagaaggttggtcaagagctcaagtgtttctgagaatctgggtgatttataagaaacccttagctgaatgcagggtggggagaacgaaagacaaaagcatcttttttcagaagggaaactgaaagaaagaggggaagagtattaaagaccatttctggctgggcagggcactctcagcagctcaactgcccagcgtgaccagtggccacctctgcagtgtcttccacaacctgggtgaatctacttctcttaacaaagtctcaatgtcctatttgcaatttatgtggtaaacactgaagacaatggtccttaaccttttggcatctcagcctcctttcgaaagtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaaggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattgttcggtttggaagtagtaaaattgacaaagagctaataaaccgaatagagagagccaccggccaaagaccacaccacttcctgcgcagaggcatcttcttctcacacagagatatgaatcaggttcttgatgcctatgaaaataagaagccattttatctgtacacgggccggggcccctcttctgaagcaatgcatgtaggtcacctcattccatttattttcacaaagtggctccaggatgtatttaacgtgcccttggtcatccagatgacggatgacgagaagtatctgtggaaggacctgaccctggaccaggcctatagctatgctgtggagaatgccaaggacatcatcgcctgtggctttgacatcaacaagactttcatattctctgacctggactacatggggatgagctcaggtttctacaaaaatgtggtgaagattcaaaagcatgttaccttcaaccaagtgaaaggcattttcggcttcactgacagcgactgcattgggaagatcagttttcctgccatccaggctgctccctccttcagcaactcattcccacagatcttccgagacaggacggatatccagtgccttatcccatgtgccattgaccaggatccttactttagaatgacaagggacgtcgcccccaggatcggctatcctaaaccagccctgttgcactccaccttcttcccagccctgcagggcgcccagaccaaaatgagtgccagcgaccccaactcctccatcttcctcaccgacacggccaagcagatcaaaaccaaggtcaataagcatgcgttttctggagggagagacaccatcgaggagcacaggcagtttgggggcaactgtgatgtggacgtgtctttcatgtacctgaccttcttcctcgaggacgacgacaagctcgagcagatcaggaaggattacaccagcggagccatgctcaccggtgagctcaagaaggcactcatagaggttctgcagcccttgatcgcagagcaccaggcccggcgcaaggaggtcacggatgagatagtgaaagagttcatgactccccggaagctgtccttcgactttcagtagcactcgttttacatatgcttataaaagaagtgatgtatcagtaatgtatcaataatcccagcccagtcaaagcaccgccacctgtaggcttctgtctcatggtaattactgggcctggcctctgtaagcctgtgtatgttatcaatactgtttcttcctgtgagttccattatttctatctcttatgggcaaagcattgtgggtaattggtgctggctaacattgcatggtcggatagagaagtccagctgtgagtctctccccaaagcagccccacagtggagcctttggctggaagtccatgggccaccctgttcttgtccatggaggactccgagggttccaagtatactcttaagacccactctgtttaaaaatatatattctatgtatgcgtatatggaattgaaatgtcattattgtaacctagaaagtgctttgaaatattgatgtggggaggtttattgagcacaagatgtatttcagcccatgccccctcccaaaaagaaattgataagtaaaagcttcgttatacatttgactaagaaatcacccagctttaaagctgcttttaacaatgaagattgaacagagttcagcaattttgattaaattaagacttgggggtgaaactttccagtttactgaactccagaccatgcatgtagtccactccagaaatcatgctcgcttcccttggcacaccagtgttctcctgccaaatgaccctagaccctctgtcctgcagagtcagggtggcttttcccctgactgtgtccgatgccaaggagtcctggcctccgcagatgcttcattttgacccttggctgcagtggaagtcagcacagagcagtgccctggctgtgtccctggacgggtggacttagctagggagaaagtcgaggcagcagccctcgaggccctcacagatgtctaggcaggcctcatttcatcacgcagcatgtgcaggcctggaagagcaaagccaaatctcagggaagtccttggttgatgtatctgggtctcctctggagcactctgccctcctgtcacccagtagagtaaataaacttccttggctcctgaactcttgtcattgtgc

SEQ ID NO: 314335 - DNA, 2689 bp, Homo sapiens
caatgaccagctaatggctcgattctcaagagggtttcattggtctcaacctggccccccaggcaacccacccctgattggacagtctcatcaagaagtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaaggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattgttcggtttggaagtagtaaaattgacaaagagctaataaaccgaatagagagagccaccggccaaagaccacaccacttcctgcgcagaggcatcttcttctcacacagagatatgaatcaggttcttgatgcctatgaaaataagaagccattttatctgtacacgggccggggcccctcttctgaagcaatgcatgtaggtcacctcattccatttattttcacaaagtggctccaggatgtatttaacgtgcccttggtcatccagatgacggatgacgagaagtatctgtggaaggacctgaccctggaccaggcctatagctatgctgtggagaatgccaaggacatcatcgcctgtggctttgacatcaacaagactttcatattctctgacctggactacatggggatgagctcaggtttctacaaaaatgtggtgaagattcaaaagcatgttaccttcaaccaagtgaaaggcattttcggcttcactgacagcgactgcattgggaagatcagttttcctgccatccaggctgctccctccttcagcaactcattcccacagatcttccgagacaggacggatatccagtgccttatcccatgtgccattgaccaggatccttactttagaatgacaagggacgtcgcccccaggatcggctatcctaaaccagccctgttgcactccaccttcttcccagccctgcagggcgcccagaccaaaatgagtgccagcgaccccaactcctccatcttcctcaccgacacggccaagcagatcaaaaccaaggtcaataagcatgcgttttctggagggagagacaccatcgaggagcacaggcagtttgggggcaactgtgatgtggacgtgtctttcatgtacctgaccttcttcctcgaggacgacgacaagctcgagcagatcaggaaggattacaccagcggagccatgctcaccggtgagctcaagaaggcactcatagaggttctgcagcccttgatcgcagagcaccaggcccggcgcaaggaggtcacggatgagatagtgaaagagttcatgactccccggaagctgtccttcgactttcagtagcactcgttttacatatgcttataaaagaagtgatgtatcagtaatgtatcaataatcccagcccagtcaaagcaccgccacctgtaggcttctgtctcatggtaattactgggcctggcctctgtaagcctgtgtatgttatcaatactgtttcttcctgtgagttccattatttctatctcttatgggcaaagcattgtgggtaattggtgctggctaacattgcatggtcggatagagaagtccagctgtgagtctctccccaaagcagccccacagtggagcctttggctggaagtccatgggccaccctgttcttgtccatggaggactccgagggttccaagtatactcttaagacccactctgtttaaaaatatatattctatgtatgcgtatatggaattgaaatgtcattattgtaacctagaaagtgctttgaaatattgatgtggggaggtttattgagcacaagatgtatttcagcccatgccccctcccaaaaagaaattgataagtaaaagcttcgttatacatttgactaagaaatcacccagctttaaagctgcttttaacaatgaagattgaacagagttcagcaattttgattaaattaagacttgggggtgaaactttccagtttactgaactccagaccatgcatgtagtccactccagaaatcatgctcgcttcccttggcacaccagtgttctcctgccaaatgaccctagaccctctgtcctgcagagtcagggtggcttttcccctgactgtgtccgatgccaaggagtcctggcctccgcagatgcttcattttgacccttggctgcagtggaagtcagcacagagcagtgccctggctgtgtccctggacgggtggacttagctagggagaaagtcgaggcagcagccctcgaggccctcacagatgtctaggcaggcctcatttcatcacgcagcatgtgcaggcctggaagagcaaagccaaatctcagggaagtccttggttgatgtatctgggtctcctctggagcactctgccctcctgtcacccagtagagtaaataaacttccttggctcctgaactcttgtcattgtgc

SEQ ID NO: 314336 - DNA, 2747 bp, Homo sapiens
ggcgtttccacggacgcccaggagacagccggttgctgagccgggagcgctgactggcccggctgggcaggatgttcctgaactccaagttgaaaaacctctgaagttcaactcaattctgaaagtcaacaaagaaataaaggaggatgtcaatagtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaaggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattgttcggtttggaagtagtaaaattgacaaagagctaataaaccgaatagagagagccaccggccaaagaccacaccacttcctgcgcagaggcatcttcttctcacacagagatatgaatcaggttcttgatgcctatgaaaataagaagccattttatctgtacacgggccggggcccctcttctgaagcaatgcatgtaggtcacctcattccatttattttcacaaagtggctccaggatgtatttaacgtgcccttggtcatccagatgacggatgacgagaagtatctgtggaaggacctgaccctggaccaggcctatagctatgctgtggagaatgccaaggacatcatcgcctgtggctttgacatcaacaagactttcatattctctgacctggactacatggggatgagctcaggtttctacaaaaatgtggtgaagattcaaaagcatgttaccttcaaccaagtgaaaggcattttcggcttcactgacagcgactgcattgggaagatcagttttcctgccatccaggctgctccctccttcagcaactcattcccacagatcttccgagacaggacggatatccagtgccttatcccatgtgccattgaccaggatccttactttagaatgacaagggacgtcgcccccaggatcggctatcctaaaccagccctgttgcactccaccttcttcccagccctgcagggcgcccagaccaaaatgagtgccagcgaccccaactcctccatcttcctcaccgacacggccaagcagatcaaaaccaaggtcaataagcatgcgttttctggagggagagacaccatcgaggagcacaggcagtttgggggcaactgtgatgtggacgtgtctttcatgtacctgaccttcttcctcgaggacgacgacaagctcgagcagatcaggaaggattacaccagcggagccatgctcaccggtgagctcaagaaggcactcatagaggttctgcagcccttgatcgcagagcaccaggcccggcgcaaggaggtcacggatgagatagtgaaagagttcatgactccccggaagctgtccttcgactttcagtagcactcgttttacatatgcttataaaagaagtgatgtatcagtaatgtatcaataatcccagcccagtcaaagcaccgccacctgtaggcttctgtctcatggtaattactgggcctggcctctgtaagcctgtgtatgttatcaatactgtttcttcctgtgagttccattatttctatctcttatgggcaaagcattgtgggtaattggtgctggctaacattgcatggtcggatagagaagtccagctgtgagtctctccccaaagcagccccacagtggagcctttggctggaagtccatgggccaccctgttcttgtccatggaggactccgagggttccaagtatactcttaagacccactctgtttaaaaatatatattctatgtatgcgtatatggaattgaaatgtcattattgtaacctagaaagtgctttgaaatattgatgtggggaggtttattgagcacaagatgtatttcagcccatgccccctcccaaaaagaaattgataagtaaaagcttcgttatacatttgactaagaaatcacccagctttaaagctgcttttaacaatgaagattgaacagagttcagcaattttgattaaattaagacttgggggtgaaactttccagtttactgaactccagaccatgcatgtagtccactccagaaatcatgctcgcttcccttggcacaccagtgttctcctgccaaatgaccctagaccctctgtcctgcagagtcagggtggcttttcccctgactgtgtccgatgccaaggagtcctggcctccgcagatgcttcattttgacccttggctgcagtggaagtcagcacagagcagtgccctggctgtgtccctggacgggtggacttagctagggagaaagtcgaggcagcagccctcgaggccctcacagatgtctaggcaggcctcatttcatcacgcagcatgtgcaggcctggaagagcaaagccaaatctcagggaagtccttggttgatgtatctgggtctcctctggagcactctgccctcctgtcacccagtagagtaaataaacttccttggctcctgaactcttgtcattgtgc

SEQ ID NO: 314337 - DNA, 2650 bp, Homo sapiens
  misc_feature (28)..(28): n is a, c, g, or t
  misc_feature (49)..(49): n is a, c, g, or t
cgctgactggcccggctgggcaggagtntactatttgttaaacagcctnctttcgaaagtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaaggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattgttcggtttggaagtagtaaaattgacaaagagctaataaaccgaatagagagagccaccggccaaagaccacaccacttcctgcgcagaggcatcttcttctcacacagagatatgaatcaggttcttgatgcctatgaaaataagaagccattttatctgtacacgggccggggcccctcttctgaagcaatgcatgtaggtcacctcattccatttattttcacaaagtggctccaggatgtatttaacgtgcccttggtcatccagatgacggatgacgagaagtatctgtggaaggacctgaccctggaccaggcctatagctatgctgtggagaatgccaaggacatcatcgcctgtggctttgacatcaacaagactttcatattctctgacctggactacatggggatgagctcaggtttctacaaaaatgtggtgaagattcaaaagcatgttaccttcaaccaagtgaaaggcattttcggcttcactgacagcgactgcattgggaagatcagttttcctgccatccaggctgctccctccttcagcaactcattcccacagatcttccgagacaggacggatatccagtgccttatcccatgtgccattgaccaggatccttactttagaatgacaagggacgtcgcccccaggatcggctatcctaaaccagccctgttgcactccaccttcttcccagccctgcagggcgcccagaccaaaatgagtgccagcgaccccaactcctccatcttcctcaccgacacggccaagcagatcaaaaccaaggtcaataagcatgcgttttctggagggagagacaccatcgaggagcacaggcagtttgggggcaactgtgatgtggacgtgtctttcatgtacctgaccttcttcctcgaggacgacgacaagctcgagcagatcaggaaggattacaccagcggagccatgctcaccggtgagctcaagaaggcactcatagaggttctgcagcccttgatcgcagagcaccaggcccggcgcaaggaggtcacggatgagatagtgaaagagttcatgactccccggaagctgtccttcgactttcagtagcactcgttttacatatgcttataaaagaagtgatgtatcagtaatgtatcaataatcccagcccagtcaaagcaccgccacctgtaggcttctgtctcatggtaattactgggcctggcctctgtaagcctgtgtatgttatcaatactgtttcttcctgtgagttccattatttctatctcttatgggcaaagcattgtgggtaattggtgctggctaacattgcatggtcggatagagaagtccagctgtgagtctctccccaaagcagccccacagtggagcctttggctggaagtccatgggccaccctgttcttgtccatggaggactccgagggttccaagtatactcttaagacccactctgtttaaaaatatatattctatgtatgcgtatatggaattgaaatgtcattattgtaacctagaaagtgctttgaaatattgatgtggggaggtttattgagcacaagatgtatttcagcccatgccccctcccaaaaagaaattgataagtaaaagcttcgttatacatttgactaagaaatcacccagctttaaagctgcttttaacaatgaagattgaacagagttcagcaattttgattaaattaagacttgggggtgaaactttccagtttactgaactccagaccatgcatgtagtccactccagaaatcatgctcgcttcccttggcacaccagtgttctcctgccaaatgaccctagaccctctgtcctgcagagtcagggtggcttttcccctgactgtgtccgatgccaaggagtcctggcctccgcagatgcttcattttgacccttggctgcagtggaagtcagcacagagcagtgccctggctgtgtccctggacgggtggacttagctagggagaaagtcgaggcagcagccctcgaggccctcacagatgtctaggcaggcctcatttcatcacgcagcatgtgcaggcctggaagagcaaagccaaatctcagggaagtccttggttgatgtatctgggtctcctctggagcactctgccctcctgtcacccagtagagtaaataaacttccttggctcctgaactcttgtcattgtgc

SEQ ID NO: 314338 - DNA, 2880 bp, Homo sapiens
caatgaccagctaatggctcgattctcaagagggtttcattggtctcaacctggccccccaggcaacccacccctgattggacagtctcatcaagaaggttggtcaagagctcaagtgtttctgagaatctgggtgatttataagaaacccttagctgaatgcagggtggggagaacgaaagacaaaagcatcttttttcagaagggaaactgaaagaaagaggggaagagtattaaagaccatttctggctgggcagggcactctcagcagctcaactgcccagcgtgaccagtggccacctctgcagtgtcttccacaacctgggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaaggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattgttcggtttggaagtagtaaaattgacaaagagctaataaaccgaatagagagagccaccggccaaagaccacaccacttcctgcgcagaggcatcttcttctcacacagagatatgaatcaggttcttgatgcctatgaaaataagaagccattttatctgtacacgggccggggcccctcttctgaagcaatgcatgtaggtcacctcattccatttattttcacaaagtggctccaggatgtatttaacgtgcccttggtcatccagatgacggatgacgagaagtatctgtggaaggacctgaccctggaccaggcctatagctatgctgtggagaatgccaaggacatcatcgcctgtggctttgacatcaacaagactttcatattctctgacctggactacatggggatgagctcaggtttctacaaaaatgtggtgaagattcaaaagcatgttaccttcaaccaagtgaaaggcattttcggcttcactgacagcgactgcattgggaagatcagttttcctgccatccaggctgctccctccttcagcaactcattcccacagatcttccgagacaggacggatatccagtgccttatcccatgtgccattgaccaggatccttactttagaatgacaagggacgtcgcccccaggatcggctatcctaaaccagccctgttgcactccaccttcttcccagccctgcagggcgcccagaccaaaatgagtgccagcgaccccaactcctccatcttcctcaccgacacggccaagcagatcaaaaccaaggtcaataagcatgcgttttctggagggagagacaccatcgaggagcacaggcagtttgggggcaactgtgatgtggacgtgtctttcatgtacctgaccttcttcctcgaggacgacgacaagctcgagcagatcaggaaggattacaccagcggagccatgctcaccggtgagctcaagaaggcactcatagaggttctgcagcccttgatcgcagagcaccaggcccggcgcaaggaggtcacggatgagatagtgaaagagttcatgactccccggaagctgtccttcgactttcagtagcactcgttttacatatgcttataaaagaagtgatgtatcagtaatgtatcaataatcccagcccagtcaaagcaccgccacctgtaggcttctgtctcatggtaattactgggcctggcctctgtaagcctgtgtatgttatcaatactgtttcttcctgtgagttccattatttctatctcttatgggcaaagcattgtgggtaattggtgctggctaacattgcatggtcggatagagaagtccagctgtgagtctctccccaaagcagccccacagtggagcctttggctggaagtccatgggccaccctgttcttgtccatggaggactccgagggttccaagtatactcttaagacccactctgtttaaaaatatatattctatgtatgcgtatatggaattgaaatgtcattattgtaacctagaaagtgctttgaaatattgatgtggggaggtttattgagcacaagatgtatttcagcccatgccccctcccaaaaagaaattgataagtaaaagcttcgttatacatttgactaagaaatcacccagctttaaagctgcttttaacaatgaagattgaacagagttcagcaattttgattaaattaagacttgggggtgaaactttccagtttactgaactccagaccatgcatgtagtccactccagaaatcatgctcgcttcccttggcacaccagtgttctcctgccaaatgaccctagaccctctgtcctgcagagtcagggtggcttttcccctgactgtgtccgatgccaaggagtcctggcctccgcagatgcttcattttgacccttggctgcagtggaagtcagcacagagcagtgccctggctgtgtccctggacgggtggacttagctagggagaaagtcgaggcagcagccctcgaggccctcacagatgtctaggcaggcctcatttcatcacgcagcatgtgcaggcctggaagagcaaagccaaatctcagggaagtccttggttgatgtatctgggtctcctctggagcactctgccctcctgtcacccagtagagtaaataaacttccttggctcctgaactcttgtcattgtgc

SEQ ID NO: 314339 - DNA, 2745 bp, Homo sapiens
caatgaccagctaatggctcgattctcaagagggtttcattggtctcaacctggccccccaggcaacccacccctgattggacagtctcatcaagaaggttggtcaagagctcaagtgtttctgagaatctgggtgatttataagaaacccttagctgaatgcagggtggggagaacgaaagacaaaagcatcttttttcagaagggaaactgaaagaaagaggggaagagtattaaagaccatttctggctgggcagggcactctcagcagctcaactgcccagcgtgaccagtggccacctctgcagtgtcttccacaacctgggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattgttcggtttggaagtagtaaaattgacaaagagctaataaaccgaatagagagagccaccggccaaagaccacaccacttcctgcgcagaggcatcttcttctcacacagagatatgaatcaggttcttgatgcctatgaaaataagaagccattttatctgtacacgggccggggcccctcttctgaagcaatgcatgtaggtcacctcattccatttattttcacaaagtggctccaggatgtatttaacgtgcccttggtcatccagatgacggatgacgagaagtatctgtggaaggacctgaccctggaccaggcctatagctatgctgtggagaatgccaaggacatcatcgcctgtggctttgacatcaacaagactttcatattctctgacctggactacatggggatgagctcaggtttctacaaaaatgtggtgaagattcaaaagcatgttaccttcaaccaagtgaaaggcattttcggcttcactgacagcgactgcattgggaagatcagttttcctgccatccaggctgctccctccttcagcaactcattcccacagatcttccgagacaggacggatatccagtgccttatcccatgtgccattgaccaggatccttactttagaatgacaagggacgtcgcccccaggatcggctatcctaaaccagccctgttgcactccaccttcttcccagccctgcagggcgcccagaccaaaatgagtgccagcgaccccaactcctccatcttcctcaccgacacggccaagcagatcaaaaccaaggtcaataagcatgcgttttctggagggagagacaccatcgaggagcacaggcagtttgggggcaactgtgatgtggacgtgtctttcatgtacctgaccttcttcctcgaggacgacgacaagctcgagcagatcaggaaggattacaccagcggagccatgctcaccggtgagctcaagaaggcactcatagaggttctgcagcccttgatcgcagagcaccaggcccggcgcaaggaggtcacggatgagatagtgaaagagttcatgactccccggaagctgtccttcgactttcagtagcactcgttttacatatgcttataaaagaagtgatgtatcagtaatgtatcaataatcccagcccagtcaaagcaccgccacctgtaggcttctgtctcatggtaattactgggcctggcctctgtaagcctgtgtatgttatcaatactgtttcttcctgtgagttccattatttctatctcttatgggcaaagcattgtgggtaattggtgctggctaacattgcatggtcggatagagaagtccagctgtgagtctctccccaaagcagccccacagtggagcctttggctggaagtccatgggccaccctgttcttgtccatggaggactccgagggttccaagtatactcttaagacccactctgtttaaaaatatatattctatgtatgcgtatatggaattgaaatgtcattattgtaacctagaaagtgctttgaaatattgatgtggggaggtttattgagcacaagatgtatttcagcccatgccccctcccaaaaagaaattgataagtaaaagcttcgttatacatttgactaagaaatcacccagctttaaagctgcttttaacaatgaagattgaacagagttcagcaattttgattaaattaagacttgggggtgaaactttccagtttactgaactccagaccatgcatgtagtccactccagaaatcatgctcgcttcccttggcacaccagtgttctcctgccaaatgaccctagaccctctgtcctgcagagtcagggtggcttttcccctgactgtgtccgatgccaaggagtcctggcctccgcagatgcttcattttgacccttggctgcagtggaagtcagcacagagcagtgccctggctgtgtccctggacgggtggacttagctagggagaaagtcgaggcagcagccctcgaggccctcacagatgtctaggcaggcctcatttcatcacgcagcatgtgcaggcctggaagagcaaagccaaatctcagggaagtccttggttgatgtatctgggtctcctctggagcactctgccctcctgtcacccagtagagtaaataaacttccttggctcctgaactcttgtcattgtgc

SEQ ID NO: 314340 - DNA, 3028 bp, Homo sapiens
caatgaccagctaatggctcgattctcaagagggtttcattggtctcaacctggccccccaggcaacccacccctgattggacagtctcatcaagaaggttggtcaagagctcaagtgtttctgagaatctgggtgatttataagaaacccttagctgaatgcagggtggggagaacgaaagacaaaagcatcttttttcagaagggaaactgaaagaaagaggggaagagtattaaagaccatttctggctgggcagggcactctcagcagctcaactgcccagcgtgaccagtggccacctctgcagtgtcttccacaacctggagtgtactatttgttaaacaggtgaatctacttctcttaacaaagtctcaatgtcctatttgcaatttatgtggtaaacactgaagacaatggtccttaaccttttggcatctcagcctcctttcgaaagtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattgttcggtttggaagtagtaaaattgacaaagagctaataaaccgaatagagagagccaccggccaaagaccacaccacttcctgcgcagaggcatcttcttctcacacagagatatgaatcaggttcttgatgcctatgaaaataagaagccattttatctgtacacgggccggggcccctcttctgaagcaatgcatgtaggtcacctcattccatttattttcacaaagtggctccaggatgtatttaacgtgcccttggtcatccagatgacggatgacgagaagtatctgtggaaggacctgaccctggaccaggcctatagctatgctgtggagaatgccaaggacatcatcgcctgtggctttgacatcaacaagactttcatattctctgacctggactacatggggatgagctcaggtttctacaaaaatgtggtgaagattcaaaagcatgttaccttcaaccaagtgaaaggcattttcggcttcactgacagcgactgcattgggaagatcagttttcctgccatccaggctgctccctccttcagcaactcattcccacagatcttccgagacaggacggatatccagtgccttatcccatgtgccattgaccaggatccttactttagaatgacaagggacgtcgcccccaggatcggctatcctaaaccagccctgttgcactccaccttcttcccagccctgcagggcgcccagaccaaaatgagtgccagcgaccccaactcctccatcttcctcaccgacacggccaagcagatcaaaaccaaggtcaataagcatgcgttttctggagggagagacaccatcgaggagcacaggcagtttgggggcaactgtgatgtggacgtgtctttcatgtacctgaccttcttcctcgaggacgacgacaagctcgagcagatcaggaaggattacaccagcggagccatgctcaccggtgagctcaagaaggcactcatagaggttctgcagcccttgatcgcagagcaccaggcccggcgcaaggaggtcacggatgagatagtgaaagagttcatgactccccggaagctgtccttcgactttcagtagcactcgttttacatatgcttataaaagaagtgatgtatcagtaatgtatcaataatcccagcccagtcaaagcaccgccacctgtaggcttctgtctcatggtaattactgggcctggcctctgtaagcctgtgtatgttatcaatactgtttcttcctgtgagttccattatttctatctcttatgggcaaagcattgtgggtaattggtgctggctaacattgcatggtcggatagagaagtccagctgtgagtctctccccaaagcagccccacagtggagcctttggctggaagtccatgggccaccctgttcttgtccatggaggactccgagggttccaagtatactcttaagacccactctgtttaaaaatatatattctatgtatgcgtatatggaattgaaatgtcattattgtaacctagaaagtgctttgaaatattgatgtggggaggtttattgagcacaagatgtatttcagcccatgccccctcccaaaaagaaattgataagtaaaagcttcgttatacatttgactaagaaatcacccagctttaaagctgcttttaacaatgaagattgaacagagttcagcaattttgattaaattaagacttgggggtgaaactttccagtttactgaactccagaccatgcatgtagtccactccagaaatcatgctcgcttcccttggcacaccagtgttctcctgccaaatgaccctagaccctctgtcctgcagagtcagggtggcttttcccctgactgtgtccgatgccaaggagtcctggcctccgcagatgcttcattttgacccttggctgcagtggaagtcagcacagagcagtgccctggctgtgtccctggacgggtggacttagctagggagaaagtcgaggcagcagccctcgaggccctcacagatgtctaggcaggcctcatttcatcacgcagcatgtgcaggcctggaagagcaaagccaaatctcagggaagtccttggttgatgtatctgggtctcctctggagcactctgccctcctgtcacccagtagagtaaataaacttccttggctcctgaactcttgtcattgtgc

SEQ ID NO: 314341 - DNA, 2889 bp, Homo sapiens
caatgaccagctaatggctcgattctcaagagggtttcattggtctcaacctggccccccaggcaacccacccctgattggacagtctcatcaagaaggttggtcaagagctcaagtgtttctgagaatctgggtgatttataagaaacccttagctgaatgcagggtggggagaacgaaagacaaaagcatcttttttcagaagggaaactgaaagaaagaggggaagagtattaaagaccatttctggctgggcagggcactctcagcagctcaactgcccagcgtgaccagtggccacctctgcagtgtcttccacaacctggtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaaggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattgttcggtttggaagtagtaaaattgacaaagagctaataaaccgaatagagagagccaccggccaaagaccacaccacttcctgcgcagaggcatcttcttctcacacagagatatgaatcaggttcttgatgcctatgaaaataagaagccattttatctgtacacgggccggggcccctcttctgaagcaatgcatgtaggtcacctcattccatttattttcacaaagtggctccaggatgtatttaacgtgcccttggtcatccagatgacggatgacgagaagtatctgtggaaggacctgaccctggaccaggcctatagctatgctgtggagaatgccaaggacatcatcgcctgtggctttgacatcaacaagactttcatattctctgacctggactacatggggatgagctcaggtttctacaaaaatgtggtgaagattcaaaagcatgttaccttcaaccaagtgaaaggcattttcggcttcactgacagcgactgcattgggaagatcagttttcctgccatccaggctgctccctccttcagcaactcattcccacagatcttccgagacaggacggatatccagtgccttatcccatgtgccattgaccaggatccttactttagaatgacaagggacgtcgcccccaggatcggctatcctaaaccagccctgttgcactccaccttcttcccagccctgcagggcgcccagaccaaaatgagtgccagcgaccccaactcctccatcttcctcaccgacacggccaagcagatcaaaaccaaggtcaataagcatgcgttttctggagggagagacaccatcgaggagcacaggcagtttgggggcaactgtgatgtggacgtgtctttcatgtacctgaccttcttcctcgaggacgacgacaagctcgagcagatcaggaaggattacaccagcggagccatgctcaccggtgagctcaagaaggcactcatagaggttctgcagcccttgatcgcagagcaccaggcccggcgcaaggaggtcacggatgagatagtgaaagagttcatgactccccggaagctgtccttcgactttcagtagcactcgttttacatatgcttataaaagaagtgatgtatcagtattgataacatacacaggcttacagaggccaggcccagtaattaccatgagacagaagcctgtgtatgttatcaatactgtttcttcctgtgagttccattatttctatctcttatgggcaaagcattgtgggtaattggtgctggctaacattgcatggtcggatagagaagtccagctgtgagtctctccccaaagcagccccacagtggagcctttggctggaagtccatgggccaccctgttcttgtccatggaggactccgagggttccaagtatactcttaagacccactctgtttaaaaatatatattctatgtatgcgtatatggaattgaaatgtcattattgtaacctagaaagtgctttgaaatattgatgtggggaggtttattgagcacaagatgtatttcagcccatgccccctcccaaaaagaaattgataagtaaaagcttcgttatacatttgactaagaaatcacccagctttaaagctgcttttaacaatgaagattgaacagagttcagcaattttgattaaattaagacttgggggtgaaactttccagtttactgaactccagaccatgcatgtagtccactccagaaatcatgctcgcttcccttggcacaccagtgttctcctgccaaatgaccctagaccctctgtcctgcagagtcagggtggcttttcccctgactgtgtccgatgccaaggagtcctggcctccgcagatgcttcattttgacccttggctgcagtggaagtcagcacagagcagtgccctggctgtgtccctggacgggtggacttagctagggagaaagtcgaggcagcagccctcgaggccctcacagatgtctaggcaggcctcatttcatcacgcagcatgtgcaggcctggaagagcaaagccaaatctcagggaagtccttggttgatgtatctgggtctcctctggagcactctgccctcctgtcacccagtagagtaaataaacttccttggctcctgaactcttgtcattgtgc

SEQ ID NO: 314342 - DNA, 2688 bp, Homo sapiens
  misc_feature (584)..(584): n is a, c, g, or t
caatgaccagctaatggctcgattctcaagagggtttcattggtctcaacctggccccccaggcaacccacccctgattggacagtctcatcaagaaggttggtcaagagctcaagtgtttctgagaatctgggtgatttataagaaacccttagctgaatgcagggtggggagaacgaaagacaaaagcatcttttttcagaagggaaactgaaagaaagaggggaagagtattaaagaccatttctggctgggcagggcactctcagcagctcaactgcccagcgtgaccagtggccacctctgcagtgtcttccacaacctgggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattgttcgttttgaagtggtccaattcttgccacaggggattttcttntcacacagagatatgaatcaggttcttgatgcctatgaaaataagaagccattttatctgtacacgggccggggcccctcttctgaagcaatgcatgtaggtcacctcattccatttattttcacaaagtggctccaggatgtatttaacgtgcccttggtcatccagatgacggatgacgagaagtatctgtggaaggacctgaccctggaccaggcctatagctatgctgtggagaatgccaaggacatcatcgcctgtggctttgacatcaacaagactttcatattctctgacctggactacatggggatgagctcaggtttctacaaaaatgtggtgaagattcaaaagcatgttaccttcaaccaagtgaaaggcattttcggcttcactgacagcgactgcattgggaagatcagttttcctgccatccaggctgctccctccttcagcaactcattcccacagatcttccgagacaggacggatatccagtgccttatcccatgtgccattgaccaggatccttactttagaatgacaagggacgtcgcccccaggatcggctatcctaaaccagccctgttgcactccaccttcttcccagccctgcagggcgcccagaccaaaatgagtgccagcgaccccaactcctccatcttcctcaccgacacggccaagcagatcaaaaccaaggtcaataagcatgcgttttctggagggagagacaccatcgaggagcacaggcagtttgggggcaactgtgatgtggacgtgtctttcatgtacctgaccttcttcctcgaggacgacgacaagctcgagcagatcaggaaggattacaccagcggagccatgctcaccggtgagctcaagaaggcactcatagaggttctgcagcccttgatcgcagagcaccaggcccggcgcaaggaggtcacggatgagatagtgaaagagttcatgactccccggaagctgtccttcgactttcagtagcactcgttttacatatgcttataaaagaagtgatgtatcagtaatgtatcaataatcccagcccagtcaaagcaccgccacctgtaggcttctgtctcatggtaattactgggcctggcctctgtaagcctgtgtatgttatcaatactgtttcttcctgtgagttccattatttctatctcttatgggcaaagcattgtgggtaattggtgctggctaacattgcatggtcggatagagaagtccagctgtgagtctctccccaaagcagccccacagtggagcctttggctggaagtccatgggccaccctgttcttgtccatggaggactccgagggttccaagtatactcttaagacccactctgtttaaaaatatatattctatgtatgcgtatatggaattgaaatgtcattattgtaacctagaaagtgctttgaaatattgatgtggggaggtttattgagcacaagatgtatttcagcccatgccccctcccaaaaagaaattgataagtaaaagcttcgttatacatttgactaagaaatcacccagctttaaagctgcttttaacaatgaagattgaacagagttcagcaattttgattaaattaagacttgggggtgaaactttccagtttactgaactccagaccatgcatgtagtccactccagaaatcatgctcgcttcccttggcacaccagtgttctcctgccaaatgaccctagaccctctgtcctgcagagtcagggtggcttttcccctgactgtgtccgatgccaaggagtcctggcctccgcagatgcttcattttgacccttggctgcagtggaagtcagcacagagcagtgccctggctgtgtccctggacgggtggacttagctagggagaaagtcgaggcagcagccctcgaggccctcacagatgtctaggcaggcctcatttcatcacgcagcatgtgcaggcctggaagagcaaagccaaatctcagggaagtccttggttgatgtatctgggtctcctctggagcactctgccctcctgtcacccagtagagtaaataaacttccttggctcctgaactcttgtcattgtgc

SEQ ID NO: 314343 - DNA, 2318 bp, Homo sapiens
caatgaccagctaatggctcgattctcaagagggtttcattggtctcaacctggccccccaggcaacccacccctgattggacagtctcatcaagaaggttggtcaagagctcaagtgtttctgagaatctgggtgatttataagaaacccttagctgaatgcagggtggggagaacgaaagacaaaagcatcttttttcagaagggaaactgaaagaaagaggggaagagtattaaagaccatttctggctgggcagggcactctcagcagctcaactgcccagcgtgaccagtggccacctctgcagtgtcttccacaacctggtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaaggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattgttcggtttggaagtagtaaaattgacaaagagctaataaaccgaatagagagagccaccggccaaagaccacaccacttcctgcgcagaggcatcttcttctcacacagagatatgaatcaggttcttgatgcctatgaaaataagaagccattttatctgtacacgggccggggcccctcttctgaagcaatgcatgtaggtcacctcattccatttattttcacaaagtggctccaggatgtatttaacgtgcccttggtcatccagatgacggatgacgagaagtatctgtggaaggacctgaccctggaccaggcctatagctatgctgtggagaatgccaaggacatcatcgcctgtggctttgacatcaacaagactttcatattctctgacctggactacatggggatgagctcaggtttctacaaaaatgtggtgaagattcaaaagcatgttaccttcaaccaagtgaaaggcattttcggcttcactgacagcgactgcattgggaagatcagttttcctgccatccaggctgctccctccttcagcaactcattcccacagatcttccgagacaggacggatatccagtgccttatcccatgtgccattgaccaggatccttactttagaatgacaagggacgtcgcccccaggatcggctatcctaaaccagccctgttgcactccaccttcttcccagccctgcagggcgcccagaccaaaatgagtgccagcgaccccaactcctccatcttcctcaccgacacggccaagcagatcaaaaccaaggtcaataagcatgcgttttctggagggagagacaccatcgaggagcacaggcagtttgggggcaactgtgatgtggacgtgtctttcatgtacctgaccttcttcctcgaggacgacgacaagctcgagcagatcaggaaggattacaccagcggagccatgctcaccggtgagctcaagaaggcactcatagaggttctgcagcccttgatcgcagagcaccaggcccggcgcaaggaggtcacggatgagatagtgaaagagttcatgactccccggaagctgtccttcgactttcagtagcactcgttttacatatgcttataaaagaagtgatgtatcagtaatgtatcaataatcccagcccagtcaaagcaccgccacctgtaggcttctgtctcatggtaattactgggcctggcctctgtaagcctgtgtatgttatcaatactgtttcttcctgtgagttccattatttctatctcttatgggcaaagcattgtgggtaattggtgctggctaacattgcatggtcggatagagaagtccagctgtgagtctctccccaaagcagccccacagtggagcctttggctggaagtccatgggccaccctgttcttgtccatggaggactccgagggttccaagtatactcttaagacccactctgtttaaaaatatatattctatgtatgcgtatatggaattgaaatgtcattattgtcactctacgcacctgctctcgaagatacttgaccatggggacggtatccatctgcccgtcttgtaacctctggaacagct

SEQ ID NO: 314344 - DNA, 1758 bp, Homo sapiens
tccagcatcatgtcttcttcctgcacgtcataggacttcgtggttactgtgaaaacgatggcgttgggaagatcagttttcctgccatccaggctgctccctccttcagcaactcattcccacagatcttccgagacaggacggatatccagtgccttatcccatgtgccattgaccaggatccttactttagaatgacaagggacgtcgcccccaggatcggctatcctaaaccagccctgttgcactccaccttcttcccagccctgcagggcgcccagaccaaaatgagtgccagcgaccccaactcctccatcttcctcaccgacacggccaagcagatcaaaaccaaggtcaataagcatgcgttttctggagggagagacaccatcgaggagcacaggcagtttgggggcaactgtgatgtggacgtgtctttcatgtacctgaccttcttcctcgaggacgacgacaagctcgagcagatcaggaaggattacaccagcggagccatgctcaccggtgagctcaagaaggcactcatagaggttctgcagcccttgatcgcagagcaccaggcccggcgcaaggaggtcacggatgagatagtgaaagagttcatgactccccggaagctgtccttcgactttcagtagcactcgttttacatatgcttataaaagaagtgatgtatcagtaatgtatcaataatcccagcccagtcaaagcaccgccacctgtaggcttctgtctcatggtaattactgggcctggcctctgtaagcctgtgtatgttatcaatactgtttcttcctgtgagttccattatttctatctcttatgggcaaagcattgtgggtaattggtgctggctaacattgcatggtcggatagagaagtccagctgtgagtctctccccaaagcagccccacagtggagcctttggctggaagtccatgggccaccctgttcttgtccatggaggactccgagggttccaagtatactcttaagacccactctgtttaaaaatatatattctatgtatgcgtatatggaattgaaatgtcattattgtaacctagaaagtgctttgaaatattgatgtggggaggtttattgagcacaagatgtatttcagcccatgccccctcccaaaaagaaattgataagtaaaagcttcgttatacatttgactaagaaatcacccagctttaaagctgcttttaacaatgaagattgaacagagttcagcaattttgattaaattaagacttgggggtgaaactttccagtttactgaactccagaccatgcatgtagtccactccagaaatcatgctcgcttcccttggcacaccagtgttctcctgccaaatgaccctagaccctctgtcctgcagagtcagggtggcttttcccctgactgtgtccgatgccaaggagtcctggcctccgcagatgcttcattttgacccttggctgcagtggaagtcagcacagagcagtgccctggctgtgtccctggacgggtggacttagctagggagaaagtcgaggcagcagccctcgaggccctcacagatgtctaggcaggcctcatttcatcacgcagcatgtgcaggcctggaagagcaaagccaaatctcagggaagtccttggttgatgtatctgggtctcctctggagcactctgccctcctgtcacccagtagagtaaataaacttccttggctcctgaactcttgtcattgtgc

SEQ ID NO: 314345 - DNA, 1936 bp, Homo sapiens
caatgaccagctaatggctcgattctcaagagggtttcattggtctcaacctggccccccaggcaacccacccctgattggacagtctcatcaagaaggttggtcaagagctcaagtgtttctgagaatctgggtgatttataagaaacccttagctgaatgcagggtggggagaacgaaagacaaaagcatcttttttcagaagggaaactgaaagaaagaggggaagagtattaaagaccatttctggctgggcagggcactctcagcagctcaactgcccagcgtgaccagtggccacctctgcagtgtcttccacaacctggtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaaggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattgttcggtttggaagtagtaaaattgacaaagagctaataaaccgaatagagagagccaccggccaaagaccacaccacttcctgcgcagaggcatcttcttctcacacagagatatgaatcaggttcttgatgcctatgaaaataagaagccattttatctgtacacgggccggggcccctcttctgaagcaatgcatgtaggtcacctcattccatttattttcacaaagtggctccaggatgtatttaacgtgcccttggtcatccagatgacggatgacgagaagtatctgtggaaggacctgaccctggaccaggcctatagctatgctgtggagaatgccaaggacatcatcgcctgtggctttgacatcaacaagactttcatattctctgacctggactacatggggatgagctcaggtttctacaaaaatgtggtgaagattcaaaagcatgttaccttcaaccaagtgaaaggcattttcggcttcactgacagcgactgcattgggaagatcagttttcctgccatccaggctgctccctccttcagcaactcattcccacagatcttccgagacaggacggatatccagtgccttatcccatgtgccattgaccaggatccttactttagaatgacaagggacgtcgcccccaggatcggctatcctaaaccagccctgttgcactccaccttcttcccagccctgcagggcgcccagaccaaaatgagtgccagcgaccccaactcctccatcttcctcaccgacacggccaagcagatcaaaaccaagaaatcatgctcgcttcccttggcacaccagtgttctcctgccaaatgaccctagaccctctgtcctgcagagtcagggtggcttttcccctgactgtgtccgatgccaaggagtcctggcctccgcagatgcttcattttgacccttggctgcagtggaagtcagcacagagcagtgccctggctgtgtccctggacgggtggacttagctagggagaaagtcgaggcagcagccctcgaggccctcacagatgtctaggcaggcctcatttcatcacgcagcatgtgcaggcctggaagagcaaagccaaatctcagggaagtccttggttgatgtatctgggtctcctctggagcactctgccctcctgtcacccagtagagtaaataaacttccttggctcctgaactcttgtcattgtgc

SEQ ID NO: 314346 - DNA, 2426 bp, Homo sapiens
caatgaccagctaatggctcgattctcaagagggtttcattggtctcaacctggccccccaggcaacccacccctgattggacagtctcatcaagaaggttggtcaagagctcaagtgtttctgagaatctgggtgatttataagaaacccttagctgaatgcagggtggggagaacgaaagacaaaagcatcttttttcagaagggaaactgaaagaaagaggggaagagtattaaagaccatttctggctgggcagggcactctcagcagctcaactgcccagcgtgaccagtggccacctctgcagtgtcttccacaacctggtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaaggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattgttcggtttggaagtagtaaaattgacaaagagctaataaaccgaatagagagagccaccggccaaagaccacaccacttcctgcgcagaggcatcttcttctcacacagagatatgaatcaggttcttgatgcctatgaaaataagaagccattttatctgtacacgggccggggcccctcttctgaagcaatgcatgtaggtcacctcattccatttattttcacaaagtggctccaggatgtatttaacgtgcccttggtcatccagatgacggatgacgagaagtatctgtggaaggacctgaccctggaccaggcctatagctatgctgtggagaatgccaaggacatcatcgcctgtggctttgacatcaacaagactttcatattctctgacctggactacatggggatgagctcaggtttctacaaaaatgtggtgaagattcaaaagcatgttaccttcaaccaagtgaaaggcattttcggcttcactgacagcgactgcattgggaagatcagttttcctgccatccaggctgctccctccttcagcaactcattcccacagatcttccgagacaggacggatatccagtgccttatcccatgtgccattgaccaggatccttactttagaatgacaagggacgtcgcccccaggatcggctatcctaaaccagccctgttgcactccaccttcttcccagccctgcagggcgcccagaccaaaatgagtgccagcgaccccaactcctccatcttcctcaccgacacggccaagcagatcaaaaccaaggtcaataagcatgcgttttctggagggagagacaccatcgaggagcacaggcagtttgggggcaactgtgatgtggacgtgtctttcatgtacctgaccttcttcctcgaggacgacgacaagctcgagcagatcaggaaggtgagcagggaaccccaagggcccacagccgcctcctgccacccactcctgcccatggggcctggaaggctccaacagccaggcatgaaggcttggtcggaggtgctcaactgaaacaaggtgaaaactgagtagactcgccctcatggtttttaggcctgggctcagaagcctcatgaacaaatctcgaaagagcagatacaaatcactattcatttaggagccacccaaaacagtcttgctttattagtcatcagagaaatgtaagttaacgtgatcaaagctaagacagttgagtatagaattagtaggggcttttgtgttgccattgactattttcagtgattatgaagcagatgcttcaaggcacactcaagtgagcagagtgtttatcagcacagcctcaggaagcagtttggtactgggtacaaagagcccaaaaatgttcagagcttctcctcaggttttctcattcttagattttttccaaggaaataatcctgagtaagagaaagctttccacacgaagatgttaaaaatgataatagcaaaaagttcaacacagactcagtacaacagaggaaacgttaaattagaattgttacagggtggattattatgcgggcatgaactattttaagtgttcatatgcagggcatggtggcacacatctgtagcccctgctacttgggaagctgagacaggaggatcccttgagcccaggagttcaaatccagcctgggcgacatagcaagaccctcatttctttcttt

SEQ ID NO: 314347 - DNA, 1999 bp, Homo sapiens
  misc_feature (1999)..(1999): n is a, c, g, or t
caatgaccagctaatggctcgattctcaagagggtttcattggtctcaacctggccccccaggcaacccacccctgattggacagtctcatcaagaaggttggtcaagagctcaagtgtttctgagaatctgggtgatttataagaaacccttagctgaatgcagggtggggagaacgaaagacaaaagcatcttttttcagaagggaaactgaaagaaagaggggaagagtattaaagaccatttctggctgggcagggcactctcagcagctcaactgcccagcgtgaccagtggccacctctgcagtgtcttccacaacctggtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaaggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattgttcggtttggaagtagtaaaattgacaaagagctaataaaccgaatagagagagccaccggccaaagaccacaccacttcctgcgcagaggcatcttcttctcacacagagatatgaatcaggttcttgatgcctatgaaaataagaagccattttatctgtacacgggccggggcccctcttctgaagcaatgcatgtaggtcacctcattccatttattttcacaaagtggctccaggatgtatttaacgtgcccttggtcatccagatgacggatgacgagaagtatctgtggaaggacctgaccctggaccaggcctatagctatgctgtggagaatgccaaggacatcatcgcctgtggctttgacatcaacaagactttcatattctctgacctggactacatggggatgagctcaggtttctacaaaaatgtggtgaagattcaaaagcatgttaccttcaaccaagtgaaaggcattttcggcttcactgacagcgactgcattgggaagatcagttttcctgccatccaggctgctccctccttcagcaactcattcccacagatcttccgagacaggacggatatccagtgccttatcccatgtgccattgaccaggatccttactttagaatgacaagggacgtcgcccccaggatcggctatcctaaaccagccctgttgcactccaccttcttcccagccctgcagggcgcccagaccaaaatgagtgccagcgaccccaactcctccatcttcctcaccgacacggccaagcagatcaaaaccaaggtcaataagcatgcgttttctggagggagagacaccatcgaggagcacaggcagtttgggggcaactgtgatgtggacgtgtctttcatgtacctgaccttcttcctcgaggacgacgacaagctcgagcagatcaggaaggattacaccagggagccaggtcacgggagctccagaagcacccataaggttctggaggcctggtcgggaagcccaggccgggcatgaggtcccgtggaatcggacaagagatgatcccggaggggcctcgaattcaggacgcccgttaatatgctgtacaaagcgtggtcgagggcaaatccggcacgaagaacagccatgtgggtttggcatggatatggcggctgagcgggtgtcgaaacgatgccgggacgactatcagcaacagatacggagacagaggggaaatggccacacaacggggagccggcagacgaaacaaaagtgagagagggcgccggcgaan

SEQ ID NO: 314348 - DNA, 893 bp, Homo sapiens
ggacggctttggggagagactcacagctggacttctctatccgaccatgcaatgttagccagccccacagtggagcctttggctggaagtccatgggccaccctgttcttgtccatggaggactccgagggttccaagtatactcttaagacccactctgtttaaaaatatatattctatgtatgcgtatatggaattgaaatgtcattattgtaacctagaaagtgctttgaaatattgatgtggggaggtttattgagcacaagatgtatttcagcccatgccccctcccaaaaagaaattgataagtaaaagcttcgttatacatttgactaagaaatcacccagctttaaagctgcttttaacaatgaagattgaacagagttcagcaattttgattaaattaagacttgggggtgaaactttccagtttactgaactccagaccatgcatgtagtccactccagaaatcatgctcgcttcccttggcacaccagtgttctcctgccaaatgaccctagaccctctgtcctgcagagtcagggtggcttttcccctgactgtgtccgatgccaaggagtcctggcctccgcagatgcttcattttgacccttggctgcagtggaagtcagcacagagcagtgccctggctgtgtccctggacgggtggacttagctagggagaaagtcgaggcagcagccctcgaggccctcacagatgtctaggcaggcctcatttcatcacgcagcatgtgcaggcctggaagagcaaagccaaatctcagggaagtccttggttgatgtatctgggtctcctctggagcactctgccctcctgtcacccagtagagtaaataaacttccttggctcctgaactcttgtcattgtgc

SEQ ID NO: 314349 - DNA, 2566 bp, Homo sapiens
caatgaccagctaatggctcgattctcaagagggtttcattggtctcaacctggccccccaggcaacccacccctgattggacagtctcatcaagaaggttggtcaagagctcaagtgtttctgagaatctgggtgatttataagaaacccttagctgaatgcagggtggggagaacgaaagacaaaagcatcttttttcagaagggaaactgaaagaaagaggggaagagtattaaagaccatttctggctgggcagggcactctcagcagctcaactgcccagcgtgaccagtggccacctctgcagtgtcttccacaacctggtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaaggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattgttcggtttggaagtagtaaaattgacaaagagctaataaaccgaatagagagagccaccggccaaagaccacaccacttcctgcgcagaggcatcttcttctcacacagagatatgaatcaggttcttgatgcctatgaaaataagaagccattttatctgtacacgggccggggcccctcttctgaagcaatgcatgtaggtcacctcattccatttattttcacaaagtggctccaggatgtatttaacgtgcccttggtcatccagatgacggatgacgagaagtatctgtggaaggacctgaccctggaccaggcctatagctatgctgtggagaatgccaaggacatcatcgcctgtggctttgacatcaacaagactttcatattctctgacctggactacatggggatgagctcaggtttctacaaaaatgtggtgaagattcaaaagcatgttaccttcaaccaagtgaaaggcattttcggcttcactgacagcgactgcattgggaagatcagttttcctgccatccaggctgctccctccttcagcaactcattcccacagatcttccgagacaggacggatatccagtgccttatcccatgtgccattgaccaggatccttactttagaatgacaagggacgtcgcccccaggatcggctatcctaaaccagccctgttgcactccaccttcttcccagccctgcagggcgcccagaccaaaatgagtgccagcgaccccaactcctccatcttcctcaccgacacggccaagcagatcaaaaccaagggtgagcagtggcccaggcagagggcagccagcgggatcagaaacatgccctggggggcacacgcacacacacaccactgcacagtgctttgggcctcagccacccagccaccgtagcaatgctgaactccaggattgccaactttgctccctgcagaactcaaggcagcctgtccttcccacatgaatcaggtgaatttgttttgtgtcctttcatttaggtaaaattttgaatttttttttctttttttccttttctgcttttcttatcagcactgttctgcaggcaaagtcatggcaatttccttaaagttataattagtgtggatgttattaaataatggaaaagattgtgtatatttctcatcatcagctgtgttccagcggctggacccggtgccttatttatgttttctcatgtttcattctcactgggaggtggtggtgctattccctttaaagatgagatgatgaggcttagagaagcccagccacttgaccaagtttccaccaccaggaatcagcagcactgctctcctggccctgagcagccattaccaagcaggggttatgagctggtcttctcccagagagcgttctcactgagagacatagaacggagaaacgtccatccacgggacagtcctgctggccccaggagggatgcatgcagcaggcattcagcaaacatttgacaaatcactagagaaactaaaaggagaagttagtttgagcttccttattttgcatggccccagttctgttgcctggttcctcaacagccagtgtatatataattgcctcactgttacacaaagcagttgacattttctttggaatcaagtgtgtgtttgcaggctagaagattgcagtgggaatgctgggaactgtatttgaggcatgtcacatgccctctgagtcactgcccctgaccgttctggaaagtcccaagcaggttctggttgacaatggggaagcctttcatatcaaaacttcctaagacatgccctccaccaactctccccactcagttggaagctggtataattgaaga

SEQ ID NO: 314350 - DNA, 1363 bp, Homo sapiens
caatgaccagctaatggctcgattctcaagagggtttcattggtctcaacctggccccccaggcaacccacccctgattggacagtctcatcaagaaggttggtcaagagctcaagtgtttctgagaatctgggtgatttataagaaacccttagctgaatgcagggtggggagaacgaaagacaaaagcatcttttttcagaagggaaactgaaagaaagaggggaagagtattaaagaccatttctggctgggcagggcactctcagcagctcaactgcccagcgtgaccagtggccacctctgcagtgtcttccacaacctggtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaaggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattgttcggtttggaagtagtaaaattgacaaagagctaataaaccgaatagagagagccaccggccaaagaccacaccacttcctgcgcagaggcatcttcttctcacacagagatatgaatcaggttcttgatgcctatgaaaataagaagccattttatctgtacacgggccggggcccctcttctgaagcaatgcatgtaggtcacctcattccatttattttcacaaagtggctccaggatgtatttaacgtgcccttggtcatccagatgacggatgacgagaagtatctgtggaaggacctgaccctggaccaggcctatagctatgctgtggagaatgccaaggacatcatcgcctgtggctttgacatcaacaagactttcatattctctgacctggactacatgggaaatttaaaatatgggctcagccacagcatgatggcatctcagatcttcatcctcagctgtgccaggaagtcctgccttgcagtttcttgccaaggatagtcagtcttccagagttatgtcttcctccttttcaacgcaccttttcctcacagagaaaagactcagtggttacacagtttcctcagtctagttcttttaatcagccatttaataaaccaaaatatttcattctgaaaat

SEQ ID NO: 314351 - DNA, 1135 bp, Homo sapiens
caatgaccagctaatggctcgattctcaagagggtttcattggtctcaacctggccccccaggcaacccacccctgattggacagtctcatcaagaaggttggtcaagagctcaagtgtttctgagaatctgggtgatttataagaaacccttagctgaatgcagggtggggagaacgaaagacaaaagcatcttttttcagaagggaaactgaaagaaagaggggaagagtattaaagaccatttctggctgggcagggcactctcagcagctcaactgcccagcgtgaccagtggccacctctgcagtgtcttccacaacctggtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaaggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattgttcggtttggaagtagtaaaattgacaaagagctaataaaccgaatagagagagccaccggccaaagaccacaccacttcctgcgcagaggcatcttcttctcacacagagatatgaatcaggttcttgatgcctatgaaaataagaagccattttatctgtacacgggccggggcccctcttctgaagcaatgcatgtaggtcacctcattccatttattttcacaaagtggctccaggatgtatttaacgtgcccttggtcatccagatgacggatgacgagaagtatctgtggaagagcaaagccaaatctcagggaagtccttggttgatgtatctgggtctcctctggagcactctgccctcctgtcacccagtagagtaaataaacttccttggctcctgaactcttgtcattgtgc

SEQ ID NO: 314352 - DNA, 543 bp, Homo sapiens
caatgaccagctaatggctcgattctcaagagggtttcattggtctcaacctggccccccaggcaacccacccctgattggacagtctcatcaagaaggttggtcaagagctcaagtgtttctgagaatctgggtgatttataagaaacccttagctgaatgcagggtggggagaacgaaagacaaaagcatcttttttcagaagggaaactgaaagaaagaggggaagagtattaaagaccatttctggctgggcagggcactctcagcagctcaactgcccagcgtgaccagtggccacctctgcagtgtcttccacaacctgggtatgtattgccatctttgccaggcttagagcttgttcgtgtttttagcaaagtgctgaaaaccttggtttagggggtcaggacttgtgtcttaggattagggtgttatgcattttacttcttccattgacccaaagttcaggtgattcactgctcccatagggaacagagatcctggctgagcagtcgcgggcttggatccgtagcttgcctctca

SEQ ID NO: 314353 - DNA, 487 bp, Homo sapiens
caacatgatgaaacctcatctctactaaaaatacaaaaatcagctgggtgtggtacgcacctgtagtcccagctactcgggagcctgaggcaggagaatcacttgaaccccaggaggcagaggtagcggtgagctgagatcgagccaccacactccagcctggcaacaaagcgagactccttctgagaaaaaaaaaaggaaaagaaaaagccaaggaaagaccaaatatagtgtaatcacaacaaaaatgcatagagtaaaatatataaagaaaatggatgaaatcagacacattgcaactgtacagcttgttctttctacttttctgtattttttagatttattttaatgattgttttataatgggagaaaacctgtttttgttcattcctttattaactaagcagaacaggaactcatctcacgtgtaaaaatactttttctcattttcagggaagatcagttttcctgccatccaggctgctcc

SEQ ID NO: 314354 - DNA, 467 bp, Homo sapiens
ggcgtttccacggacgcccaggagacagccggttgctgagccgggagcgctgactggcccggctgggcagggtaagcgaggggagtaaggccggggcggagtgaggaaacaagggagggagtgatggagggacgctggcgcggcgcccagtggcctggccctcccgggagtatccttagagcccggcttgctgcccgccgcgttctggcactgtgaggcgcggagcctgccaccgacccctcgcccctttcctctgagcgccgccgacccaccccgtctccctttcccactggcacccttcatcgtctccgcctgttcgcttttcccgaggagagaggcccccatttttatttagcgcctgccatgtgccagaggctttgcgtagtgttgcacttagtcccctcaacggtaatgttagcaggcttctccatgcccattccacagatgaggaaaccgaaggggaagca

SEQ ID NO: 314355 - DNA, 453 bp, Homo sapiens
caagaggctttttagctttctccttgaaggtctgctgtgatctgctgtggagtaggcagttttgctctttacacgcccagtacttttgtttagggaagataatagagtacttcactggttataactgcatttctttgtttcagagtgtactatttgttaaacaggtgaatctacttctcttaacaaagtctcaatgtcctatttgcaatttatgtggtaaacactgaagacaatggtccttaaccttttggcatctcagcctcctttcgaaaggtaagaaagccaggagactgctcaaaaccatgtacataccaatgtacttgcaagcattaatgtaatttcagatgttcctgaactccaagttgaaaaacctctgaagttcaactcaattctgaaagtcaacaaagaaataaaggaggatgtcaataggtagggggaagaagaacatttaca

SEQ ID NO: 314356 - DNA, 834 bp, Homo sapiens
ggcgtttccacggacgcccaggagacagccggttgctgagccgggagcgctgactggcccggctgggcaggtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaaggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattgttcggtttggaagtagtaaaattgacaaagagctaataaaccgaatagagagagccaccggccaaagaccacaccacttcctgcgcagaggcatcttcttctcacacagagatatgaatcaggttcttgatgcctatgaaaataagaagccattttatctgtacacgggccggggcccctcttctgaagcaatgcatgtaggtcacctcattccatttattttcacaaagtaagtattggatcttatggcttttcttactctcttagtgaattgagaatgttgcttataaaccatgtttagaactgacaagatcatgctagttcatttgctgagcaaccaagatgtcaagagttggcacttttttggcttccattca

SEQ ID NO: 314357 - DNA, 2917 bp, Homo sapiens
caatgaccagctaatggctcgattctcaagagggtttcattggtctcaacctggccccccaggcaacccacccctgattggacagtctcatcaagaaggttggtcaagagctcaagtgtttctgagaatctgggtgatttataagaaacccttagctgaatgcagggtggggagaacgaaagacaaaagcatcttttttcagaagggaaactgaaagaaagaggggaagagtattaaagaccatttctggctgggcagggcactctcagcagctcaactgcccagcgtgaccagtggccacctctgcagtgtcttccacaacctggtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaaggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattgttcggtttggaagtagtaaaattgacaaagagctaataaaccgaatagagagagccaccggccaaagaccacaccacttcctgcgcagaggcatcttcttctcacacagagatatgaatcaggttcttgatgcctatgaaaataagaagccattttatctgtacacgggccggggcccctcttctgaagcaatgcatgtaggtcacctcattccatttattttcacaaagtggctccaggatgtatttaacgtgcccttggtcatccagatgacggatgacgagaagtatctgtggaaggacctgaccctggaccaggcctatagctatgctgtggagaatgccaaggacatcatcgcctgtggctttgacatcaacaagactttcatattctctgacctggactacatggggatgagctcaggtttctacaaaaatgtggtgaagattcaaaagcatgttaccttcaaccaagtgaaaggcattttcggcttcactgacagcgactgcattgggaagatcagttttcctgccatccaggctgctccctccttcagcaactcattcccacagatcttccgagacaggacggatatccagtgccttatcccatgtgccattgaccaggatccttactttagaatgacaagggacgtcgcccccaggatcggctatcctaaaccagccctgttgcactccaccttcttcccagccctgcagggcgcccagaccaaaatgagtgccagcgaccccaactcctccatcttcctcaccgacacggccaagcagatcaaaaccaaggtcaataagcatgcgttttctggagggagagacaccatcgaggagcacaggcagtttgggggcaactgtgatgtggacgtgtctttcatgtacctgaccttcttcctcgaggacgacgacaagctcgagcagatcaggaaggattacaccagcggagccatgctcaccggtgagctcaagaaggcactcatagaggttctgcagcccttgatcgcagagcaccaggcccggcgcaaggaggtcacggatgagatagtgaaagagttcatgactccccggaagctgtccttcgactttcagtagcactcgttttacatatgcttataaaagaagtgatgtatcagtaatgtatcaataatcccagcccagtcaaagcaccgccacctgtaggcttctgtctcatggtaattactgggcctggcctctgtaagcctgtgtatgttatcaatactgtttcttcctgtgagttccattatttctatctcttatgggcaaagcattgtgggtaattggtgctggctaacattgcatggtcggatagagaagtccagctgtgagtctctccccaaagcagccccacagtggagcctttggctggaagtccatgggccaccctgttcttgtccatggaggactccgagggttccaagtatactcttaagacccactctgtttaaaaatatatattctatgtatgcgtatatggaattgaaatgtcattattgtaacctagaaagtgctttgaaatattgatgtggggaggtttattgagcacaagatgtatttcagcccatgccccctcccaaaaagaaattgataagtaaaagcttcgttatacatttgactaagaaatcacccagctttaaagctgcttttaacaatgaagattgaacagagttcagcaattttgattaaattaagacttgggggtgaaactttccagtttactgaactccagaccatgcatgtagtccactccagaaatcatgctcgcttcccttggcacaccagtgttctcctgccaaatgaccctagaccctctgtcctgcagagtcagggtggcttttcccctgactgtgtccgatgccaaggagtcctggcctccgcagatgcttcattttgacccttggctgcagtggaagtcagcacagagcagtgccctggctgtgtccctggacgggtggacttagctagggagaaagtcgaggcagcagccctcgaggccctcacagatgtctaggcaggcctcatttcatcacgcagcatgtgcaggcctggaagagcaaagccaaatctcagggaagtccttggttgatgtatctgggtctcctctggagcactctgccctcctgtcacccagtagagtaaataaacttccttggctcctgaactcttgtcattgtgc

SEQ ID NO: 314358 - DNA, 2786 bp, Homo sapiens
ggcgtttccacggacgcccaggagacagccggttgctgagccgggagcgctgactggcccggctgggcaggaagggaaactgaaagaaagaggggaagagtattaaagaccatttctggctgggcagggcactctcagcagctcaactgcccagcgtgaccagtggccacctctgcagtgtcttccacaacctggtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaaggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattgttcggtttggaagtagtaaaattgacaaagagctaataaaccgaatagagagagccaccggccaaagaccacaccacttcctgcgcagaggcatcttcttctcacacagagatatgaatcaggttcttgatgcctatgaaaataagaagccattttatctgtacacgggccggggcccctcttctgaagcaatgcatgtaggtcacctcattccatttattttcacaaagtggctccaggatgtatttaacgtgcccttggtcatccagatgacggatgacgagaagtatctgtggaaggacctgaccctggaccaggcctatagctatgctgtggagaatgccaaggacatcatcgcctgtggctttgacatcaacaagactttcatattctctgacctggactacatggggatgagctcaggtttctacaaaaatgtggtgaagattcaaaagcatgttaccttcaaccaagtgaaaggcattttcggcttcactgacagcgactgcattgggaagatcagttttcctgccatccaggctgctccctccttcagcaactcattcccacagatcttccgagacaggacggatatccagtgccttatcccatgtgccattgaccaggatccttactttagaatgacaagggacgtcgcccccaggatcggctatcctaaaccagccctgttgcactccaccttcttcccagccctgcagggcgcccagaccaaaatgagtgccagcgaccccaactcctccatcttcctcaccgacacggccaagcagatcaaaaccaaggtcaataagcatgcgttttctggagggagagacaccatcgaggagcacaggcagtttgggggcaactgtgatgtggacgtgtctttcatgtacctgaccttcttcctcgaggacgacgacaagctcgagcagatcaggaaggattacaccagcggagccatgctcaccggtgagctcaagaaggcactcatagaggttctgcagcccttgatcgcagagcaccaggcccggcgcaaggaggtcacggatgagatagtgaaagagttcatgactccccggaagctgtccttcgactttcagtagcactcgttttacatatgcttataaaagaagtgatgtatcagtaatgtatcaataatcccagcccagtcaaagcaccgccacctgtaggcttctgtctcatggtaattactgggcctggcctctgtaagcctgtgtatgttatcaatactgtttcttcctgtgagttccattatttctatctcttatgggcaaagcattgtgggtaattggtgctggctaacattgcatggtcggatagagaagtccagctgtgagtctctccccaaagcagccccacagtggagcctttggctggaagtccatgggccaccctgttcttgtccatggaggactccgagggttccaagtatactcttaagacccactctgtttaaaaatatatattctatgtatgcgtatatggaattgaaatgtcattattgtaacctagaaagtgctttgaaatattgatgtggggaggtttattgagcacaagatgtatttcagcccatgccccctcccaaaaagaaattgataagtaaaagcttcgttatacatttgactaagaaatcacccagctttaaagctgcttttaacaatgaagattgaacagagttcagcaattttgattaaattaagacttgggggtgaaactttccagtttactgaactccagaccatgcatgtagtccactccagaaatcatgctcgcttcccttggcacaccagtgttctcctgccaaatgaccctagaccctctgtcctgcagagtcagggtggcttttcccctgactgtgtccgatgccaaggagtcctggcctccgcagatgcttcattttgacccttggctgcagtggaagtcagcacagagcagtgccctggctgtgtccctggacgggtggacttagctagggagaaagtcgaggcagcagccctcgaggccctcacagatgtctaggcaggcctcatttcatcacgcagcatgtgcaggcctggaagagcaaagccaaatctcagggaagtccttggttgatgtatctgggtctcctctggagcactctgccctcctgtcacccagtagagtaaataaacttccttggctcctgaactcttgtcattgtgc

SEQ ID NO: 314359 - DNA, 3047 bp, Homo sapiens
caatgaccagctaatggctcgattctcaagagggtttcattggtctcaacctggccccccaggcaacccacccctgattggacagtctcatcaagaaggttggtcaagagctcaagtgtttctgagaatctgggtgatttataagaaacccttagctgaatgcagggtggggagaacgaaagacaaaagcatcttttttcagaagggaaactgaaagaaagaggggaagagtattaaagaccatttctggctgggcagggcactctcagcagctcaactgcccagcgtgaccagtggccacctctgcagtgtcttccacaacctggagtgtactatttgttaaacaggtgaatctacttctcttaacaaagtctcaatgtcctatttgcaatttatgtggtaaacactgaagacaatggtccttaaccttttggcatctcagcctcctttcgaaagtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaaggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattgttcggtttggaagtagtaaaattgacaaagagctaataaaccgaatagagagagccaccggccaaagaccacaccacttcctgcgcagaggcatcttcttctcacacagagatatgaatcaggttcttgatgcctatgaaaataagaagccattttatctgtacacgggccggggcccctcttctgaagcaatgcatgtaggtcacctcattccatttattttcacaaagtggctccaggatgtatttaacgtgcccttggtcatccagatgacggatgacgagaagtatctgtggaaggacctgaccctggaccaggcctatagctatgctgtggagaatgccaaggacatcatcgcctgtggctttgacatcaacaagactttcatattctctgacctggactacatggggatgagctcaggtttctacaaaaatgtggtgaagattcaaaagcatgttaccttcaaccaagtgaaaggcattttcggcttcactgacagcgactgcattgggaagatcagttttcctgccatccaggctgctccctccttcagcaactcattcccacagatcttccgagacaggacggatatccagtgccttatcccatgtgccattgaccaggatccttactttagaatgacaagggacgtcgcccccaggatcggctatcctaaaccagccctgttgcactccaccttcttcccagccctgcagggcgcccagaccaaaatgagtgccagcgaccccaactcctccatcttcctcaccgacacggccaagcagatcaaaaccaaggtcaataagcatgcgttttctggagggagagacaccatcgaggagcacaggcagtttgggggcaactgtgatgtggacgtgtctttcatgtacctgaccttcttcctcgaggacgacgacaagctcgagcagatcaggaaggattacaccagcggagccatgctcaccggtgagctcaagaaggcactcatagaggttctgcagcccttgatcgcagagcaccaggcccggcgcaaggaggtcacggatgagatagtgaaagagttcatgactccccggaagctgtccttcgactttcagtagcactcgttttacatatgcttataaaagaagtgatgtatcagtaatgtatcaataatcccagcccagtcaaagcaccgccacctgtaggcttctgtctcatggtaattactgggcctggcctctgtaagcctgtgtatgttatcaatactgtttcttcctgtgagttccattatttctatctcttatgggcaaagcattgtgggtaattggtgctggctaacattgcatggtcggatagagaagtccagctgtgagtctctccccaaagcagccccacagtggagcctttggctggaagtccatgggccaccctgttcttgtccatggaggactccgagggttccaagtatactcttaagacccactctgtttaaaaatatatattctatgtatgcgtatatggaattgaaatgtcattattgtaacctagaaagtgctttgaaatattgatgtggggaggtttattgagcacaagatgtatttcagcccatgccccctcccaaaaagaaattgataagtaaaagcttcgttatacatttgactaagaaatcacccagctttaaagctgcttttaacaatgaagattgaacagagttcagcaattttgattaaattaagacttgggggtgaaactttccagtttactgaactccagaccatgcatgtagtccactccagaaatcatgctcgcttcccttggcacaccagtgttctcctgccaaatgaccctagaccctctgtcctgcagagtcagggtggcttttcccctgactgtgtccgatgccaaggagtcctggcctccgcagatgcttcattttgacccttggctgcagtggaagtcagcacagagcagtgccctggctgtgtccctggacgggtggacttagctagggagaaagtcgaggcagcagccctcgaggccctcacagatgtctaggcaggcctcatttcatcacgcagcatgtgcaggcctggaagagcaaagccaaatctcagggaagtccttggttgatgtatctgggtctcctctggagcactctgccctcctgtcacccagtagagtaaataaacttccttggctcctgaactcttgtcattgtgc

SEQ ID NO: 314360 - DNA, 2771 bp, Homo sapiens
ggcgtttccacggacgcccaggagacagccggttgctgagccgggagcgctgactggcccggctgggcagggtgaatctacttctcttaacaaagtctcaatgtcctatttgcaatttatgtggtaaacactgaagacaatggtccttaaccttttggcatctcagcctcctttcgaaagtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaaggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattgttcggtttggaagtagtaaaattgacaaagagctaataaaccgaatagagagagccaccggccaaagaccacaccacttcctgcgcagaggcatcttcttctcacacagagatatgaatcaggttcttgatgcctatgaaaataagaagccattttatctgtacacgggccggggcccctcttctgaagcaatgcatgtaggtcacctcattccatttattttcacaaagtggctccaggatgtatttaacgtgcccttggtcatccagatgacggatgacgagaagtatctgtggaaggacctgaccctggaccaggcctatagctatgctgtggagaatgccaaggacatcatcgcctgtggctttgacatcaacaagactttcatattctctgacctggactacatggggatgagctcaggtttctacaaaaatgtggtgaagattcaaaagcatgttaccttcaaccaagtgaaaggcattttcggcttcactgacagcgactgcattgggaagatcagttttcctgccatccaggctgctccctccttcagcaactcattcccacagatcttccgagacaggacggatatccagtgccttatcccatgtgccattgaccaggatccttactttagaatgacaagggacgtcgcccccaggatcggctatcctaaaccagccctgttgcactccaccttcttcccagccctgcagggcgcccagaccaaaatgagtgccagcgaccccaactcctccatcttcctcaccgacacggccaagcagatcaaaaccaaggtcaataagcatgcgttttctggagggagagacaccatcgaggagcacaggcagtttgggggcaactgtgatgtggacgtgtctttcatgtacctgaccttcttcctcgaggacgacgacaagctcgagcagatcaggaaggattacaccagcggagccatgctcaccggtgagctcaagaaggcactcatagaggttctgcagcccttgatcgcagagcaccaggcccggcgcaaggaggtcacggatgagatagtgaaagagttcatgactccccggaagctgtccttcgactttcagtagcactcgttttacatatgcttataaaagaagtgatgtatcagtaatgtatcaataatcccagcccagtcaaagcaccgccacctgtaggcttctgtctcatggtaattactgggcctggcctctgtaagcctgtgtatgttatcaatactgtttcttcctgtgagttccattatttctatctcttatgggcaaagcattgtgggtaattggtgctggctaacattgcatggtcggatagagaagtccagctgtgagtctctccccaaagcagccccacagtggagcctttggctggaagtccatgggccaccctgttcttgtccatggaggactccgagggttccaagtatactcttaagacccactctgtttaaaaatatatattctatgtatgcgtatatggaattgaaatgtcattattgtaacctagaaagtgctttgaaatattgatgtggggaggtttattgagcacaagatgtatttcagcccatgccccctcccaaaaagaaattgataagtaaaagcttcgttatacatttgactaagaaatcacccagctttaaagctgcttttaacaatgaagattgaacagagttcagcaattttgattaaattaagacttgggggtgaaactttccagtttactgaactccagaccatgcatgtagtccactccagaaatcatgctcgcttcccttggcacaccagtgttctcctgccaaatgaccctagaccctctgtcctgcagagtcagggtggcttttcccctgactgtgtccgatgccaaggagtcctggcctccgcagatgcttcattttgacccttggctgcagtggaagtcagcacagagcagtgccctggctgtgtccctggacgggtggacttagctagggagaaagtcgaggcagcagccctcgaggccctcacagatgtctaggcaggcctcatttcatcacgcagcatgtgcaggcctggaagagcaaagccaaatctcagggaagtccttggttgatgtatctgggtctcctctggagcactctgccctcctgtcacccagtagagtaaataaacttccttggctcctgaactcttgtcattgtgc

SEQ ID NO: 314361 - DNA, 2490 bp, Homo sapiens
ggcgtttccacggacgcccaggagacagccggttgctgagccgggagcgctgactggcccggctgggcagggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattgttcggtttggaagtagtaaaattgacaaagagctaataaaccgaatagagagagccaccggccaaagaccacaccacttcctgcgcagaggcatcttcttctcacacagagatatgaatcaggttcttgatgcctatgaaaataagaagccattttatctgtacacgggccggggcccctcttctgaagcaatgcatgtaggtcacctcattccatttattttcacaaagtggctccaggatgtatttaacgtgcccttggtcatccagatgacggatgacgagaagtatctgtggaaggacctgaccctggaccaggcctatagctatgctgtggagaatgccaaggacatcatcgcctgtggctttgacatcaacaagactttcatattctctgacctggactacatggggatgagctcaggtttctacaaaaatgtggtgaagattcaaaagcatgttaccttcaaccaagtgaaaggcattttcggcttcactgacagcgactgcattgggaagatcagttttcctgccatccaggctgctccctccttcagcaactcattcccacagatcttccgagacaggacggatatccagtgccttatcccatgtgccattgaccaggatccttactttagaatgacaagggacgtcgcccccaggatcggctatcctaaaccagccctgttgcactccaccttcttcccagccctgcagggcgcccagaccaaaatgagtgccagcgaccccaactcctccatcttcctcaccgacacggccaagcagatcaaaaccaaggtcaataagcatgcgttttctggagggagagacaccatcgaggagcacaggcagtttgggggcaactgtgatgtggacgtgtctttcatgtacctgaccttcttcctcgaggacgacgacaagctcgagcagatcaggaaggattacaccagcggagccatgctcaccggtgagctcaagaaggcactcatagaggttctgcagcccttgatcgcagagcaccaggcccggcgcaaggaggtcacggatgagatagtgaaagagttcatgactccccggaagctgtccttcgactttcagtagcactcgttttacatatgcttataaaagaagtgatgtatcagtaatgtatcaataatcccagcccagtcaaagcaccgccacctgtaggcttctgtctcatggtaattactgggcctggcctctgtaagcctgtgtatgttatcaatactgtttcttcctgtgagttccattatttctatctcttatgggcaaagcattgtgggtaattggtgctggctaacattgcatggtcggatagagaagtccagctgtgagtctctccccaaagcagccccacagtggagcctttggctggaagtccatgggccaccctgttcttgtccatggaggactccgagggttccaagtatactcttaagacccactctgtttaaaaatatatattctatgtatgcgtatatggaattgaaatgtcattattgtaacctagaaagtgctttgaaatattgatgtggggaggtttattgagcacaagatgtatttcagcccatgccccctcccaaaaagaaattgataagtaaaagcttcgttatacatttgactaagaaatcacccagctttaaagctgcttttaacaatgaagattgaacagagttcagcaattttgattaaattaagacttgggggtgaaactttccagtttactgaactccagaccatgcatgtagtccactccagaaatcatgctcgcttcccttggcacaccagtgttctcctgccaaatgaccctagaccctctgtcctgcagagtcagggtggcttttcccctgactgtgtccgatgccaaggagtcctggcctccgcagatgcttcattttgacccttggctgcagtggaagtcagcacagagcagtgccctggctgtgtccctggacgggtggacttagctagggagaaagtcgaggcagcagccctcgaggccctcacagatgtctaggcaggcctcatttcatcacgcagcatgtgcaggcctggaagagcaaagccaaatctcagggaagtccttggttgatgtatctgggtctcctctggagcactctgccctcctgtcacccagtagagtaaataaacttccttggctcctgaactcttgtcattgtgc

SEQ ID NO: 314362 - DNA, 2876 bp, Homo sapiens
caatgaccagctaatggctcgattctcaagagggtttcattggtctcaacctggccccccaggcaacccacccctgattggacagtctcatcaagaaggttggtcaagagctcaagtgtttctgagaatctgggtgatttataagaaacccttagctgaatgcagggtggggagaacgaaagacaaaagcatcttttttcagaagggaaactgaaagaaagaggggaagagtattaaagaccatttctggctgggcagggcactctcagcagctcaactgcccagcgtgaccagtggccacctctgcagtgtcttccacaacctggtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaaggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattgttcggtttggaagtagtaaaattgacaaagagctaataaaccgaatagagagagccaccggccaaagaccacaccacttcctgcgcagaggcatcttcttctcacacagagatatgaatcaggttcttgatgcctatgaaaataagaagccattttatctgtacacgggccggggcccctcttctgaagcaatgcatgtaggtcacctcattccatttattttcacaaagtggctccaggatgtatttaacgtgcccttggtcatccagatgacggatgacgagaagtatctgtggaaggacctgaccctggaccaggcctatagctatgctgtggagaatgccaaggacatcatcgcctgtggctttgacatcaacaagactttcatattctctgacctggactacatggggatgagctcaggtttctacaaaaatgtggtgaagattcaaaagcatgttaccttcaaccaagtgaaaggcattttcggcttcactgacagcgactgcattgggaagatcagttttcctgccatccaggctgctccctccttcagcaactcattcccacagatcttccgagacaggacggatatccagtgccttatcccatgtgccattgaccaggatccttactttagaatgacaagggacgtcgcccccaggatcggctatcctaaaccagccctgttgcactccaccttcttcccagccctgcagggcgcccagaccaaaatgagtgccagcgaccccaactcctccatcttcctcaccgacacggccaagcagatcaaaaccaaggtcaataagcatgcgttttctggagggagagacaccatcgaggagcacaggcagtttgggggcaactgtgatgtggacgtgtctttcatgtacctgaccttcttcctcgaggacgacgacaagctcgagcagatcaggaaggattacaccagcggagccatgctcaccggtgagctcaagaaggcactcatagaggttctgcagcccttgatcgcagagcaccaggcccggcgcaaggaggtcacggatgagatagtgaaagagttcatgactccccggaagctgtccttcgactttcagtagcactcgttttacatatgcttataaaagaagtgatgtatcagtaatgtatcaataatcccagcccagtcaaagcaccgccacctgtaggcttctgtctcatggtaattactgggcctggcctctgtaagcctgtgtatgttatcaatactgtttcttcctgtgagttccattatttctatctcttatgggcaaagcattgtgggtaattggtgctggctaacattgcatggtcggatagagaagtccagctgtgagtctctccccaaagcagccccacagtggagcctttggctggaagtccatgggccaccctgttcttgtccatggaggactccgagggttccaagtatactcttaagacccactctgtttaaaaatatatattctatgtatgcgtatatggaattgaaatgtcattattgtaacctagaaagtgctttgaaatattgatgtggggaggtttattgagcacaagatgtatttcagcccatgccccctcccaaaaagaaattgataatttaaagctgcttttaacaatgaagattgaacagagttcagcaattttgattaaattaagacttgggggtgaaactttccagtttactgaactccagaccatgcatgtagtccactccagaaatcatgctcgcttcccttggcacaccagtgttctcctgccaaatgaccctagaccctctgtcctgcagagtcagggtggcttttcccctgactgtgtccgatgccaaggagtcctggcctccgcagatgcttcattttgacccttggctgcagtggaagtcagcacagagcagtgccctggctgtgtccctggacgggtggacttagctagggagaaagtcgaggcagcagccctcgaggccctcacagatgtctaggcaggcctcatttcatcacgcagcatgtgcaggcctggaagagcaaagccaaatctcagggaagtccttggttgatgtatctgggtctcctctggagcactctgccctcctgtcacccagtagagtaaataaacttccttggctcctgaactcttgtcattgtgc

SEQ ID NO: 314363 - DNA, 2829 bp, Homo sapiens
caatgaccagctaatggctcgattctcaagagggtttcattggtctcaacctggccccccaggcaacccacccctgattggacagtctcatcaagaaggttggtcaagagctcaagtgtttctgagaatctgggtgatttataagaaacccttagctgaatgcagggtggggagaacgaaagacaaaagcatcttttttcagaagggaaactgaaagaaagaggggaagagtattaaagaccatttctggctgggcagggcactctcagcagctcaactgcccagcgtgaccagtggccacctctgcagtgtcttccacaacctggtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaaggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattgttcggtttggaagtagtaaaattgacaaagagctaataaaccgaatagagagagccaccggccaaagaccacaccacttcctgcgcagaggcatcttcttctcacacagagatatgaatcaggttcttgatgcctatgaaaataagaagccattttatctgtacacgggccggggcccctcttctgaagcaatgcatgtaggtcacctcattccatttattttcacaaagtggctccaggatgtatttaacgtgcccttggtcatccagatgacggatgacgagaagtatctgtggaaggacctgaccctggaccaggcctatagatgagctcaggtttctacaaaaatgtggtgaagattcaaaagcatgttaccttcaaccaagtgaaaggcattttcggcttcactgacagcgactgcattgggaagatcagttttcctgccatccaggctgctccctccttcagcaactcattcccacagatcttccgagacaggacggatatccagtgccttatcccatgtgccattgaccaggatccttactttagaatgacaagggacgtcgcccccaggatcggctatcctaaaccagccctgttgcactccaccttcttcccagccctgcagggcgcccagaccaaaatgagtgccagcgaccccaactcctccatcttcctcaccgacacggccaagcagatcaaaaccaaggtcaataagcatgcgttttctggagggagagacaccatcgaggagcacaggcagtttgggggcaactgtgatgtggacgtgtctttcatgtacctgaccttcttcctcgaggacgacgacaagctcgagcagatcaggaaggattacaccagcggagccatgctcaccggtgagctcaagaaggcactcatagaggttctgcagcccttgatcgcagagcaccaggcccggcgcaaggaggtcacggatgagatagtgaaagagttcatgactccccggaagctgtccttcgactttcagtagcactcgttttacatatgcttataaaagaagtgatgtatcagtaatgtatcaataatcccagcccagtcaaagcaccgccacctgtaggcttctgtctcatggtaattactgggcctggcctctgtaagcctgtgtatgttatcaatactgtttcttcctgtgagttccattatttctatctcttatgggcaaagcattgtgggtaattggtgctggctaacattgcatggtcggatagagaagtccagctgtgagtctctccccaaagcagccccacagtggagcctttggctggaagtccatgggccaccctgttcttgtccatggaggactccgagggttccaagtatactcttaagacccactctgtttaaaaatatatattctatgtatgcgtatatggaattgaaatgtcattattgtaacctagaaagtgctttgaaatattgatgtggggaggtttattgagcacaagatgtatttcagcccatgccccctcccaaaaagaaattgataagtaaaagcttcgttatacatttgactaagaaatcacccagctttaaagctgcttttaacaatgaagattgaacagagttcagcaattttgattaaattaagacttgggggtgaaactttccagtttactgaactccagaccatgcatgtagtccactccagaaatcatgctcgcttcccttggcacaccagtgttctcctgccaaatgaccctagaccctctgtcctgcagagtcagggtggcttttcccctgactgtgtccgatgccaaggagtcctggcctccgcagatgcttcattttgacccttggctgcagtggaagtcagcacagagcagtgccctggctgtgtccctggacgggtggacttagctagggagaaagtcgaggcagcagccctcgaggccctcacagatgtctaggcaggcctcatttcatcacgcagcatgtgcaggcctggaagagcaaagccaaatctcagggaagtccttggttgatgtatctgggtctcctctggagcactctgccctcctgtcacccagtagagtaaataaacttccttggctcctgaactcttgtcattgtgc

SEQ ID NO: 314364 - DNA, 2213 bp, Homo sapiens
caatgaccagctaatggctcgattctcaagagggtttcattggtctcaacctggccccccaggcaacccacccctgattggacagtctcatcaagaaggttggtcaagagctcaagtgtttctgagaatctgggtgatttataagaaacccttagctgaatgcagggtggggagaacgaaagacaaaagcatcttttttcagaagggaaactgaaagaaagaggggaagagtattaaagaccatttctggctgggcagggcactctcagcagctcaactgcccagcgtgaccagtggccacctctgcagtgtcttccacaacctggtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaaggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattgttcggtttggaagtagtaaaattgacaaagagctaataaaccgaatagagagagccaccggccaaagaccacaccacttcctgcgcagaggcatcttcttctcacacagagatatgaatcaggttcttgatgcctatgaaaataagaagccattttatctgtacacgggccggggcccctcttctgaagcaatgcatgtaggtcacctcattccatttattttcacaaagtggctccaggatgtatttaacgtgcccttggtcatccagatgacggatgacgagaagtatctgtggaaggacctgaccctggaccaggcctatagctatgctgtggagaatgccaaggacatcatcgcctgtggctttgacatcaacaagactttcatattctctgacctggactacatggggatgagctcaggtttctacaaaaatgtggtgaagattcaaaagcatgttaccttcaaccaagtgaaaggcattttcggcttcactgacagcgactgcattgggaagatcagttttcctgccatccaggctgctccctccttcagcaactcattcccacagatcttccgagacaggacggatatccagtgccttatcccatgtgccattgaccaggatccttactttagaatgacaagggacgtcgcccccaggatcggctatcctaaaccagccctgttgcactccaccttcttcccagccctgcagggcgcccagaccaaaatgagtgccagcgaccccaactcctccatcttcctcaccgacacggccaagcagatcaaaaccaaggtcaataagcatgcgttttctggagggagagacaccatcgaggagcacaggcagtttgggggcaactgtgatgtggacgtgtctttcatgtacctgaccttcttcctcgaggacgacgacaagctcgagcagatcaggaaggattacaccagcggagccatgctcaccggtgagctcaagaaggcactcatagaggttctgcagcccttgatcgcagagcaccaggcccggcgcaaggaggtcacggatgagatagtgaaagagttcatgactccccggaagctgtccttcgactttcagtagcactcgttttacatatgcttataaaagaagtgatgtatcagtaatgtatcaataatcccagcccagtcaaagcaccgccacctgtaggcttctgtctcatggtaattactgggcctggcctctgtaagcctgtgtatgttatcaatactgtttcttcctgtgagttccattatttctatctcttatgggcaaagcattgtgggtaattggtgctggctaacattgcatggtcggatagagaagtccagctgtgagtctctccccaaagcagccccacagtggagcctttggctggaagtccatgggccaccctgttcttgtccatggaggactccgagggttccaagtatactcttaagacccactctgtttaaaaatatatattctatgtatgcgta

SEQ ID NO: 314365 - DNA, 2314 bp, Homo sapiens
tccctgtctgcatggccatgggcctgctacttctctgagcctaagtttccacatctgcaagatgagaatgaagatacctacctcatagaactactgtaaagcttcaaaacaaagtgtgtagagcagctaacacagagcacacagggccacctggtcgataaatggtagtagaccttatcattatccatagtcaaattcatatcacaattcaaattgtgattttgtaggcaaggaagttttaacatacgttgtaagtaggagctgtgttttcagatgcacgatggcgttcctccacaggggagatgagacgtcagctttctccccctgtgtttctttaggtggctccaggatgtatttaacgtgcccttggtcatccagatgacggatgacgagaagtatctgtggaaggacctgaccctggaccaggcctatagctatgctgtggagaatgccaaggacatcatcgcctgtggctttgacatcaacaagactttcatattctctgacctggactacatggggatgagctcaggtttctacaaaaatgtggtgaagattcaaaagcatgttaccttcaaccaagtgaaaggcattttcggcttcactgacagcgactgcattgggaagatcagttttcctgccatccaggctgctccctccttcagcaactcattcccacagatcttccgagacaggacggatatccagtgccttatcccatgtgccattgaccaggatccttactttagaatgacaagggacgtcgcccccaggatcggctatcctaaaccagccctgttgcactccaccttcttcccagccctgcagggcgcccagaccaaaatgagtgccagcgaccccaactcctccatcttcctcaccgacacggccaagcagatcaaaaccaaggtcaataagcatgcgttttctggagggagagacaccatcgaggagcacaggcagtttgggggcaactgtgatgtggacgtgtctttcatgtacctgaccttcttcctcgaggacgacgacaagctcgagcagatcaggaaggattacaccagcggagccatgctcaccggtgagctcaagaaggcactcatagaggttctgcagcccttgatcgcagagcaccaggcccggcgcaaggaggtcacggatgagatagtgaaagagttcatgactccccggaagctgtccttcgactttcagtagcactcgttttacatatgcttataaaagaagtgatgtatcagtaatgtatcaataatcccagcccagtcaaagcaccgccacctgtaggcttctgtctcatggtaattactgggcctggcctctgtaagcctgtgtatgttatcaatactgtttcttcctgtgagttccattatttctatctcttatgggcaaagcattgtgggtaattggtgctggctaacattgcatggtcggatagagaagtccagctgtgagtctctccccaaagcagccccacagtggagcctttggctggaagtccatgggccaccctgttcttgtccatggaggactccgagggttccaagtatactcttaagacccactctgtttaaaaatatatattctatgtatgcgtatatggaattgaaatgtcattattgtaacctagaaagtgctttgaaatattgatgtggggaggtttattgagcacaagatgtatttcagcccatgccccctcccaaaaagaaattgataagtaaaagcttcgttatacatttgactaagaaatcacccagctttaaagctgcttttaacaatgaagattgaacagagttcagcaattttgattaaattaagacttgggggtgaaactttccagtttactgaactccagaccatgcatgtagtccactccagaaatcatgctcgcttcccttggcacaccagtgttctcctgccaaatgaccctagaccctctgtcctgcagagtcagggtggcttttcccctgactgtgtccgatgccaaggagtcctggcctccgcagatgcttcattttgacccttggctgcagtggaagtcagcacagagcagtgccctggctgtgtccctggacgggtggacttagctagggagaaagtcgaggcagcagccctcgaggccctcacagatgtctaggcaggcctcatttcatcacgcagcatgtgcaggcctggaagagcaaagccaaatctcagggaagtccttggttgatgtatctgggtctcctctggagcactctgccctcctgtcacccagtagagtaaataaacttccttggctcctgaactcttgtcattgtgc

SEQ ID NO: 314366 - DNA, 2087 bp, Homo sapiens
caatgaccagctaatggctcgattctcaagagggtttcattggtctcaacctggccccccaggcaacccacccctgattggacagtctcatcaagaaggttggtcaagagctcaagtgtttctgagaatctgggtgatttataagaaacccttagctgaatgcagggtggggagaacgaaagacaaaagcatcttttttcagaagggaaactgaaagaaagaggggaagagtattaaagaccatttctggctgggcagggcactctcagcagctcaactgcccagcgtgaccagtggccacctctgcagtgtcttccacaacctggtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaaggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattgttcggtttggaagtagtaaaattgacaaagagctaataaaccgaatagagagagccaccggccaaagaccacaccacttcctgcgcagaggcatcttcttctcacacagagatatgaatcaggttcttgatgcctatgaaaataagaagccattttatctgtacacgggccggggcccctcttctgaagcaatgcatgtaggtcacctcattccatttattttcacaaagtggctccaggatgtatttaacgtgcccttggtcatccagatgacggatgacgagaagtatctgtggaaggacctgaccctggaccaggcctatagctatgctgtggagaatgccaaggacatcatcgcctgtggctttgacatcaacaagactttcatattctctgacctggactacatggggatgagctcaggtttctacaaaaatgtggtgaagattcaaaagcatgttaccttcaaccaagtgaaaggcattttcggcttcactgacagcgactgcattgggaagatcagttttcctgccatccaggctgctccctccttcagcaactcattcccacagatcttccgagacaggacggatatccagtgccttatcccatgtgccattgaccaggatccttactttagaatgacaagggacgtcgcccccaggatcggctatcctaaaccagccctgttgcactccaccttcttcccagccctgcagggcgcccagaccaaaatgagtgccagcgaccccaactcctccatcttcctcaccgacacggccaagcagatcaaaaccaaggtcaataagcatgcgttttctggagggagagacaccatcgaggagcacaggcagtttgggggcaactgtgatgtggacgtgtctttcatgtacctgaccttcttcctcgaggacgacgacaagctcgagcagatcaggaaggattacaccagcggagccatgctcaccggtgagctcaagaaggcactcatagaggttctgcagcccttgatcgcagagcaccaggcccggcgcaaggaggtcacggatgagatagtgaaagagttcatgactccccggaagctgtccttcgactttcagtagcactcgttttacatatgcttataaaagaagtgatgtatcagtaatgtatcaataatcccagcccagtcaaagcaccgccacctgtaggcttctgtctcatggtaattactgggcctggcctctgtaagcctgtgtatgttatcaatactgtttcttcctgtgagttccattatttctatctcttatgggcaaaggaagacaggcagaagtcagaaagacagggtttggacggggcagatgcagaacgcgggtcatgtgagcagaagcaggag

SEQ ID NO: 314367 - DNA, 1959 bp, Homo sapiens
caatgaccagctaatggctcgattctcaagagggtttcattggtctcaacctggccccccaggcaacccacccctgattggacagtctcatcaagaaggttggtcaagagctcaagtgtttctgagaatctgggtgatttataagaaacccttagctgaatgcagggtggggagaacgaaagacaaaagcatcttttttcagaagggaaactgaaagaaagaggggaagagtattaaagaccatttctggctgggcagggcactctcagcagctcaactgcccagcgtgaccagtggccacctctgcagtgtcttccacaacctggtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaaggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattgttcggtttggaagtagtaaaattgacaaagagctaataaaccgaatagagagagccaccggccaaagaccacaccacttcctgcgcagaggcatcttcttctcacacagagatatgaatcaggttcttgatgcctatgaaaataagaagccattttatctgtacacgggccggggcccctcttctgaagcaatgcatgtaggtcacctcattccatttattttcacaaagtggctccaggatgtatttaacgtgcccttggtcatccagatgacggatgacgagaagtatctgtggaaggacctgaccctggaccaggcctatagctatgctgtggagaatgccaaggacatcatcgcctgtggctttgacatcaacaagactttcatattctctgacctggactacatggggatgagctcaggtttctacaaaaatgtggtgaagattcaaaagcatgttaccttcaaccaagtgaaaggcattttcggcttcactgacagcgactgcattgggaagatcagttttcctgccatccaggctgctccctccttcagcaactcattcccacagatcttccgagacaggacggatatccagtgccttatcccatgtgccattgaccaggatccttactttagaatgacaagggacgtcgcccccaggatcggctatcctaaaccagccctgttgcactccaccttcttcccagccctgcagggcgcccagaccaaaatgagtgccagcgaccccaactcctccatcttcctcaccgacacggccaagcagatcaaaaccaaggtcaataagcatgcgttttctggagggagagacaccatcgaggagcacaggcagtttgggggcaactgtgatgtggacgtgtctttcatgtacctgaccttcttcctcgaggacgacgacaagctcgagcagatcaggaaggattacaccagcggagccatgctcaccggtgagctcaagaaggcactcatagaggttctgcagcccttgatcgcagagcaccaggcccggcgcaaggaggtcacggatgagatagtgaaagagttcatgactccccggaagctgtccttcgactttcagtagcactcgttttacatatgcttataaaagaagtgatgtatcagtattgataacatacacaggcttacagaggccaggcccagtaattaccatgagacagaagcctacaggtgcggtgctttgactgggctgggattattgatacat

SEQ ID NO: 314368 - DNA, 1914 bp, Homo sapiens
  misc_feature (1885)..(1885): n is a, c, g, or t
caatgaccagctaatggctcgattctcaagagggtttcattggtctcaacctggccccccaggcaacccacccctgattggacagtctcatcaagaaggttggtcaagagctcaagtgtttctgagaatctgggtgatttataagaaacccttagctgaatgcagggtggggagaacgaaagacaaaagcatcttttttcagaagggaaactgaaagaaagaggggaagagtattaaagaccatttctggctgggcagggcactctcagcagctcaactgcccagcgtgaccagtggccacctctgcagtgtcttccacaacctggtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaaggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattgttcggtttggaagtagtaaaattgacaaagagctaataaaccgaatagagagagccaccggccaaagaccacaccacttcctgcgcagaggcatcttcttctcacacagagatatgaatcaggttcttgatgcctatgaaaataagaagccattttatctgtacacgggccggggcccctcttctgaagcaatgcatgtaggtcacctcattccatttattttcacaaagtggctccaggatgtatttaacgtgcccttggtcatccagatgacggatgacgagaagtatctgtggaaggacctgaccctggaccaggcctatagctatgctgtggagaatgccaaggacatcatcgcctgtggctttgacatcaacaagactttcatattctctgacctggactacatggggatgagctcaggtttctacaaaaatgtggtgaagattcaaaagcatgttaccttcaaccaagtgaaaggcattttcggcttcactgacagcgactgcattgggaagatcagttttcctgccatccaggctgctccctccttcagcaactcattcccacagatcttccgagacaggacggatatccagtgccttatcccatgtgccattgaccaggatccttactttagaatgacaagggacgtcgcccccaggatcggctatcctaaaccagccctgttgcactccaccttcttcccagccctgcagggcgcccagaccaaaatgagtgccagcgaccccaactcctccatcttcctcaccgacacggccaagcagatcaaaaccaaggtcaataagcatgcgttttctggagggagagacaccatcgaggagcacaggcagtttgggggcaactgtgatgtggacgtgtctttcatgtacctgaccttcttcctcgaggacgacgacaagctcgagcagatcaggaaggtgagcagggaaccccaagggcccacagccgcctcctgccacccactcctgcccatggggcctggaaggctccaacagccaggcatgaaggcttggtcggaggtgctcaactgaaacaaggtgaaaactgagtagactcgccctcatggtttttaggcctgggctcagaagcctcatgaacaaatctcgaaagagcagatacaaatcactattcatttaggccttatcccangtgccattgaccaggatccttagagtcga

SEQ ID NO: 314369 - DNA, 1543 bp, Homo sapiens
caatgaccagctaatggctcgattctcaagagggtttcattggtctcaacctggccccccaggcaacccacccctgattggacagtctcatcaagaaggttggtcaagagctcaagtgtttctgagaatctgggtgatttataagaaacccttagctgaatgcagggtggggagaacgaaagacaaaagcatcttttttcagaagggaaactgaaagaaagaggggaagagtattaaagaccatttctggctgggcagggcactctcagcagctcaactgcccagcgtgaccagtggccacctctgcagtgtcttccacaacctggtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaaggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattgttcggtttggaagtagtaaaattgacaaagagctaataaaccgaatagagagagccaccggccaaagaccacaccacttcctgcgcagaggcatcttcttctcacacagagatatgaatcaggttcttgatgcctatgaaaataagaagccattttatctgtacacgggccggggcccctcttctgaagcaatgcatgtaggtcacctcattccatttattttcacaaagtggctccaggatgtatttaacgtgcccttggtcatccagatgacggatgacgagaagtatctgtggaaggacctgaccctggaccaggcctatagctatgctgtggagaatgccaaggacatcatcgcctgtggctttgacatcaacaagactttcatattctctgacctggactacatggggatgagctcaggtttctacaaaaatgtggtgaagattcaaaagcatgttaccttcaaccaagtgaaaggcattttcggcttcactgacagcgactgcattgggaagatcagttttcctgccatccaggctgctccctccttcagcaactcattcccacagatcttccgagacaggacggatatccagtgccttatcccatgtgccattgaccaggatatgcaggctctgaaggaggtcttcaaggagtatttgattgaactgtttatcttgcaacactttcaagggaacattatggatttcttagctttcaagaagaaacattatgccccattacaagcatatcttaggcagaatgatttggacattgaagaacaggaggaggaggaggaagaagaggaagaaaaatctgaggttatca

SEQ ID NO: 314370 - DNA, 1308 bp, Homo sapiens
caatgaccagctaatggctcgattctcaagagggtttcattggtctcaacctggccccccaggcaacccacccctgattggacagtctcatcaagaaggttggtcaagagctcaagtgtttctgagaatctgggtgatttataagaaacccttagctgaatgcagggtggggagaacgaaagacaaaagcatcttttttcagaagggaaactgaaagaaagaggggaagagtattaaagaccatttctggctgggcagggcactctcagcagctcaactgcccagcgtgaccagtggccacctctgcagtgtcttccacaacctggtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaaggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattgttcggtttggaagtagtaaaattgacaaagagctaataaaccgaatagagagagccaccggccaaagaccacaccacttcctgcgcagaggcatcttcttctcacacagagatatgaatcaggttcttgatgcctatgaaaataagaagccattttatctgtacacgggccggggcccctcttctgaagcaatgcatgtaggtcacctcattccatttattttcacaaagtggctccaggatgtatttaacgtgcccttggtcatccagatgacggatgacgagaagtatctgtggaaggacctgaccctggaccaggcctatacagtggaagtcagcacagagcagtgccctggctgtgtccctggacgggtggacttagctagggagaaagtcgaggcagcagccctcgaggccctcacagatgtctaggcaggcctcatttcatcacgcagcatgtgcaggcctggaagagcaaagccaaatctcagggaagtccttggttgatgtatctgggtctcctctggagcactctgccctcctgtcacccagtagagtaaataaacttccttggctcctgaactcttgtcattgtgc

SEQ ID NO: 314371 - DNA, 2509 bp, Homo sapiens
  misc_feature (756)..(756): n is a, c, g, or t
caatgaccagctaatggctcgattctcaagagggtttcattggtctcaacctggccccccaggcaacccacccctgattggacagtctcatcaagaaggttggtcaagagctcaagtgtttctgagaatctgggtgatttataagaaacccttagctgaatgcagggtggggagaacgaaagacaaaagcatcttttttcagaagggaaactgaaagaaagaggggaagagtattaaagaccatttctggctgggcagggcactctcagcagctcaactgcccagcgtgaccagtggccacctctgcagtgtcttccacaacctggtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaaggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattgttcgttttgaagtggtccaattcttgccacaggggattttcttntcacacagagatatgaatcaggttcttgatgcctatgaaaataagaagccattttatctgtacacgggccggggcccctcttctgaagcaatgcatgtaggtcacctcattccatttattttcacaaagtggctccaggatgtatttaacgtgcccttggtcatccagatgacggatgacgagaagtatctgtggaaggacctgaccctggaccaggcctatagctatgctgtggagaatgccaaggacatcatcgcctgtggctttgacatcaacaagactttcatattctctgacctggactacatggggatgagctcaggtttctacaaaaatgtggtgaagattcaaaagcatgttaccttcaaccaagtgaaaggcattttcggcttcactgacagcgactgcattgggaagatcagttttcctgccatccaggctgctccctccttcagcaactcattcccacagatcttccgagacaggacggatatccagtgccttatcccatgtgccattgaccaggatccttactttagaatgacaagggacgtcgcccccaggatcggctatcctaaaccagccctgttgcactccaccttcttcccagccctgcagggcgcccagaccaaaatgagtgccagcgaccccaactcctccatcttcctcaccgacacggccaagcagatcaaaaccaagggtgagcagtggcccaggcagagggcagccagcgggatcagaaacatgccctggggggcacacgcacacacacaccactgcacagtgctttgggcctcagccacccagccaccgtagcaatgctgaactccaggattgccaactttgctccctgcagaactcaaggcagcctgtccttcccacatgaatcaggtgaatttgttttgtgtcctttcatttaggtaaaattttgaatttttttttctttttttccttttctgcttttcttatcagcactgttctgcaggcaaagtcatggcaatttccttaaagttataattagtgtggatgttattaaataatggaaaagattgtgtatatttctcatcatcagctgtgttccagcggctggacccggtgccttatttatgttttctcatgtttcattctcactgggaggtggtggtgctattccctttaaagatgagatgatgaggcttagagaagcccagccacttgaccaagtttccaccaccaggaatcagcagcactgctctcctggccctgagcagccattaccaagcaggggttatgagctggtcttctcccagagagcgttctcactgagagacatagaacggagaaacgtccatccacgggacagtcctgctggccccaggagggatgcatgcagcaggcattcagcaaacatttgacaaatcactagagaaactaaaaggagaagttagtttgagcttccttattttgcatggccccagttctgttgcctggttcctcaacagccagtgtatatataattgcctcactgttacacaaagcagttgacattttctttggaatcaagtgtgtgtttgcaggctagaagattgcagtgggaatgctgggaactgtatttgaggcatgtcacatgccctctgagtcactgcccctgaccgttctggaaagtcccaagcaggttctggttgacaatggggaagcctttcatatcaaaacttcctaagacatgccctccaccaactctccccactcagttggaagctggtataattgaaga

SEQ ID NO: 314372 - DNA, 491 bp, Homo sapiens
tttttttgagccggagtttcgctcttgttgcccaggctggagtgcaatggtgcagtctcggctcactgcaacctccacctcctgggttcaagtgattctcctgcctcagcctcccgagtacctgggattaaaagcatgcgccaccacacccggctaattttgcatttttagtagagatgtggtttctctatgttggtcaggctggtctcaaactcccgacctcaggtgatccacctgcctcggcctcccgaagtgctgggattacaggtgtgagccaccacgcccggtctagtatctatcttaatcaaaccgagagttctgaaatttcttcataaactagatctctattgctgtttttctggtttattttttgttttgagtcttgctctgtcactcaggctggagtgcagtggcgtgatctcagctcactgcagcctctgcctcagcctcccgagtggctaggattataggtgcctgccaccacatctggc

SEQ ID NO: 314373 - DNA, 700 bp, Homo sapiens
atcccctagtcaaggggatgccttaatgtgttacaggagagtttttttcatattgaggtatcttgaacataggacatgaaatctttcctctccttttttctcctctttgtccaaaattaaatcaaatgagctcactgcagagatgccgctggaagcagcaaggtacagagcaggcagggcggccctctcacctgcccttcttaactgtgccatgggagcgggagattctgcaggctgtggggtgcaagaagtgtcacggagcctctctcccaggacatcttgtcatccctgccaacgtggcaggagagggtctttaaggtcttagaaagagactgtgttcacgcttgagacgtttttatcatgttactaaatggggcttcttggctgggtgcaatggctcacgcctataaccctaacactttgggaggccgaggcgggtagatagtttgaagtcaggagttcaaggccatcctgggcaatatagcaagaactcgtctctgcaaaaaaaaaaaaaaatttaaattagctaggcgtgatggcatgcgctattcagaaggctgaggtgggtggatcccttgagcccaggaattctaggctgcgttgagccatgatcgcaccactacactccagcctgggtgacagagcaggccctgtctctagaataaataaataagtaaactaaagaggcttcttgattgtg

SEQ ID NO: 314374 - DNA, 322 bp, Homo sapiens
gtgatccacctgcctcggcttcccaaagtgctggaattacaggtgtgagccaccgcgcccggcccctagggtcattttgagagacacatgaggacatgtgttcaacccagtcctcaacacagggcaaagacttcttaaatatgagcgtttagggttatatttcattattatttagggtcatacttcattattattttcctattattaatgttattttggctcttttacgtccttgctgtatgacatccatcaaggggcttcccctctctgaacctcaagcgaggggaaggtttgtgggggcatctgaccagccacaagtccc

SEQ ID NO: 314375 - DNA, 5257 bp, Homo sapiens
  misc_feature (30)..(31): n is a, c, g, or t
  misc_feature (5246)..(5246): n is a, c, g, or t
cgctgggagcggggcgggcgctcgcgtccnnggcttccctccccgactgtgcgccgcggctggctcgggttcccgggccgacatgggcgccgccgcgtgggcacggccgctgagcgtgtctttcctgctgctgcttctgccgctcccggggatgcctgcgggctcctgggacccggccggttacctgctctactgcccctgcatggggcgctttgggaaccaggccgatcacttcttgggctctctggcatttgcaaagctgctaaaccgtaccttggctgtccctccttggattgagtaccagcatcacaagcctcctttcaccaacctccatgtgtcctaccagaagtacttcaagctggagcccctccaggcttaccatcgggtcatcagcttggaggatttcatggagaagctggcacccacccactggccccctgagaagcgggtggcatactgctttgaggtggcagcccagcgaagcccagataagaagacgtgccccatgaaggaaggaaacccctttggcccattctgggatcagtttcatgtgagtttcaacaagtcggagctttttacaggcatttccttcagtgcttcctacagagaacaatggagccagagattttctccaaaggaacatccggtgcttgccctgccaggagccccagcccagttccccgtcctagaggaacacaggccactacagaagtacatggtatggtcagacgaaatggtgaagacgggagaggcccagattcatgcccaccttgtccggccctatgtgggcattcatctgcgcattggctctgactggaagaacgcctgtgccatgctgaaggacgggactgcaggctcgcacttcatggcctctccgcagtgtgtgggctacagccgcagcacagcggcccccctcacgatgactatgtgcctgcctgacctgaaggagatccagagggctgtgaagctctgggtgaggtcgctggatgcccagtcggtctacgttgctactgattccgagagttatgtgcctgagctccaacagctcttcaaagggaaggtgaaggtggtgagcctgaagcctgaggtggcccaggtcgacctgtacatcctcggccaagccgaccactttattggcaactgtgtctcctccttcactgcctttgtgaagcgggagcgggacctccaggggaggccgtcttctttcttcggcatggacaggccccctaagctgcgggacgagttctgattctggccggagcaccagaccctctgatcctggagggaccagagtctgagctggtccttccagccaggcctggcagccagaggtgctccgggattgcaaactcctcttctcacctgccaaagatggagaagagtgccagggacccctcaaggagggagacgctccatatcccagggcataggacttgcaggttcctaggagcaggagcatctcccatcgcacgtgctttctgctcttctgggaatttctcacactggcaaagcagtccagcctccgtcttctggtccactctgctctgagcagcctgggatgctgaactcttcagagagatttttttatagagagatttctataattttgatacaaggtcatgactatcctagaactctctgtggtttttgaaaatcattgaattctattaatgtaggtacctaaagtgaccttaactgaatgtggatgaggctggggctggtgtgggtcttttggctgcttttcaaggtgtcccccaatgtggccctcaagagccatccccactgcctggccagagccattgttgtcccctacttcctaggccatttctggggcttgggggatgaatgctgtcctgtgctgtaaacactatgcaaatggaagttatcggttgtggtgctgtgcagcgctctgtgggcgactaagtgccactcacgcagcatgttcctggcaaggagcacataccatcaagccacactatcatggtattgttctcacagtcttttggtggttgatggccactgcaaacctggcaccatcagatctcttctgatctcttgccccagtggggcctggttggtagaatgttggcattcggttgatatccaaagcctgttctcccagccgtcctcctgcagctggagccttcaggccgtattctcacgagggaacgtttgccaaggctctgacctcacagaagatgcccagggcccagaagccatcagaattatcagtggagaagcaccttttgactcttcccttccaatgtaatctctgccaacaccatgaggcttaaggtgctctaagtcatgagtgttttggtctcaaatgctgcagttttaataatctgtgactcctgagagcccatggttttttgaccttgtggttctaaaattccttgtctgacccctgtagatcttttccttgccatgtcacctcccttggcctttgatcctggaaaggtggcagagcctccactgagccaggcccagagctccttgcagtgccttcttccttgtttacctgtgggaggaaacactttttttgtcaggggcagcctggttcagagctcagaggtcacactgtatcaaagatctcaaacagcaaagtcagcatttgctgtatagagctgccacccaactctaagcaggagaaactgtacagaaagggctttgctatttttcccttttgggaaaacaatgaagtgttttaagtcctgggtggactgagagatggtttgcctgtccagacttgctctcaagcctcatccagagaaggagctgcagatgagggagcccgtacactccctgccaccactaggttgtaagcctgtagctggctggctgatttcattttggaattcatttgccatccacagccttacactaggcacacactttagagtctggggctccagtggggcccgcctaattttttttccccccaagacagggccttgctctgtctcccaggctggagtgcagtggcatgatcatggcttactgcagccttgatctcccaggctcaagcgatccttctgcctcagcctctctggtagctgagactgcatgcccagctccaaatcaccttgattcatatcagcagtaataatcacttgtgttctgaaagaaagggcaccagaagttctagcaaaattcagttgtgttctgtgagctagcactttttcctctgacccaattttcttacctataaaatggtgataaaaaccgacaggttgttcaaaggcccagatcagctaaagcatgtatataagagcacgttgtaaacttgaaagagacaaaggcacaaatgtggctgttgattaatttgactgcttctcgttgctcgtcacctccatgccaggcactgtgcttgctaattgctttatgggggcattctcttatttattccccagccctgggaaataggagctgtcattatccttctctttctgcacaaggaaaaattaatgccctgagaattgtcataattttcccaaggctgcccagctggtggtgttaagccagaatttgacctcccagagccagtttccattagctgccatgctctgctgcctctaattcacagaatgcactttctaccctgtgtgccatggagacctcctatggaaaaatgatcagccaccttaccttctactgggtacctgctgtgagtctgcctatgccagaaggattaaggaggggaggttacccaagaaacaaagcctacatgccgcttacagcccccgttggatggttgctcagtacaacagtcttgcattcagcaggtgtttgttcatcacctactatgtgtcaggctctatgctaggtactggggatacaggagagaatcaagcgtaaagtctttgttctcaaggaatttgcattctagaaagtagaagatgtaataaatgtactgtgggacatgttaataagtgctataaagaaatataaagggtttgggagcaaaaagagggagtggatctattttagatgagcccaggtaagacctctctgaagagctgtcatgaaggagggagggagcacattcctggcagagaaaacagcacgtgcaaaggccccgagactggagtgtgttcctgaagagcagccaggaggccagcatggctggagaggcaggcataggcagggaaccgagcagcaggtcagagcaggcgagctgacattctgcagcctggacggccatggcaggaagcttttagttggagagatacaggaagcctcctagggttctgagcagaagaggggcatgagctgattcacattctgaaggacctctctagctggccagtgctgaggaggttggagagagaaagggtgaaagcagagagaccagtgcagggctgttaacagggttgcaggcgagagactggggtgctgggctcccctagactaggactccagtgccctcctctcccaagagacaaaggccattgcattgaaggaggtgggaaatgattagattctgaacatatgtaattatttttcagtctttttcaaagatacaaatatttacatagttttaatcatgtaatatatacaatttaatgtcctagtgttttacttaatagtgtatcatgttttccctgttggtatgtagcctggataaatgctcttaattataaaaaattctgtcgaggagtgttccatagtttattgttttcctattatgagaatttaggccaagtgtggtggctcatgcctgtaatcccagcactttgcgaggccgaggtgggcagatcacttgaggtgaggagttcaagaccagcctggccaacatggtgaattatctctactaaaaatacaaaaaaataataataatagccaggcgtggtggcacatgcctgtattcccagctgcttgggaggctgaggcaggagaatggcttgaacctgggaggtggaggttgcagtgagccgagatggtgccactgcattccagcctgggcaacagagcgagactccatctcaaaaaaaaggagacttcatgtgcccccaatttttcactattgttatttgaaaaaatatttttatttgtaagagtttttctttatttaaaatgttcattaataaagttgttggacgggaagcaaaaaaaaaaagttgtttaagataaattcccagaagtgaatttgttagatcaaacacttaaaactttttgttatggaagaattcaaatataaataaaaaattgtgagtaataaaatgaactcacagtttcaacaatgncccacatttta

SEQ ID NO: 314376 - DNA, 1539 bp, Homo sapiens
  misc_feature (30)..(31): n is a, c, g, or t
cgctgggagcggggcgggcgctcgcgtccnnggcttccctccccgactgtgcgccgcggctggctcgggttcccgggccgacatgggcgccgccgcgtgggcacggccgctgagcgtgtctttcctgctgctgcttctgccgctcccggggatgcctgcgggctcctgggacccggccggttacctgctctactgcccctgcatggggcgctttgggaaccaggccgatcacttcttgggctctctggcatttgcaaagctgctaaaccgtaccttggctgtccctccttggattgagtaccagcatcacaagcctcctttcaccaacctccatgtgtcctaccagaagtacttcaagctggagcccctccaggcttaccatcgggtcatcagcttggaggatttcatggagaagctggcacccacccactggccccctgagaagcgggtggcatactgctttgaggtggcagcccagcgaagcccagataagaagacgtgccccatgaaggaaggaaacccctttggcccattctgggatcagtttcatgtgagtttcaacaagtcggagctttttacaggcatttccttcagtgcttcctacagagaacaatggagccagaggcgtgagaatcactcctgtgttaccttactcttcccaaggtgaaactggaagcagcttctagagaacagcttcaggtgcagaccgagaaatgacgtcatcctgataattattggacgtgtttattaattgcaccccattagcccctgtttttaaaaaatataggttagcaggacgtgggcacaggccgtgaaacatttatagggcgcctgtcacgtgtgagacatagtaatcagaggccaatggtgatgtgtgaaaatgaggatgaccagctctggttttctaggagctatggtctcataatgacaataatcagcatagtgtacttgtccttaatgttatagcatggcaggaaagaccatgggcttagaaggcagacattggttaggaggtgcagggaacatactaattcatgtgcggtcaaagcacttggcatttaatagggcaaaggtaaacagatgtagagaaatgagtctcatgcctgtaatcccagcactttgggaggccaaggtgggtggatcacttgagcctaagagatcaaggctgcagtgagccatgatggtacccctgcactccagcccaggttacagagcaagggcctgtctcagcaaaacaaaacaagcacaggccaaggagtgagatagccagcgctgatggtatctgcctcgtagtgcatgaagtgcatgtcatacactaagcagccagccagtgttggctgtcagtgttattactcacatgctttattttatttaagactttgagatagttcatgaagtgggtattattatcaatttccattttataggtgaggaaactgagcccagtgaagttaaataacttcccaaggtcattgagctgttgagtggacagctcaggtctgtttgtaaatctttaataaataacaacagctaagattc

SEQ ID NO: 314377 - DNA, 4659 bp, Homo sapiens
  misc_feature (30)..(31): n is a, c, g, or t
cgctgggagcggggcgggcgctcgcgtccnnggcttccctccccgactgtgcgccgcggctggctcgggttcccgggccgacatgggcgccgccgcgtgggcacggccgctgagcgtgtctttcctgctgctgcttctgccgctcccggggatgcctgcgggctcctgggacccggccggttacctgctctactgcccctgcatggggcgctttgggaaccaggccgatcacttcttgggctctctggcatttgcaaagctgctaaaccgtaccttggctgtccctccttggattgagtaccagcatcacaagcctcctttcaccaacctccatgtgtcctaccagaagtacttcaagctggagcccctccaggcttaccatcgggtcatcagcttggaggatttcatggagaagctggcacccacccactggccccctgagaagcgggtggcatactgctttgaggtggcagcccagcgaagcccagataagaagacgtgccccatgaaggaaggaaacccctttggcccattctgggatcagtttcatgtgagtttcaacaagtcggagctttttacaggcatttccttcagtgcttcctacagagaacaatggagccagagattttctccaaaggaacatccggtgcttgccctgccaggagccccagcccagttccccgtcctagaggaacacaggccactacagaagtacatggtatggtcagacgaaatggtgaagacgggagaggcccagattcatgcccaccttgtccggccctatgtgggcattcatctgcgcattggctctgactggaagaacgcctgtgccatgctgaaggacgggactgcaggctcgcacttcatggcctctccgcagtgtgtgggctacagccgcagcacagcggcccccctcacgatgactatgtgcctgcctgacctgaaggagatccagagggctgtgaagctctgggtgaggtcgctggatgcccagtcggtctacgttgctactgattccgagagttatgtgcctgagctccaacagctcttcaaagggaaggtgaaggtggtgagcctgaagcctgaggtggcccaggtcgacctgtacatcctcggccaagccgaccactttattggcaactgtgtctcctccttcactgcctttgtgaagcgggagcgggacctccaggggaggccgtcttctttcttcggcatggacaggccccctaagctgcgggacgagttctgattctggccggagcaccagaccctctgatcctggagggaccagagtctgagctggtccttccagccaggcctggcagccagaggtgctccgggattgcaaactcctcttctcacctgccaaagatggagaagagtgccagggacccctcaaggagggagacgctccatatcccagggcataggacttgcaggttcctaggagcaggagcatctcccatcgcacgtgctttctgctcttctgggaatttctcacactggcaaagcagtccagcctccgtcttctggtccactctgctctgagcagcctgggatgctgaactcttcagagagatttttttatagagagatttctataattttgatacaaggtcatgactatcctagaactctctgtggtttttgaaaatcattgaattctattaatgtaggtacctaaagtgaccttaactgaatgtggatgaggctggggctggtgtgggtcttttggctgcttttcaaggtgtcccccaatgtggccctcaagagccatccccactgcctggccagagccattgttgtcccctacttcctaggccatttctggggcttgggggatgaatgctgtcctgtgctgtaaacactatgcaaatggaagttatcggttgtggtgctgtgcagcgctctgtgggcgactaagtgccactcacgcagcatgttcctggcaaggagcacataccatcaagccacactatcatggtattgttctcacagtcttttggtggttgatggccactgcaaacctggcaccatcagatctcttctgatctcttgccccagtggggcctggttggtagaatgttggcattcggttgatatccaaagcctgttctcccagccgtcctcctgcagctggagccttcaggccgtattctcacgagggaacgtttgccaaggctctgacctcacagaagatgcccagggcccagaagccatcagaattatcagtggagaagcaccttttgactcttcccttccaatgtaatctctgccaacaccatgaggcttaaggtgctctaagtcatgagtgttttggtctcaaatgctgcagttttaataatctgtgactcctgagagcccatggttttttgaccttgtggttctaaaattccttgtctgacccctgtagatcttttccttgccatgtcacctcccttggcctttgatcctggaaaggtggcagagcctccactgagccaggcccagagctccttgcagtgccttcttccttgtttacctgtgggaggaaacactttttttgtcaggggcagcctggttcagagctcagaggtcacactgtatcaaagatctcaaacagcaaagtcagcatttgctgtatagagctgccacccaactctaagcaggagaaactgtacagaaagggctttgctatttttcccttttgggaaaacaatgaagtgttttaagtcctgggtggactgagagatggtttgcctgtccagacttgctctcaagcctcatccagagaaggagctgcagatgagggagcccgtacactccctgccaccactaggttgtaagcctgtagctggctggctgatttcattttggaattcatttgccatccacagccttacactaggcacacactttagagtctggggctccagtggggcccgcctaattttttttccccccaagacagggccttgctctgtctcccaggctggagtgcagtggcatgatcatggcttactgcagccttgatctcccaggctcaagcgatccttctgcctcagcctctctggtagctgagactgcatgcccagctccaaatcaccttgattcatatcagcagtaataatcacttgtgttctgaaagaaagggcaccagaagttctagcaaaattcagttgtgttctgtgagctagcactttttcctctgacccaattttcttacctataaaatggtgataaaaaccgacaggttgttcaaaggcccagatcagctaaagcatgtatataagagcacgttgtaaacttgaaagagacaaaggcacaaatgtggctgttgattaatttgactgcttctcgttgctcgtcacctccatgccaggcactgtgcttgctaattgctttatgggggcattctcttatttattccccagccctgggaaataggagctgtcattatccttctctttctgcacaaggaaaaattaatgccctgagaattgtcataattttcccaaggctgcccagctggtggtgttaagccagaatttgacctcccagagccagtttccattagctgccatgctctgctgcctctaattcacagaatgcactttctaccctgtgtgccatggagacctcctatggaaaaatgatcagccaccttaccttctactgggtacctgctgtgagtctgcctatgccagaaggattaaggaggggaggttacccaagaaacaaagcctacatgccgcttacagcccccgttggatggttgctcagtacaacagtcttgcattcagcaggtgtttgttcatcacctactatgtgtcaggctctatgctaggtactggggatacaggagagaatcaagcgtaaagtctttgttctcaaggaatttgcattctagaaagtagaagatgtaataaatgtactgtgggacatgttaataagtgctataaagaaatataaagggtttgggagcaaaaagagggagtggatctattttagatgagcccaggtaagacctctctgaagagctgtcatgaaggagggagggagcacattcctggcagagaaaacagcacgtgcaaaggccccgagactggagtgtgttcctgaagagcagccaggaggccagcatggctggagaggcaggcataggcagggaaccgagcagcaggtcagagcaggcgagctgacattctgcagcctggacggccatggcaggaagcttttagttggagagatacaggaagcctcctagggttctgagcagaagaggggcatgagctgattcacattctgaaggacctctctagctggccagtgctgaggaggttggagagagaaagggtgaaagcagagagaccagtgcagggctgttaacagggttgcaggcgagagactggggtgctgggctcccctagactaggactccagtgccctcctctcccaagagacaaaggccattgcattgaaggaggtgggaaatgattagattctgaacatatgtaattatttttcagtctttttcaaagatacaaatatttacatagttttaatcatgtaatatatacaatttaatgtcctagtgttttacttaatagtgtatcatgttttccctgttggtatgtagcctggataaatgctcttaattataaaaaattctgtcgagga

SEQ ID NO: 314378 - DNA, 4660 bp, Homo sapiens
  misc_feature (30)..(31): n is a, c, g, or t
cgctgggagcggggcgggcgctcgcgtccnnggcttccctccccgactgtgcgccgcggctggctcgggttcccgggccgacatgggcgccgccgcgtgggcacggccgctgagcgtgtctttcctgctgctgcttctgccgctcccggggatgcctgcgggctcctgggacccggccggttacctgctctactgcccctgcatggggcgctttgggaaccaggccgatcacttcttgggctctctggcatttgcaaagctgctaaaccgtaccttggctgtccctccttggattgagtaccagcatcacaagcctcctttcaccaacctccatgtgtcctaccagaagtacttcaagctggagcccctccaggcttaccatcgggtcatcagcttggaggatttcatggagaagctggcacccacccactggccccctgagaagcgggtggcatactgctttgaggtggcagcccagcgaagcccagataagaagacgtgccccatgaaggaaggaaacccctttggcccattctgggatcagtttcatgtgagtttcaacaagtcggagctttttacaggcatttccttcagtgcttcctacagagaacaatggagccagagattttctccaaaggaacatccggtgcttgccctgccaggagccccagcccagttccccgtcctagaggaacacaggccactacagaagtacatggtatggtcagacgaaatggtgaagacgggagaggcccagattcatgcccaccttgtccggccctatgtgggcattcatctgcgcattggctctgactggaagaacgcctgtgccatgctgaaggacgggactgcaggctcgcacttcatggcctctccgcagtgtgtgggctacagccgcagcacagcggcccccctcacgatgactatgtgcctgcctgacctgaaggagatccagagggctgtgaagctctgggtgaggtcgctggatgcccagtcggtctacgttgctactgattccgagagttatgtgcctgagctccaacagctcttcaaagggaaggtgaaggtggtgagcctgaagcctgaggtggcccaggtcgacctgtacatcctcggccaagccgaccactttattggcaactgtgtctcctccttcactgcctttgtgaagcgggagcgggacctccaggggaggccgtcttctttcttcggcatggacaggccccctaagctgcgggacgagttctgattctggccggagcaccagaccctctgatcctggagggaccagagtctgagctggtccttccagccaggcctggcagccagaggtgctccgggattgcaaactcctcttctcacctgccaaagatggagaagagtgccagggacccctcaaggagggagacgctccatatcccagggcataggacttgcaggttcctaggagcaggagcatctcccatcgcacgtgctttctgctcttctgggaatttctcacactggcaaagcagtccagcctccgtcttctggtccactctgctctgagcagcctgggatgctgaactcttcagagagatttttttatagagagatttctataattttgatacaaggtcatgactatcctagaactctctgtggtttttgaaaatcattgaattctattaatgtaggtacctaaagtgaccttaactgaatgtggatgaggctggggctggtgtgggtcttttggctgcttttcaaggtgtcccccaatgtggccctcaagagccatccccactgcctggccagagccattgttgtcccctacttcctaggccatttctggggcttgggggatgaatgctgtcctgtgctgtaaacactatgcaaatggaagttatcggttgtggtgctgtgcagcgctctgtgggcgactaagtgccactcacgcagcatgttcctggcaaggagcacataccatcaagccacactatcatggtattgttctcacagtcttttggtggttgatggccactgcaaacctggcaccatcagatctcttctgatctcttgccccagtggggcctggttggtagaatgttggcattcggttgatatccaaagcctgttctcccagccgtcctcctgcagctggagccttcaggccgtattctcacgagggaacgtttgccaaggctctgacctcacagaagatgcccagggcccagaagccatcagaattatcagtggagaagcaccttttgactcttcccttccaatgtaatctctgccaacaccatgaggcttaaggtgctctaagtcatgagtgttttggtctcaaatgctgcagttttaataatctgtgactcctgagagcccatggttttttgaccttgtggttctaaaattccttgtctgacccctgtagatcttttccttgccatgtcacctcccttggcctttgatcctggaaaggtggcagagcctccactgagccaggcccagagctccttgcagtgccttcttccttgtttacctgtgggaggaaacactttttttgtcaggggcagcctggttcagagctcagaggtcacactgtatcaaagatctcaaacagcaaagtcagcatttgctgtatagagctgccacccaactctaagcaggagaaactgtacagaaagggctttgctatttttcccttttgggaaaacaatgaagtgttttaagtcctgggtggactgagagatggtttgcctgtccagacttgctctcaagcctcatccagagaaggagctgcagatgagggagcccgtacactccctgccaccactaggttgtaagcctgtagctggctggctgatttcattttggaattcatttgccatccacagccttacactaggcacacactttagagtctggggctccagtggggcccgcctaattttttttccccccaagacagggccttgctctgtctcccaggctggagtgcagtggcatgatcatggcttactgcagccttgatctcccaggctcaagcgatccttctgcctcagcctctctggtagctgagactgcatgcccagctccaaatcaccttgattcatatcagcagtaataatcacttgtgttctgaaagaaagggcaccagaagttctagcaaaattcagttgtgttctgtgagctagcactttttcctctgacccaattttcttacctataaaatggtgataaaaaccgacaggttgttcaaaggcccagatcagctaaagcatgtatataagagcacgttgtaaacttgaaagagacaaaggcacaaatgtggctgttgattaatttgactgcttctcgttgctcgtcacctccatgccaggcactgtgcttgctaattgctttatgggggcattctcttatttattccccagccctgggaaataggagctgtcattatccttctctttctgcacaaggaaaaattaatgccctgagaattgtcataattttcccaaggctgcccagctggtggtgttaagccagaatttgacctcccagagccagtttccattagctgccatgctctgctgcctctaattcacagaatgcactttctaccctgtgtgccatggagacctcctatggaaaaatgatcagccaccttaccttctactgggtacctgctgtgagtctgcctatgccagaaggattaaggaggggaggttacccaagaaacaaagcctacatgccgcttacagcccccgttggatggttgctcagtacaacagtcttgcattcagcaggtgtttgttcatcacctactatgtgtcaggctctatgctaggtactggggatacaggagagaatcaagcgtaaagtctttgttctcaaggaatttgcattctagaaagtagaagatgtaataaatgtactgtgggacatgttaataagtgctataaagaaatataaagggtttgggagcaaaaagagggagtggatctattttagatgagcccaggtaagacctctctgaagagctgtcatgaaggagggagggagcacattcctggcagagaaaacagcacgtgcaaaggccccgagactggagtgtgttcctgaagagcagccaggaggccagcatggctggagaggcaggcataggcagggaaccgagcagcaggtcagagcaggcgagctgacattctgcagcctggacggccatggcaggaagcttttagttggagagatacaggaagcctcctagggttctgagcagaagaggggcatgagctgattcacattctgaaggacctctctagctggccagtgctgaggaggttggagagagaaagggtgaaagcagagagaccagtgcagggctgttaacagggttgcaggcgagagactggggtgctgggctcccctagactaggactccagtgccctcctctcccaagagacaaaggccattgcattgaaggaggtgggaaatgattagattctgaacatatgtaattatttttcagtctttttcaaagatacaaatatttacatagttttaatcatgtaatatatacaatttaatgtcctagtgttttacttaatagtgtatcatgtcagcctgggtattacgatgtttttttctgtttttttcttttttctgttttttcgctttttt

SEQ ID NO: 314379 - DNA, 5157 bp, Homo sapiens
  misc_feature (30)..(31): n is a, c, g, or t
  misc_feature (5146)..(5146): n is a, c, g, or t
cgctgggagcggggcgggcgctcgcgtccnnggcttccctccccgactgtgcgccgcggctggctcgggttcccgggccgacatgggcgccgccgcgtgggcacggccgctgagcgtgtctttcctgctgctgcttctgccgctcccggggatgcctgcgggctcctgggacccggccggttacctgctctactgcccctgcatggggcgctttgggaaccaggccgatcacttcttgggctctctggcatttgcaaagctgctaaaccgtaccttggctgtccctccttggattgagtaccagcatcacaagcctcctttcaccaacctccatgtgtcctaccagaagtacttcaagctggagcccctccaggcttaccatcgggtcatcagcttggaggatttcatggagaagctggcacccacccactggccccctgagaagcgggtggcatactgctttgaggtggcagcccagcgaagcccagataagaagacgtgccccatgaaggaaggaaacccctttggcccattctgggatcagtttcatgtgagtttcaacaagtcggagctttttacaggcatttccttcagtgcttcctacagagaacaatggagccagagattttctccaaaggaacatccggtgcttgccctgccaggagccccagcccagttccccgtcctagaggaacacaggccactacagaagtacatggtatggtcagacgaaatggtgaagacgggagaggcccagattcatgcccaccttgtccggccctatgtgggcattcatctgcgcattggctctgactggaagaacgcctgtgccatgctgaaggacgggactgcaggctcgcacttcatggcctctccgcagtgtgtgggctacagccgcagcacagcggcccccctcacgatgactatgtgcctgcctgacctgaaggagatccagagggctgtgaagctctgggtgaggtcgctggatgcccagtcggtctacgttgctactgattccgagagttatgtgcctgagctccaacagctcttcaaagggaaggtgaaggtggtgagcctgaagcctgaggtggcccaggtcgacctgtacatcctcggccaagccgaccactttattggcaactgtgtctcctccttcactgcctttgtgaagcgggagcgggacctccaggggaggccgtcttctttcttcggcatggacaggccccctaagctgcgggacgagttctgattctggccggagcaccagaccctctgatcctggagggaccagagtctgagctggtccttccagccaggcctggcagccagaggtgctccgggattgcaaactcctcttctcacctgccaaagatggagaagagtgccagggacccctcaaggagggagacgctccatatcccagggcataggacttgcaggttcctaggagcaggagcatctcccatcgcacgtgctttctgctcttctgggaatttctcacactggcaaagcagtccagcctccgtcttctggtccactctgctctgagcagcctgggatgctgaactcttcagagagatttttttatagagagatttctataattttgatacaaggtcatgactatcctagaactctctgtggtttttgaaaatcattgaattctattaatgtaggtacctaaagtgaccttaactgaatgtggatgaggctggggctggtgtgggtcttttggctgcttttcaaggtgtcccccaatgtggccctcaagagccatccccactgcctggccagagccattgttgtcccctacttcctaggccatttctggggcttgggggatgaatgctgtcctgtgctgtaaacactatgcaaatggaagttatcggttgtggtgctgtgcagcgctctgtgggcgactaagtgccactcacgcagcatgttcctggcaaggagcacataccatcaagccacactatcatggtattgttctcacagtcttttggtggttgatggccactgcaaacctggcaccatcagatctcttctgatctcttgccccagtggggcctggttggtagaatgttggcattcggttgatatccaaagcctgttctcccagccgtcctcctgcagctggagccttcaggccgtattctcacgagggaacgtttgccaaggctctgacctcacagaagatgcccagggcccagaagccatcagaattatcagtggagaagcaccttttgactcttcccttccaatgtaatctctgccaacaccatgaggcttaaggtgctctaagtcatgagtgttttggtctcaaatgctgcagttttaataatctgtgactcctgagagcccatggttttttgaccttgtggttctaaaattccttgtctgacccctgtagatcttttccttgccatgtcacctcccttggcctttgatcctggaaaggtggcagagcctccactgagccaggcccagagctccttgcagtgccttcttccttgtttacctgtgggaggaaacactttttttgtcaggggcagcctggttcagagctcagaggtcacactgtatcaaagatctcaaacagcaaagtcagcatttgctgtatagagctgccacccaactctaagcaggagaaactgtacagaaagggctttgctatttttcccttttgggaaaacaatgaagtgttttaagtcctgggtggactgagagatggtttgcctgtccagacttgctctcaagcctcatccagagaaggagctgcagatgagggagcccgtacactccctgccaccactaggttgtaagcctgtagctggctggctgatttcattttggaattcatttgccatccacagccttacactaggcacacactttagagtctggggctccagtggggcccgcctaattttttttccccccaagacagggccttgctctgtctcccaggctggagtgcagtggcatgatcatggcttactgcagccttgatctcccaggctcaagcgatccttctgcctcagcctctctggtagctgagactgcatgcccagctccaaatcaccttgattcatatcagcagtaataatcacttgtgttctgaaagaaagggcaccagaagttctagcaaaattcagttgtgttctgtgagctagcactttttcctctgacccaattttcttacctataaaatggtgataaaaaccgacaggttgttcaaaggcccagatcagctaaagcatgtatataagagcacgttgtaaacttgaaagagacaaaggcacaaatgtggctgttgattaatttgactgcttctcgttgctcgtcacctccatgccaggcactgtgcttgctaattgctttatgggggcattctcttatttattccccagccctgggaaataggagctgtcattatccttctctttctgcacaaggaaaaattaatgccctgagaattgtcataattttcccaaggctgcccagctggtggtgttaagccagaatttgacctcccagagccagtttccattagctgccatgctctgctgcctctaattcacagaatgcactttctaccctgtgtgccatggagacctcctatggaaaaatgatcagccaccttaccttctactgggtacctgctgtgagtctgcctatgccagaaggattaaggaggggaggttacccaagaaacaaagcctacatgccgcttacagcccccgttggatggttgctcagtacaacagtcttgcattcagcaggtgtttgttcatcacctactatgtgtcaggctctatgctaggtactggggatacaggagagaatcaagcgtaaagtctttgttctcaaggaatttgcattctagaaagtagaagatgtaataaatgtactgtgggacatgttaataagtgctataaagaaatataaagggtttgggagcaaaaagagggagtggatctattttagatgagcccaggtaagacctctctgaagagctgtcatgaaggagggagggagcacattcctggcagagaaaacagcacgtgcaaaggccccgagactggagtgtgttcctgaagagcagccaggaggccagcatggctggagaggcaggcataggcagggaaccgagcagcaggtcagagcaggcgagctgacattctgcagcctggacggccatggcaggaagcttttagttggagagagaaagggtgaaagcagagagaccagtgcagggctgttaacagggttgcaggcgagagactggggtgctgggctcccctagactaggactccagtgccctcctctcccaagagacaaaggccattgcattgaaggaggtgggaaatgattagattctgaacatatgtaattatttttcagtctttttcaaagatacaaatatttacatagttttaatcatgtaatatatacaatttaatgtcctagtgttttacttaatagtgtatcatgttttccctgttggtatgtagcctggataaatgctcttaattataaaaaattctgtcgaggagtgttccatagtttattgttttcctattatgagaatttaggccaagtgtggtggctcatgcctgtaatcccagcactttgcgaggccgaggtgggcagatcacttgaggtgaggagttcaagaccagcctggccaacatggtgaattatctctactaaaaatacaaaaaaataataataatagccaggcgtggtggcacatgcctgtattcccagctgcttgggaggctgaggcaggagaatggcttgaacctgggaggtggaggttgcagtgagccgagatggtgccactgcattccagcctgggcaacagagcgagactccatctcaaaaaaaaggagacttcatgtgcccccaatttttcactattgttatttgaaaaaatatttttatttgtaagagtttttctttatttaaaatgttcattaataaagttgttggacgggaagcaaaaaaaaaaagttgtttaagataaattcccagaagtgaatttgttagatcaaacacttaaaactttttgttatggaagaattcaaatataaataaaaaattgtgagtaataaaatgaactcacagtttcaacaatgncccacatttta

SEQ ID NO: 314380 - DNA, 1662 bp, Homo sapiens
cagaaaggaataaggtcccttgcccaaggtcataaagcttgaagttgcagagcttggttttgaacccagaagtctgaatccaaatcaccttgattcatatcagcagtaataatcacttgtgttctgaaagaaagggcaccagaagttctagcaaaattcagttgtgttctgtgagctagcactttttcctctgacccaattttcttacctataaaatggtgataaaaaccgacaggttgttcaaaggcccagatcagctaaagcatgtatataagagcacgttgtaaacttgaaagagacaaaggcacaaatgtggctgttgattaatttgactgcttctcgttgctcgtcacctccatgccaggcactgtgcttgctaattgctttatgggggcattctcttatttattccccagccctgggaaataggagctgtcattatccttctctttctgcacaaggaaaaattaatgccctgagaattgtcataattttcccaaggctgcccagctggtggtgttaagccagaatttgacctcccagagccagtttccattagctgccatgctctgctgcctctaattcacagaatgcactttctaccctgtgtgccatggagacctcctatggaaaaatgatcagccaccttaccttctactgggtacctgctgtgagtctgcctatgccagaaggattaaggaggggaggttacccaagaaacaaagcctacatgccgcttacagcccccgttggatggttgctcagtacaacagtcttgcattcagcaggtgtttgttcatcacctactatgtgtcaggctctatgctaggtactggggatacaggagagaatcaagcgtaaagtctttgttctcaaggaatttgcattctagaaagtagaagatgtaataaatgtactgtgggacatgttaataagtgctataaagaaatataaagggtttgggagcaaaaagagggagtggatctattttagatgagcccaggtaagacctctctgaagagctgtcatgaaggagggagggagcacattcctggcagagaaaacagcacgtgcaaaggccccgagactggagtgtgttcctgaagagcagccaggaggccagcatggctggagaggcaggcataggcagggaaccgagcagcaggtcagagcaggcgagctgacattctgcagcctggacggccatggcaggaagcttttagttggagagatacaggaagcctcctagggttctgagcagaagaggggcatgagctgattcacattctgaaggacctctctagctggccagtgctgaggaggttggagagagaaagggtgaaagcagagagaccagtgcagggctgttaacagggttgcaggcgagagactggggtgctgggctcccctagactaggactccagtgccctcctctcccaagagacaaaggccattgcattgaaggaggtgggaaatgattagattctgaacatatgtaattatttttcagtctttttcaaagatacaaatatttacatagttttaatcatgtaatatatacaatttaatgtcctagtgttttacttaatagtgtatcatgttttccctgttggtatgtagcctggataaatgctcttaattataaaaaattctgtcgagga

SEQ ID NO: 314381 - DNA, 2035 bp, Homo sapiens
  misc_feature (30)..(31): n is a, c, g, or t
cgctgggagcggggcgggcgctcgcgtccnnggcttccctccccgactgtgcgccgcggctggctcgggttcccgggccgacatgggcgccgccgcgtgggcacggccgctgagcgtgtctttcctgctgctgcttctgccgctcccggggatgcctgcgggctcctgggacccggccggttacctgctctactgcccctgcatggggcgctttgggaaccaggccgatcacttcttgggctctctggcatttgcaaagctgctaaaccgtaccttggctgtccctccttggattgagtaccagcatcacaagcctcctttcaccaacctccatgtgtcctaccagaagtacttcaagctggagcccctccaggcttaccatcgggtcatcagcttggaggatttcatggagaagctggcacccacccactggccccctgagaagcgggtggcatactgctttgaggtggcagcccagcgaagcccagataagaagacgtgccccatgaaggaaggaaacccctttggcccattctgggatcagtttcatgtgagtttcaacaagtcggagctttttacaggcatttccttcagtgcttcctacagagaacaatggagccagaggcgtgagaatcactcctgtgttaccttactcttcccaaggtgaaactggaagcagcttctagagaacagcttcaggtgcagaccgagaaatgacgtcatcctgataattattggacgtgtttattaattgcaccccattagcccctgtttttaaaaaatataggttagcaggacgtgggcacaggccgtgaaacatttatagggcgcctgtcacgtgtgagacatagtaatcagaggccaatggtgatgtgtgaaaatgaggatgaccagctctggttttctaggagctatggtctcataatgacaataatcagcatagtgtacttgtccttaatgttatagcatggcaggaaagaccatgggcttagaaggcagacattggttaggaggtgcagggaacatactaattcatgtgcggtcaaagcacttggcatttaataggtgctgggattacaagcatgagctgctgcgcccagtcccaaagcacctgttcttaatcacagtggattaaatagctgtgcctttaacagctgccagttcccttctgggacttgcctttggacctagctttggacctagttcatgtgccactgaggatcctcagtcatggcagatttaaatcttcctcattgttgatcccagatagcacactcccattctctgcctgcatggttctcccccattcacctccgaatgacctggagctattgccagaaggcagacctgccctcaaaggatggagatttgcccatattgacaatatgccaggaaaaaaagaaagaaaaaaaagccaccaactctaaaagcaactccaaaagcaaattccaaaaagctagaaaaagcacacaatcctagtaggaagagaaaggacaatggtgcatggggagtgttgttgaaacacttgtttattgccccatagctttgtttgagttcattgagttgtaagaattacatgagggtttgaagaagtttgtgccttacagccaagtttttgggaaaggaaaattagtagggaagatgaggtccctagagggagtttgagggagttgatggtcccttggcagctgcctgtcttccttcaacacatatttaagaagcacttcctgagtgtcaagggctggtttggatgctggggatataggccagaataaggacatgaacaaggcagggaatgaacaaggccagaataaggcagataaggtccctgccccaatggaactcatagtctaacaggggagatagtgaataaacttttacataggatagttccagagtgagatggtgcttagaaggatataaacaggtggtatgtgattggcagggctaagaccagaaggatgagaaggagccagttgtgtcagagttagaggaaaagtagttcacaacagattgagaccgtcttaaaaaaaaa

SEQ ID NO: 314382 - DNA, 1100 bp, Homo sapiens
gagtgcaggcatgtgccaccatgcctgacgaatattttgttttgttttgtacaaacagggtcttgctatgttgcccaggctggtcttaaactcctggcctcaagtgatcctcccacctcagcctcccaaagtgctgggattacaagcatgagctgctgcgcccagtcccaaagcacctgttcttaatcacagtggattaaatagctgtgcctttaacagctgccagttcccttctgggacttgcctttggacctagctttggacctagttcatgtgccactgaggatcctcagtcatggcagatttaaatcttcctcattgttgatcccagatagcacactcccattctctgcctgcatggttctcccccattcacctccgaatgacctggagctattgccagaaggcagacctgccctcaaaggatggagatttgcccatattgacaatatgccaggaaaaaaagaaagaaaaaaaagccaccaactctaaaagcaactccaaaagcaaattccaaaaagctagaaaaagcacacaatcctagtaggaagagaaaggacaatggtgcatggggagtgttgttgaaacacttgtttattgccccatagctttgtttgagttcattgagttgtaagaattacatgagggtttgaagaagtttgtgccttacagccaagtttttgggaaaggaaaattagtagggaagatgaggtccctagagggagtttgagggagttgatggtcccttggcagctgcctgtcttccttcaacacatatttaagaagcacttcctgagtgtcaagggctggtttggatgctggggatataggccagaataaggacatgaacaaggcagggaatgaacaaggccagaataaggcagataaggtccctgccccaatggaactcatagtctaacaggggagatagtgaataaacttttacataggatagttccagagtgagatggtgcttagaaggatataaacaggtggtatgtgattggcagggctaagaccagaaggatgagaaggagccagttgtgtcagagttagaggaaaagtagttcacaacagattgagaccgtcttaaaaaaaaa

SEQ ID NO: 314383 - DNA, 4537 bp, Homo sapiens
  misc_feature (30)..(31): n is a, c, g, or t
cgctgggagcggggcgggcgctcgcgtccnnggcttccctccccgactgtgcgccgcggctggctcgggttcccgggccgacatgggcgccgccgcgtgggcacggccgctgagcgtgtctttcctgctgctgcttctgccgctcccggggatgcctgcgggctcctgggacccggccggttacctgctctactgcccctgcatggctccatgtgtcctaccagaagtacttcaagctggagcccctccaggcttaccatcgggtcatcagcttggaggatttcatggagaagctggcacccacccactggccccctgagaagcgggtggcatactgctttgaggtggcagcccagcgaagcccagataagaagacgtgccccatgaaggaaggaaacccctttggcccattctgggatcagtttcatgtgagtttcaacaagtcggagctttttacaggcatttccttcagtgcttcctacagagaacaatggagccagagattttctccaaaggaacatccggtgcttgccctgccaggagccccagcccagttccccgtcctagaggaacacaggccactacagaagtacatggtatggtcagacgaaatggtgaagacgggagaggcccagattcatgcccaccttgtccggccctatgtgggcattcatctgcgcattggctctgactggaagaacgcctgtgccatgctgaaggacgggactgcaggctcgcacttcatggcctctccgcagtgtgtgggctacagccgcagcacagcggcccccctcacgatgactatgtgcctgcctgacctgaaggagatccagagggctgtgaagctctgggtgaggtcgctggatgcccagtcggtctacgttgctactgattccgagagttatgtgcctgagctccaacagctcttcaaagggaaggtgaaggtggtgagcctgaagcctgaggtggcccaggtcgacctgtacatcctcggccaagccgaccactttattggcaactgtgtctcctccttcactgcctttgtgaagcgggagcgggacctccaggggaggccgtcttctttcttcggcatggacaggccccctaagctgcgggacgagttctgattctggccggagcaccagaccctctgatcctggagggaccagagtctgagctggtccttccagccaggcctggcagccagaggtgctccgggattgcaaactcctcttctcacctgccaaagatggagaagagtgccagggacccctcaaggagggagacgctccatatcccagggcataggacttgcaggttcctaggagcaggagcatctcccatcgcacgtgctttctgctcttctgggaatttctcacactggcaaagcagtccagcctccgtcttctggtccactctgctctgagcagcctgggatgctgaactcttcagagagatttttttatagagagatttctataattttgatacaaggtcatgactatcctagaactctctgtggtttttgaaaatcattgaattctattaatgtaggtacctaaagtgaccttaactgaatgtggatgaggctggggctggtgtgggtcttttggctgcttttcaaggtgtcccccaatgtggccctcaagagccatccccactgcctggccagagccattgttgtcccctacttcctaggccatttctggggcttgggggatgaatgctgtcctgtgctgtaaacactatgcaaatggaagttatcggttgtggtgctgtgcagcgctctgtgggcgactaagtgccactcacgcagcatgttcctggcaaggagcacataccatcaagccacactatcatggtattgttctcacagtcttttggtggttgatggccactgcaaacctggcaccatcagatctcttctgatctcttgccccagtggggcctggttggtagaatgttggcattcggttgatatccaaagcctgttctcccagccgtcctcctgcagctggagccttcaggccgtattctcacgagggaacgtttgccaaggctctgacctcacagaagatgcccagggcccagaagccatcagaattatcagtggagaagcaccttttgactcttcccttccaatgtaatctctgccaacaccatgaggcttaaggtgctctaagtcatgagtgttttggtctcaaatgctgcagttttaataatctgtgactcctgagagcccatggttttttgaccttgtggttctaaaattccttgtctgacccctgtagatcttttccttgccatgtcacctcccttggcctttgatcctggaaaggtggcagagcctccactgagccaggcccagagctccttgcagtgccttcttccttgtttacctgtgggaggaaacactttttttgtcaggggcagcctggttcagagctcagaggtcacactgtatcaaagatctcaaacagcaaagtcagcatttgctgtatagagctgccacccaactctaagcaggagaaactgtacagaaagggctttgctatttttcccttttgggaaaacaatgaagtgttttaagtcctgggtggactgagagatggtttgcctgtccagacttgctctcaagcctcatccagagaaggagctgcagatgagggagcccgtacactccctgccaccactaggttgtaagcctgtagctggctggctgatttcattttggaattcatttgccatccacagccttacactaggcacacactttagagtctggggctccagtggggcccgcctaattttttttccccccaagacagggccttgctctgtctcccaggctggagtgcagtggcatgatcatggcttactgcagccttgatctcccaggctcaagcgatccttctgcctcagcctctctggtagctgagactgcatgcccagctccaaatcaccttgattcatatcagcagtaataatcacttgtgttctgaaagaaagggcaccagaagttctagcaaaattcagttgtgttctgtgagctagcactttttcctctgacccaattttcttacctataaaatggtgataaaaaccgacaggttgttcaaaggcccagatcagctaaagcatgtatataagagcacgttgtaaacttgaaagagacaaaggcacaaatgtggctgttgattaatttgactgcttctcgttgctcgtcacctccatgccaggcactgtgcttgctaattgctttatgggggcattctcttatttattccccagccctgggaaataggagctgtcattatccttctctttctgcacaaggaaaaattaatgccctgagaattgtcataattttcccaaggctgcccagctggtggtgttaagccagaatttgacctcccagagccagtttccattagctgccatgctctgctgcctctaattcacagaatgcactttctaccctgtgtgccatggagacctcctatggaaaaatgatcagccaccttaccttctactgggtacctgctgtgagtctgcctatgccagaaggattaaggaggggaggttacccaagaaacaaagcctacatgccgcttacagcccccgttggatggttgctcagtacaacagtcttgcattcagcaggtgtttgttcatcacctactatgtgtcaggctctatgctaggtactggggatacaggagagaatcaagcgtaaagtctttgttctcaaggaatttgcattctagaaagtagaagatgtaataaatgtactgtgggacatgttaataagtgctataaagaaatataaagggtttgggagcaaaaagagggagtggatctattttagatgagcccaggtaagacctctctgaagagctgtcatgaaggagggagggagcacattcctggcagagaaaacagcacgtgcaaaggccccgagactggagtgtgttcctgaagagcagccaggaggccagcatggctggagaggcaggcataggcagggaaccgagcagcaggtcagagcaggcgagctgacattctgcagcctggacggccatggcaggaagcttttagttggagagatacaggaagcctcctagggttctgagcagaagaggggcatgagctgattcacattctgaaggacctctctagctggccagtgctgaggaggttggagagagaaagggtgaaagcagagagaccagtgcagggctgttaacagggttgcaggcgagagactggggtgctgggctcccctagactaggactccagtgccctcctctcccaagagacaaaggccattgcattgaaggaggtgggaaatgattagattctgaacatatgtaattatttttcagtctttttcaaagatacaaatatttacatagttttaatcatgtaatatatacaatttaatgtcctagtgttttacttaatagtgtatcatgttttccctgttggtatgtagcctggataaatgctcttaattataaaaaattctgtcgagga

SEQ ID NO: 314384 - DNA, 5119 bp, Homo sapiens
  misc_feature (30)..(31): n is a, c, g, or t
cgctgggagcggggcgggcgctcgcgtccnnggcttccctccccgactgtgcgccgcggctggctcgggttcccgggccgacatgggcgccgccgcgtgggcacggccgctgagcgtgtctttcctgctgctgcttctgccgctcccggggatgcctgcgggctcctgggacccggccggttacctgctctactgcccctgcatggggcgctttgggaaccaggccgatcacttcttgggctctctggcatttgcaaagctgctaaaccgtaccttggctgtccctccttggattgagtaccagcatcacaagcctcctttcaccaacctccatgtgtcctaccagaagtacttcaagctggagcccctccaggcttaccatcgggtcatcagcttggaggatttcatggagaagctggcacccacccactggccccctgagaagcgggtggcatactgctttgaggtggcagcccagcgaagcccagataagaagacgtgccccatgaaggaaggaaacccctttggcccattctgggatcagtttcatgtgagtttcaacaagtcggagctttttacaggcatttccttcagtgcttcctacagagaacaatggagccagagattttctccaaaggaacatccggtgcttgccctgccaggagccccagcccagttccccgtcctagaggaacacaggccactacagaagtacatggtatggtcagacgaaatggtgaagacgggagaggcccagattcatgcccaccttgtccggccctatgtgggcattcatctgcgcattggctctgactggaagaacgcctgtgccatgctgaaggacgggactgcaggctcgcacttcatggcctctccgcagtgtgtgggctacagccgcagcacagcggcccccctcacgatgactatgtgcctgcctgacctgaaggagatccagagggctgtgaagctctgggtgaggtcgctggatgcccagtcggtctacgttgctactgattccgagagttatgtgcctgagctccaacagctcttcaaagggaaggtgaaggtggtgagcctgaagcctgaggtggcccaggtcgacctgtacatcctcggccaagccgaccactttattggcaactgtgtctcctccttcactgcctttgtgaagcgggagcgggacctccaggggaggccgtcttctttcttcggcatggacaggccccctaagctgcgggacgagttctgattctggccggagcaccagaccctctgatcctggagggaccagagtctgagctggtccttccagccaggcctggcagccagaggtgctccgggattgcaaactcctcttctcacctgccaaagatggagaagagtgccagggacccctcaaggagggagacgctccatatcccagggcataggacttgcaggttcctaggagcaggagcatctcccatcgcacgtgctttctgctcttctgggaatttctcacactggcaaagcagtccagcctccgtcttctggtccactctgctctgagcagcctgggatgctgaactcttcagagagatttttttatagagagatttctataattttgatacaaggtcatgactatcctagaactctctgtggtttttgaaaatcattgaattctattaatgtaggtacctaaagtgaccttaactgaatgtggatgaggctggggctggtgtgggtcttttggctgcttttcaaggtgtcccccaatgtggccctcaagagccatccccactgcctggccagagccattgttgtcccctacttcctaggccatttctggggcttgggggatgaatgctgtcctgtgctgtaaacactatgcaaatggaagttatcggttgtggtgctgtgcagcgctctgtgggcgactaagtgccactcacgcagcatgttcctggcaaggagcacataccatcaagccacactatcatggtattgttctcacagtcttttggtggttgatggccactgcaaacctggcaccatcagatctcttctgatctcttgccccagtggggcctggttggtagaatgttggcattcggttgatatccaaagcctgttctcccagccgtcctcctgcagctggagccttcaggccgtattctcacgagggaacgtttgccaaggctctgacctcacagaagatgcccagggcccagaagccatcagaattatcagtggagaagcaccttttgactcttcccttccaatgtaatctctgccaacaccatgaggcttaaggtgctctaagtcatgagtgttttggtctcaaatgctgcagttttaataatctgtgactcctgagagcccatggttttttgaccttgtggttctaaaattccttgtctgacccctgtagatcttttccttgccatgtcacctcccttggcctttgatcctggaaaggtggcagagcctccactgagccaggcccagagctccttgcagtgccttcttccttgtttacctgtgggaggaaacactttttttgtcaggggcagcctggttcagagctcagaggtcacactgtatcaaagatctcaaacagcaaagtcagcatttgctgtatagagctgccacccaactctaagcaggagaaactgtacagaaagggctttgctatttttcccttttgggaaaacaatgaagtgttttaagtcctgggtggactgagagatggtttgcctgtccagacttgctctcaagcctcatccagagaaggagctgcagatgagggagcccgtacactccctgccaccactaggttgtaagcctgtagctggctggctgatttcattttggaattcatttgccatccacagccttacactaggcacacactttagagtctggggctccagtggggcccgcctaattttttttccccccaagacagggccttgctctgtctcccaggctggagtgcagtggcatgatcatggcttactgcagccttgatctcccaggctcaagcgatccttctgcctcagcctctctggtagctgagactgcatgcccagctccaaatcaccttgattcatatcagcagtaataatcacttgtgttctgaaagaaagggcaccagaagttctagcaaaattcagttgtgttctgtgagctagcactttttcctctgacccaattttcttacctataaaatggtgataaaaaccgacaggttgttcaaaggcccagatcagctaaagcatgtatataagagcacgttgtaaacttgaaagagacaaaggcacaaatgtggctgttgattaatttgactgcttctcgttgctcgtcacctccatgccaggcactgtgcttgctaattgctttatgggggcattctcttatttattccccagccctgggaaataggagctgtcattatccttctctttctgcacaaggaaaaattaatgccctgagaattgtcataattttcccaaggctgcccagctggtggtgttaagccagaatttgacctcccagagccagtttccattagctgccatgctctgctgcctctaattcacagaatgcactttctaccctgtgtgccatggagacctcctatggaaaaatgatcagccaccttaccttctactgggtacctgctgtgagtctgcctatgccagaaggattaaggaggggaggttacccaagaaacaaagcctacatgccgcttacagcccccgttggatggttgctcagtacaacagtcttgcattcagcaggtgtttgttcatcacctactatgtgtcaggctctatgctaggtactggggatacaggagagaatcaagcgtaaagtctttgttctcaaggaatttgcattctagaaagtagaagatgtaataaatgtactgtgggacatgttaataagtgctataaagaaatataaagggtttgggagcaaaaagagggagtggatctattttagatgagcccaggtaagacctctctgaagagctgtcatgaaggagggagggagcacattcctggcagagaaaacagcacgtgcaaaggccccgagactggagtgtgttcctgaagagcagccaggaggccagcatggctggagaggcaggcataggcagggaaccgagcagcaggtcagagcaggcgagctgacattctgcagcctggacggccatggcaggaagcttttagttggagagatacaggaagcctcctagggttctgagcagaagaggggcatgagctgattcacattctgaaggacctctctagctggccagtgctgaggaggttggagagagaaagggtgaaagcagagagaccagtgcagggctgttaacagggttgcaggcgagagactggggtgctgggctcccctagactaggactccagtgccctcctctcccaagagacaaaggccattgcattgaaggaggtgggaaatgattagattctgaacatatgtaattatttttcagtctttttcaaagatacaaatatttacatagttttaatcatgtaatatatacaatttaatgtcctagtgttttacttaatagtgtatcatgttttccctgttggtatgtagcctggataaatgctcttaattataaaaaattctgtcgaggagtgttccatagtttattgttttcctattatgagaatttaggccaagtgtggtggctcatgcctgtaatcccagcactttgcgaggccgaggtgggcagatcacttgaggtgaggagttcaagaccagcctggccaacatggtgaattatctctactaaaaatacaaaaaaataataataatagccaggcgtggtggcacatgcctgtattcccagctgcttgggaggctgaggcaggagaatggcttgaacctgggaggtggaggttgcagtgagccgagatggtgccactgcattccagcctgggcaacagagcgagactccatctcaaaaaaaaggagacttcatgtgcccccaatttttcactattgttatttgaaaaaatatttttatttgtaagagtttttctttatttaaaatgttcattaataaagttgttgactacgatgccggtaccgcct

SEQ ID NO: 314385 - DNA, 3349 bp, Homo sapiens
  misc_feature (30)..(31): n is a, c, g, or t
cgctgggagcggggcgggcgctcgcgtccnnggcttccctccccgactgtgcgccgcggctggctcgggttcccgggccgacatgggcgccgccgcgtgggcacggccgctgagcgtgtctttcctgctgctgcttctgccgctcccggggatgcctgcgggctcctgggacccggccggttacctgctctactgcccctgcatggggcgctttgggaaccaggccgatcacttcttgggctctctggcatttgcaaagctgctaaaccgtaccttggctgtccctccttggattgagtaccagcatcacaagcctcctttcaccaacctccatgtgtcctaccagaagtacttcaagctggagcccctccaggcttaccatcgggtcatcagcttggaggatttcatggagaagctggcacccacccactggccccctgagaagcgggtggcatactgctttgaggtggcagcccagcgaagcccagataagaagacgtgccccatgaaggaaggaaacccctttggcccattctgggatcagtttcatgtgagtttcaacaagtcggagctttttacaggcatttccttcagtgcttcctacagagaacaatggagccagagattttctccaaaggaacatccggtgcttgccctgccaggagccccagcccagttccccgtcctagaggaacacaggccactacagaagtacatggtatggtcagacgaaatggtgaagacgggagaggcccagattcatgcccaccttgtccggccctatgtgggcattcatctgcgcattggctctgactggaagaacgcctgtgccatgctgaaggacgggactgcaggctcgcacttcatggcctctccgcagtgtgtgggctacagccgcagcacagcggcccccctcacgatgactatgtgcctgcctgacctgaaggagatccagagggctgtgaagctctgggtgaggtcgctggatgcccagtcggtctacgttgctactgattccgagagttatgtgcctgagctccaacagctcttcaaagggaaggtgaaggtggtgagcctgaagcctgaggtggcccaggtcgacctgtacatcctcggccaagccgaccactttattggcaactgtgtctcctccttcactgcctttgtgaagcgggagcgggacctccaggggaggccgtcttctttcttcggcatggacaggccccctaagctgcgggacgagttctgattctggccggagcaccagaccctctgatcctggagggaccagagtctgagctggtccttccagccaggcctggcagccagaggtgctccgggattgcaaactcctcttctcacctgccaaagatggagaagagtgccagggacccctcaaggagggagacgctccatatcccagggcataggacttgcaggttcctaggagcaggagcatctcccatcgcacgtgctttctgctcttctgggaatttctcacactggcaaagcagtccagcctccgtcttctggtccactctgctctgagcagcctgggatgctgaactcttcagagagatttttttatagagagatttctataattttgatacaaggtcatgactatcctagaactctctgtggtttttgaaaatcattgaattctattaatgtaggtacctaaagtgaccttaactgaatgtggatgaggctcaagcgatccttctgcctcagcctctctggtagctgagactgcatgcccagctccaaatcaccttgattcatatcagcagtaataatcacttgtgttctgaaagaaagggcaccagaagttctagcaaaattcagttgtgttctgtgagctagcactttttcctctgacccaattttcttacctataaaatggtgataaaaaccgacaggttgttcaaaggcccagatcagctaaagcatgtatataagagcacgttgtaaacttgaaagagacaaaggcacaaatgtggctgttgattaatttgactgcttctcgttgctcgtcacctccatgccaggcactgtgcttgctaattgctttatgggggcattctcttatttattccccagccctgggaaataggagctgtcattatccttctctttctgcacaaggaaaaattaatgccctgagaattgtcataattttcccaaggctgcccagctggtggtgttaagccagaatttgacctcccagagccagtttccattagctgccatgctctgctgcctctaattcacagaatgcactttctaccctgtgtgccatggagacctcctatggaaaaatgatcagccaccttaccttctactgggtacctgctgtgagtctgcctatgccagaaggattaaggaggggaggttacccaagaaacaaagcctacatgccgcttacagcccccgttggatggttgctcagtacaacagtcttgcattcagcaggtgtttgttcatcacctactatgtgtcaggctctatgctaggtactggggatacaggagagaatcaagcgtaaagtctttgttctcaaggaatttgcattctagaaagtagaagatgtaataaatgtactgtgggacatgttaataagtgctataaagaaatataaagggtttgggagcaaaaagagggagtggatctattttagatgagcccaggtaagacctctctgaagagctgtcatgaaggagggagggagcacattcctggcagagaaaacagcacgtgcaaaggccccgagactggagtgtgttcctgaagagcagccaggaggccagcatggctggagaggcaggcataggcagggaaccgagcagcaggtcagagcaggcgagctgacattctgcagcctggacggccatggcaggaagcttttagttggagagatacaggaagcctcctagggttctgagcagaagaggggcatgagctgattcacattctgaaggacctctctagctggccagtgctgaggaggttggagagagaaagggtgaaagcagagagaccagtgcagggctgttaacagggttgcaggcgagagactggggtgctgggctcccctagactaggactccagtgccctcctctcccaagagacaaaggccattgcattgaaggaggtgggaaatgattagattctgaacatatgtaattatttttcagtctttttcaaagatacaaatatttacatagttttaatcatgtaatatatacaatttaatgtcctagtgttttacttaatagtgtatcatgttttccctgttggtatgtagcctggataaatgctcttaattataaaaaattctgtcgagga

SEQ ID NO: 314386 - DNA, 3333 bp, Homo sapiens
  misc_feature (30)..(31): n is a, c, g, or t
  misc_feature (3321)..(3321): n is a, c, g, or t
cgctgggagcggggcgggcgctcgcgtccnnggcttccctccccgactgtgcgccgcggctggctcgggttcccgggccgacatgggcgccgccgcgtgggcacggccgctgagcgtgtctttcctgctgctgcttctgccgctcccggggatgcctgcgggctcctgggacccggccggttacctgctctactgcccctgcatggggcgctttgggaaccaggccgatcacttcttgggctctctggcatttgcaaagctgctaaaccgtaccttggctgtccctccttggattgagtaccagcatcacaagcctcctttcaccaacctccatgtgtcctaccagaagtacttcaagctggagcccctccaggcttaccatcgggtcatcagcttggaggatttcatggagaagctggcacccacccactggccccctgagaagcgggtggcatactgctttgaggtggcagcccagcgaagcccagataagaagacgtgccccatgaaggaaggaaacccctttggcccattctgggatcagtttcatgtgagtttcaacaagtcggagctttttacaggcatttccttcagtgcttcctacagagaacaatggagccagagattttctccaaaggaacatccggtgcttgccctgccaggagccccagcccagttccccgtcctagaggaacacaggccactacagaagtacatggtatggtcagacgaaatggtgaagacgggagaggcccagattcatgcccaccttgtccggccctatgtgggcattcatctgcgcattggctctgactggaagaacgcctgtgccatgctgaaggacgggactgcaggctcgcacttcatggcctctccgcagtgtgtgggctacagccgcagcacagcggcccccctcacgatgactatgtgcctgcctgacctgaaggagatccagagggctgtgaagctctgggtgaggtcgctggatgcccagtcggtctacgttgctactgattccgagagttatgtgcctgagctccaacagctcttcaaagggaaggtgaaggtggtgagcctgaagcctgaggtggcccaggtcgacctgtacatcctcggccaagccgaccactttattggcaactgtgtctcctccttcactgcctttgtgaagcgggagcgggacctccaggggaggccgtcttctttcttcggcatggacaggccccctaagctgcgggacgagttctgattctggccggagcaccagaccctctgatcctggagggaccagagtctgagctggtccttccagccaggcctggcagccagaggtgctccgggattgcaaactcctcttctcacctgccaaagatggagaagagtgccagggacccctcaaggagggagacgctccatatcccagggcataggacttgcaggttcctaggagcaggagcatctcccatcgcacgtgctttctgctcttctgggaatttctcacactggcaaagcagtccagcctccgtcttctggtccactctgctctgagcagcctgggatgctgaactcttcagagagatttttttatagagagatttctataattttgatacaaggtcatgactatcctagaactctctgtggtttttgaaaatcattgaattctattaatgtaggtacctaaagtgaccttaactgaatgtggatgaggctggggctggtgtgggtcttttggctgcttttcaaggtgtcccccaatgtggccctcaagagccatccccactgcctggccagagccattgttgtcccctacttcctaggccatttctggggcttgggggatgaatgctgtcctgtgctgtaaacactatgcaaatggaagttatcggttgtggtgctgtgcagcgctctgtgggcgactaagtgccactcacgcagcatgttcctggcaaggagcacataccatcaagccacactatcatggtattgttctcacagtcttttggtggttgatggccactgcaaacctggcaccatcagatctcttctgatctcttgccccagtggggcctggttggtagaatgttggcattcggttgatatccaaagcctgttctcccagccgtcctcctgcagctggagccttcaggccgtattctcacgagggaacgtttgccaaggctctgacctcacagaagatgcccagggcccagaagccatcagaattatcagtggagaagcaccttttgactcttcccttccaatgtaatctctgccaacaccatgaggcttaaggtgctctaagtcatgagtgttttggtctcaaatgctgcagttttaataatctgtgactcctgagagcccatggttttttgaccttgtggttctaaaattccttgtctgacccctgtagatcttttccttgccatgtcacctcccttggcctttgatcctggaaaggtggcagagcctccactgagccaggcccagagctccttgcagtgccttcttccttgtttacctgtgggaggaaacactttttttgtcaggggcagcctggttcagagctcagaggtcacactgtatcaaagatctcaaacagcaaagtcagcatttgctgtatagagctgccacccaactctaagcaggagaaactgtacagaaagggctttgctatttttcccttttgggaaaacaatgaagtgttttaagtcctgggtggactgagagatggtttgcctgtccagacttgctctcaagcctcatccagagaaggagctgcagatgagggagcccgtacactccctgccaccactaggttgtaagcctgtagctggctggctgatttcattttggaattcatttgccatccacagccttacactaggcacacactttagagtctggggctccagtggggcccgcctaattttttttccccccaagacagggccttgctctgtctcccaggctggagtgcagtggcatgatcatggcttactgcagccttgatctcccaggctcaagcgatccttctgcctcagcctctctggtagctgagactgcatgcccagctccaaatcaccttgattcatatcagcagtaataatcacttgtgttctgaaagaaagggcaccagaagttctagcaaaattcagttgtgttctgtgagctagcactttttcctctgacccaattttcttacctataaaatggtgataaaaaccgacaggttgttcaaaggcccagatcagctaaagcatgtatataagagcacgccgtcaatagaaaaaggaaggcaagtacagagggaggaattcngcgccgcacgct

SEQ ID NO: 314387 - DNA, 1335 bp, Homo sapiens
  misc_feature (30)..(31): n is a, c, g, or t
cgctgggagcggggcgggcgctcgcgtccnnggcttccctccccgactgtgcgccgcggctggctcgggttcccgggccgacatgggcgccgccgcgtgggcacggccgctgagcgtgtctttcctgctgctgcttctgccgctcccggggatgcctgcgggctcctgggacccggccggttacctgctctactgcccctgcatggggcgctttgggaaccaggccgatcacttcttgggctctctggcatttgcaaagctgctaaaccgtaccttggctgtccctccttggattgagtaccagcatcacaagcctcctttcaccaacctccatgtgtcctaccagaagtacttcaagctggagcccctccaggcttaccatcgggtcatcagcttggaggatttcatggagaagctggcacccacccactggccccctgagaagcgggtggcatactgctttgaggtggcagcccagcgaagcccagataagaagacgtgccccatgaaggaaggaaacccctttggcccattctgggatcagtttcatgtgagtttcaacaagtcggagctttttacaggcatttccttcagtgcttcctacagagaacaatggagccagagattttctccaaaggaacatccggtgcttgccctgccaggagccccagcccagttccccgtcctagaggaacacaggccactacagaagtacatggtatggtcagacgaaatggtgaagacgggagaggcccagattcatgcccaccttgtccggccctatgtgggcattcatctgcgcattggctctgactggaagaacgcctgtgccatgctgaaggacgggactgcaggctcgcacttcatggcctctccgcagtgtgtgggctacagccgcagcacagcggcccccctcacgatgactatgtgcctgcctgacctgaaggagatccagagggctgtgaagctctgggtgaggtcgctggatgcccagtcggtctacgttgctactgattccgagagttatgtgcctgagctccaacagctcttcaaagggaaggtatgtgtgggccaagtgggagtgcagtaggaagggaatgaaaggaggagccaggatggtcccactgcccactgcatgcttcacgggctcccctacaagccttttgcctggacctaccattcctcttcagttcctaccctccttcaaaccccagctcagaggcctcctccgtagtctttccaggttttcatccactcctggagctcacgtatccctgctgggaccttcgtggccctatatcatttcttctctcgggcactttctggactgtatga

SEQ ID NO: 314388 - DNA, 817 bp, Homo sapiens
cacttgaggtcaggagttcgagaccagcctgaccaacatggcgaaaccccgactctactaaaactataaaaagccgggtgtggtggtgcatgcctgttatcctagctactcgggaggctgaggcacaagaatcatttgaacctgggagatggaggttgcagtgagccaagatcgtgccactcttctccaaactgggtgacagagggacactgtctcaaaaataaaataaatgtagagatggactgaatgctccaagctaatctgacaggattttagaaataatccaaatttatgctatttaaaaaaagctatatctgaataaagatattgaaaggctgaagtaaaaggatctactttgcatagtataacccaagacatggccaactttttctgtaaagggccagatggtaaatgttgttagctttgcacagtctctgtcacagctactaaactctgcccttgtggcaggaacatagtcattgacggtactcaaatagaacaggcatggctgtgttccaataaaactttatttacaaatacaggctgcaagtaggatttggcccataggccaaagtttgctggcccctatattgaccaaaacaaaaccgaaggagctacattattaccaagcaaaatagatgttaaggcaaaatactccttaaagcatttgttcaggaaaaataattgtaaatatatagtttcaaattacataatacaaaaattcatagaacaagaatacttagataaatctagtaaaaataatgagattttactatacctttcttacaaattaagcagacaaaaaaataaggatatg

SEQ ID NO: 314389 - DNA, 1089 bp, Homo sapiens
cacttgaggtcaggagttcgagaccagcctgaccaacatggcgaaaccccgactctactaaaactataaaaagccgggtgtggtggtgcatgcctgttatcctagctactcgggaggctgaggcacaagaatcatttgaacctgggagatggaggttgcagtgagccaagatcgtgccactcttctccaaactgggcaacagagtgagactctgtctcaaaaacacagtctgatagaatttttattaggatagccttgaatctatagatccatttgaaaataattaacatcttaaatttccaatttctggccgggcgctatggctcacgcctgtaattccagcacgttgggaggccgaggtgggcagatcatcaagtcaggagttcgagaccagcctgaccaacatggtgaaaccctgtctctactaaaaatacaaaaaaattagccaggcgtggtggcacatgcctgtagtcccagctactcaggaggctgaggcaggagaatcgcttgaatctgggaggcagaggttgcagtaagccgagattgtgccactgtactccagcctgggcaacagagtgaggctccgtctccaaaaaaaaaaaaaaaaaattccagttgttgagaaagaataggaattccagctttggaggagtggggagaccatcaaatcctctttccaaaaatactactaaaatactactgagcagagtatagttccacaaatagtcttctgtaaagagactcacagtacatatttgtctttgtaggccatatagtccctgttgcaatttctcaattctacagctataacaggaaagcagctatatacagtatgtgaatgcttgtgttctaatacaaatttatttgcaaaatcaggaaaatggcttgaaatggtttaagatctagttttctgactagatcatggtatataatcttttccatatatattttgaatttggtttgctaatattttgctgatcatttttatatctctctttatgaaggatgctgatctacaactttcttttcttgtgatatctttttctggctttgctaccagggtagtactagcctcttaaaatgagttga

SEQ ID NO: 314390 - DNA, 514 bp, Homo sapiens
attcatggcactgctcctctccatccataggattatcttatgccctgtggcatttatcattttggaccctatctctctcctatctatattggactatggtggcacacagagtgttgtagagatgagggtctcatccttttgcccaggctggagtacagtggtgtgtatgtagcacactgcagccttcaactcctgatcctccaacctcagcctccacagttgctgggattacaagttcaagttggtgtgtatctgcaaaggcgatggaaaggagttcttacatatgcatattctgaagaaggatgttacccttactgaaaaacttattccaagatatgtttaatcaatcatgagaaaaataaagagacatccttatgaatggagaataaagtcctcagggtttttttctaattccccatgtgaatgaagagctgtgttattctaaatatagtgtttgtcataaggcaattgtgttggtttgagtcgttagtcgctgtgacactgataggaattc

SEQ ID NO: 314391 - DNA, 464 bp, Homo sapiens
tccaaaggagtctatgttgtatgatttttatcctcctaacctctccaaataagagagtaaaatgatgtatgataaaacaagttcaagtaactaccagtttatatgtagttgagttcatttctctggttgttcctcagtgactttggagtgtctcatcctcaaaccccacatcccttcacacttggcaatagctgcagttctaccttggtctgttaagaattatgcgggtggtggtgggggaattggggggaaatgtgcctcgcctatggaacagtatcgttgactatttatttcttttatttcctctcagtcaagttggtgtgtatctgcaaaggcgatggaaaggagttcttacatatgcatattctgaagaaggatgttacccttactgaaaaacttattccaagatatgtttaatcaatcatgagaaaaataaagagacatccttatgaatggagaataaa

SEQ ID NO: 314392 - DNA, 838 bp, Homo sapiens
caattatgtatccactgaatgagaggacaccttgatttcaatttccatttataaacttctgcccatcatcattcatatttagctctgtgagtctcataactgcaccagcagccttgcatgtctattttactgccactttctaggcccaaactgtttaaatttatgtcttgatttcatctttaaactttgattttaccaggttattcttgaaattaaagttaaaccttgctcttctaacattaggccccttctaacattcttccaattttccatccccaaaccacatatcagattgtcatgttctctttgctgcactctagcctgggcaacagagcaaaactccgtctcacaaaaaaaaaaaaaaacactgcagtaaaaagccagctgtacctatacatgatgtacctacttgtatgcataggcttaagtatacctatagaataaattcctaaaagtggaattgttggtgtaggcattaataaatcttgtcaaattgccctccataaaggtttctgccatttttcattctgaccaactacatgtgagaatgtgtatttcctccaaaacatcaccaatattgtgttttaaataaaactacttgaaagtcatgtttaaacagggttaattttatcaactttgactacatttctgtgactaattccacaatatgatttcacaaatattctaacagaaggcttcttaggagaaactaagtggcaagaaggccagattatttcaatatatcttgaaacttttctgttttcctaaaacataaacttacatcagtttgtttgatctagcctgggcaacagagcaaaactccgtctcacaaaaaaaa

SEQ ID NO: 314393 - DNA, 556 bp, Homo sapiens
gcgggagtatgggcttagaagccggaagtgggttgaggtagcccggaaggggaatacttccaagttgtagtgttgttgttttcagcctgctgctgctgctgctgttgcggctaggggaaccgtcgtggggaaggatggtgtgcgaaaaatgtgaaaagaaacttggtactgttatcactccagatacatggaaagatggtgctaggaataccacagaaagtggtggaagaaagctgaatgaaaataaagctttgacttcaaaaaaagcaagatttgatccatatggaaagaataagttctccacttgtagaatttgtaaaagttctgtgcaccaaccaggttctcattactgccagggctgtgcctacaaaaaaggcatctgtgcgatgtgtggaaaaaaggttttggataccaaaaactacaagcaaacatctgtctagatgtattgatggaatttctggctttctaaatgattttactttctgccttgaattttcaaggcatagatgtcaacttacagaataacatgttttaagataattaagtttaaaccaga

SEQ ID NO: 314394 - DNA, 1177 bp, Homo sapiens
gcgggagtatgggcttagaagccggaagtgggttgaggtagcccggaaggggaatacttccaagttgtagtgttgttgttttcagcctgctgctgctgctgctgttgcggctaggggaaccgtcgtggggaaggatggtgtgcgaaaaatgtgaaaagaaacttggtactgttatcactccagatacatggaaagatggtgctaggaataccacagaaagtggtggaagaaagctgaatgaaaataaagctttgacttcaaaaaaagcaagatttgatccatatggaaagaataagttctccacttgtagaatttgtaaaagttctgtgcaccaaccaggttctcattactgccagggctgtgcctacaaaaaaggcatctgtgcgatgtgtggaaaaaaggttttggataccaaaaactacaagcaaacatctgtctagatgtattgatggaatttctggctttctaaatgattttactttctgccttgaattttcaaggcatagatgtcaacttacagaataacatgttttaagataattaagtttaaaccagagaatttgattgttactcattttgctctcatgttctaaacagcaacagtgtaactagtcttttgttgtaaatggttattttccttataagaattttaagaactaagtggcaaattccatgaaaatatttctcagttctgtatgcacttttatttaacattattcatataattctccccccaccactttatttatagatactgcaaaagtgagaaggagataatagatactttgctctgaatttggcatccagagttaacatttctcccctcactcccttgctggtgtcatagttattagaatcagcagcctcttaactaattgcggtttcataggatatataaatgtttcaagccattattgctgaatggttctttagttattaacctagacccaaatcaaagaccagttggatttatgatattttttatttgttcttgcagccaaagtgccagtttctttaatatgtgaccaagaacacaaggagcatccatatggccaaataaatacactgaattttagaaaaacatattactttgaattcaaattgtcatgaaaaccagaacagtgtttgtccatgttgcatgtaatgaaaataaatccctgctctgagaaaagctctt

SEQ ID NO: 314395 - DNA, 1184 bp, Homo sapiens
gctatgtggctaagggcacagccgtcgtgcgcggaacggtatgtgtgtcgcgatcacaatagtgaagatagcaagactgtgcgttactgttgtatccattccagatacattgcaaagatggttgctaggtacatccacagcacaaagtggtggaagaaagctgaatgaaaataaagctttgacttcaaaaaaagcaagatttgatccatatggaaagaataagttctccacttgtagaatttgtaaaagttctgtgcaccaaccaggttctcattactgccagggctgtgcctacaaaaaaggcatctgtgcgatgtgtggaaaaaaggttttggataccaaaaactacaagcaaacatctgtctagatgtattgatggaatttctggctttctaaatgattttactttctgccttgaattttcaaggcatagatgtcaacttacagaataacatgttttaagataattaagtttaaaccagagaatttgattgttactcattttgctctcatgttctaaacagcaacagtgtaactagtcttttgttgtaaatggttattttccttataagaattttaagaactaagtggcaaattccatgaaaatatttctcagttctgtatgcacttttatttaacattattcatataattctccccccaccactttatttatagatactgcaaaagtgagaaggagataatagatactttgctctgaatttggcatccagagttaacatttctcccctcactcccttgctggtgtcatagttattagaatcagcagcctcttaactaattgcggtttcataggatatataaatgtttcaagccattattgctgaatggttctttagttattaacctagacccaaatcaaagaccagttggatttatgatattttttatttgttcttgcagccaaagtgccagtttctttaatatgtgaccaagaacacaaggagcatccatatggccaaataaatacactgaattttagaaaaacatattactttgaattcaaattgtcatgaaaaccagaacagtgtttgtccatgttgcatgtaatgaaaataaatccctgctctgagaaaagctctttgaagcaaaaaccaaacttttttttttttttttttacctcctgtcttgccccctaaaagaaataaatagagcaaacatct

SEQ ID NO: 314396 - DNA, 1047 bp, Homo sapiens
  misc_feature (1)..(1): n is a, c, g, or t
ngtacccttattcgtgttgcacctggaatgaaaataaagctttgacttcaaaaaaagcaagatttgatccatatggaaagaataagttctccacttgtagaatttgtaaaagttctgtgcaccaaccaggttctcattactgccagggctgtgcctacaaaaaaggcatctgtgcgatgtgtggaaaaaaggttttggataccaaaaactacaagcaaacatctgtctagatgtattgatggaatttctggctttctaaatgattttactttctgccttgaattttcaaggcatagatgtcaacttacagaataacatgttttaagataattaagtttaaaccagagaatttgattgttactcattttgctctcatgttctaaacagcaacagtgtaactagtcttttgttgtaaatggttattttccttataagaattttaagaactaagtggcaaattccatgaaaatatttctcagttctgtatgcacttttatttaacattattcatataattctccccccaccactttatttatagatactgcaaaagtgagaaggagataatagatactttgctctgaatttggcatccagagttaacatttctcccctcactcccttgctggtgtcatagttattagaatcagcagcctcttaactaattgcggtttcataggatatataaatgtttcaagccattattgctgaatggttctttagttattaacctagacccaaatcaaagaccagttggatttatgatattttttatttgttcttgcagccaaagtgccagtttctttaatatgtgaccaagaacacaaggagcatccatatggccaaataaatacactgaattttagaaaaacatattactttgaattcaaattgtcatgaaaaccagaacagtgtttgtccatgttgcatgtaatgaaaataaatccctgctctgagaaaagctctttgaagcaaaaaccaaacttttttttttttttttttacctcctgtcttgccccctaaaagaaataaatagagcaaacatct

SEQ ID NO: 314397 - DNA, 1257 bp, Homo sapiens
gcgggagtatgggcttagaagccggaagtgggttgaggtagcccggaaggggaatacttccaagttgtagtgttgttgttttcagcctgctgctgctgctgctgttgcggctaggggaaccgtcgtggggaaggatggtgtgcgaaaaatgtgaaaagaaacttggtactgttatcactccagatacatggaaagatggtgctaggaataccacagaaagtggtggaagaaagctgaatgaaaataaagctttgacttcaaaaaaagcaagatttgatccatatggaaagaataagttctccacttgtagaatttgtaaaagttctgtgcaccaaccaggttctcattactgccagggctgtgcctacaaaaaaggcatctgtgcgatgtgtggaaaaaaggttttggataccaaaaactacaagcaaacatctgtctagatgtattgatggaatttctggctttctaaatgattttactttctgccttgaattttcaaggcatagatgtcaacttacagaataacatgttttaagataattaagtttaaaccagagaatttgattgttactcattttgctctcatgttctaaacagcaacagtgtaactagtcttttgttgtaaatggttattttccttataagaattttaagaactaagtggcaaattccatgaaaatatttctcagttctgtatgcacttttatttaacattattcatataattctccccccaccactttatttatagatactgcaaaagtgagaaggagataatagatactttgctctgaatttggcatccagagttaacatttctcccctcactcccttgctggtgtcatagttattagaatcagcagcctcttaactaattgcggtttcataggatatataaatgtttcaagccattattgctgaatggttctttagttattaacctagacccaaatcaaagaccagttggatttatgatattttttatttgttcttgcagccaaagtgccagtttctttaatatgtgaccaagaacacaaggagcatccatatggccaaataaatacactgaattttagaaaaacatattactttgaattcaaattgtcatgaaaaccagaacagtgtttgtccatgttgcatgtaatgaaaataaatccctgctctgagaaaagctctttgaagcaaaaaccaaacttttttttttttttttttacctcctgtcttgccccctaaaagaaataaatagagcaaacatct

SEQ ID NO: 314398 - DNA, 1914 bp, Homo sapiens
ctttccccttactccgctcccctcttttccctccctctcctccccttccctctgttctctcctcctcttcccctcccctcccccgtccggggcactctatattcaagccaccgtttcctgcttcacaaaatggccaccgcacgcgacacctacggtcacgtggcctgccgccctctcagtttcgggaatctgcctagctcccactaaggggaggctacccgcggaagagcgagggcagattagaccggagaaatcccaccacatctccaagcccgggaactgagagaggaagaagagtgaaggccagtgttaggaaaaaaaaaaacaaaaacaaaaaaaacgaaaaacgaaagctgagtgcatagagttggaaaggggagcgaatgcgtaaggttggaaaggggggcgaagaggcctaggttaacattttcaggcgtcttagccggtggaaagcgggagacgcaagttctcgcgagatctcgagaactccgaggctgagactagggttttagcggagagcacgggaagtgtagctcgagagaactgggacagcatttcgcaccctaagctccaaggcaggactgctaggggcgacaggactaagtaggaaatcccttgagcttagacctgagggagcgcgcagtagccgggcagaagtcgccgcgacagggaattgcggtgtgagagggagggcacacgttgtacgtgctgacgtagccggctttccagcgggtatattagatccgtggccgcgcggtgcgctccagagccgcagttctcccgtgagagggccttcgcggtggaacaaacactcgcttagcagcggaagactccgagttctcggtactcttcagggatgagtcatgtggcagtggaaaatgcgctcgggctggaccagcagtttgctggcctagacctgaactcttcagataatcagagtggaggaagtacagccagcagttggagtgcaatggtgtgatctcggctcaccgcagtctctgcctccgggttcaagcgattctcctgcctcagcctcccgaatagctgtgcctttctgataataaaacatcaatgactagctggctctcttgagtaaaagcagctaatcattggaaagaaccttattatatcaaattatctctagaagagtttttgtccattataaatcctgagcccagtttagaggtgatgggaatgtgtccctgttaactgactatatttattaaattgaattaagggaatatgcatttcattggttatagctactcctttctcctgaagaacagaagactatactgaattttggattggtggttaggttaggttttcaaatgtgtcatttcttttaaaaaggcattagaaaagttgctttttttcttctaaggggggttatttagagacttgttagaggttagtgttaagataggggatcttggtggtttattataagggcaatagacccttatttttagctcagatctcttcctacttattaaaacaaaagtgagtatgggctatgatgtgtcctcatttttaggcaagaacagcttcactgggaacaaaacttggtgtttgctttaactttcaccttatttgtcatgctaagaatcttttaggaactgattgtcctagtagagatttttaaaaatatttaattcagtctagaagtgaaaaagaaaaatgacacgtttactagttataaagcaaatttatttggctttatgttgttttttttgcttatccatattctaggctgtactcctgctcgcatacagagcaactgtcaactttccttaaactcagcaagccccaaattaaaacctgcaattccttgaaattaactcccctttgcagcttttccttgtttatttattgtatgttttgcaacttactggcatagaaacaaaagattgt

SEQ ID NO: 314399 - DNA, 5331 bp, Homo sapiens
ctttccccttactccgctcccctcttttccctccctctcctccccttccctctgttctctcctcctcttcccctcccctcccccgtccggggcactctatattcaagccaccgtttcctgcttcacaaaatggccaccgcacgcgacacctacggtcacgtggcctgccgccctctcagtttcgggaatctgcctagctcccactaaggggaggctacccgcggaagagcgagggcagattagaccggagaaatcccaccacatctccaagcccgggaactgagagaggaagaagagtgaaggccagtgttaggaaaaaaaaaaacaaaaacaaaaaaaacgaaaaacgaaagctgagtgcatagagttggaaaggggagcgaatgcgtaaggttggaaaggggggcgaagaggcctaggttaacattttcaggcgtcttagccggtggaaagcgggagacgcaagttctcgcgagatctcgagaactccgaggctgagactagggttttagcggagagcacgggaagtgtagctcgagagaactgggacagcatttcgcaccctaagctccaaggcaggactgctaggggcgacaggactaagtaggaaatcccttgagcttagacctgagggagcgcgcagtagccgggcagaagtcgccgcgacagggaattgcggtgtgagagggagggcacacgttgtacgtgctgacgtagccggctttccagcgggtatattagatccgtggccgcgcggtgcgctccagagccgcagttctcccgtgagagggccttcgcggtggaacaaacactcgcttagcagcggaagactccgagttctcggtactcttcagggatgagtcatgtggcagtggaaaatgcgctcgggctggaccagcagtttgctggcctagacctgaactcttcagataatcagagtggaggaagtacagccagcaaagggcgctatattcctcctcatttaaggaaccgagaagctactaaaggtttctacgataaagacagttcagggtggagttctagcaaagataaggatgcgtatagcagttttggatctcgtagtgattcaagagggaagtctagcttcttcagtgatcgtggaagtggatcaaggggaaggtttgatgatcgtggacggagtgattacgatggcattggcagccgtggtgacagaagtggctttggcaaatttgaacgtggtggaaacagtcgctggtgtgacaaatcagatgaagatgattggtcaaaaccactcccaccaagtgaacgcttggaacaggaactcttttctggaggcaacactgggattaattttgagaaatacgatgacattccagttgaggcaacaggcaacaactgtcctccacatattgaaagtttcagtgatgttgagatgggagaaattatcatgggaaacattgagcttactcgttatactcgcccaactccagtgcaaaagcatgctattcctattatcaaagagaaaagagacttgatggcttgtgcccaaacagggtctggaaaaactgcagcatttctgttgcccatcttgagtcagatttattcagatggtccaggcgaggctttgagggccatgaaggaaaatggaaggtatgggcgccgcaaacaatacccaatctccttggtattagcaccaacgagagagttggcagtacagatctacgaggaagccagaaaattttcataccgatctagagttcgtccttgcgtggtttatggtggtgccgatattggtcagcagattcgagacttggaacgtggatgccatttgttagtagccactccaggacgtctagtggatatgatggaaagaggaaagattggattagacttttgcaaatacttggtgttagatgaagctgatcggatgttggatatggggtttgagcctcagattcgtagaatagtcgaacaagatactatgcctccaaagggtgtccgccacactatgatgtttagtgctacttttcctaaggaaatacagatgctggctcgtgatttcttagatgaatatatcttcttggctgtaggaagagttggctctacctctgaaaacatcacacagaaagtagtttgggtggaagaatcagacaaacggtcatttctgcttgacctcctaaatgcaacaggcaaggattcactgaccttagtgtttgtggagaccaaaaagggtgcagattctctggaggatttcttataccatgaaggatacgcatgtaccagcatccatggagaccgttctcagagggatagagaagaggcccttcaccagttccgctcaggaaaaagcccaattttagtggctacagcagtagcagcaagaggactggacatttcaaatgtgaaacatgttatcaattttgacttgccaagtgatattgaagaatatgtacatcgtattggtcgtacgggacgtgtaggaaaccttggcctggcaacctcattctttaacgagaggaacataaatattactaaggatttgttggatcttcttgttgaagctaaacaagaagtgccgtcttggttagaaaacatggcttatgaacaccactacaagggtagcagtcgtggacgttctaagagtagcagatttagtggagggtttggtgccagagactaccgacaaagtagcggtgccagcagttccagcttcagcagcagccgcgcaagcagcagccgcagtggcggaggtggccacggtagcagcagaggatttggtggaggtggctatggaggcttttacaacagtgatggatatggaggaaattataactcccagggggttgactggtggggtaactgagcctgctttgcagtaggtcaccctgccaaacaagctaatatggaaaccacatgtaacttagccagactataccttgtgtagcttcaagaactcgcagtacattaccagctgtgattctccactgaaattttttttttaagggagctcaaggtcacaagaagaaatgaaaggaacaatcagcagccctgttcagaaggtggtttgaagacttcattgctgtagtttggattaactcccctcccgcctacccccatcccaaactgcatttataattttgtgactgaggatcatttgtttgttaatgtactgtgcctttaactttagacaactttttattttgatgtcctgttggctcagtaatgctcaagatatcaattgttttgacaaaataaatttactgaacttgggctaaaatcaaaccttggcacacaggtgtgatacaacttaacaggaatcatcgattcatccataaataatataaggaaaaacttatgcggtagcctgcattagggctttttgatacttgcagattgggggaaaacaacaaatgtcttgaagcatattaatggaattagtttctaatgtggcaaactgtattaagttaaagttctgatttgctcactctatcctggataggtatttagaacctgatagtctttaagccattccagtcatgatgaggtgatgtatgaatacatgcatacattcaaagcactgttttcaaagttaatgcaagtaaatacagcaattcctctttcaacgtttaggcagatcattaattatgagctagccaaatgtgggcatactattacagggaaagtttaaaggtctgataacttgaaataggtttttaggagaattcatctacttagactttttaaatgcctgccataaatgaaattgaaatggtagaatggctgaccacagcaatgaccagccctcattagggccctggatgatttttggtctaataacgcatgctagtgttgatgttttttggtcaagagggtatgaacaggaagaattaaatgcagcaggctttattttaaatgccgattcacattactctgttcaagctgcgttgagatgttaaactggcttactatagacttcgtaaaaatggctccagaagagtaacaaactgaaatctttgagatcacacaggttggaaatatgtacataactgcacaaggtgtcaattctgctctacagtgcagttttagtcagttttagttgcataggtttccattgtatttatagtctgtttatgctaaatctggccaaagatgagcattgtccaccactaaaatgcctctgccactttgaattctgtgctaattttgtggccagaatgcggtgatcaaaacgctccatctttttacagtggcataggaagacggcaaaaatttcctaaagtgcaatagattttcaagtgtattgtgccttgttctaaaacttttattaagtaggtgcacttgacagtattgaggtcatttgttatggtgctatttcaattagtctaggtttaggcccttgtacattttgcccataactttttacaaagtacttcttttattgcacattcagagaattttatatatatgtcttgtgtgcgtgtccttaaacttccaatcttactttgtctcttggagattgttgaacgcagcttgtctaggaaggggatgggactagattctaaaatttatttgggaccatgggaatgatagttgggaagaaaactatttgcacacgacagatttctagatactttttgctgctagttttatgtaatatttattgaacattttgacaaatatttatttttgtaagcctaaaagtgattctttgaaagtttaaagaaacttgaccaaaagacagtacaaaaacactggcacttgaatgttgaatgtcaccgtatgcgtgaaattatatatttcggggtagtgtgagcttttaatgtttaagtcatattaaactcttaagtcaaattaagcagacccggcgttggcagtgtagccataactttctgatgttagtaaaaacaaaattggcgacttgaaattaaatcatgccaaggttttgatacacttgtcttaagatattaatgaaacacttcaaaacactgatgtgaagtgtccagattctcagatgtttgttgtgtggattttgtttagttgtgtgtttttttttttttttcagtgaatgtctggcacattgcaatcctcaaacatgtggttatctttgttgtattggcataatcagtgacttgtacattcagcaatagcatttgagcaagttttatcagcaagcaatattttcagttaataaggtttcaaaaatcatgtaaggatttaaacttgctgaatgtaaagattgaacctcaagtcactgtagctttagtaattgcttattgtattagtttagatgctagcactgcatgtgctgtgcatattctgattttattaaaataaaaagttgaactgcac

SEQ ID NO: 314400 - DNA, 3408 bp, Homo sapiens
ctttccccttactccgctcccctcttttccctccctctcctccccttccctctgttctctcctcctcttcccctcccctcccccgtccggggcactctatattcaagccaccgtttcctgcttcacaaaatggccaccgcacgcgacacctacggtcacgtggcctgccgccctctcagtttcgggaatctgcctagctcccactaaggggaggctacccgcggaagagcgagggcagattagaccggagaaatcccaccacatctccaagcccgggaactgagagaggaagaagagtgaaggccagtgttaggaaaaaaaaaaacaaaaacaaaaaaaacgaaaaacgaaagctgagtgcatagagttggaaaggggagcgaatgcgtaaggttggaaaggggggcgaagaggcctaggttaacattttcaggcgtcttagccggtggaaagcgggagacgcaagttctcgcgagatctcgagaactccgaggctgagactagggttttagcggagagcacgggaagtgtagctcgagagaactgggacagcatttcgcaccctaagctccaaggcaggactgctaggggcgacaggactaagtaggaaatcccttgagcttagacctgagggagcgcgcagtagccgggcagaagtcgccgcgacagggaattgcggtgtgagagggagggcacacgttgtacgtgctgacgtagccggctttccagcgggtatattagatccgtggccgcgcggtgcgctccagagccgcagttctcccgtgagagggccttcgcggtggaacaaacactcgcttagcagcggaagactccgagttctcggtactcttcagggatgagtcatgtggcagtggaaaatgcgctcgggctggaccagcagtttgctggcctagacctgaactcttcagataatcagagtggaggaagtacagccagcaaagggcgctatattcctcctcatttaaggaaccgagaagctactaaaggtttctacgataaagacagttcagggtggagttctagcaaagataaggatgcgtatagcagttttggatctcgtagtgattcaagagggaagtctagcttcttcagtgatcgtggaagtggatcaaggggaaggtttgatgatcgtggacggagtgattacgatggcattggcagccgtggtgacagaagtggctttggcaaatttgaacgtggtggaaacagtcgctggtgtgacaaatcagatgaagatgattggtcaaaaccactcccaccaagtgaacgcttggaacaggaactcttttctggaggcaacactgggattaattttgagaaatacgatgacattccagttgaggcaacaggcaacaactgtcctccacatattgaaagtttcagtgatgttgagatgggagaaattatcatgggaaacattgagcttactcgttatactcgcccaactccagtgcaaaagcatgctattcctattatcaaagagaaaagagacttgatggcttgtgcccaaacagggtctggaaaaactgcagcatttctgttgcccatcttgagtcagatttattcagatggtccaggcgaggctttgagggccatgaaggaaaatggaaggtatgggcgccgcaaacaatacccaatctccttggtattagcaccaacgagagagttggcagtacagatctacgaggaagccagaaaattttcataccgatctagagttcgtccttgcgtggtttatggtggtgccgatattggtcagcagattcgagacttggaacgtggatgccatttgttagtagccactccaggacgtctagtggatatgatggaaagaggaaagattggattagacttttgcaaatacttggtgttagatgaagctgatcggatgttggatatggggtttgagcctcagattcgtagaatagtcgaacaagatactatgcctccaaagggtgtccgccacactatgatgtttagtgctacttttcctaaggaaatacagatgctggctcgtgatttcttagatgaatatatcttcttggctgtaggaagagttggctctacctctgaaaacatcacacagaaagtagtttgggtggaagaatcagacaaacggtcatttctgcttgacctcctaaatgcaacaggcaaggattcactgaccttagtgtttgtggagaccaaaaagggtgcagattctctggaggatttcttataccatgaaggatacgcatgtaccagcatccatggagaccgttctcagagggatagagaagaggcccttcaccagttccgctcaggaaaaagcccaattttagtggctacagcagtagcagcaagaggactggacatttcaaatgtgaaacatgttatcaattttgacttgccaagtgatattgaagaatatgtacatcgtattggtcgtacgggacgtgtaggaaaccttggcctggcaacctcattctttaacgagaggaacataaatattactaaggatttgttggatcttcttgttgaagctaaacaagaagtgccgtcttggttagaaaacatggcttatgaacaccactacaagggtagcagtcgtggacgttctaagagtagcagatttagtggagggtttggtgccagagactaccgacaaagtagcggtgccagcagttccagcttcagcagcagccgcgcaagcagcagccgcagtggcggaggtggccacggtagcagcagaggatttggtggaggtggctatggaggcttttacaacagtgatggatatggaggaaattataactcccagggggttgactggtggggtaactgagcctgctttgcagtaggtcaccctgccaaacaagctaatatggaaaccacatgtaacttagccagactataccttgtgtagcttcaagaactcgcagtacattaccagctgtgattctccactgaaattttttttttaagggagctcaaggtcacaagaagaaatgaaaggaacaatcagcagccctgttcagaaggatcatgctcctctgtggagcaagtgcctccatgaaatgccatattttgtgaagaaagtgcatgcaggaatattcaggagtccagcatgtagtcatggcagccttaggtatttgagaccgaccaaccctcctgatgaagacaaccataactcatgcaggcatgagtctaacttggagcgtgatgcccagaagtgtgtgaactggtctgtgaccacaaagatgagaaccgcatgctgagattggtggaatggagacttcagtgagcctacatgcagatgacatggtgacacccgtgcccagcctgagctgttttcttctggccctcttattacatgagaaaaataaacacctatgcaccttggcctca

SEQ ID NO: 314401 - DNA, 562 bp, Homo sapiens
aaggcacaatacacttgaaatctatggcactttaggaaattttggccgtcttccttatgccactgtaaaaagatggagcgttttgatcaccgcattctggccacaaaattagcacagaattcaaagtggcagaggcattttagtggtggactatgctcatcttcggccagatttagcataaacagactataaatacaatggaaaccttggcctggcaacctcattctttaacgagaggaacataaatattactaaggatttgttggatcttcttgttgaagctaaacaagaagtgccgtcttggttagaaaacatggcttatgaacaccactacaagggtagcagtcgtggacgttctaagagtagcagatttagtggagggtttggtgccagagactaccgacaaagtagcggtgccagcagttccagcttcagcagcagccgcgcaagcagcagccgcagtggcggaggtggccacggtagcagcagaggatttggtggaggttccacaacctcatactggtcacgcatcatcgtgcagatagcggcgcagtccacgaca

SEQ ID NO: 314402 - DNA, 5405 bp, Homo sapiens
ctttccccttactccgctcccctcttttccctccctctcctccccttccctctgttctctcctcctcttcccctcccctcccccgtccggggcactctatattcaagccaccgtttcctgcttcacaaaatggccaccgcacgcgacacctacggtcacgtggcctgccgccctctcagtttcgggaatctgcctagctcccactaaggggaggctacccgcggaagagcgagggcagattagaccggagaaatcccaccacatctccaagcccgggaactgagagaggaagaagagtgaaggccagtgttaggaaaaaaaaaaacaaaaacaaaaaaaacgaaaaacgaaagctgagtgcatagagttggaaaggggagcgaatgcgtaaggttggaaaggggggcgaagaggcctaggttaacattttcaggcgtcttagccggtggaaagcgggagacgcaagttctcgcgagatctcgagaactccgaggctgagactagggttttagcggagagcacgggaagtgtagctcgagagaactgggacagcatttcgcaccctaagctccaaggcaggactgctaggggcgacaggactaagtaggaaatcccttgagcttagacctgagggagcgcgcagtagccgggcagaagtcgccgcgacagggaattgcggtgtgagagggagggcacacgttgtacgtgctgacgtagccggctttccagcgggtatattagatccgtggccgcgcggtgcgctccagagccgcagttctcccgtgagagggccttcgcggtggaacaaacactcgcttagcagcggaagactccgagttctcggtactcttcagggatgagtcatgtggcagtggaaaatgcgctcgggctggaccagcagtttgctggcctagacctgaactcttcagataatcagagtggaggaagtacagccagcaaagggcgctatattcctcctcatttaaggaaccgagaagctactaaaggtttctacgataaagacagttcagggtggagttctagcaaagataaggatgcgtatagcagttttggatctcgtagtgattcaagagggaagtctagcttcttcagtgatcgtggaagtggatcaaggggaaggtttgatgatcgtggacggagtgattacgatggcattggcagccgtggtgacagaagtggctttggcaaatttgaacgtggtggaaacagtcgctggtgtgacaaatcagatgaagatgattggtcaaaaccactcccaccaagtgaacgcttggaacaggaactcttttctggaggcaacactgggattaattttgagaaatacgatgacattccagttgaggcaacaggcaacaactgtcctccacatattgaaagtttcagtgatgttgagatgggagaaattatcatgggaaacattgagcttactcgttatactcgcccaactccagtgcaaaagcatgctattcctattatcaaagagaaaagagacttgatggcttgtgcccaaacagggtctggaaaaactgcagcatttctgttgcccatcttgagtcagatttattcagatggtccaggcgaggctttgagggccatgaaggaaaatggaaggtatgggcgccgcaaacaatacccaatctccttggtattagcaccaacgagagagttggcagtacagatctacgaggaagccagaaaattttcataccgatctagagttcgtccttgcgtggtttatggtggtgccgatattggtcagcagattcgagacttggaacgtggatgccatttgttagtagccactccaggacgtctagtggatatgatggaaagaggaaagattggattagacttttgcaaatacttggtgttagatgaagctgatcggatgttggatatggggtttgagcctcagattcgtagaatagtcgaacaagatactatgcctccaaagggtgtccgccacactatgatgtttagtgctacttttcctaaggaaatacagatgctggctcgtgatttcttagatgaatatatcttcttggctgtaggaagagttggctctacctctgaaaacatcacacagaaagtagtttgggtggaagaatcagacaaacggtcatttctgcttgacctcctaaatgcaacaggcaaggattcactgaccttagtgtttgtggagaccaaaaagggtgcagattctctggaggatttcttataccatgaaggatacgcatgtaccagcatccatggagaccgttctcagagggatagagaagaggcccttcaccagttccgctcaggaaaaagcccaattttagtggctacagcagtagcagcaagaggactggacatttcaaatgtgaaacatgttatcaattttgacttgccaagtgatattgaagaatatgtacatcgtattggtcgtacgggacgtgtaggaaaccttggcctggcaacctcattctttaacgagaggaacataaatattactaaggatttgttggatcttcttgttgaagctaaacaagaagtgccgtcttggttagaaaacatggcttatgaacaccactacaagggtagcagtcgtggacgttctaagagtagcagatttagtggagggtttggtgccagagactaccgacaaagtagcggtgccagcagttccagcttcagcagcagccgcgcaagcagcagccgcagtggcggaggtggccacggtagcagcagaggatttggtggaggtggctatggaggcttttacaacagtgatggatatggaggaaattataactcccagggggttgactggtggggtaactgagcctgctttgcagtaggtcaccctgccaaacaagctaatatggaaaccacatgtaacttagccagactataccttgtgtagcttcaagaactcgcagtacattaccagctgtgattctccactgaaattttttttttaagggagctcaaggtcacaagaagaaatgaaaggaacaatcagcagccctgttcagaaggtggtttgaagacttcattgctgtagtttggattaactcccctcccgcctacccccatcccaaactgcatttataattttgtgactgaggatcatttgtttgttaatgtactgtgcctttaactttagacaactttttattttgatgtcctgttggctcagtaatgctcaagatatcaattgttttgacaaaataaatttactgaacttgggctaaaatcaaaccttggcacacaggtgtgatacaacttaacaggaatcatcgattcatccataaataatataaggaaaaacttatgcggtagcctgcattagggctttttgatacttgcagattgggggaaaacaacaaatgtcttgaagcatattaatggaattagtttctaatgtggcaaactgtattaagttaaagttctgatttgctcactctatcctggataggtatttagaacctgatagtctttaagccattccagtcatgatgaggtgatgtatgaatacatgcatacattcaaagcactgttttcaaagttaatgcaagtaaatacagcaattcctctttcaacgtttaggcagatcattaattatgagctagccaaatgtgggcatactattacagggaaagtttaaaggtctgataacttgaaataggtttttaggagaattcatctacttagactttttaaatgcctgccataaatgaaattgaaatggtagaatggctgaccacagcaatgaccagccctcattagggccctggatgatttttggtctaataacgcatgctagtgttgatgttttttggtcaagagggtatgaacaggaagaattaaatgcagcaggctttattttaaatgccgattcacattactctgttcaagctgcgttgagatgttaaactggcttactatagacttcgtaaaaatggctccagaagagtaacaaactgaaatctttgagatcacacaggttggaaatatgtacataactgcacaaggtgtcaattctgctctacagtgcagttttagtcagttttagttgcataggtttccattgtatttatagtctgtttatgctaaatctggccaaagatgagcattgtccaccactaaaatgcctctgccactttgaattctgtgctaattttgtggccagaatgcggtgatcaaaacgctccatctttttacagtggcataggaagacggcaaaaatttcctaaagtgcaatagattttcaagtgtattgtgccttgttctaaaacttttattaagtaggtgcacttgacagtattgaggtcatttgttatggtgctatttcaattagtctaggtttaggcccttgtacattttgcccataactttttacaaagtacttcttttattgcacattcagagaattttatatatatgtcttgtgtgcgtgtccttaaacttccaatcttactttgtctcttggagattgttgaacgcagcttgtctaggaaggggatgggactagattctaaaatttatttgggaccatgggaatgatagttgggaagaaaactatttgcacacgacagatttctagatactttttgctgctagttttatgtaatatttattgaacattttgacaaatatttatttttgtaagcctaaaagtgattctttgaaagtttaaagaaacttgaccaaaagacagtacaaaaacactggcacttgaatgttgaatgtcaccgtatgcgtgaaattatatatttcggggtagtgtgagcttttaatgtttaagtcatattaaactcttaagtcaaattaagcagacccggcgttggcagtgtagccataactttctgatgttagtaaaaacaaaattggcgacttgaaattaaatcatgccaaggttttgatacacttgtcttaagatattaatgaaacacttcaaaacactgatgtgaagtgtccagattctcagatgtttgttgtgtggattttgtttagttgtgtgtttttttttttttttcagtgaatgtctggcacattgcaatcctcaaacatgtggttatctttgttgtattggcataatcagtgacttgtacattcagcaatagcatttgagcaagttttatcagcaagcaatattttcagttaataaggtttcaaaaatcatgtaaggatttaaacttgctgaatgtaaagattgaacctcaagtcactgtagctttagtaattgcttattgtattagtttagatgctagcactgcatgtgctgtgcatattctgattttattaaaataaaaagttgaactgcacagtctcctttgttgttgtcaattgtggtttattttcagaggtgtaaataaagtgctcttgcctgaaaaattgta

SEQ ID NO: 314403 - DNA, 4661 bp, Homo sapiens
tcttaaaaacatcttagttcaggtaaggattattttctaccttttatccaaagtctgtcacacaggtgaattgtcctttaagtgacatcctagtataactaggacgattgatatttggtgtgctattttcttgttttccctaccattaaatatatttggatgagcactttaaatgaaggttgtgagctgtgtgccgatttcaaataaaatccttattcttaattttggcatctgtgaggccttttaggctatacaactttatagaaatgtaaagattactgattttagaaaacgaggttatgtaaatgatgctggttagagagccttatttgtcaagtaactcagaattggattgttgacatccttatggttagccataacttaagtctccagatacagttctagagtagggataagaatctgataatggttaaatgatatgattctgattaattgcttgtgctgttcaggtttgatgatcgtggacggagtgattacgatggcattggcagccgtggtgacagaagtggctttggcaaatttgaacgtggtggaaacagtcgctggtgtgacaaatcagatgaagatgattggtcaaaaccactcccaccaagtgaacgcttggaacaggaactcttttctggaggcaacactgggattaattttgagaaatacgatgacattccagttgaggcaacaggcaacaactgtcctccacatattgaaagtttcagtgatgttgagatgggagaaattatcatgggaaacattgagcttactcgttatactcgcccaactccagtgcaaaagcatgctattcctattatcaaagagaaaagagacttgatggcttgtgcccaaacagggtctggaaaaactgcagcatttctgttgcccatcttgagtcagatttattcagatggtccaggcgaggctttgagggccatgaaggaaaatggaaggtatgggcgccgcaaacaatacccaatctccttggtattagcaccaacgagagagttggcagtacagatctacgaggaagccagaaaattttcataccgatctagagttcgtccttgcgtggtttatggtggtgccgatattggtcagcagattcgagacttggaacgtggatgccatttgttagtagccactccaggacgtctagtggatatgatggaaagaggaaagattggattagacttttgcaaatacttggtgttagatgaagctgatcggatgttggatatggggtttgagcctcagattcgtagaatagtcgaacaagatactatgcctccaaagggtgtccgccacactatgatgtttagtgctacttttcctaaggaaatacagatgctggctcgtgatttcttagatgaatatatcttcttggctgtaggaagagttggctctacctctgaaaacatcacacagaaagtagtttgggtggaagaatcagacaaacggtcatttctgcttgacctcctaaatgcaacaggcaaggattcactgaccttagtgtttgtggagaccaaaaagggtgcagattctctggaggatttcttataccatgaaggatacgcatgtaccagcatccatggagaccgttctcagagggatagagaagaggcccttcaccagttccgctcaggaaaaagcccaattttagtggctacagcagtagcagcaagaggactggacatttcaaatgtgaaacatgttatcaattttgacttgccaagtgatattgaagaatatgtacatcgtattggtcgtacgggacgtgtaggaaaccttggcctggcaacctcattctttaacgagaggaacataaatattactaaggatttgttggatcttcttgttgaagctaaacaagaagtgccgtcttggttagaaaacatggcttatgaacaccactacaagggtagcagtcgtggacgttctaagagtagcagatttagtggagggtttggtgccagagactaccgacaaagtagcggtgccagcagttccagcttcagcagcagccgcgcaagcagcagccgcagtggcggaggtggccacggtagcagcagaggatttggtggaggtggctatggaggcttttacaacagtgatggatatggaggaaattataactcccagggggttgactggtggggtaactgagcctgctttgcagtaggtcaccctgccaaacaagctaatatggaaaccacatgtaacttagccagactataccttgtgtagcttcaagaactcgcagtacattaccagctgtgattctccactgaaattttttttttaagggagctcaaggtcacaagaagaaatgaaaggaacaatcagcagccctgttcagaaggtggtttgaagacttcattgctgtagtttggattaactcccctcccgcctacccccatcccaaactgcatttataattttgtgactgaggatcatttgtttgttaatgtactgtgcctttaactttagacaactttttattttgatgtcctgttggctcagtaatgctcaagatatcaattgttttgacaaaataaatttactgaacttgggctaaaatcaaaccttggcacacaggtgtgatacaacttaacaggaatcatcgattcatccataaataatataaggaaaaacttatgcggtagcctgcattagggctttttgatacttgcagattgggggaaaacaacaaatgtcttgaagcatattaatggaattagtttctaatgtggcaaactgtattaagttaaagttctgatttgctcactctatcctggataggtatttagaacctgatagtctttaagccattccagtcatgatgaggtgatgtatgaatacatgcatacattcaaagcactgttttcaaagttaatgcaagtaaatacagcaattcctctttcaacgtttaggcagatcattaattatgagctagccaaatgtgggcatactattacagggaaagtttaaaggtctgataacttgaaataggtttttaggagaattcatctacttagactttttaaatgcctgccataaatgaaattgaaatggtagaatggctgaccacagcaatgaccagccctcattagggccctggatgatttttggtctaataacgcatgctagtgttgatgttttttggtcaagagggtatgaacaggaagaattaaatgcagcaggctttattttaaatgccgattcacattactctgttcaagctgcgttgagatgttaaactggcttactatagacttcgtaaaaatggctccagaagagtaacaaactgaaatctttgagatcacacaggttggaaatatgtacataactgcacaaggtgtcaattctgctctacagtgcagttttagtcagttttagttgcataggtttccattgtatttatagtctgtttatgctaaatctggccaaagatgagcattgtccaccactaaaatgcctctgccactttgaattctgtgctaattttgtggccagaatgcggtgatcaaaacgctccatctttttacagtggcataggaagacggcaaaaatttcctaaagtgcaatagattttcaagtgtattgtgccttgttctaaaacttttattaagtaggtgcacttgacagtattgaggtcatttgttatggtgctatttcaattagtctaggtttaggcccttgtacattttgcccataactttttacaaagtacttcttttattgcacattcagagaattttatatatatgtcttgtgtgcgtgtccttaaacttccaatcttactttgtctcttggagattgttgaacgcagcttgtctaggaaggggatgggactagattctaaaatttatttgggaccatgggaatgatagttgggaagaaaactatttgcacacgacagatttctagatactttttgctgctagttttatgtaatatttattgaacattttgacaaatatttatttttgtaagcctaaaagtgattctttgaaagtttaaagaaacttgaccaaaagacagtacaaaaacactggcacttgaatgttgaatgtcaccgtatgcgtgaaattatatatttcggggtagtgtgagcttttaatgtttaagtcatattaaactcttaagtcaaattaagcagacccggcgttggcagtgtagccataactttctgatgttagtaaaaacaaaattggcgacttgaaattaaatcatgccaaggttttgatacacttgtcttaagatattaatgaaacacttcaaaacactgatgtgaagtgtccagattctcagatgtttgttgtgtggattttgtttagttgtgtgtttttttttttttttcagtgaatgtctggcacattgcaatcctcaaacatgtggttatctttgttgtattggcataatcagtgacttgtacattcagcaatagcatttgagcaagttttatcagcaagcaatattttcagttaataaggtttcaaaaatcatgtaaggatttaaacttgctgaatgtaaagattgaacctcaagtcactgtagctttagtaattgcttattgtattagtttagatgctagcactgcatgtgctgtgcatattctgattttattaaaataaaaagttgaactgcac

SEQ ID NO: 314404 - DNA, 5177 bp, Homo sapiens
  misc_feature (4965)..(4966): n is a, c, g, or t
  misc_feature (4976)..(4976): n is a, c, g, or t
  misc_feature (4991)..(4991): n is a, c, g, or t
  misc_feature (4994)..(4994): n is a, c, g, or t
  misc_feature (5002)..(5003): n is a, c, g, or t
  misc_feature (5005)..(5005): n is a, c, g, or t
  misc_feature (5019)..(5019): n is a, c, g, or t
  misc_feature (5068)..(5068): n is a, c, g, or t
ctttccccttactccgctcccctcttttccctccctctcctccccttccctctgttctctcctcctcttcccctcccctcccccgtccggggcactctatattcaagccaccgtttcctgcttcacaaaatggccaccgcacgcgacacctacggtcacgtggcctgccgccctctcagtttcgggaatctgcctagctcccactaaggggaggctacccgcggaagagcgagggcagattagaccggagaaatcccaccacatctccaagcccgggaactgagagaggaagaagagtgaaggccagtgttaggaaaaaaaaaaacaaaaacaaaaaaaacgaaaaacgaaagctgagtgcatagagttggaaaggggagcgaatgcgtaaggttggaaaggggggcgaagaggcctaggttaacattttcaggcgtcttagccggtggaaagcgggagacgcaagttctcgcgagatctcgagaactccgaggctgagactagggttttagcggagagcacgggaagtgtagctcgagagaactgggacagcatttcgcaccctaagctccaaggcaggactgctaggggcgacaggactaagtaggaaatcccttgagcttagacctgagggagcgcgcagtagccgggcagaagtcgccgcgacagggaattgcggtgtgagagggagggcacacgttgtacgtgctgacgtagccggctttccagcgggtatattagatccgtggccgcgcggtgcgctccagagccgcagttctcccgtgagagggccttcgcggtggaacaaacactcgcttagcagcggaagactccgagttctcggtactcttcagggatgagtcatgtggcagtggaaaatgcgctcgggctggaccagcagtttgctggcctagacctgaactcttcagataatcagagtggaggaagtacagccagcaaagggcgctatattcctcctcatttaaggaaccgagaagctactaaaggtttctacgataaagacagttcagggtggagttctagcaaagataaggatgcgtatagcagttttggatctcgtagtgattcaagagggaagtctagcttcttcagtgatcgtggaagtggatcaaggggaaggtttgatgatcgtggacggagtgattacgatggcattggcagccgtggtgacagaagtggctttggcaaatttgaacgtggtggaaacagtcgctggtgtgacaaatcagatgaagatgattggtcaaaaccactcccaccaagtgaacgcttggaacaggaactcttttctggaggcaacactgggattaattttgagaaatacgatgacattccagttgaggcaacaggcaacaactgtcctccacatattgaaagtttcagtgatgttgagatgggagaaattatcatgggaaacattgagcttactcgttatactcgcccaactccagtgcaaaagcatgctattcctattatcaaagagaaaagagacttgatggcttgtgcccaaacagggtctggaaaaactgcagcatttctgttgcccatcttgagtcagatttattcagatggtccaggcgaggctttgagggccatgaaggaaaatggaaggtatgggcgccgcaaacaatacccaatctccttggtattagcaccaacgagagagttggcagtacagatctacgaggaagccagaaaattttcataccgatctagagttcgtccttgcgtggtttatggtggtgccgatattggtcagcagattcgagacttggaacgtggatgccatttgttagtagccactccaggacgtctagtggatatgatggaaagaggaaagattggattagacttttgcaaatacttggtgttagatgaagctgatcggatgttggatatggggtttgagcctcagattcgtagaatagtcgaacaagatactatgcctccaaagggtgtccgccacactatgatgtttagtgctacttttcctaaggaaatacagatgctggctcgtgatttcttagatgaatatatcttcttggctgtaggaagagttggctctacctctgaaaacatcacacagaaagtagtttgggtggaagaatcagacaaacggtcatttctgcttgacctcctaaatgcaacaggcaaggattcactgaccttagtgtttgtggagaccaaaaagggtgcagattctctggaggatttcttataccatgaaggatacgcatgtaccagcatccatggagaccgttctcagagggatagagaagaggcccttcaccagttccgctcaggaaaaagcccaattttagtggctacagcagtagcagcaagaggactggacatttcaaatgtgaaacatgttatcaattttgacttgccaagtgatattgaagaatatgtacatcgtattggtcgtacgggacgtgtaggaaaccttggcctggcaacctcattctttaacgagaggaacataaatattactaaggatttgttggatcttcttgttgaagctaaacaagaagtgccgtcttggttagaaaacatggcttatgaacaccactacaagggtagcagtcgtggacgttctaagagtagcagatttagtggagggtttggtgccagagactaccgacaaagtagcggtgccagcagttccagcttcagcagcagccgcgcaagcagcagccgcagtggcggaggtggccacggtagcagcagaggatttggtggaggtggctatggaggcttttacaacagtgatggatatggaggaaattataactcccagggggttgactggtggggtaactgagcctgctttgcagtaggtcaccctgccaaacaagctaatatggaaaccacatgtaacttagccagactataccttgtgtagcttcaagaactcgcagtacattaccagctgtgattctccactgaaattttttttttaagggagctcaaggtcacaagaagaaatgaaaggaacaatcagcagccctgttcagaaggtggtttgaagacttcattgctgtagtttggattaactcccctcccgcctacccccatcccaaactgcatttataattttgtgactgaggatcatttgtttgttaatgtactgtgcctttaactttagacaactttttattttgatgtcctgttggctcagtaatgctcaagatatcaattgttttgacaaaataaatttactgaacttgggctaaaatcaaaccttggcacacaggtgtgatacaacttaacaggaatcatcgattcatccataaataatataaggaaaaacttatgcggtagcctgcattagggctttttgatacttgcagattgggggaaaacaacaaatgtcttgaagcatattaatggaattagtttctaatgtggcaaactgtattaagttaaagttctgatttgctcactctatcctggataggtatttagaacctgatagtctttaagccattccagtcatgatgaggtgatgtatgaatacatgcatacattcaaagcactgttttcaaagttaatgcaagtaaatacagcaattcctctttcaacgtttaggcagatcattaattatgagctagccaaatgtgggcatactattacagggaaagtttaaaggtctgataacttgaaataggtttttaggagaattcatctacttagactttttaaatgcctgccataaatgaaattgaaatggtagaatggctgaccacagcaatgaccagccctcattagggccctggatgatttttggtctaataacgcatgctagtgttgatgttttttggtcaagagggtatgaacaggaagaattaaatgcagcaggctttattttaaatgccgattcacattactctgttcaagctgcgttgagatgttaaactggcttactatagacttcgtaaaaatggctccagaagagtaacaaactgaaatctttgagatcacacaggttggaaatatgtacataactgcacaaggtgtcaattctgctctacagtgcagttttagtcagttttagttgcataggtttccattgtatttatagtctgtttatgctaaatctggccaaagatgagcattgtccaccactaaaatgcctctgccactttgaattctgtgctaattttgtggccagaatgcggtgatcaaaacgctccatctttttacagtggcataggaagacggcaaaaatttcctaaagtgcaatagattttcaagtgtattgtgccttgttctaaaacttttattaagtaggtgcacttgacagtattgaggtcatttgttatggtgctatttcaattagtctaggtttaggcccttgtacattttgcccataactttttacaaagtacttcttttattgcacattcagagaattttatatatatgtcttgtgtgcgtgtccttaaacttccaatcttactttgtctcttggagattgttgaacgcagcttgtctaggaaggggatgggactagattctaaaatttatttgggaccatgggaatgatagttgggaagaaaactatttgcacacgacagatttctagatactttttgctgctagttttatgtaatatttattgaacattttgacaaatatttatttttgtaagcctaaaagtgattctttgaaagtttaaagaaacttgaccaaaagacagtacaaaaacactggcacttgaatgttgaatgtcaccgtatgcgtgaaattatatatttcggggtagtgtgagcttttaatgtttaagtcatattaaactcttaagtcaaattaagcagacccggcgttggcagtgtagccataactttctgatgttagtaaaaacaaaattggcgacttgaaattaaatcatgccaaggttttgatacacttgtcttaagatattaatgaaacacttcttanntgtgtgtttntttttttttttttantgnatgtttgnncntttgcattcctctnccctgtcggtctctttgttgtttgggcctctccgtcgcttgcccttccntcgttcgcttctgtgccggtttttcgttctgccgtctttgtggctctcccggctccctctttggccggctctcccttgctcttgctccctttctccctctcgcgctgtc

SEQ ID NO: 314405 - DNA, 5111 bp, Homo sapiens
ctttccccttactccgctcccctcttttccctccctctcctccccttccctctgttctctcctcctcttcccctcccctcccccgtccggggcactctatattcaagccaccgtttcctgcttcacaaaatggccaccgcacgcgacacctacggtcacgtggcctgccgccctctcagtttcgggaatctgcctagctcccactaaggggaggctacccgcggaagagcgagggcagattagaccggagaaatcccaccacatctccaagcccgggaactgagagaggaagaagagtgaaggccagtgttaggaaaaaaaaaaacaaaaacaaaaaaaacgaaaaacgaaagctgagtgcatagagttggaaaggggagcgaatgcgtaaggttggaaaggggggcgaagaggcctaggttaacattttcaggcgtcttagccggtggaaagcgggagacgcaagttctcgcgagatctcgagaactccgaggctgagactagggttttagcggagagcacgggaagtgtagctcgagagaactgggacagcatttcgcaccctaagctccaaggcaggactgctaggggcgacaggactaagtaggaaatcccttgagcttagacctgagggagcgcgcagtagccgggcagaagtcgccgcgacagggaattgcggtgtgagagggagggcacacgttgtacgtgctgacgtagccggctttccagcgggtatattagatccgtggccgcgcggtgcgctccagagccgcagttctcccgtgagagggccttcgcggtggaacaaacactcgcttagcagcggaagactccgagttctcggtactcttcagggatgagtcatgtggcagtggaaaatgcgctcgggctggaccagcagtttgctggcctagacctgaactcttcagataatcagagtggaggaagtacagccagcaaagggcgctatattcctcctcatttaaggaaccgagaagctactaaaggtttctacgataaagacagttcagggtggagttctagcaaagataaggatgcgtatagcagttttggatctcgtagtgattcaagagggaagtctagcttcttcagtgatcgtggaagtggatcaaggggaaggtttgatgatcgtggacggagtgattacgatggcattggcagccgtggtgacagaagtggctttggcaaatttgaacgtggtggaaacagtcgctggtgtgacaaatcagatgaagatgattggtcaaaaccactcccaccaagtgaacgcttggaacaggaactcttttctggaggcaacactgggattaattttgagaaatacgatgacattccagttgaggcaacaggcaacaactgtcctccacatattgaaagtttcagtgatgttgagatgggagaaattatcatgggaaacattgagcttactcgttatactcgcccaactccagtgcaaaagcatgctattcctattatcaaagagaaaagagacttgatggcttgtgcccaaacagggtctggaaaaactgcagcatttctgttgcccatcttgagtcagatttattcagatggtccaggcgaggctttgagggccatgaaggaaaatggaaggtatgggcgccgcaaacaatacccaatctccttggtattagcaccaacgagagagttggcagtacagatctacgaggaagccagaaaattttcataccgatctagagttcgtccttgcgtggtttatggtggtgccgatattggtcagcagattcgagacttggaacgtggatgccatttgttagtagccactccaggacgtctagtggatatgatggaaagaggaaagattggattagacttttgcaaatacttggtgttagatgaagctgatcggatgttggatatggggtttgagcctcagattcgtagaatagtcgaacaagatactatgcctccaaagggtgtccgccacactatgatgtttagtgctacttttcctaaggaaatacagatgctggctcgtgatttcttagatgaatatatcttcttggctgtaggaagagttggctctacctctgaaaacatcacacagaaagtagtttgggtggaagaatcagacaaacggtcatttctgcttgacctcctaaatgcaacaggcaaggattcactgaccttagtgtttgtggagaccaaaaagggtgcagattctctggaggatttcttataccatgaaggatacgcatgtaccagcatccatggagaccgttctcagagggatagagaagaggcccttcaccagttccgctcaggaaaaagcccaattttagtggctacagcagtagcagcaagaggactggacatttcaaatgtgaaacatgttatcaattttgacttgccaagtgatattgaagaatatgtacatcgtattggtcgtacgggacgtgtaggaaaccttggcctggcaacctcattctttaacgagaggaacataaatattactaaggatttgttggatcttcttgttgaagctaaacaagaagtgccgtcttggttagaaaacatggcttatgaacaccactacaagggtagcagtcgtggacgttctaagagtagcagatttagtggagggtttggtgccagagactaccgacaaagtagcggtgccagcagttccagcttcagcagcagccgcgcaagcagcagccgcagtggcggaggtggccacggtagcagcagaggatttggtggagggagctcaaggtcacaagaagaaatgaaaggaacaatcagcagccctgttcagaaggtggtttgaagacttcattgctgtagtttggattaactcccctcccgcctacccccatcccaaactgcatttataattttgtgactgaggatcatttgtttgttaatgtactgtgcctttaactttagacaactttttattttgatgtcctgttggctcagtaatgctcaagatatcaattgttttgacaaaataaatttactgaacttgggctaaaatcaaaccttggcacacaggtgtgatacaacttaacaggaatcatcgattcatccataaataatataaggaaaaacttatgcggtagcctgcattagggctttttgatacttgcagattgggggaaaacaacaaatgtcttgaagcatattaatggaattagtttctaatgtggcaaactgtattaagttaaagttctgatttgctcactctatcctggataggtatttagaacctgatagtctttaagccattccagtcatgatgaggtgatgtatgaatacatgcatacattcaaagcactgttttcaaagttaatgcaagtaaatacagcaattcctctttcaacgtttaggcagatcattaattatgagctagccaaatgtgggcatactattacagggaaagtttaaaggtctgataacttgaaataggtttttaggagaattcatctacttagactttttaaatgcctgccataaatgaaattgaaatggtagaatggctgaccacagcaatgaccagccctcattagggccctggatgatttttggtctaataacgcatgctagtgttgatgttttttggtcaagagggtatgaacaggaagaattaaatgcagcaggctttattttaaatgccgattcacattactctgttcaagctgcgttgagatgttaaactggcttactatagacttcgtaaaaatggctccagaagagtaacaaactgaaatctttgagatcacacaggttggaaatatgtacataactgcacaaggtgtcaattctgctctacagtgcagttttagtcagttttagttgcataggtttccattgtatttatagtctgtttatgctaaatctggccaaagatgagcattgtccaccactaaaatgcctctgccactttgaattctgtgctaattttgtggccagaatgcggtgatcaaaacgctccatctttttacagtggcataggaagacggcaaaaatttcctaaagtgcaatagattttcaagtgtattgtgccttgttctaaaacttttattaagtaggtgcacttgacagtattgaggtcatttgttatggtgctatttcaattagtctaggtttaggcccttgtacattttgcccataactttttacaaagtacttcttttattgcacattcagagaattttatatatatgtcttgtgtgcgtgtccttaaacttccaatcttactttgtctcttggagattgttgaacgcagcttgtctaggaaggggatgggactagattctaaaatttatttgggaccatgggaatgatagttgggaagaaaactatttgcacacgacagatttctagatactttttgctgctagttttatgtaatatttattgaacattttgacaaatatttatttttgtaagcctaaaagtgattctttgaaagtttaaagaaacttgaccaaaagacagtacaaaaacactggcacttgaatgttgaatgtcaccgtatgcgtgaaattatatatttcggggtagtgtgagcttttaatgtttaagtcatattaaactcttaagtcaaattaagcagacccggcgttggcagtgtagccataactttctgatgttagtaaaaacaaaattggcgacttgaaattaaatcatgccaaggttttgatacacttgtcttaagatattaatgaaacacttcaaaacactgatgtgaagtgtccagattctcagatgtttgttgtgtggattttgtttagttgtgtgtttttttttttttttcagtgaatgtctggcacattgcaatcctcaaacatgtggttatctttgttgtattggcataatcagtgacttgtacattcagcaatagcatttgagcaagttttatcagcaagcaatattttcagttaataaggtttcaaaaatcatgtaaggatttaaacttgctgaatgtaaagattgaacctcaagtcactgtagctttagtaattgcttattgtattagtttagatgctagcactgcatgtgctgtgcatattctgattttattaaaataaaaagttgaactgcac

SEQ ID NO: 314406 - DNA, 5057 bp, Homo sapiens
ctttccccttactccgctcccctcttttccctccctctcctccccttccctctgttctctcctcctcttcccctcccctcccccgtccggggcactctatattcaagccaccgtttcctgcttcacaaaatggccaccgcacgcgacacctacggtcacgtggcctgccgccctctcagtttcgggaatctgcctagctcccactaaggggaggctacccgcggaagagcgagggcagattagaccggagaaatcccaccacatctccaagcccgggaactgagagaggaagaagagtgaaggccagtgttaggaaaaaaaaaaacaaaaacaaaaaaaacgaaaaacgaaagctgagtgcatagagttggaaaggggagcgaatgcgtaaggttggaaaggggggcgaagaggcctaggttaacattttcaggcgtcttagccggtggaaagcgggagacgcaagttctcgcgagatctcgagaactccgaggctgagactagggttttagcggagagcacgggaagtgtagctcgagagaactgggacagcatttcgcaccctaagctccaaggcaggactgctaggggcgacaggactaagtaggaaatcccttgagcttagacctgagggagcgcgcagtagccgggcagaagtcgccgcgacagggaattgcggtgtgagagggagggcacacgttgtacgtgctgacgtagccggctttccagcgggtatattagatccgtggccgcgcggtgcgctccagagccgcagttctcccgtgagagggccttcgcggtggaacaaacactcgcttagcagcggaagactccgagttctcggtactcttcagggatgagtcatgtggcagtggaaaatgcgctcgggctggaccagcagtttgctggcctagacctgaactcttcagataatcagagtggaggaagtacagccagcaaagggcgctatattcctcctcatttaaggaaccgagaagctactaaaggtttctacgataaagacagttcagggtggagttctagcaaagataaggatgcgtatagcagttttggatctcgtagtgattcaagagggaagtctagcttcttcagtgatcgtggaagtggatcaaggggaaggtttgatgatcgtggacggagtgattacgatggcattggcagccgtggtgacagaagtggctttggcaaatttgaacgtggtggaaacagtcgctggtgtgacaaatcagatgaagatgattggtcaaaaccactcccaccaagtgaacgcttggaacaggaactcttttctggaggcaacactgggattaattttgagaaatacgatgacattccagttgaggcaacaggcaacaactgtcctccacatattgaaagtttcagtgatgttgagatgggagaaattatcatgggaaacattgagcttactcgttatactcgcccaactccagtgcaaaagcatgctattcctattatcaaagagaaaagagacttgatggcttgtgcccaaacagggtctggaaaaactgcagcatttctgttgcccatcttgagtcagatttattcagatggtccaggcgaggctttgagggccatgaaggaaaatggaaggtatgggcgccgcaaacaatacccaatctccttggtattagcaccaacgagagagttggcagtacagatctacgaggaagccagaaaattttcataccgatctagagttcgtccttgcgtggtttatggtggtgccgatattggtcagcagattcgagacttggaacgtggatgccatttgttagtagccactccaggacgtctagtggatatgatggaaagaggaaagattggattagacttttgcaaatacttggtgttagatgaagctgatcggatgttggatatggggtttgagcctcagattcgtagaatagtcgaacaagatactatgcctccaaagggtgtccgccacactatgatgtttagtgctacttttcctaaggaaatacagatgctggctcgtgatttcttagatgaatatatcttcttggctgtaggaagagttggctctacctctgaaaacatcacacagaaagtagtttgggtggaagaatcagacaaacggtcatttctgcttgacctcctaaatgcaacaggcaaggattcactgaccttagtgtttgtggagaccaaaaagggtgcagattctctggaggatttcttataccatgaaggatacgcatgtaccagcatccatggagaccgttctcagagggatagagaagaggcccttcaccagttccgctcaggaaaaagcccaattttagtggctacagcagtagcagcaagaggactggacatttcaaatgtgaaacatgttatcaattttgacttgccaagtgatattgaagaatatgtacatcgtattggtcgtacgggacgtgtaggaaaccttggcctggcaacctcattctttaacgagaggaacataaatattactaaggatttgttggatcttcttgttgaagctaaacaagaagtgccgtcttggttagatagcagatttagtggagggtttggtgccagagactaccgacaaagtagcggtgccagcagttccagcttcagcagcagccgcgcaagcagcagccgcagtggcggaggtggccacggtagcagcagaggatttggtggagggagctcaaggtcacaagaagaaatgaaaggaacaatcagcagccctgttcagaaggtggtttgaagacttcattgctgtagtttggattaactcccctcccgcctacccccatcccaaactgcatttataattttgtgactgaggatcatttgtttgttaatgtactgtgcctttaactttagacaactttttattttgatgtcctgttggctcagtaatgctcaagatatcaattgttttgacaaaataaatttactgaacttgggctaaaatcaaaccttggcacacaggtgtgatacaacttaacaggaatcatcgattcatccataaataatataaggaaaaacttatgcggtagcctgcattagggctttttgatacttgcagattgggggaaaacaacaaatgtcttgaagcatattaatggaattagtttctaatgtggcaaactgtattaagttaaagttctgatttgctcactctatcctggataggtatttagaacctgatagtctttaagccattccagtcatgatgaggtgatgtatgaatacatgcatacattcaaagcactgttttcaaagttaatgcaagtaaatacagcaattcctctttcaacgtttaggcagatcattaattatgagctagccaaatgtgggcatactattacagggaaagtttaaaggtctgataacttgaaataggtttttaggagaattcatctacttagactttttaaatgcctgccataaatgaaattgaaatggtagaatggctgaccacagcaatgaccagccctcattagggccctggatgatttttggtctaataacgcatgctagtgttgatgttttttggtcaagagggtatgaacaggaagaattaaatgcagcaggctttattttaaatgccgattcacattactctgttcaagctgcgttgagatgttaaactggcttactatagacttcgtaaaaatggctccagaagagtaacaaactgaaatctttgagatcacacaggttggaaatatgtacataactgcacaaggtgtcaattctgctctacagtgcagttttagtcagttttagttgcataggtttccattgtatttatagtctgtttatgctaaatctggccaaagatgagcattgtccaccactaaaatgcctctgccactttgaattctgtgctaattttgtggccagaatgcggtgatcaaaacgctccatctttttacagtggcataggaagacggcaaaaatttcctaaagtgcaatagattttcaagtgtattgtgccttgttctaaaacttttattaagtaggtgcacttgacagtattgaggtcatttgttatggtgctatttcaattagtctaggtttaggcccttgtacattttgcccataactttttacaaagtacttcttttattgcacattcagagaattttatatatatgtcttgtgtgcgtgtccttaaacttccaatcttactttgtctcttggagattgttgaacgcagcttgtctaggaaggggatgggactagattctaaaatttatttgggaccatgggaatgatagttgggaagaaaactatttgcacacgacagatttctagatactttttgctgctagttttatgtaatatttattgaacattttgacaaatatttatttttgtaagcctaaaagtgattctttgaaagtttaaagaaacttgaccaaaagacagtacaaaaacactggcacttgaatgttgaatgtcaccgtatgcgtgaaattatatatttcggggtagtgtgagcttttaatgtttaagtcatattaaactcttaagtcaaattaagcagacccggcgttggcagtgtagccataactttctgatgttagtaaaaacaaaattggcgacttgaaattaaatcatgccaaggttttgatacacttgtcttaagatattaatgaaacacttcaaaacactgatgtgaagtgtccagattctcagatgtttgttgtgtggattttgtttagttgtgtgtttttttttttttttcagtgaatgtctggcacattgcaatcctcaaacatgtggttatctttgttgtattggcataatcagtgacttgtacattcagcaatagcatttgagcaagttttatcagcaagcaatattttcagttaataaggtttcaaaaatcatgtaaggatttaaacttgctgaatgtaaagattgaacctcaagtcactgtagctttagtaattgcttattgtattagtttagatgctagcactgcatgtgctgtgcatattctgattttattaaaataaaaagttgaactgcac

SEQ ID NO: 314407 - DNA, 859 bp, Homo sapiens
gcacgagcaacaatctccaagagacaaagtaagattggaagtttaaggacacgcacacaagacatattctaaaatttatttgggaccatgggaatgatagttgggaagaaaactatttgcacacgacagatttctagatactttttgctgctagttttatgtaatatttattgaacattttgacaaatatttatttttgtaagcctaaaagtgattctttgaaagtttaaagaaacttgaccaaaagacagtacaaaaacactggcacttgaatgttgaatgtcaccgtatgcgtgaaattatatatttcggggtagtgtgagcttttaatgtttaagtcatattaaactcttaagtcaaattaagcagacccggcgttggcagtgtagccataactttctgatgttagtaaaaacaaaattggcgacttgaaattaaatcatgccaaggttttgatacacttgtcttaagatattaatgaaacacttcaaaacactgatgtgaagtgtccagattctcagatgtttgttgtgtggattttgtttagttgtgtgtttttttttttttttcagtgaatgtctggcacattgcaatcctcaaacatgtggttatctttgttgtattggcataatcagtgacttgtacattcagcaatagcatttgagcaagttttatcagcaagcaatattttcagttaataaggtttcaaaaatcatgtaaggatttaaacttgctgaatgtaaagattgaacctcaagtcactgtagctttagtaattgcttattgtattagtttagatgctagcactgcatgtgctgtgcatattctgattttattaaaataaaaagttgaactgcac

SEQ ID NO: 314408 - DNA, 2342 bp, Homo sapiens
ctttccccttactccgctcccctcttttccctccctctcctccccttccctctgttctctcctcctcttcccctcccctcccccgtccggggcactctatattcaagccaccgtttcctgcttcacaaaatggccaccgcacgcgacacctacggtcacgtggcctgccgccctctcagtttcgggaatctgcctagctcccactaaggggaggctacccgcggaagagcgagggcagattagaccggagaaatcccaccacatctccaagcccgggaactgagagaggaagaagagtgaaggccagtgttaggaaaaaaaaaaacaaaaacaaaaaaaacgaaaaacgaaagctgagtgcatagagttggaaaggggagcgaatgcgtaaggttggaaaggggggcgaagaggcctaggttaacattttcaggcgtcttagccggtggaaagcgggagacgcaagttctcgcgagatctcgagaactccgaggctgagactagggttttagcggagagcacgggaagtgtagctcgagagaactgggacagcatttcgcaccctaagctccaaggcaggactgctaggggcgacaggactaagtaggaaatcccttgagcttagacctgagggagcgcgcagtagccgggcagaagtcgccgcgacagggaattgcggtgtgagagggagggcacacgttgtacgtgctgacgtagccggctttccagcgggtatattagatccgtggccgcgcggtgcgctccagagccgcagttctcccgtgagagggccttcgcggtggaacaaacactcgcttagcagcggaagactccgagttctcggtactcttcagggatgagtcatgtggcagtggaaaatgcgctcgggctggaccagcagtttgctggcctagacctgaactcttcagataatcagagtggaggaagtacagccagcaaagggcgctatattcctcctcatttaaggaaccgagaagctactaaaggtttctacgataaagacagttcagggtggagttctagcaaagataaggatgcgtatagcagttttggatctcgtagtgattcaagagggaagtctagcttcttcagtgatcgtggaagtggatcaaggggaaggtttgatgatcgtggacggagtgattacgatggcattggcagccgtggtgacagaagtggctttggcaaatttgaacgtggtggaaacagtcgctggtgtgacaaatcagatgaagatgattggtcaaaaccactcccaccaagtgaacgcttggaacaggaactcttttctggaggcaacactgggattaattttgagaaatacgatgacattccagttgaggcaacaggcaacaactgtcctccacatattgaaagtttcagtgatgttgagatgggagaaattatcatgggaaacattgagcttactcgttatactcgcccaactccagtgcaaaagcatgctattcctattatcaaagagaaaagagacttgatggcttgtgcccaaacagggtctggaaaaactgcagcatttctgttgcccatcttgagtcagatttattcagatggtccaggcgaggctttgagggccatgaaggaaaatggaaggtatgggcgccgcaaacaatacccaatctccttggtattagcaccaacgagagagttggcagtacagatctacgaggaagccagaaaattttcataccgatctagagttcgtccttgcgtggtttatggtggtgccgatattggtcagcagattcgagacttggaacgtggatgccatttgttagtagccactccaggacgtctagtggatatgatggaaagaggaaagattggattagacttttgcaaatacttggtgttagatgaagctgatcggatgttggatatggggtttgagcctcagattcgtagaatagtcgaacaagatactatgcctccaaagggtgtccgccacactatgatgtttagtgctacttttcctaaggaaatacagctggttgcgaattttaaaaggaaattttttttggtgtttgaaaagtggcctacccttgaaacatccacccaaggtttttgggggaaatctacaaccggcattttgttacccttaaaggcagggagggttctgcccttagtttggggaccaaaggggtccattttggggagttttcccgaggggcctggtgcccatttgggaacattttaagggtaaaaaagcctcactttcttgagaaaccctttttgggcccggtttcggtgtgtttaagggagttatattcttcccgggtttgttcctcttgtgcccggggcgg

SEQ ID NO: 314409 - DNA, 401 bp, Homo sapiens
gctgggattacagacgtgggccaccacgcctggctaatattgtatatgtagtagagacggggtttctccatgttggtcaggctagtctcgaactcctgacctcaggtgacctgcccgccttggcctcccaaagtgctgggattacaggcgtgagccaccatgcctggccagtggacagtattttctagtggggagaattaaagaaaaactttgtccgggtgtaaaccagctttaaatcttggttctcttacagtgccatggtagggatagtcagtggaggctttcaaattcagaaagattgataataccttaacatggttcctatttctaattaataataaaatgtatttgtgcttttttaatcaaaggtttctacgataaagacagttcagggtggagtt

SEQ ID NO: 314410 - DNA, 378 bp, Homo sapiens
cctagacctgaactcttcagataatcagagtggaggaagtacagccagcagtaagtacaacatcttgtgggtttattgaatattagagcttaacatcttaagatttcattgggcttatgtaaaatttaagaaatttgcctttcaattttttactgcttaaagaattatgtagtctttgtgttatagaattatgtagtacttagtgatcaatctaaagcatcgttgccttttttttttttttttggttgagatggagctttgctcttgttgcccaggttggagtgcaatggtgtgatctcggctcaccgcagtctctgcctccgggttcaagcgattctcctgcctcagcctcccgaatagctgtgcctttctgataat

SEQ ID NO: 314411 - DNA, 3262 bp, Homo sapiens
ctttccccttactccgctcccctcttttccctccctctcctccccttccctctgttctctcctcctcttcccctcccctcccccgtccggggcactctatattcaagccaccgtttcctgcttcacaaaatggccaccgcacgcgacacctacggtcacgtggcctgccgccctctcagtttcgggaatctgcctagctcccactaaggggaggctacccgcggaagagcgagggcagattagaccggagaaatcccaccacatctccaagcccgggaactgagagaggaagaagagtgaaggccagtgttaggaaaaaaaaaaacaaaaacaaaaaaaacgaaaaacgaaagctgagtgcatagagttggaaaggggagcgaatgcgtaaggttggaaaggggggcgaagaggcctaggttaacattttcaggcgtcttagccggtggaaagcgggagacgcaagttctcgcgagatctcgagaactccgaggctgagactagggttttagcggagagcacgggaagtgtagctcgagagaactgggacagcatttcgcaccctaagctccaaggcaggactgctaggggcgacaggactaagtaggaaatcccttgagcttagacctgagggagcgcgcagtagccgggcagaagtcgccgcgacagggaattgcggtgtgagagggagggcacacgttgtacgtgctgacgtagccggctttccagcgggtatattagatccgtggccgcgcggtgcgctccagagccgcagttctcccgtgagagggccttcgcggtggaacaaacactcgcttagcagcggaagactccgagttctcggtactcttcagggatgagtcatgtggcagtggaaaatgcgctcgggctggaccagcagtttgctggcctagacctgaactcttcagataatcagagtggaggaagtacagccagcaaagggcgctatattcctcctcatttaaggaaccgagaagctactaaaggtttctacgataaagacagttcagggtggagttctagcaaagataaggatgcgtatagcagttttggatctcgtagtgattcaagagggaagtctagcttcttcagtgatcgtggaagtggatcaaggggaaggtttgatgatcgtggacggagtgattacgatggcattggcagccgtggtgacagaagtggctttggcaaatttgaacgtggtggaaacagtcgctggtgtgacaaatcagatgaagatgattggtcaaaaccactcccaccaagtgaacgcttggaacaggaactcttttctggaggcaacactgggattaattttgagaaatacgatgacattccagttgaggcaacaggcaacaactgtcctccacatattgaaagtttcagtgatgttgagatgggagaaattatcatgggaaacattgagcttactcgttatactcgcccaactccagtgcaaaagcatgctattcctattatcaaagagaaaagagacttgatggcttgtgcccaaacagggtctggaaaaactgcagcatttctgttgcccatcttgagtcagatttattcagatggtccaggcgaggctttgagggccatgaaggaaaatggaaggtatgggcgccgcaaacaatacccaatctccttggtattagcaccaacgagagagttggcagtacagatctacgaggaagccagaaaattttcataccgatctagagttcgtccttgcgtggtttatggtggtgccgatattggtcagcagattcgagacttggaacgtggatgccatttgttagtagccactccaggacgtctagtggatatgatggaaagaggaaagattggattagacttttgcaaatacttggtgttagatgaagctgatcggatgttggatatggggtttgagcctcagattcgtagaatagtcgaacaagatactatgcctccaaagggtgtccgccacactatgatgtttagtgctacttttcctaaggaaatacagatgctggctcgtgatttcttagatgaatatatcttcttggctgtaggaagagttggctctacctctgaaaacatcacacagaaagtagtttgggtggaagaatcagacaaacggtcatttctgcttgacctcctaaatgcaacaggcaaggattcactgaccttagtgtttgtggagaccaaaaagggtgcagattctctggaggatttcttataccatgaaggatacgcatgtaccagcatccatggagaccgttctcagagggatagagaagaggcccttcaccagttccgctcaggaaaaagcccaattttagtggctacagcagtagcagcaagaggactggacatttcaaatgtgaaacatgttatcaattttgacttgccaagtgatattgaagaatatgtacatcgtattggtcgtacgggacgtgtaggaaaccttggcctggcaacctcattctttaacgagaggaacataaatattactaaggatttgttggatcttcttgttgaagctaaacaagaagtgccgtcttggttagaaaacatggcttatgaacaccactacaagggtagcagtcgtggacgttctaagagtagcagatttagtggagggtttggtgccagagactaccgacaaagtagcggtgccagcagttccagcttcagcagcagccgcgcaagcagcagccgcagtggcggaggtggccacggtagcagcagaggatttggtggaggtggctatggaggcttttacaacagtgatggatatggaggaaattataactcccagggggttgactggtggggtaactgagcctgctttgcagtaggtcaccctgccaaacaagctaatatggaaaccacatgtaacttagccagactataccttgtgtagcttcaagaactcgcagtacattaccagctgtgattctccactgaaattttttttttaagggagctcaaggtcacaagaagaaatgaaaggaacaatcagcagccctgttcagaaggtggtttgaagacttcattgctgtagtttggattaactcccctcccgcctacccccatcccaaactgcatttataattttgtgactgaggatcatttgtttgttaatgtactgtgcctttaactttagacaactttttattttgatgtcctgttggctcagtaatgctcaagatatcaattgttttgacaaaataaatttactgaacttgggctaaaatca

SEQ ID NO: 314412 - DNA, 5804 bp, Homo sapiens
ctttccccttactccgctcccctcttttccctccctctcctccccttccctctgttctctcctcctcttcccctcccctcccccgtccggggcactctatattcaagccaccgtttcctgcttcacaaaatggccaccgcacgcgacacctacggtcacgtggcctgccgccctctcagtttcgggaatctgcctagctcccactaaggggaggctacccgcggaagagcgagggcagattagaccggagaaatcccaccacatctccaagcccgggaactgagagaggaagaagagtgaaggccagtgttaggaaaaaaaaaaacaaaaacaaaaaaaacgaaaaacgaaagctgagtgcatagagttggaaaggggagcgaatgcgtaaggttggaaaggggggcgaagaggcctaggttaacattttcaggcgtcttagccggtggaaagcgggagacgcaagttctcgcgagatctcgagaactccgaggctgagactagggttttagcggagagcacgggaagtgtagctcgagagaactgggacagcatttcgcaccctaagctccaaggcaggactgctaggggcgacaggactaagtaggaaatcccttgagcttagacctgagggagcgcgcagtagccgggcagaagtcgccgcgacagggaattgcggtgtgagagggagggcacacgttgtacgtgctgacgtagccggctttccagcgggtatattagatccgtggccgcgcggtgcgctccagagccgcagttctcccgtgagagggccttcgcggtggaacaaacactcgcttagcagcggaagactccgagttctcggtactcttcagggatgagtcatgtggcagtggaaaatgcgctcgggctggaccagcagtttgctggcctagacctgaactcttcagataatcagagtggaggaagtacagccagcaaagggcgctatattcctcctcatttaaggaaccgagaagctactaaaggtttctacgataaagacagttcagggtggagttctagcaaagataaggatgcgtatagcagttttggatctcgtagtgattcaagagggaagtctagcttcttcagtgatcgtggaagtggatcaaggggaaggtttgatgatcgtggacggagtgattacgatggcattggcagccgtggtgacagaagtggctttggcaaatttgaacgtggtggaaacagtcgctggtgtgacaaatcagatgaagatgattggtcaaaaccactcccaccaagtgaacgcttggaacaggaactcttttctggaggcaacactgggattaattttgagaaatacgatgacattccagttgaggcaacaggcaacaactgtcctccacatattgaaagtttcagtgatgttgagatgggagaaattatcatgggaaacattgagcttactcgttatactcgcccaactccagtgcaaaagcatgctattcctattatcaaagagaaaagagacttgatggcttgtgcccaaacagggtctggaaaaactgcagcatttctgttgcccatcttgagtcagatttattcagatggtccaggcgaggctttgagggccatgaaggaaaatggaaggtatgggcgccgcaaacaatacccaatctccttggtattagcaccaacgagagagttggcagtacagatctacgaggaagccagaaaattttcataccgatctagagttcgtccttgcgtggtttatggtggtgccgatattggtcagcagattcgagacttggaacgtggatgccatttgttagtagccactccaggacgtctagtggatatgatggaaagaggaaagattggattagacttttgcaaatacttggtgttagatgaagctgatcggatgttggatatggggtttgagcctcagattcgtagaatagtcgaacaagatactatgcctccaaagggtgtccgccacactatgatgtttagtgctacttttcctaaggaaatacagatgctggctcgtgatttcttagatgaatatatcttcttggctgtaggaagagttggctctacctctgaaaacatcacacagaaagtagtttgggtggaagaatcagacaaacggtcatttctgcttgacctcctaaatgcaacaggcaaggattcactgaccttagtgtttgtggagaccaaaaagggtgcagattctctggaggatttcttataccatgaaggatacgcatgtaccagcatccatggagaccgttctcagagggatagagaagaggcccttcaccagttccgctcaggaaaaagcccaattttagtggctacagcagtagcagcaagaggactggacatttcaaatgtgaaacatgttatcaattttgacttgccaagtgatattgaagaatatgtacatcgtattggtcgtacgggacgtgtaggaaaccttggcctggcaacctcattctttaacgagaggaacataaatattactaaggatttgttggatcttcttgttgaagctaaacaagaagtgccgtcttggttagaaaacatggcttatgaacaccactacaagggtagcagtcgtggacgttctaagagtagcagatttagtggagggtttggtgccagagactaccgacaaagtagcggtgccagcagttccagcttcagcagcagccgcgcaagcagcagccgcagtggcggaggtggccacggtagcagcagaggatttggtggaggtggctatggaggcttttacaacagtgatggatatggaggaaattataactcccagggggttgactggtggggtaactgagcctgctttgcagtaggtcaccctgccaaacaagctaatatggaaaccacatgtaacttagccagactataccttgtgtagcttcaagaactcgcagtacattaccagctgtgattctccactgaaattttttttttaagggagctcaaggtcacaagaagaaatgaaaggaacaatcagcagccctgttcagaaggtggtttgaagacttcattgctgtagtttggattaactcccctcccgcctacccccatcccaaactgcatttataattttgtgactgaggatcatttgtttgttaatgtactgtgcctttaactttagacaactttttattttgatgtcctgttggctcagtaatgctcaagatatcaattgttttgacaaaataaatttactgaacttgggctaaaatcaaaccttggcacacaggtgtgatacaacttaacaggaatcatcgattcatccataaataatataaggaaaaacttatgcggtagcctgcattagggctttttgatacttgcagattgggggaaaacaacaaatgtcttgaagcatattaatggaattagtttctaatgtggcaaactgtattaagttaaagttctgatttgctcactctatcctggataggtatttagaacctgatagtctttaagccattccagtcatgatgaggtgatgtatgaatacatgcatacattcaaagcactgttttcaaagttaatgcaagtaaatacagcaattcctctttcaacgtttaggcagatcattaattatgagctagccaaatgtgggcatactattacagggaaagtttaaaggtctgataacttgaaataggtttttaggagaattcatctacttagactttttaaatgcctgccataaatgaaattgaaatggtagaatggctgaccacagcaatgaccagccctcattagggccctggatgatttttggtctaataacgcatgctagtgttgatgttttttggtcaagagggtatgaacaggaagaattaaatgcagcaggctttattttaaatgccgattcacattactctgttcaagctgcgttgagatgttaaactggcttactatagacttcgtaaaaatggctccagaagagtaacaaactgaaatctttgagatcacacaggttggaaatatgtacataactgcacaaggtgtcaattctgctctacagtgcagttttagtcagttttagttgcataggtttccattgtatttatagtctgtttatgctaaatctggccaaagatgagcattgtccaccactaaaatgcctctgccactttgaattctgtgctaattttgtggccagaatgcggtgatcaaaacgctccatctttttacagtggcataggaagacggcaaaaatttcctaaagtgcaatagattttcaagtgtattgtgccttgttctaaaacttttattaagtaggtgcacttgacagtattgaggtcatttgttatggtgctatttcaattagtctaggtttaggcccttgtacattttgcccataactttttacaaagtacttcttttattgcacattcagagaattttatatatatgtcttgtgtgcgtgtccttaaacttccaatcttactttgtctcttggagattgttgaacgcagcttgtctaggaaggggatgggactagattctaaaatttatttgggaccatgggaatgatagttgggaagaaaactatttgcacacgacagatttctagatactttttgctgctagttttatgtaatatttattgaacattttgacaaatatttatttttgtaagcctaaaagtgattctttgaaagtttaaagaaacttgaccaaaagacagtacaaaaacactggcacttgaatgttgaatgtcaccgtatgcgtgaaattatatatttcggggtagtgtgagcttttaatgtttaagtcatattaaactcttaagtcaaattaagcagacccggcgttggcagtgtagccataactttctgatgttagtaaaaacaaaattggcgacttgaaattaaatcatgccaaggttttgatacacttgtcttaagatattaatgaaacacttcaaaacactgatgtgaagtgtccagattctcagatgtttgttgtgtggattttgtttagttgtgtgtttttttttttttttcagtgaatgtctggcacattgcaatcctcaaacatgtggttatctttgttgtattggcataatcagtgacttgtacattcagcaatagcatttgagcaagttttatcagcaagcaatattttcagttaataaggtttcaaaaatcatgtaaggatttaaacttgctgaatgtaaagattgaacctcaagtcactgtagctttagtaattgcttattgtattagtttagatgctagcactgcatgtgctgtgcatattctgattttattaaaataaaaagttgaactgcacaaaaaaaaaaaaaaaaaaaaaaaaaagggggggggggtaaaaaattattccctgggggggcccattttcgtgatccccacggcttttctgttgttaccaagggggcgcccctaatgaggggagaggccggatattaataaacgagcaaaaggcgcagggcgccggcggtgaaaacagccgcgtcgcgggcgggcggggaacacagccgctaccgtggggcacatcttgtggtgggagagggcaaccccttcaccttgcggggcggggggcgcccatactcgcgtgggcgaccaacaactaccccttgacggaaaatatttaataacgacccaagggcgaatatcacaaccttttcaagccggctttcttggtggttctactccgaagcgccgacattagtctggccgtatgaaaaaattggccgtccgggacattattctcttgaatacctttatgcgcggggtataaaaaga

SEQ ID NO: 314413 - DNA, 5277 bp, Homo sapiens
ctttccccttactccgctcccctcttttccctccctctcctccccttccctctgttctctcctcctcttcccctcccctcccccgtccggggcactctatattcaagccaccgtttcctgcttcacaaaatggccaccgcacgcgacacctacggtcacgtggcctgccgccctctcagtttcgggaatctgcctagctcccactaaggggaggctacccgcggaagagcgagggcagattagaccggagaaatcccaccacatctccaagcccgggaactgagagaggaagaagagtgaaggccagtgttaggaaaaaaaaaaacaaaaacaaaaaaaacgaaaaacgaaagctgagtgcatagagttggaaaggggagcgaatgcgtaaggttggaaaggggggcgaagaggcctaggttaacattttcaggcgtcttagccggtggaaagcgggagacgcaagttctcgcgagatctcgagaactccgaggctgagactagggttttagcggagagcacgggaagtgtagctcgagagaactgggacagcatttcgcaccctaagctccaaggcaggactgctaggggcgacaggactaagtaggaaatcccttgagcttagacctgagggagcgcgcagtagccgggcagaagtcgccgcgacagggaattgcggtgtgagagggagggcacacgttgtacgtgctgacgtagccggctttccagcgggtatattagatccgtggccgcgcggtgcgctccagagccgcagttctcccgtgagagggccttcgcggtggaacaaacactcgcttagcagcggaagactccgagttctcggtactcttcagggatgagtcatgtggcagtggaaaatgcgctcgggctggaccagcagtttgctggcctagacctgaactcttcagataatcagagtggaggaagtacagccagcaaagggcgctatattcctcctcatttaaggaaccgagaagctactaaaggtttctacgataaagacagttcagggtggagttctagcaaagataaggatgcgtatagcagttttggatctcgtagtgattcaagagggaagtctagcttcttcagtgatcgtggaagtggatcaaggggaaggtttgatgatcgtggacggagtgattacgatggcattggcagccgtggtgacagaagtggctttggcaaatttgaacgtggtggaaacagtcgctggtgtgacaaatcagatgaagatgattggtcaaaaccactcccaccaagtgaacgcttggaacaggaactcttttctggaggcaacactgggattaattttgagaaatacgatgacattccagttgaggcaacaggcaacaactgtcctccacatattgaaagtttcagtgatgttgagatgggagaaattatcatgggaaacattgagcttactcgttatactcgcccaactccagtgcaaaagcatgctattcctattatcaaagagaaaagagacttgatggcttgtgcccaaacagggtctggaaaaactgcagcatttctgttgcccatcttgagtcagatttattcagatggtccaggcgaggctttgagggccatgaaggaaaatggaaggtatgggcgccgcaaacaatacccaatctccttggtattagcaccaacgagagagttggcagtacagatctacgaggaagccagaaaattttcataccgatctagagttcgtccttgcgtggtttatggtggtgccgatattggtcagcagattcgagacttggaacgtggatgccatttgttagtagccactccaggacgtctagtggatatgatggaaagaggaaagattggattagacttttgcaaatacttggtgttagatgaagctgatcggatgttggatatggggtttgagcctcagattcgtagaatagtcgaacaagatactatgcctccaaagggtgtccgccacactatgatgtttagtgctacttttcctaaggaaatacagatgctggctcgtgatttcttagatgaatatatcttcttggctgtaggaagagttggctctacctctgaaaacatcacacagaaagtagtttgggtggaagaatcagacaaacggtcatttctgcttgacctcctaaatgcaacaggcaaggattcactgaccttagtgtttgtggagaccaaaaagggtgcagattctctggaggatttcttataccatgaaggatacgcatgtaccagcatccatggagaccgttctcagagggatagagaagaggcccttcaccagttccgctcaggaaaaagcccaattttagtggctacagcagtagcagcaagaggactggacatttcaaatgtgaaacatgttatcaattttgacttgccaagtgatattgaagaatatgtacatcgtattggtcgtacgggacgtgtaggaaaccttggcctggcaacctcattctttaacgagaggaacataaatattactaaggatttgttggatcttcttgttgaagctaaacaagaagtgccgtcttggttagaaaacatggcttatgaacaccactacaagggtagcagtcgtggacgttctaagagtagcagatttagtggagggtttggtgccagagactaccgacaaagtagcggtgccagcagttccagcttcagcagcagccgcgcaagcagcagccgcagtggcggaggtggccacggtagcagcagaggatttggtggaggtggctatggaggcttttacaacagtgatggatatggaggaaattataactcccagggggttgactggtggggtaactgagcctgctttgcagtaggtcaccctgccaaacaagctaatatggaaaccacatgtaacttagccagactataccttgtgtagcttcaagaactcgcagtacattaccagctgtgattctccactgaaattttttttttaagggagctcaaggtcacaagaagaaatgaaaggaacaatcagcagccctgttcagaaggtggtttgaagacttcattgctgtagtttggattaactcccctcccgcctacccccatcccaaactgcatttataattttgtgactgaggatcatttgtttgttaatgtactgtgcctttaactttagacaactttttattttgatgtcctgttggctcagtaatgctcaagatatcaattgttttgacaaaataaatttactgaacttgggctaaaatcaaaccttggcacacaggtgtgatacaacttaacaggaatcatcgattcatccataaataatataaggaaaaacttatgcggtagcctgcattagggctttttgatacttgcagattgggggaaaacaacaaatgtcttgaagcatattaatggaattagtttctaatgtggcaaactgtattaagttaaagttctgatttgctcactctatcctggataggtatttagaacctgatagtctttaagccattccagtcatgatgaggtgatgtatgaatacatgcatacattcaaagcactgttttcaaagttaatgcaagtaaatacagcaattcctctttcaacgtttaggcagatcattaattatgagctagccaaatgtgggcatactattacagggaaagtttaaaggtctgataacttgaaataggtttttaggagaattcatctacttagactttttaaatgcctgccataaatgaaattgaaatggtagaatggctgaccacagcaatgaccagccctcattagggccctggatgatttttggtctaataacgcatgctagtgttgatgttttttggtcaagagggtatgaacaggaagaattaaatgcagcaggctttattttaaatgccgattcacattactctgttcaagctgcgttgagatgttaaactggcttactatagacttcgtaaaaatggctccagaagagtaacaaactgaaatctttgagatcacacaggttggaaatatgtacataactgcacaaggtgtcaattctgctctacagtgcagttttagtcagttttagttgcataggtttccattgtatttatagtctgtttatgctaaatctggccaaagatgagcattgtccaccactaaaatgcctctgccactttgaattctgtgctaattttgtggccagaatgcggtgatcaaaacgctccatctttttacagtggcataggaagacggcaaaaatttcctaaagtgcaatagattttcaagtgtattgtgccttgttctaaaacttttattaagtaggtgcacttgacagtattgaggtcatttgttatggtgctatttcaattagtctaggtttaggcccttgtacattttgcccataactttttacaaagtacttcttttattgcacattcagagaattttatatatatgtcttgtgtgcgtgtccttaaacttccaatcttactttgtctcttggagattgttgaacgcagcttgtctaggaaggggatgggactagattctaaaatttatttgggaccatgggaatgatagttgggaagaaaactatttgcacacgacagatttctagatactttttgctgctagttttatgtaatatttattgaacattttgacaaatatttatttttgtaagcctaaaagtgattctttgaaagtttaaagaaacttgaccaaaagacagtacacggggtagtgtgagcttttaatgtttaagtcatattaaactcttaagtcaaattaagcagacccggcgttggcagtgtagccataactttctgatgttagtaaaaacaaaattggcgacttgaaattaaatcatgccaaggttttgatacacttgtcttaagatattaatgaaacacttcaaaacactgatgtgaagtgtccagattctcagatgtttgttgtgtggattttgtttagttgtgtgtttttttttttttttcagtgaatgtctggcacattgcaatcctcaaacatgtggttatctttgttgtattggcataatcagtgacttgtacattcagcaatagcatttgagcaagttttatcagcaagcaatattttcagttaataaggtttcaaaaatcatgtaaggatttaaacttgctgaatgtaaagattgaacctcaagtcactgtagctttagtaattgcttattgtattagtttagatgctagcactgcatgtgctgtgcatattctgattttattaaaataaaaagttgaactgcac

SEQ ID NO: 314414 - DNA, 4902 bp, Homo sapiens
ctttccccttactccgctcccctcttttccctccctctcctccccttccctctgttctctcctcctcttcccctcccctcccccgtccggggcactctatattcaagccaccgtttcctgcttcacaaaatggccaccgcacgcgacacctacggtcacgtggcctgccgccctctcagtttcgggaatctgcctagctcccactaaggggaggctacccgcggaagagcgagggcagattagaccggagaaatcccaccacatctccaagcccgggaactgagagaggaagaagagtgaaggccagtgttaggaaaaaaaaaaacaaaaacaaaaaaaacgaaaaacgaaagctgagtgcatagagttggaaaggggagcgaatgcgtaaggttggaaaggggggcgaagaggcctaggttaacattttcaggcgtcttagccggtggaaagcgggagacgcaagttctcgcgagatctcgagaactccgaggctgagactagggttttagcggagagcacgggaagtgtagctcgagagaactgggacagcatttcgcaccctaagctccaaggcaggactgctaggggcgacaggactaagtaggaaatcccttgagcttagacctgagggagcgcgcagtagccgggcagaagtcgccgcgacagggaattgcggtgtgagagggagggcacacgttgtacgtgctgacgtagccggctttccagcgggtatattagatccgtggccgcgcggtgcgctccagagccgcagttctcccgtgagagggccttcgcggtggaacaaacactcgcttagcagcggaagactccgagttctcggtactcttcagggatgagtcatgtggcagtggaaaatgcgctcgggctggaccagcagtttgctggcctagacctgaactcttcagataatcagagtggaggaagtacagccagcaaagggcgctatattcctcctcatttaaggaaccgagaagctactaaaggtttctacgataaagacagttcagggtggagttctagcaaagataaggatgcgtatagcagttttggatctcgtagtgattcaagagggaagtctagcttcttcagtgatcgtggaagtggatcaaggggaaggtttgatgatcgtggacggagtgattacgatggcattggcagccgtggtgacagaagtggctttggcaaatttgaacgtggtggaaacagtcgctggtgtgacaaatcagatgaagatgattggtcaaaaccactcccaccaagtgaacgcttggaacaggaactcttttctggaggcaacactgggattaattttgagaaatacgatgacattccagttgaggcaacaggcaacaactgtcctccacatattgaaagtttcagtgatgttgagatgggagaaattatcatgggaaacattgagcttactcgttatactcgcccaactccagtgcaaaagcatgctattcctattatcaaagagaaaagagacttgatggcttgtgcccaaacagggtctggaaaaactgcagcatttctgttgcccatcttgagtcagatttattcagatggtccaggcgaggctttgagggccatgaaggaaaatggaaggtatgggcgccgcaaacaatacccaatctccttggtattagcaccaacgagagagttggcagtacagatctacgaggaagccagaaaattttcataccgatctagagttcgtccttgcgtggtttatggtggtgccgatattggtcagcagattcgagacttggaacgtggatgccatttgttagtagccactccaggacgtctagtggatatgatggaaagaggaaagattggattagacttttgcaaatacttggtgttagatgaagctgatcggatgttggatatggggtttgagcctcagattcgtagaatagtcgaacaagatactatgcctccaaagggtgtccgccacactatgatgtttagtgctacttttcctaaggaaatacagatgctggctcgtgatttcttagatgaatatatcttcttggctgtaggaagagttggctctacctctgaaaacatcacacagaaagtagtttgggtggaagaatcagacaaacggtcatttctgcttgacctcctaaatgcaacaggcaaggattcactgaccttagtgtttgtggagaccaaaaagggtgcagattctctggaggatttcttataccatgaaggatacgcatgtaccagcatccatggagaccgttctcagagggatagagaagaggcccttcaccagttccgctcaggaaaaagcccaattttagtggctacagcagtagcagcaagaggactggacatttcaaatgtgaaacatgttatcaattttgacttgccaagtgatattgaagaatatgtacatcgtattggtcgtacgggacgtgtaggaaaccttggcctggcaacctcattctttaacgagaggaacataaatattactaaggatttgttggatcttcttgttgaagctaaacaagaagtgccgtcttggttagaaaacatggcttatgaacaccactacaagggtagcagtcgtggacgttctaagagtagcagatttagtggagggtttggtgccagagactaccgacaaagtagcggtgccagcagttccagcttcagcagcagccgcgcaagcagcagccgcagtggcggaggtggccacggtagcagcagaggatttggtggaggtggctatggaggcttttacaacagtgatggatatggaggaaattataactcccagggggttgactggtggggtaactgagcctgctttgcagtaggtcaccctgccaaacaagctaatatggaaaccacatgtaacttagccagactataccttgtgtagcttcaagaactcgcagtacattaccagctgtgattctccactgaaattttttttttaagggagctcaaggtcacaagaagaaatgaaaggaacaatcagcagccctgttcagaaggtggtttgaagacttcattgctgtagtttggattaactcccctcccgcctacccccatcccaaactgcatttataattttgtgactgaggatcatttgtttttaatgcaagtaaatacagcaattcctctttcaacgtttaggcagatcattaattatgagctagccaaatgtgggcatactattacagggaaagtttaaaggtctgataacttgaaataggtttttaggagaattcatctacttagactttttaaatgcctgccataaatgaaattgaaatggtagaatggctgaccacagcaatgaccagccctcattagggccctggatgatttttggtctaataacgcatgctagtgttgatgttttttggtcaagagggtatgaacaggaagaattaaatgcagcaggctttattttaaatgccgattcacattactctgttcaagctgcgttgagatgttaaactggcttactatagacttcgtaaaaatggctccagaagagtaacaaactgaaatctttgagatcacacaggttggaaatatgtacataactgcacaaggtgtcaattctgctctacagtgcagttttagtcagttttagttgcataggtttccattgtatttatagtctgtttatgctaaatctggccaaagatgagcattgtccaccactaaaatgcctctgccactttgaattctgtgctaattttgtggccagaatgcggtgatcaaaacgctccatctttttacagtggcataggaagacggcaaaaatttcctaaagtgcaatagattttcaagtgtattgtgccttgttctaaaacttttattaagtaggtgcacttgacagtattgaggtcatttgttatggtgctatttcaattagtctaggtttaggcccttgtacattttgcccataactttttacaaagtacttcttttattgcacattcagagaattttatatatatgtcttgtgtgcgtgtccttaaacttccaatcttactttgtctcttggagattgttgaacgcagcttgtctaggaaggggatgggactagattctaaaatttatttgggaccatgggaatgatagttgggaagaaaactatttgcacacgacagatttctagatactttttgctgctagttttatgtaatatttattgaacattttgacaaatatttatttttgtaagcctaaaagtgattctttgaaagtttaaagaaacttgaccaaaagacagtacaaaaacactggcacttgaatgttgaatgtcaccgtatgcgtgaaattatatatttcggggtagtgtgagcttttaatgtttaagtcatattaaactcttaagtcaaattaagcagacccggcgttggcagtgtagccataactttctgatgttagtaaaaacaaaattggcgacttgaaattaaatcatgccaaggttttgatacacttgtcttaagatattaatgaaacacttcaaaacactgatgtgaagtgtccagattctcagatgtttgttgtgtggattttgtttagttgtgtgtttttttttttttttcagtgaatgtctggcacattgcaatcctcaaacatgtggttatctttgttgtattggcataatcagtgacttgtacattcagcaatagcatttgagcaagttttatcagcaagcaatattttcagttaataaggtttcaaaaatcatgtaaggatttaaacttgctgaatgtaaagattgaacctcaagtcactgtagctttagtaattgcttattgtattagtttagatgctagcactgcatgtgctgtgcatattctgattttattaaaataaaaagttgaactgcac

SEQ ID NO: 314415 - DNA, 2997 bp, Homo sapiens
tgggcgcgctcaacccgggaaacagctagaggatgggtacatggctcatgtgaccgatgttatcaattttgacttgccaagtgatattgaagaatatgtacatcgtattggtcgtacgggacgtgtaggaaaccttggcctggcaacctcattctttaacgagaggaacataaatattactaaggatttgttggatcttcttgttgaagctaaacaagaagtgccgtcttggttagaaaacatggcttatgaacaccactacaagggtagcagtcgtggacgttctaagagtagcagatttagtggagggtttggtgccagagactaccgacaaagtagcggtgccagcagttccagcttcagcagcagccgcgcaagcagcagccgcagtggcggaggtggccacggtagcagcagaggatttggtggaggtggctatggaggcttttacaacagtgatggatatggaggaaattataactcccagggggttgactggtggggtaactgagcctgctttgcagtaggtcaccctgccaaacaagctaatatggaaaccacatgtaacttagccagactataccttgtgtagcttcaagaactcgcagtacattaccagctgtgattctccactgaaattttttttttaagggagctcaaggtcacaagaagaaatgaaaggaacaatcagcagccctgttcagaaggtggtttgaagacttcattgctgtagtttggattaactcccctcccgcctacccccatcccaaactgcatttataattttgtgactgaggatcatttgtttgttaatgtactgtgcctttaactttagacaactttttattttgatgtcctgttggctcagtaatgctcaagatatcaattgttttgacaaaataaatttactgaacttgggctaaaatcaaaccttggcacacaggtgtgatacaacttaacaggaatcatcgattcatccataaataatataaggaaaaacttatgcggtagcctgcattagggctttttgatacttgcagattgggggaaaacaacaaatgtcttgaagcatattaatggaattagtttctaatgtggcaaactgtattaagttaaagttctgatttgctcactctatcctggataggtatttagaacctgatagtctttaagccattccagtcatgatgaggtgatgtatgaatacatgcatacattcaaagcactgttttcaaagttaatgcaagtaaatacagcaattcctctttcaacgtttaggcagatcattaattatgagctagccaaatgtgggcatactattacagggaaagtttaaaggtctgataacttgaaataggtttttaggagaattcatctacttagactttttaaatgcctgccataaatgaaattgaaatggtagaatggctgaccacagcaatgaccagccctcattagggccctggatgatttttggtctaataacgcatgctagtgttgatgttttttggtcaagagggtatgaacaggaagaattaaatgcagcaggctttattttaaatgccgattcacattactctgttcaagctgcgttgagatgttaaactggcttactatagacttcgtaaaaatggctccagaagagtaacaaactgaaatctttgagatcacacaggttggaaatatgtacataactgcacaaggtgtcaattctgctctacagtgcagttttagtcagttttagttgcataggtttccattgtatttatagtctgtttatgctaaatctggccaaagatgagcattgtccaccactaaaatgcctctgccactttgaattctgtgctaattttgtggccagaatgcggtgatcaaaacgctccatctttttacagtggcataggaagacggcaaaaatttcctaaagtgcaatagattttcaagtgtattgtgccttgttctaaaacttttattaagtaggtgcacttgacagtattgaggtcatttgttatggtgctatttcaattagtctaggtttaggcccttgtacattttgcccataactttttacaaagtacttcttttattgcacattcagagaattttatatatatgtcttgtgtgcgtgtccttaaacttccaatcttactttgtctcttggagattgttgaacgcagcttgtctaggaaggggatgggactagattctaaaatttatttgggaccatgggaatgatagttgggaagaaaactatttgcacacgacagatttctagatactttttgctgctagttttatgtaatatttattgaacattttgacaaatatttatttttgtaagcctaaaagtgattctttgaaagtttaaagaaacttgaccaaaagacagtacaaaaacactggcacttgaatgttgaatgtcaccgtatgcgtgaaattatatatttcggggtagtgtgagcttttaatgtttaagtcatattaaactcttaagtcaaattaagcagacccggcgttggcagtgtagccataactttctgatgttagtaaaaacaaaattggcgacttgaaattaaatcatgccaaggttttgatacacttgtcttaagatattaatgaaacacttcaaaacactgatgtgaagtgtccagattctcagatgtttgttgtgtggattttgtttagttgtgtgtttttttttttttttcagtgaatgtctggcacattgcaatcctcaaacatgtggttatctttgttgtattggcataatcagtgacttgtacattcagcaatagcatttgagcaagttttatcagcaagcaatattttcagttaataaggtttcaaaaatcatgtaaggatttaaacttgctgaatgtaaagattgaacctcaagtcactgtagctttagtaattgcttattgtattagtttagatgctagcactgcatgtgctgtgcatattctgattttattaaaataaaaagttgaactgcac

SEQ ID NO: 314416 - DNA, 3182 bp, Homo sapiens
ctttccccttactccgctcccctcttttccctccctctcctccccttccctctgttctctcctcctcttcccctcccctcccccgtccggggcactctatattcaagccaccgtttcctgcttcacaaaatggccaccgcacgcgacacctacggtcacgtggcctgccgccctctcagtttcgggaatctgcctagctcccactaaggggaggctacccgcggaagagcgagggcagattagaccggagaaatcccaccacatctccaagcccgggaactgagagaggaagaagagtgaaggccagtgttaggaaaaaaaaaaacaaaaacaaaaaaaacgaaaaacgaaagctgagtgcatagagttggaaaggggagcgaatgcgtaaggttggaaaggggggcgaagaggcctaggttaacattttcaggcgtcttagccggtggaaagcgggagacgcaagttctcgcgagatctcgagaactccgaggctgagactagggttttagcggagagcacgggaagtgtagctcgagagaactgggacagcatttcgcaccctaagctccaaggcaggactgctaggggcgacaggactaagtaggaaatcccttgagcttagacctgagggagcgcgcagtagccgggcagaagtcgccgcgacagggaattgcggtgtgagagggagggcacacgttgtacgtgctgacgtagccggctttccagcgggtatattagatccgtggccgcgcggtgcgctccagagccgcagttctcccgtgagagggccttcgcggtggaacaaacactcgcttagcagcggaagactccgagttctcggtactcttcagggatgagtcatgtggcagtggaaaatgcgctcgggctggaccagcagtttgctggcctagacctgaactcttcagataatcagagtggaggaagtacagccagcaaagggcgctatattcctcctcatttaaggaaccgagaagctactaaaggtttctacgataaagacagttcagggtggagttctagcaaagataaggatgcgtatagcagttttggatctcgtagtgattcaagagggaagtctagcttcttcagtgatcgtggaagtggatcaaggggaaggtttgatgatcgtggacggagtgattacgatggcattggcagccgtggtgacagaagtggctttggcaaatttgaacgtggtggaaacagtcgctggtgtgacaaatcagatgaagatgattggtcaaaaccactcccaccaagtgaacgcttggaacaggaactcttttctggaggcaacactgggattaattttgagaaatacgatgacattccagttgaggcaacaggcaacaactgtcctccacatattgaaagtttcagtgatgttgagatgggagaaattatcatgggaaacattgagcttactcgttatactcgcccaactccagtgcaaaagcatgctattcctattatcaaagagaaaagagacttgatggcttgtgcccaaacagggtctggaaaaactgcagcatttctgttgcccatcttgagtcagatttattcagatggtccaggcgaggctttgagggccatgaaggaaaatggaaggtatgggcgccgcaaacaatacccaatctccttggtattagcaccaacgagagagttggcagtacagatctacgaggaagccagaaaattttcataccgatctagagttcgtccttgcgtggtttatggtggtgccgatattggtcagcagattcgagacttggaacgtggatgccatttgttagtagccactccaggacgtctagtggatatgatggaaagaggaaagattggattagacttttgcaaatacttggtgttagatgaagctgatcggatgttggatatggggtttgagcctcagattcgtagaatagtcgaacaagatactatgcctccaaagggtgtccgccacactatgatgtttagtgctacttttcctaaggaaatacagatgctggctcgtgatttcttagatgaatatatcttcttggctgtaggaagagttggctctacctctgaaaacatcacacagaaagtagtttgggtggaagaatcagacaaacggtcatttctgcttgacctcctaaatgcaacaggcaaggattcactgaccttagtgtttgtggagaccaaaaagggtgcagattctctggaggatttcttataccatgaaggatacgcatgtaccagcatccatggagaccgttctcagagggatagagaagaggcccttcaccagttccgctcaggaaaaagcccaattttagtggctacagcagtagcagcaagaggactggacatttcaaatgtgaaacatgttatcaattttgacttgccaagtgatattgaagaatatgtacatcgtattggtcgtacgggacgtgtaggaaaccttggcctggcaacctcattctttaacgagaggaacataaatattactaaggatttgttggatcttcttgttgaagctaaacaagaagtgccgtcttggttagaaaacatggcttatgaacaccactacaagggtagcagtcgtggacgttctaagagtagcagatttagtggagggtttggtgccagagactaccgacaaagtagcggtgccagcagttccagcttcagcagcagccgcgcaagcagcagccgcagtggcggaggtggccacggtagcagcagaggatttggtggaggtggctatggaggcttttacaacagtgatggatatggaggaaattataactcccagggggttgactggtggggtaactgagcctgctttgcagtaggtcaccctgccaaacaagctaatatggaaaccacatgtaacttagccagactataccttgtgtagcttcaagaactcgcatgtattggcataatcagtgacttgtacattcagcaatagcatttgagcaagttttatcagcaagcaatattttcagttaataaggtttcaaaaatcatgtaaggatttaaacttgctgaatgtaaagattgaacctcaagtcactgtagctttagtaattgcttattgtattagtttagatgctagcactgcatgtgctgtgcatattctgattttattaaaataaaaagttgaactgcac

SEQ ID NO: 314417 - DNA, 3835 bp, Homo sapiens
gcggccgccctgcgcgcgaagctcgtggcccgagaggggtgcggtcgggccgacggaggcggggccctggctgcctctctccctgctcataggctggccgctcaggcctggccggcctcggggcctcgggattcgcggcggcgctgccaatcaggcgatcgggccccgcccccccggagttgggtgaaatagaggcgggcgtcaagtgtcagtagtcgcggggcaggtacgtgcgctcgcggttctctcgcggaggtcggcggtggcgggagcgggctccggagagcctgagagcacggtggggcggggcgggagaaagtggccgcccggaggacgttggcgtttacgtgtggaagagcggaagagttttgcttttcgtgcgcgccttcgaaaactgcctgccgctgtctgaggagtccacccgaaacctcccctcctccgccggcagccccgcgctgagctcgccgacccaagccagcgtgggcgaggtgggaagtgcgcccgacccgcgcctggagctgcgcccccgagtgcccatggctacaagggtgctgagcatgagcgcccgcctgggacccgtgccccagccgccggcgccgcaggacgagccggtgttcgcgcagctcaagccggtgctgggcgccgcgaatccggcccgcgacgcggcgctcttccccggcgaggagctgaagcacgcgcaccaccgcccgcaggcgcagcccgcgcccgcgcaggccccgcagccggcccagccgcccgccaccggcccgcggctgcctccagaggacctggtccagacaagatgtgaaatggagaagtatctgacacctcagcttcctccagttcctataattccagagcataaaaagtatagacgagacagtgcctcagtcgtagaccagttcttcactgacactgaagggttaccttacagtatcaacatgaacgtcttcctccctgacatcactcacctgagaactggcctctacaaatcccagagaccgtgcgtaacacacatcaagacagaacctgttgccattttcagccaccagagtgaaacgactgcccctcctccggccccgacccaggccctccctgagttcaccagtatattcagctcacaccagaccgcagctccagaggtgaacaatattttcatcaaacaagaacttcctacaccagatcttcatctttctgtccctacccagcagggccacctgtaccagctactgaatacaccggatctagatatgcccagttctacaaatcagacagcagcaatggacactcttaatgtttctatgtcagctgccatggcaggccttaacacacacacctctgctgttccgcagactgcagtgaaacaattccagggcatgcccccttgcacatacacaatgccaagtcagtttcttccacaacaggccacttactttcccccgtcaccaccaagctcagagcctggaagtccagatagacaagcagagatgctccagaatttaaccccacctccatcctatgctgctacaattgcttctaaactggcaattcacaatccaaatttacccaccaccctgccagttaactcacaaaacatccaacctgtcagatacaatagaaggagtaaccccgatttggagaaacgacgcatccactactgcgattaccctggttgcacaaaagtttataccaagtcttctcatttaaaagctcacctgaggactcacactggtgaaaagccatacaagtgtacctgggaaggctgcgactggaggttcgcgcgatcggatgagctgacccgccactaccggaagcacacaggcgccaagcccttccagtgcggggtgtgcaaccgcagcttctcgcgctctgaccacctggccctgcatatgaagaggcaccagaactgagcactgcccgtgtgacccgttccaggtcccctgggctccctcaaatgacagacctaactattcctgtgtaaaaacaacaaaaacaaaaaaaaaacaagaaaaccacaactaaaactggaaatgtatattttgtatatttgagaaaacagggaatacattgtattaataccaaagtgtttggtcattttaagaatctggaatgcttgctgtaatgtatatggctttactcaagcagatctcatctcatgacaggcagccacgtctcaacatgggtaaggggtgggggtggaggggagtgtgtgcagcgtttttacctaggcaccatcatttaatgtgacagtgttcagtaaacaaatcagttggcaggcaccagaagaagaatggattgtatgtcaagattttacttggcattgagtagtttttttcaatagtaggtaattccttagagatacagtatacctggcaattcacaaatagccattgaacaaatgtgtgggtttttaaaaattatatacatatatgagttgcctatatttgctattcaaaattttgtaaatatgcaaatcagctttataggtttattacaagttttttaggattcttttggggaagagtcataattcttttgaaaataaccatgaatacacttacagttaggatttgtggtaaggtacctctcaacattaccaaaatcatttctttagagggaaggaataatcattcaaatgaactttaaaaaagcaaatttcatgcactgattaaaataggattattttaaatacaaaaggcattttatatgaattataaactgaagagcttaaagatagttacaaaatacaaaagttcaacctcttacaataagctaaacgcaatgtcatttttaaaaagaaggacttagggtgtcgttttcacatatgacaatgttgcatttatgatgcagtttcaagtaccaaaacgttgaattgatgatgcagttttcatatatcgagatgttcgctcgtgcagtactgttggttaaatgacaatttatgtggattttgcatgtaatacacagtgagacacagtaattttatctaaattacagtgcagtttagttaatctattaatactgactcagtgtctgcctttaaatataaatgatatgttgaaaacttaaggaagcaaatgctacatatatgcaatataaaatagtaatgtgatgctgatgctgttaaccaaagggcagaataaataagcaaaatgccaaaaggggtcttaattgaaatgaaaatttaattttgtttttaaaatattgtttatctttatttattttgtggtaatatagtaagtttttttagaagacaattttcataacttgataaattatagttttgtttgttagaaaagttgctcttaaaagatgtaaatagatgacaaacgatgtaaataattttgtaagaggcttcaaaatgtttatacgtggaaacacacctacatgaaaagcagaaatcggttgctgttttgcttctttttccctcttatttttgtattgtggtcatttcctatgcaaataatggagcaaacagctgtatagttgtagaattttttgagagaatgagatgtttatatattaacgacaattttttttttggaaaataaaaagtgcctaaaagaaaaaaaaaaaaaaaaaaaaaaaaaaagggaggaaggaaaaaggaaaaaagagaaaaaaaataaaaaaaaaaaaagagaagaggaaaggagggaccaaagaagacaacgaaaacagtggcaaaaaggtgggggcccagaggagaacacggggacgacgcagaaaaggaggagagagaattgagcccacactacaaaacgccccggggggcaaagagaagacgtgcacgaaaacaccccagaggagggcgagagggagcacaaagggggccaaa

SEQ ID NO: 314418 - DNA, 572 bp, Homo sapiens
attctgagactccccaagcagttaatactgactcagtgtctgcctttaaatataaatgatatgttgaaaacttaaggaagcaaatgctacatatatgcaatataaaatagtaatgtgatgctgatgctgttaaccaaagggcagaataaataagcaaaatgccaaaaggggtcttaattgaaatgaaaatttaattttgtttttaaaatattgtttatctttatttattttgtggtaatatagtaagtttttttagaagacaattttcataacttgataaattatagttttgtttgttagaaaagttgctcttaaaagatgtaaatagatgacaaacgatgtaaataattttgtaagaggcttcaaaatgtttatacgtggaaacacacctacatgaaaagcagaaatcggttgctgttttgcttctttttccctcttatttttgtattgtggtcatttcctatgcaaataatggagcaaacagctgtatagttgtagaattttttgagagaatgagatgtttatatattaacgacaattttttttttggaaaataaaaagtgcctaaaaga

SEQ ID NO: 314419 - DNA, 2355 bp, Homo sapiens
gcggccgccctgcgcgcgaagctcgtggcccgagaggggtgcggtcgggccgacggaggcggggccctggctgcctctctccctgctcataggctggccgctcaggcctggccggcctcggggcctcgggattcgcggcggcgctgccaatcaggcgatcgggccccgcccccccggagttgggtgaaatagaggcgggcgtcaagtgtcagtagtcgcggggcaggtacgtgcgctcgcggttctctcgcggaggtcggcggtggcgggagcgggctccggagagcctgagagcacggtggggcggggcgggagaaagtggccgcccggaggacgttggcgtttacgtgtggaagagcggaagagttttgcttttcgtgcgcgccttcgaaaactgcctgccgctgtctgaggagtccacccgaaacctcccctcctccgccggcagccccgcgctgagctcgccgacccaagccagcgtgggcgaggtgggaagtgcgcccgacccgcgcctggagctgcgcccccgagtgcccatggctacaagggtgctgagcatgagcgcccgcctgggacccgtgccccagccgccggcgccgcaggacgagccggtgttcgcgcagctcaagccggtgctgggcgccgcgaatccggcccgcgacgcggcgctcttccccggcgaggagctgaagcacgcgcaccaccgcccgcaggcgcagcccgcgcccgcgcaggccccgcagccggcccagccgcccgccaccggcccgcggctgcctccagaggacctggtccagacaagatgtgaaatggagaagtatctgacacctcagcttcctccagttcctataattccagagcataaaaagtatagacgagacagtgcctcagtcgtagaccagttcttcactgacactgaagggttaccttacagtatcaacatgaacgtcttcctccctgacatcactcacctgagaactggcctctacaaatcccagagaccgtgcgtaacacacatcaagacagaacctgttgccattttcagccaccagagtgaaacgactgcccctcctccggccccgacccaggccctccctgagttcaccagtatattcagctcacaccagaccgcagctccagaggtgaacaatattttcatcaaacaagaacttcctacaccagatcttcatctttctgtccctacccagcagggccacctgtaccagctactgaatacaccggatctagatatgcccagttctacaaatcagacagcagcaatggacactcttaatgtttctatgtcagctgccatggcaggccttaacacacacacctctgctgttccgcagactgcagtgaaacaattccagggcatgcccccttgcacatacacaatgccaagtcagtttcttccacaacaggccacttactttcccccgtcaccaccaagctcagagcctggaagtccagatagacaagcagagatgctccagaatttaaccccacctccatcctatgctgctacaattgcttctaaactggcaattcacaatccaaatttacccaccaccctgccagttaactcacaaaacatccaacctgtcagatacaatagaaggagtaaccccgatttggagaaacgacgcatccactactgcgattaccctggttgcacaaaagtttataccaagtcttctcatttaaaagctcacctgaggactcacactggtgaaaagccatacaagtgtacctgggaaggctgcgactggaggttcgcgcgatcggatgagctgacccgccactaccggaagcacacaggcgccaagcccttccagtgcggggtgtgcaaccgcagcttctcgcgctctgaccacctggccctgcatatgaagaggcaccagaactgagcactgcccgtgtgacccgttccaggtcccctgggctccctcaaatgacagacctaactattcctgtgtaaaaacaacaaaaacaaaaaaaaaacaagaaaaccacaactaaaactggaaatgtatattttgtatatttgagaaaacagggaatacattgtattaataccaaagtgtttggtcattttaagaatctggaatgcttgctgtaatgtatatggctttactcaagcagatctcatctcatgacaggcagccacgtctcaacatgggtaaggggtgggggtggaggggagtgtgtgcagcgtttttacctaggcaccatcatttaatgtgacagtgttcagtaaacaaatcagttggcagaagcaggaagcgcttcctgcttctgcccctgcttctgctgcttcctgcttctgccgtgccagactagagtcaagctcaa

SEQ ID NO: 314420 - DNA, 2853 bp, Homo sapiens
tcagagatgtgactcacatgatgagagcgttaatttttatttttaaatcatgtctatccgggaaaccccgtccgcatccacaccaagacaagatgtgaaatggagaagtatctgacacctcagcttcctccagttcctataattccagagcataaaaagtatagacgagacagtgcctcagtcgtagaccagttcttcactgacactgaagggttaccttacagtatcaacatgaacgtcttcctccctgacatcactcacctgagaactggcctctacaaatcccagagaccgtgcgtaacacacatcaagacagaacctgttgccattttcagccaccagagtgaaacgactgcccctcctccggccccgacccaggccctccctgagttcaccagtatattcagctcacaccagaccgcagctccagaggtgaacaatattttcatcaaacaagaacttcctacaccagatcttcatctttctgtccctacccagcagggccacctgtaccagctactgaatacaccggatctagatatgcccagttctacaaatcagacagcagcaatggacactcttaatgtttctatgtcagctgccatggcaggccttaacacacacacctctgctgttccgcagactgcagtgaaacaattccagggcatgcccccttgcacatacacaatgccaagtcagtttcttccacaacaggccacttactttcccccgtcaccaccaagctcagagcctggaagtccagatagacaagcagagatgctccagaatttaaccccacctccatcctatgctgctacaattgcttctaaactggcaattcacaatccaaatttacccaccaccctgccagttaactcacaaaacatccaacctgtcagatacaatagaaggagtaaccccgatttggagaaacgacgcatccactactgcgattaccctggttgcacaaaagtttataccaagtcttctcatttaaaagctcacctgaggactcacactggtgaaaagccatacaagtgtacctgggaaggctgcgactggaggttcgcgcgatcggatgagctgacccgccactaccggaagcacacaggcgccaagcccttccagtgcggggtgtgcaaccgcagcttctcgcgctctgaccacctggccctgcatatgaagaggcaccagaactgagcactgcccgtgtgacccgttccaggtcccctgggctccctcaaatgacagacctaactattcctgtgtaaaaacaacaaaaacaaaaaaaaaacaagaaaaccacaactaaaactggaaatgtatattttgtatatttgagaaaacagggaatacattgtattaataccaaagtgtttggtcattttaagaatctggaatgcttgctgtaatgtatatggctttactcaagcagatctcatctcatgacaggcagccacgtctcaacatgggtaaggggtgggggtggaggggagtgtgtgcagcgtttttacctaggcaccatcatttaatgtgacagtgttcagtaaacaaatcagttggcaggcaccagaagaagaatggattgtatgtcaagattttacttggcattgagtagtttttttcaatagtaggtaattccttagagatacagtatacctggcaattcacaaatagccattgaacaaatgtgtgggtttttaaaaattatatacatatatgagttgcctatatttgctattcaaaattttgtaaatatgcaaatcagctttataggtttattacaagttttttaggattcttttggggaagagtcataattcttttgaaaataaccatgaatacacttacagttaggatttgtggtaaggtacctctcaacattaccaaaatcatttctttagagggaaggaataatcattcaaatgaactttaaaaaagcaaatttcatgcactgattaaaataggattattttaaatacaaaaggcattttatatgaattataaactgaagagcttaaagatagttacaaaatacaaaagttcaacctcttacaataagctaaacgcaatgtcatttttaaaaagaaggacttagggtgtcgttttcacatatgacaatgttgcatttatgatgcagtttcaagtaccaaaacgttgaattgatgatgcagttttcatatatcgagatgttcgctcgtgcagtactgttggttaaatgacaatttatgtggattttgcatgtaatacacagtgagacacagtaattttatctaaattacagtgcagtttagttaatctattaatactgactcagtgtctgcctttaaatataaatgatatgttgaaaacttaaggaagcaaatgctacatatatgcaatataaaatagtaatgtgatgctgatgctgttaaccaaagggcagaataaataagcaaaatgccaaaaggggtcttaattgaaatgaaaatttaattttgtttttaaaatattgtttatctttatttattttgtggtaatatagtaagtttttttagaagacaattttcataacttgataaattatagttttgtttgttagaaaagttgctcttaaaagatgtaaatagatgacaaacgatgtaaataattttgtaagaggcttcaaaatgtttatacgtggaaacacacctacatgaaaagcagaaatcggttgctgttttgcttctttttccctcttatttttgtattgtggtcatttcctatgcaaataatggagcaaacagctgtatagttgtagaattttttgagagaatgagatgtttatatattaacgacaattttttttttggaaaataaaaagtgcctaaaaga

SEQ ID NO: 314421 - DNA, 2936 bp, Homo sapiens
gttattacacaatcgacaaaataagcctgatatgtttataagcaacactgaggagtttgccctagtaccttacacagggattgggggaatttttagtaggcgccgattgttcgttcttcccgagatggtgaatcaggtggattatgcattttatatctcttcttttttagacaagatgtgaaatggagaagtatctgacacctcagcttcctccagttcctataattccagagcataaaaagtatagacgagacagtgcctcagtcgtagaccagttcttcactgacactgaagggttaccttacagtatcaacatgaacgtcttcctccctgacatcactcacctgagaactggcctctacaaatcccagagaccgtgcgtaacacacatcaagacagaacctgttgccattttcagccaccagagtgaaacgactgcccctcctccggccccgacccaggccctccctgagttcaccagtatattcagctcacaccagaccgcagctccagaggtgaacaatattttcatcaaacaagaacttcctacaccagatcttcatctttctgtccctacccagcagggccacctgtaccagctactgaatacaccggatctagatatgcccagttctacaaatcagacagcagcaatggacactcttaatgtttctatgtcagctgccatggcaggccttaacacacacacctctgctgttccgcagactgcagtgaaacaattccagggcatgcccccttgcacatacacaatgccaagtcagtttcttccacaacaggccacttactttcccccgtcaccaccaagctcagagcctggaagtccagatagacaagcagagatgctccagaatttaaccccacctccatcctatgctgctacaattgcttctaaactggcaattcacaatccaaatttacccaccaccctgccagttaactcacaaaacatccaacctgtcagatacaatagaaggagtaaccccgatttggagaaacgacgcatccactactgcgattaccctggttgcacaaaagtttataccaagtcttctcatttaaaagctcacctgaggactcacactggtgaaaagccatacaagtgtacctgggaaggctgcgactggaggttcgcgcgatcggatgagctgacccgccactaccggaagcacacaggcgccaagcccttccagtgcggggtgtgcaaccgcagcttctcgcgctctgaccacctggccctgcatatgaagaggcaccagaactgagcactgcccgtgtgacccgttccaggtcccctgggctccctcaaatgacagacctaactattcctgtgtaaaaacaacaaaaacaaaaaaaaaacaagaaaaccacaactaaaactggaaatgtatattttgtatatttgagaaaacagggaatacattgtattaataccaaagtgtttggtcattttaagaatctggaatgcttgctgtaatgtatatggctttactcaagcagatctcatctcatgacaggcagccacgtctcaacatgggtaaggggtgggggtggaggggagtgtgtgcagcgtttttacctaggcaccatcatttaatgtgacagtgttcagtaaacaaatcagttggcaggcaccagaagaagaatggattgtatgtcaagattttacttggcattgagtagtttttttcaatagtaggtaattccttagagatacagtatacctggcaattcacaaatagccattgaacaaatgtgtgggtttttaaaaattatatacatatatgagttgcctatatttgctattcaaaattttgtaaatatgcaaatcagctttataggtttattacaagttttttaggattcttttggggaagagtcataattcttttgaaaataaccatgaatacacttacagttaggatttgtggtaaggtacctctcaacattaccaaaatcatttctttagagggaaggaataatcattcaaatgaactttaaaaaagcaaatttcatgcactgattaaaataggattattttaaatacaaaaggcattttatatgaattataaactgaagagcttaaagatagttacaaaatacaaaagttcaacctcttacaataagctaaacgcaatgtcatttttaaaaagaaggacttagggtgtcgttttcacatatgacaatgttgcatttatgatgcagtttcaagtaccaaaacgttgaattgatgatgcagttttcatatatcgagatgttcgctcgtgcagtactgttggttaaatgacaatttatgtggattttgcatgtaatacacagtgagacacagtaattttatctaaattacagtgcagtttagttaatctattaatactgactcagtgtctgcctttaaatataaatgatatgttgaaaacttaaggaagcaaatgctacatatatgcaatataaaatagtaatgtgatgctgatgctgttaaccaaagggcagaataaataagcaaaatgccaaaaggggtcttaattgaaatgaaaatttaattttgtttttaaaatattgtttatctttatttattttgtggtaatatagtaagtttttttagaagacaattttcataacttgataaattatagttttgtttgttagaaaagttgctcttaaaagatgtaaatagatgacaaacgatgtaaataattttgtaagaggcttcaaaatgtttatacgtggaaacacacctacatgaaaagcagaaatcggttgctgttttgcttctttttccctcttatttttgtattgtggtcatttcctatgcaaataatggagcaaacagctgtatagttgtagaattttttgagagaatgagatgtttatatattaacgacaattttttttttggaaaataaaaagtgcctaaaaga

SEQ ID NO: 314422 - DNA, 3425 bp, Homo sapiens
gcggccgccctgcgcgcgaagctcgtggcccgagaggggtgcggtcgggccgacggaggcggggccctggctgcctctctccctgctcataggctggccgctcaggcctggccggcctcggggcctcgggattcgcggcggcgctgccaatcaggcgatcgggccccgcccccccggagttgggtgaaatagaggcgggcgtcaagtgtcagtagtcgcggggcaggtacgtgcgctcgcggttctctcgcggaggtcggcggtggcgggagcgggctccggagagcctgagagcacggtggggcggggcgggagaaagtggccgcccggaggacgttggcgtttacgtgtggaagagcggaagagttttgcttttcgtgcgcgccttcgaaaactgcctgccgctgtctgaggagtccacccgaaacctcccctcctccgccggcagccccgcgctgagctcgccgacccaagccagcgtgggcgaggtgggaagtgcgcccgacccgcgcctggagctgcgcccccgagtgcccatggctacaagggtgctgagcatgagcgcccgcctgggacccgtgccccagccgccggcgccgcaggacgagccggtgttcgcgcagctcaagccggtgctgggcgccgcgaatccggcccgcgacgcggcgctcttccccggcgaggagctgaagcacgcgcaccaccgcccgcaggcgcagcccgcgcccgcgcaggccccgcagccggcccagccgcccgccaccggcccgcggctgcctccagaggacctggtccagacaagatgtgaaatggagaagtatctgacacctcagcttcctccagttcctataattccagagcataaaaagtatagacgagacagtgcctcagtcgtagaccagttcttcactgacactgaagggttaccttacagtatcaacatgaacgtcttcctccctgacatcactcacctgagaactggcctctacaaatcccagagaccgtgcgtaacacacatcaagacagaacctgttgccattttcagccaccagagtgaaacgactgcccctcctccggccccgacccaggccctccctgagttcaccagtatattcagctcacaccagaccgcagctccagaggtgaacaatattttcatcaaacaagaacttcctacaccagatcttcatctttctgtccctacccagcagggccacctgtaccagctactgaatacaccggatctagatatgcccagttctacaaatcagacagcagcaatggacactcttaatgtttctatgtcagctgccatggcaggccttaacacacacacctctgctgttccgcagactgcagtgaaacaattccagggcatgcccccttgcacatacacaatgccaagtcagtttcttccacaacaggccacttactttcccccgtcaccaccaagctcagagcctggaagtccagatagacaagcagagatgctccagaatttaaccccacctccatcctatgctgctacaattgcttctaaactggcaattcacaatccaaatttacccaccaccctgccagttaactcacaaaacatccaacctgtcagatacaatagaaggagtaaccccgatttggagaaacgacgcatccactactgcgattaccctggttgcacaaaagtttataccaagtcttctcatttaaaagctcacctgaggactcacactggtgaaaagccatacaagtgtacctgggaaggctgcgactggaggttcgcgcgatcggatgagctgacccgccactaccggaagcacacaggcgccaagcccttccagtgcggggtgtgcaaccgcagcttctcgcgctctgaccacctggccctgcatatgaagaggcaccagaactgagcactgcccgtgtgacccgttccaggtcccctgggctccctcaaatttttaagaatctggaatgcttgctgtaatgtatatggctttactcaagcagatctcatctcatgacaggcagccacgtctcaacatgggtaaggggtgggggtggaggggagtgtgtgcagcgtttttacctaggcaccatcatttaatgtgacagtgttcagtaaacaaatcagttggcaggcaccagaagaagaatggattgtatgtcaagattttacttggcattgagtagtttttttcaatagtaggtaattccttagagatacagtatacctggcaattcacaaatagccattgaacaaatgtgtgggtttttaaaaattatatacatatatgagttgcctatatttgctattcaaaattttgtaaatatgcaaatcagctttataggtttattacaagttttttaggattcttttggggaagagtcataattcttttgaaaataaccatgaatacacttacagttaggatttgtggtaaggtacctctcaacattaccaaaatcatttctttagagggaaggaataatcattcaaatgaactttaaaaaagcaaatttcatgcactgattaaaataggattattttaaatacaaaaggcattttatatgaattataaactgaagagcttaaagatagttacaaaatacaaaagttcaacctcttacaataagctaaacgcaatgtcatttttaaaaagaaggacttagggtgtcgttttcacatatgacaatgttgcatttatgatgcagtttcaagtaccaaaacgttgaattgatgatgcagttttcatatatcgagatgttcgctcgtgcagtactgttggttaaatgacaatttatgtggattttgcatgtaatacacagtgagacacagtaattttatctaaattacagtgcagtttagttaatctattaatactgactcagtgtctgcctttaaatataaatgatatgttgaaaacttaaggaagcaaatgctacatatatgcaatataaaatagtaatgtgatgctgatgctgttaaccaaagggcagaataaataagcaaaatgccaaaaggggtcttaattgaaatgaaaatttaattttgtttttaaaatattgtttatctttatttattttgtggtaatatagtaagtttttttagaagacaattttcataacttgataaattatagttttgtttgttagaaaagttgctcttaaaagatgtaaatagatgacaaacgatgtaaataattttgtaagaggcttcaaaatgtttatacgtggaaacacacctacatgaaaagcagaaatcggttgctgttttgcttctttttccctcttatttttgtattgtggtcatttcctatgcaaataatggagcaaacagctgtatagttgtagaattttttgagagaatgagatgtttatatattaacgacaattttttttttggaaaataaaaagtgcctaaaaga

SEQ ID NO: 314423 - DNA, 2814 bp, Homo sapiens
gcggccgccctgcgcgcgaagctcgtggcccgagaggggtgcggtcgggccgacggaggcggggccctggctgcctctctccctgctcataggctggccgctcaggcctggccggcctcggggcctcgggattcgcggcggcgctgccaatcaggcgatcgggccccgcccccccggagttgggtgaaatagaggcgggcgtcaagtgtcagtagtcgcggggcaggtacgtgcgctcgcggttctctcgcggaggtcggcggtggcgggagcgggctccggagagcctgagagcacggtggggcggggcgggagaaagtggccgcccggaggacgttggcgtttacgtgtggaagagcggaagagttttgcttttcgtgcgcgccttcgaaaactgcctgccgctgtctgaggagtccacccgaaacctcccctcctccgccggcagccccgcgctgagctcgccgacccaagccagcgtgggcgaggtgggaagtgcgcccgacccgcgcctggagctgcgcccccgagtgcccatggctacaagggtgctgagcatgagcgcccgcctgggacccgtgccccagccgccggcgccgcaggacgagccggtgttcgcgcagctcaagccggtgctgggcgccgcgaatccggcccgcgacgcggcgctcttccccggcgaggagctgaagcacgcgcaccaccgcccgcaggcgcagcccgcgcccgcgcaggccccgcagccggcccagccgcccgccaccggcccgcggctgcctccagaggacctggtccagacaagatgtgaaatggagaagtatctgacacctcagcttcctccagttcctataattccagagcataaaaagtatagacgagacagtgcctcagtcgtagaccagttcttcactgacactgaagggttaccttacagtatcaacatgaacgtcttcctccctgacatcactcacctgagaactggcctctacaaatcccagagaccgtgcgtaacacacatcaagacagaacctgttgccattttcagccaccagagtgaaacgactgcccctcctccggccccgacccaggccctccctgagttcaccagtatattcagctcacaccagaccgcagctccagaggtgaacaatattttcatcaaacaagaacttcctacaccagatcttcatctttctgtccctacccagcagggccacctgtaccagctactgaatacaccggatctagatatgcccagttctacaaatcagacagcagcaatggacactcttaatgtttctatgtcagctgccatggcaggccttaacacacacacctctgctgttccgcagactgcagtgaaacaattccagggcatgcccccttgcacatacacaatgccaagtcagtttcttccacaacaggccacttactttcccccgtcaccaccaagctcagagcctggaagtccagatagacaagcagagatgctccagaatttaaccccacctccatcctatgctgctacaattgcttctaaactggcaattcacaatccaaatttacccaccaccctgccagttaactcacaaaacatccaacctgtcagatacagtatacctggcaattcacaaatagccattgaacaaatgtgtgggtttttaaaaattatatacatatatgagttgcctatatttgctattcaaaattttgtaaatatgcaaatcagctttataggtttattacaagttttttaggattcttttggggaagagtcataattcttttgaaaataaccatgaatacacttacagttaggatttgtggtaaggtacctctcaacattaccaaaatcatttctttagagggaaggaataatcattcaaatgaactttaaaaaagcaaatttcatgcactgattaaaataggattattttaaatacaaaaggcattttatatgaattataaactgaagagcttaaagatagttacaaaatacaaaagttcaacctcttacaataagctaaacgcaatgtcatttttaaaaagaaggacttagggtgtcgttttcacatatgacaatgttgcatttatgatgcagtttcaagtaccaaaacgttgaattgatgatgcagttttcatatatcgagatgttcgctcgtgcagtactgttggttaaatgacaatttatgtggattttgcatgtaatacacagtgagacacagtaattttatctaaattacagtgcagtttagttaatctattaatactgactcagtgtctgcctttaaatataaatgatatgttgaaaacttaaggaagcaaatgctacatatatgcaatataaaatagtaatgtgatgctgatgctgttaaccaaagggcagaataaataagcaaaatgccaaaaggggtcttaattgaaatgaaaatttaattttgtttttaaaatattgtttatctttatttattttgtggtaatatagtaagtttttttagaagacaattttcataacttgataaattatagttttgtttgttagaaaagttgctcttaaaagatgtaaatagatgacaaacgatgtaaataattttgtaagaggcttcaaaatgtttatacgtggaaacacacctacatgaaaagcagaaatcggttgctgttttgcttctttttccctcttatttttgtattgtggtcatttcctatgcaaataatggagcaaacagctgtatagttgtagaattttttgagagaatgagatgtttatatattaacgacaattttttttttggaaaataaaaagtgcctaaaaga

SEQ ID NO: 314424 - DNA, 425 bp, Homo sapiens
gcagttttaccagttacacagagtttcataaggttttggtcaaccagttattacacaatcgacaaaataagcctgatatgtttataagcaacactgaggagtttgccctagtaccttacacagggattgggggaatttttagtaggcgccgattgttcgttcttcccgagatggtgaatcaggtggattatgcattttatatctcttcttttttagacaagatgtgaaatggagaagtatctgacacctcagcttcctccagttcctataattccagagcataaaaagtatagacgagacagtgcctcagtcgtagaccagttcttcactgacactgaagggttaccttacagtatcaacatgaacgtcttcctccctgacatcactcacctgagaactggcctctacaaatcccagagaccgtg

SEQ ID NO: 314425 - DNA, 436 bp, Homo sapiens
tctttgaaattccttctccggtgttatctaggatgtttgcattacaagcaggccgctttacctcctttgttcgttgtcacaggtgtgaaaagccatacaagtgtacctgggaaggctgcgactggaggttcgcgcgatcggatgagctgacccgccactaccggaagcacacaggcgccaagcccttccagtgcggggtgtgcaaccgcagcttctcgcgctctgaccacctggccctgcatatgaagaggcaccagaactgagcactgcccgtgtgacccgttccaggtcccctgggctccctcaaatgacagacctaactattcctgtgtaaaaacaacaaaaacaaaaaaaaaacaagaaaaccacaactaaaactggaaatgtatattttgtatatttgagaaaacagggaatacattgtattaataccaaa

SEQ ID NO: 314426 - DNA, 3563 bp, Homo sapiens
gcggccgccctgcgcgcgaagctcgtggcccgagaggggtgcggtcgggccgacggaggcggggccctggctgcctctctccctgctcataggctggccgctcaggcctggccggcctcggggcctcgggattcgcggcggcgctgccaatcaggcgatcgggccccgcccccccggagttgggtgaaatagaggcgggcgtcaagtgtcagtagtcgcggggcaggtacgtgcgctcgcggttctctcgcggaggtcggcggtggcgggagcgggctccggagagcctgagagcacggtggggcggggcgggagaaagtggccgcccggaggacgttggcgtttacgtgtggaagagcggaagagttttgcttttcgtgcgcgccttcgaaaactgcctgccgctgtctgaggagtccacccgaaacctcccctcctccgccggcagccccgcgctgagctcgccgacccaagccagcgtgggcgaggtgggaagtgcgcccgacccgcgcctggagctgcgcccccgagtgcccatggctacaagggtgctgagcatgagcgcccgcctgggacccgtgccccagccgccggcgccgcaggacgagccggtgttcgcgcagctcaagccggtgctgggcgccgcgaatccggcccgcgacgcggcgctcttccccggcgaggagctgaagcacgcgcaccaccgcccgcaggcgcagcccgcgcccgcgcaggccccgcagccggcccagccgcccgccaccggcccgcggctgcctccagaggacctggtccagacaagatgtgaaatggagaagtatctgacacctcagcttcctccagttcctataattccagagcataaaaagtatagacgagacagtgcctcagtcgtagaccagttcttcactgacactgaagggttaccttacagtatcaacatgaacgtcttcctccctgacatcactcacctgagaactggcctctacaaatcccagagaccgtgcgtaacacacatcaagacagaacctgttgccattttcagccaccagagtgaaacgactgcccctcctccggccccgacccaggccctccctgagttcaccagtatattcagctcacaccagaccgcagctccagaggtgaacaatattttcatcaaacaagaacttcctacaccagatcttcatctttctgtccctacccagcagggccacctgtaccagctactgaatacaccggatctagatatgcccagttctacaaatcagacagcagcaatggacactcttaatgtttctatgtcagctgccatggcaggccttaacacacacacctctgctgttccgcagactgcagtgaaacaattccagggcatgcccccttgcacatacacaatgccaagtcagtttcttccacaacaggccacttactttcccccgtcaccaccaagctcagagcctggaagtccagatagacaagcagagatgctccagaatttaaccccacctccatcctatgctgctacaattgcttctaaactggcaattcacaatccaaatttacccaccaccctgccagttaactcacaaaacatccaacctgtcagatacaatagaaggagtaaccccgatttggagaaacgacgcatccactactgcgattaccctggttgcacaaaagtttataccaagtcttctcatttaaaagctcacctgaggactcacactggtgaaaagccatacaagtgtacctgggaaggctgcgactggaggttcgcgcgatcggatgagctgacccgccactaccggaagcacacaggcgccaagcccttccagtgcggggtgtgcaaccgcagcttctcgcgctctgaccacctggccctgcatatgaagaggcaccagaactgagcactgcccgtgtgacccgttccaggtcccctgggctccctcaaatgacagacctaactattcctgtgtaaaaacaacaaaaacaaaaaaaaaacaagaaaaccacaactaaaactggaaatgtatattttgtatatttgagaaaacagggaatacattgtattaataccaaagtgtttggtcattttaagaatctggaatgcttgctgtaatgtatatggctttactcaagcagatctcatctcatgacaggcagccacgtctcaacatgggtaaggggtgggggtggaggggagtgtgtgcagcgtttttacctaggcaccatcatttaatgtgacagtgttcagtaaacaaatcagttggcaggcaccagaagaagaatggattgtatgtcaagattttacttggcattgagtagtttttttcaatagtaggtaattccttagagatacagtatacctggcaattcacaaatagccattgaacaaatgtgtgggtttttaaaaattatatacatatatgagttgcctatatttgctattcaaaattttgtaaatatgcaaatcagctttataggtttattacaagttttttaggattcttttggggaagagtcataattcttttgaaaataaccatgaatacacttacagttaggatttgtggtaaggtacctctcaacattaccaaaatcatttctttagagggaaggaataatcattcaaatgaactttaaaaaagcaaatttcatgcactgattaaaataggattattttaaatacaaaaggcattttatatgaattataaactgaagagcttaaagatagttacaaaatacaaaagttcaacctcttacaataagctaaacgcaatgtcatttttaaaaagaaggacttagggtgtcgttttcacatatgacaatgttgcatttatgatgcagtttcaagtaccaaaacgttgaattgatgatgcagttttcatatatcgagatgttcgctcgtgcagtactgttggttaaatgacaatttatgtggattttgcatgtaatacacagtgagacacagtaattttatctaaattacagtgcagtttagttaatctattaatactgactcagtgtctgcctttaaatataaatgatatgttgaaaacttaaggaagcaaatgctacatatatgcaatataaaatagtaatgtgatgctgatgctgttaaccaaagggcagaataaataagcaaaatgccaaaaggggtcttaattgaaatgaaaatttaattttgtttttaaaatattgtttatctttatttattttgtggtaatatagtaagtttttttagaagacaattttcataacttgataaattatagttttgtttgttagaaaagttgctcttaaaagatgtaaatagatgacaaacgatgtaaataattttgtaagaggcttcaaaatgtttatacgtggaaacacacctacatgaaaagcagaaatcggttgctgttttgcttctttttccctcttatttttgtattgtggtcatttcctatgcaaataatggagcaaacagctgtatagttgtagaattttttgagagaatgagatgtttatatattaacgacaattttttttttggaaaataaaaagtgcctaaaaga

SEQ ID NO: 314427 - DNA, 2475 bp, Homo sapiens
gcggccgccctgcgcgcgaagctcgtggcccgagaggggtgcggtcgggccgacggaggcggggccctggctgcctctctccctgctcataggctggccgctcaggcctggccggcctcggggcctcgggattcgcggcggcgctgccaatcaggcgatcgggccccgcccccccggagttgggtgaaatagaggcgggcgtcaagtgtcagtagtcgcggggcaggtacgtgcgctcgcggttctctcgcggaggtcggcggtggcgggagcgggctccggagagcctgagagcacggtggggcggggcgggagaaagtggccgcccggaggacgttggcgtttacgtgtggaagagcggaagagttttgcttttcgtgcgcgccttcgaaaactgcctgccgctgtctgaggagtccacccgaaacctcccctcctccgccggcagccccgcgctgagctcgccgacccaagccagcgtgggcgaggtgggaagtgcgcccgacccgcgcctggagctgcgcccccgagtgcccatggctacaagggtgctgagcatgagcgcccgcctgggacccgtgccccagccgccggcgccgcaggacgagccggtgttcgcgcagctcaagccggtgctgggcgccgcgaatccggcccgcgacgcggcgctcttccccggcgaggagctgaagcacgcgcaccaccgcccgcaggcgcagcccgcgcccgcgcaggccccgcagccggcccagccgcccgccaccggcccgcggctgcctccagaggacctggtccagacaagatgtgaaatggagaagtatctgacacctcagcttcctccagttcctataattccagagcataaaaagtatagacgagacagtgcctcagtcgtagaccagttcttcactgacactgaagggttaccttacagtatcaacatgaacgtcttcctccctgacatcactcacctgagaactggcctctacaaatcccagagaccgtgcgtaacacacatcaagacagaacctgttgccattttcagccaccagagtgaaacgactgcccctcctccggccccgacccaggccctccctgagttcaccagtatattcagctcacaccagaccgcagctccagaggtgaacaatattttcatcaaacaagaacttcctacaccagatcttcatctttctgtccctacccagcagggccacctgtaccagctactgaatacaccggatctagatatgcccagttctacaaatcagacagcagcaatggacactcttaatgtttctatgtcagctgccatggcaggccttaacacacacacctctgctgttccgcagactgcagtgaaacaattccagggcatgcccccttgcacatacacaatgccaagtcagtttcttccacaacaggccacttactttcccccgtcaccaccaagctcagagcctggaagtccagatagacaagcagagatgctccagaatttaaccccacctccatcctatgctgctacaattgcttctaaactggcaattcacaatccaaatttacccaccaccctgccagttaactcacaaaacatccaacctgtcagatacaatagaaggagtaaccccgatttggagaaacgacgcatccactactgcgattaccctggttgcacaaaagtttataccaagtcttctcatttaaaagctcacctgaggactcacactggtgaaaagccatacaagtgtacctgggaaggctgcgactggaggttcgcgcgatcggatgagctgacccgccactaccggaagcacacaggcgccaagcccttccagtgcggggtgtgcaaccgcagcttctcgcgctctgaccacctggccctgcatatgaagaggcaccagaactgagcactgcccgtgtgacccgttccaggtcccctgggctccctcaaatgacagacctaactattcctgtgtaaaaacaacaaaaacaaaaaaaaaacaagaaaaccacaactaaaactggaaatgtatattttgtatatttgagaaaacagggaatacattgtattaataccaaagtgtttggtcattttaagaatctggaatgcttgctgtaatgtatatggctttactcaagcagatctcatctcatgacaggcagccacgtctcaacatgggtaaggggtgggggtggaggggagtgtgtgcagcgtttttacctaggcaccatcatttaatgtgacagtgttcagtaaacaaatcagttggcaggcaccagaagaagaatggattgtatgtcaagattttacttggcattgagtagtttttttcaatagtaggtaattccttagagatacagtatacctggcaattcacaaatagccattgaacaaatgtgtggagcctcggcgtgtgcagcaacaacttcgtccatccggacttggcctagtatggaccctcggcgtgtgca

SEQ ID NO: 314428 - DNA, 2953 bp, Homo sapiens
aaccactttagctcagacctttcttttaaccttgcctatcatgtttcgagtcagaatttaaatactgtgcagtttaagctacaatacgcttggcctataacttggttccaggcatttatatttatgtcacttttgtctacttattatactaacaaggtggaaaaagcaatcccagtctctccaaaagacaagatgtgaaatggagaagtatctgacacctcagcttcctccagttcctataattccagagcataaaaagtatagacgagacagtgcctcagtcgtagaccagttcttcactgacactgaagggttaccttacagtatcaacatgaacgtcttcctccctgacatcactcacctgagaactggcctctacaaatcccagagaccgtgcgtaacacacatcaagacagaacctgttgccattttcagccaccagagtgaaacgactgcccctcctccggccccgacccaggccctccctgagttcaccagtatattcagctcacaccagaccgcagctccagaggtgaacaatattttcatcaaacaagaacttcctacaccagatcttcatctttctgtccctacccagcagggccacctgtaccagctactgaatacaccggatctagatatgcccagttctacaaatcagacagcagcaatggacactcttaatgtttctatgtcagctgccatggcaggccttaacacacacacctctgctgttccgcagactgcagtgaaacaattccagggcatgcccccttgcacatacacaatgccaagtcagtttcttccacaacaggccacttactttcccccgtcaccaccaagctcagagcctggaagtccagatagacaagcagagatgctccagaatttaaccccacctccatcctatgctgctacaattgcttctaaactggcaattcacaatccaaatttacccaccaccctgccagttaactcacaaaacatccaacctgtcagatacaatagaaggagtaaccccgatttggagaaacgacgcatccactactgcgattaccctggttgcacaaaagtttataccaagtcttctcatttaaaagctcacctgaggactcacactggtgaaaagccatacaagtgtacctgggaaggctgcgactggaggttcgcgcgatcggatgagctgacccgccactaccggaagcacacaggcgccaagcccttccagtgcggggtgtgcaaccgcagcttctcgcgctctgaccacctggccctgcatatgaagaggcaccagaactgagcactgcccgtgtgacccgttccaggtcccctgggctccctcaaatgacagacctaactattcctgtgtaaaaacaacaaaaacaaaaaaaaaacaagaaaaccacaactaaaactggaaatgtatattttgtatatttgagaaaacagggaatacattgtattaataccaaagtgtttggtcattttaagaatctggaatgcttgctgtaatgtatatggctttactcaagcagatctcatctcatgacaggcagccacgtctcaacatgggtaaggggtgggggtggaggggagtgtgtgcagcgtttttacctaggcaccatcatttaatgtgacagtgttcagtaaacaaatcagttggcaggcaccagaagaagaatggattgtatgtcaagattttacttggcattgagtagtttttttcaatagtaggtaattccttagagatacagtatacctggcaattcacaaatagccattgaacaaatgtgtgggtttttaaaaattatatacatatatgagttgcctatatttgctattcaaaattttgtaaatatgcaaatcagctttataggtttattacaagttttttaggattcttttggggaagagtcataattcttttgaaaataaccatgaatacacttacagttaggatttgtggtaaggtacctctcaacattaccaaaatcatttctttagagggaaggaataatcattcaaatgaactttaaaaaagcaaatttcatgcactgattaaaataggattattttaaatacaaaaggcattttatatgaattataaactgaagagcttaaagatagttacaaaatacaaaagttcaacctcttacaataagctaaacgcaatgtcatttttaaaaagaaggacttagggtgtcgttttcacatatgacaatgttgcatttatgatgcagtttcaagtaccaaaacgttgaattgatgatgcagttttcatatatcgagatgttcgctcgtgcagtactgttggttaaatgacaatttatgtggattttgcatgtaatacacagtgagacacagtaattttatctaaattacagtgcagtttagttaatctattaatactgactcagtgtctgcctttaaatataaatgatatgttgaaaacttaaggaagcaaatgctacatatatgcaatataaaatagtaatgtgatgctgatgctgttaaccaaagggcagaataaataagcaaaatgccaaaaggggtcttaattgaaatgaaaatttaattttgtttttaaaatattgtttatctttatttattttgtggtaatatagtaagtttttttagaagacaattttcataacttgataaattatagttttgtttgttagaaaagttgctcttaaaagatgtaaatagatgacaaacgatgtaaataattttgtaagaggcttcaaaatgtttatacgtggaaacacacctacatgaaaagcagaaatcggttgctgttttgcttctttttccctcttatttttgtattgtggtcatttcctatgcaaataatggagcaaacagctgtatagttgtagaattttttgagagaatgagatgtttatatattaacgacaattttttttttggaaaataaaaagtgcctaaaaga

SEQ ID NO: 314429 - DNA, 2498 bp, Homo sapiens
ggtgaactcaggagggcctgggtcggggccggaggaggggcagtatattcagctcacaccagaccgcagctccagaggtgaacaatattttcatcaaacaagaacttcctacaccagatcttcatctttctgtccctacccagcagggccacctgtaccagctactgaatacaccggatctagatatgcccagttctacaaatcagacagcagcaatggacactcttaatgtttctatgtcagctgccatggcaggccttaacacacacacctctgctgttccgcagactgcagtgaaacaattccagggcatgcccccttgcacatacacaatgccaagtcagtttcttccacaacaggccacttactttcccccgtcaccaccaagctcagagcctggaagtccagatagacaagcagagatgctccagaatttaaccccacctccatcctatgctgctacaattgcttctaaactggcaattcacaatccaaatttacccaccaccctgccagttaactcacaaaacatccaacctgtcagatacaatagaaggagtaaccccgatttggagaaacgacgcatccactactgcgattaccctggttgcacaaaagtttataccaagtcttctcatttaaaagctcacctgaggactcacactggtgaaaagccatacaagtgtacctgggaaggctgcgactggaggttcgcgcgatcggatgagctgacccgccactaccggaagcacacaggcgccaagcccttccagtgcggggtgtgcaaccgcagcttctcgcgctctgaccacctggccctgcatatgaagaggcaccagaactgagcactgcccgtgtgacccgttccaggtcccctgggctccctcaaatgacagacctaactattcctgtgtaaaaacaacaaaaacaaaaaaaaaacaagaaaaccacaactaaaactggaaatgtatattttgtatatttgagaaaacagggaatacattgtattaataccaaagtgtttggtcattttaagaatctggaatgcttgctgtaatgtatatggctttactcaagcagatctcatctcatgacaggcagccacgtctcaacatgggtaaggggtgggggtggaggggagtgtgtgcagcgtttttacctaggcaccatcatttaatgtgacagtgttcagtaaacaaatcagttggcaggcaccagaagaagaatggattgtatgtcaagattttacttggcattgagtagtttttttcaatagtaggtaattccttagagatacagtatacctggcaattcacaaatagccattgaacaaatgtgtgggtttttaaaaattatatacatatatgagttgcctatatttgctattcaaaattttgtaaatatgcaaatcagctttataggtttattacaagttttttaggattcttttggggaagagtcataattcttttgaaaataaccatgaatacacttacagttaggatttgtggtaaggtacctctcaacattaccaaaatcatttctttagagggaaggaataatcattcaaatgaactttaaaaaagcaaatttcatgcactgattaaaataggattattttaaatacaaaaggcattttatatgaattataaactgaagagcttaaagatagttacaaaatacaaaagttcaacctcttacaataagctaaacgcaatgtcatttttaaaaagaaggacttagggtgtcgttttcacatatgacaatgttgcatttatgatgcagtttcaagtaccaaaacgttgaattgatgatgcagttttcatatatcgagatgttcgctcgtgcagtactgttggttaaatgacaatttatgtggattttgcatgtaatacacagtgagacacagtaattttatctaaattacagtgcagtttagttaatctattaatactgactcagtgtctgcctttaaatataaatgatatgttgaaaacttaaggaagcaaatgctacatatatgcaatataaaatagtaatgtgatgctgatgctgttaaccaaagggcagaataaataagcaaaatgccaaaaggggtcttaattgaaatgaaaatttaattttgtttttaaaatattgtttatctttatttattttgtggtaatatagtaagtttttttagaagacaattttcataacttgataaattatagttttgtttgttagaaaagttgctcttaaaagatgtaaatagatgacaaacgatgtaaataattttgtaagaggcttcaaaatgtttatacgtggaaacacacctacatgaaaagcagaaatcggttgctgttttgcttctttttccctcttatttttgtattgtggtcatttcctatgcaaataatggagcaaacagctgtatagttgtagaattttttgagagaatgagatgtttatatattaacgacaattttttttttggaaaataaaaagtgcctaaaaga

SEQ ID NO: 314430 - DNA, 3622 bp, Homo sapiens
gcggccgccctgcgcgcgaagctcgtggcccgagaggggtgcggtcgggccgacggaggcggggccctggctgcctctctccctgctcataggctggccgctcaggcctggccggcctcggggcctcgggattcgcggcggcgctgccaatcaggcgatcgggccccgcccccccggagttgggtgaaatagaggcgggcgtcaagtgtcagtagtcgcggggcaggtacgtgcgctcgcggttctctcgcggaggtcggcggtggcgggagcgggctccggagagcctgagagcacggtggggcggggcgggagaaagtggccgcccggaggacgttggcgtttacgtgtggaagagcggaagagttttgcttttcgtgcgcgccttcgaaaactgcctgccgctgtctgaggagtccacccgaaacctcccctcctccgccggcagccccgcgctgagctcgccgacccaagccagcgtgggcgaggtgggaagtgcgcccgacccgcgcctggagctgcgcccccgagtgcccatggctacaagggtgctgagcatgagcgcccgcctgggacccgtgccccagccgccggcgccgcaggacgagccggtgttcgcgcagctcaagccggtgctgggcgccgcgaatccggcccgcgacgcggcgctcttccccggcgaggagctgaagcacgcgcaccaccgcccgcaggcgcagcccgcgcccgcgcaggccccgcagccggcccagccgcccgccaccggcccgcggctgcctccagaggacctggtccagacaagatgtgaaatggagaagtatctgacacctcagcttcctccagttcctataattccagagcataaaaagtatagacgagacagtgcctcagtcgtagaccagttcttcactgacactgaagggttaccttacagtatcaacatgaacgtcttcctccctgacatcactcacctgagaactggcctctacaaatcccagagaccgtgcgtaacacacatcaagacagaacctgttgccattttcagccaccagagtgaaacgactgcccctcctccggccccgacccaggccctccctgagttcaccagtatattcagctcacaccagaccgcagctccagaggtgaacaatattttcatcaaacaagaacttcctacaccagatcttcatctttctgtccctacccagcagggccacctgtaccagctactgaatacaccggatctagatatgcccagttctacaaatcagacagcagcaatggacactcttaatgtttctatgtcagctgccatggcaggccttaacacacacacctctgctgttccgcagactgcagtgaaacaattccagggcatgcccccttgcacatacacaatgccaagtcagtttcttccacaacaggccacttactttcccccgtcaccaccaagctcagagcctggaagtccagatagacaagcagagatgctccagaatttaaccccacctccatcctatgctgctacaattgcttctaaactggcaattcacaatccaaatttacccaccaccctgccagttaactcacaaaacatccaacctgtcagatacaatagaaggagtaaccccgatttggagaaacgacgcatccactactgcgattaccctggttgcacaaaagtttataccaagtcttctcatttaaaagctcacctgaggactcacactgtgtgaagttatcagtaccagactattttgcttcaatctgcaaaaggaaggtgtgtgaaggtgaaaagccatacaagtgtacctgggaaggctgcgactggaggttcgcgcgatcggatgagctgacccgccactaccggaagcacacaggcgccaagcccttccagtgcggggtgtgcaaccgcagcttctcgcgctctgaccacctggccctgcatatgaagaggcaccagaactgagcactgcccgtgtgacccgttccaggtcccctgggctccctcaaatgacagacctaactattcctgtgtaaaaacaacaaaaacaaaaaaaaaacaagaaaaccacaactaaaactggaaatgtatattttgtatatttgagaaaacagggaatacattgtattaataccaaagtgtttggtcattttaagaatctggaatgcttgctgtaatgtatatggctttactcaagcagatctcatctcatgacaggcagccacgtctcaacatgggtaaggggtgggggtggaggggagtgtgtgcagcgtttttacctaggcaccatcatttaatgtgacagtgttcagtaaacaaatcagttggcaggcaccagaagaagaatggattgtatgtcaagattttacttggcattgagtagtttttttcaatagtaggtaattccttagagatacagtatacctggcaattcacaaatagccattgaacaaatgtgtgggtttttaaaaattatatacatatatgagttgcctatatttgctattcaaaattttgtaaatatgcaaatcagctttataggtttattacaagttttttaggattcttttggggaagagtcataattcttttgaaaataaccatgaatacacttacagttaggatttgtggtaaggtacctctcaacattaccaaaatcatttctttagagggaaggaataatcattcaaatgaactttaaaaaagcaaatttcatgcactgattaaaataggattattttaaatacaaaaggcattttatatgaattataaactgaagagcttaaagatagttacaaaatacaaaagttcaacctcttacaataagctaaacgcaatgtcatttttaaaaagaaggacttagggtgtcgttttcacatatgacaatgttgcatttatgatgcagtttcaagtaccaaaacgttgaattgatgatgcagttttcatatatcgagatgttcgctcgtgcagtactgttggttaaatgacaatttatgtggattttgcatgtaatacacagtgagacacagtaattttatctaaattacagtgcagtttagttaatctattaatactgactcagtgtctgcctttaaatataaatgatatgttgaaaacttaaggaagcaaatgctacatatatgcaatataaaatagtaatgtgatgctgatgctgttaaccaaagggcagaataaataagcaaaatgccaaaaggggtcttaattgaaatgaaaatttaattttgtttttaaaatattgtttatctttatttattttgtggtaatatagtaagtttttttagaagacaattttcataacttgataaattatagttttgtttgttagaaaagttgctcttaaaagatgtaaatagatgacaaacgatgtaaataattttgtaagaggcttcaaaatgtttatacgtggaaacacacctacatgaaaagcagaaatcggttgctgttttgcttctttttccctcttatttttgtattgtggtcatttcctatgcaaataatggagcaaacagctgtatagttgtagaattttttgagagaatgagatgtttatatattaacgacaattttttttttggaaaataaaaagtgcctaaaaga

SEQ ID NO: 314431 - DNA, 200 bp, Homo sapiens
caatagaaggagtaaccccgatttggagaaacgacgcatccactactgcgattaccctggtatgtgctcttacctggttgaagcatcaatagatgtagtgtgtgtgtgtgtgtgtctgtgtgcgcgcgcgtgtgcgtgtgtgcacgcgcgtgcccttttcaacctcatggctttaaataggaaagttgtacttgacagta

SEQ ID NO: 314432 - DNA, 10371 bp, Homo sapiens
  misc_feature (6243)..(6243): n is a, c, g, or t
  misc_feature (6308)..(6308): n is a, c, g, or t
gcacgctgggacctgcagaagcactctttgctaattgtgatcggcgatatcggtacagagagtcagctgagggccgtgcgggcccaccttgaacaagggattctctcctggaacattgacctgtcatcctttgacttgaaccaacagttgagactcttcattacccggcacctagctcacttctcctcagaggtcaaaggccagaggaccctttgccaccagagtgagatcctagagaccatcatcctggtaaatcccagtgcagacagcatcagctctgaggttcatcatcttcttagcagctcatcagcttataaactactaatcttgagtgggcaaagtttagagcctgggggagacctcatcctacagagtggcacctactcatatgaaaactttgcccaggtccttcacaaccccgagatttcccaattgctcagcaatagagaccctgggatacaggccttccttaccgtgtcctgcttaggggaaggtgattggagccacctgggattatccagttcccaagagaccctgcacctccggctaaaccctgagcccactctgcccaccatggacggcgtggctgagttctccgagtatgtctctgagactgtggacgtgccatccccatttgacctactagagccccccacctcagggggcttcctcaagctctccaagccttgttgctacatcttcccaggtggtcgtggggactctgccctctttgctgtcaatggtttcaacatcctggtggatggtggctctgatcgcaagtcctgtttttggaagctggtacggcacttggaccgcattgactcggtgctactcacacacattggggcagacaacctgccaggcatcaatggactactgcagcgcaaagtggcagagctagaggaggagcagtcccagggctctagcagttacagcgactgggtgaagaaccttatctctcctgagcttggagttgtctttttcaacgtgcctgagaagctgcggcttcctgatgcctcccggaaagccaagcgtagcattgaggaggcctgcctcactctgcagcacttaaaccgcctgggcatccaggctgagcctctatatcgtgtggtcagcaataccattgagccactgaccctcttccacaaaatgggtgtgggccggctggacatgtatgtcctcaaccctgtcaaggacagcaaggagatgcagttcctcatgcaaaagtgggcaggcaatagtaaagccaagacaggcatcgtgctgcccaatgggaaggaggctgagatctccgtgccctaccttacctctatcactgctctggtggtctggctaccagccaatcccactgagaagattgtgcgtgtgctttttccaggaaatgctccccaaaacaagatcttggagggcctagaaaagcttcggcatctggacttcctgcgttaccctgtggccacgcagaaggacctggcttctggggctgtgcctaccaacctcaagcccagcaaaatcaaacagcgggctgatagcaaggagagcctcaaagccactaccaagacggccgtgagcaagttggccaaacgggaggaggtggtagaagagggagccaaggaggcacgttcagagctggccaaggagttagccaagacagagaagaaggcaaaagagtcatctgagaagcccccagagaagcctgccaagcctgagagggtgaagacagagtcaagtgaggcactgaaggcagagaagcgaaagctgatcaaagacaaggtagggaaaaagcaccttaaagaaaagatatcaaagctggaagaaaaaaaagacaaggagaaaaaagagatcaaaaaggagaggaaagagctcaagaaggatgaaggaaggaaggaggagaagaaggatgccaagaaggaggagaagaggaaagataccaaacctgagctcaagaagatttccaagccagacctaaagccctttactcctgaggtacgtaagaccctctataaagccaaggtccctggaagagtcaaaatagacaggagccgtgctatccgtggggagaaggagctgtcttctgagccccagacacccccagcccagaagggaactgtaccactcccaaccatcagtgggcacagggagctggtcctatcctcaccagaggacctcacacaggactttgaggagatgaagcgtgaggagagggctttgctggctgaacaaagggacacaggactaggagataagccattccctctagacactgcagaggagggacccccaagtacagctatccagggaacaccaccctctgttccagggctgggacaagaagaacatgtgatgaaggagaaagagcttgtcccagaggtccctgaggaacaaggcagcaaggacagaggcctagactctggggctgaaacagaggaagagaaagatacctgggaggaaaagaagcagagggaagcagagaggctcccagacagaacagaagccagagaggaaagtgaacctgaagtaaaggaggatgtgatagaaaaggctgagttagaagaaatggaggaggtacacccttcagatgaggaggaagaggacgcgacaaaagctgagggtttttaccaaaaacatatgcaggaacccttgaaggtaactccaaggagccgggaggcttttgggggtcgggaattgggactccagggcaaggcccctgagaaggagacctcgttattcctaagcagcctgaccacacctgcaggagccactgagcatgtctcttacatccaggatgagacaatccctggctactcagagactgagcagaccatctcagatgaggagatccatgatgagccggaggagcgcccagctccacccagatttcatacaagtacatatgacctgcccgggcctgaaggtgctggcccattcgaagccagccaacctgccgatagtgctgttcctgctacctctggcaaagtctatggaacgccagagactgaactcacctaccccactaacatagtggctgcccctttggctgaagaggaacatgtgtcctcggccacttcaatcactgagtgtgacaaactttcttcctttgccacatcagtggctgaggaccaatctgtggcctcacttacagctccccagacagaggagacaggcaagagctccctgctgcttgacacagtcacaagcatcccttcctcccgtactgaagctacgcagggcttggactatgtgccatcagctggtaccatctcacccacctcctcactggaagaagacaagggcttcaaatcaccaccctgtgaggacttctctgtgactggggagtcagagaagagaggagagatcatagggaaaggcttgtctggagagagagctgtggaagaggaagaggaggagacagcaaacgtagagatgtctgagaaactttgcagtcaatatggaactccagtgtttagtgcccctgggcatgccctacatccaggagaaccagcccttggagaagcagaggagcggtgccttagcccagatgacagcacagtgaagatggcttctcctccaccatctggcccacccagtgccacccacacaccctttcatcagtccccagtggaagaaaagtctgagccccaagactttcaggaggcagactcctggggagacactaagcgcacaccaggtgtgggcaaagaagatgctgctgaggagacagtcaagccagggcctgaagagggcacactagagaaggaagagaaagttcctcctcccaggagcccccaggcccaggaagcacctgtcaacattgatgaggggcttacaggctgtaccattcaactgttgccagcacaggataaagcaatagtctttgagattatggaggcaggagagcccacaggcccaattctgggagcagaagcccttcccggaggtttgaggactttaccccaagaacctggcaaacctcagaaagatgaggtgctcagatatcctgaccgaagcctctctcctgaagatgcagaatccctctctgtcctcagcgtgccctccccagacactgccaaccaagagcctacccccaagtctccctgtggcctgacagaacagtacctacacaaagaccgttggccagaggtatctccagaagacacccagtcactttctctgtcagaagagagtcccagcaaggagacctccctggatgtctcttctaagcagctctctccagaaagccttggcaccctccagtttggggaactaaaccttgggaaggaagaaatggggcatctgatgcaggccgaggatacctctcaccacacagctcccatgtctgttccagagccccatgcagccacagcgtcacctcccacagatgggacaactcgatactctgcacagacagacatcacagatgacagccttgacaggaagtcacctgccagctcattctctcactctacaccttcaggaaatgggaagtacttacctggggcgatcacaagccctgatgaacacattctgacacctgatagctccttctccaagagtcctgagtctttgccaggccctgccttggaggacattgccataaagtgggaagataaagttccagggttgaaagacagaacctcagaacagaagaaggaacctgagccaaaggatgaagttttacagcagaaagacaaaactctggagcacaaggaggtggtagagccgaaggatacagccatctatcagaaagatgaggctctgcatgtaaagaatgaggctgtgaaacagcaggataaggctttagaacaaaagggcagagacttagagcaaaaagacacagccctagaacagaaggacaaggccctggaaccaaaagacaaagacttagaagaaaaagacaaggccctggaacagaaggataagattccagaagagaaagacaaagccttagaacaaaaggatacagccctggaacagaaggacaaggccctggaaccaaaagataaagacttggaacaaaaggacagggtcctagaacagaaggagaagatcccagaagagaaagacaaagccttagatcaaaaagtcagaagtgttgaacataaggctccggaggacacggtcgctgaaatgaaggacagagacctagaacagacagacaaagcccctgaacagaaacaccaggcccaggaacaaaaggataaagtctcagaaaagaaggatcaggccttagaacaaaaatactgggctttgggacagaaggatgaagccctggaacaaaacattcaggctctggaagagaaccaccaaactcaggagcaggagagcctagtgcaggaggataaaaccaggaaaccaaagatgctagaggaaaaatccccagaaaaggtcaaggccatggaagagaagttagaagctcttctggagaagaccaaagctctgggcctggaagagagcctagtgcaggagggcagggccagagagcaggaagaaaagtactggagggggcaggatgtggtccaggagtggcaagaaacatctcctaccagagaggagccggctggagaacagaaagagcttgccccggcatgggaggacacatctcctgagcaggacaataggtattggaggggcagagaggatgtggccttggaacaggacacatactggagggagctaagctgtgagcggaaggtctggttccctcacgagctggatggccagggggcccgcccacactacactgaggaacgggaaagcactttcctagatgagggcccagatgatgagcaagaagtacccctgcgggaacacgcaacccggagcccctgggcctcagacttcaaggatttccaggaatcctcaccacagaaggggctagaggtggagcgctggcttgctgaatcaccagttgggttgccaccagaggaagaggacaaactgacccgctctccctttgagatcatctcccctccagcttccccacctgagatggttggacaaagggttccttcagccccaggacaagagagtcctatcccagaccctaagctcatgccacacatgaagaatgaacccactactccctcatggctggctgacatcccaccctgggtgcccaaggacagacccctcccccctgcacccctctccccagctcctggtccccccacacctgccccggaatcccatactcctgcacccttctcttggggcacagccgagtatgacagtgtggtggctgcagtncaggagggggcagctgagttggaaggtgggccatactcccccctggggaaggactaccgcaaggntgaaggggaaagggaagaagaaggtagggctgaggctcctgacaaaagctcacacagctcaaaggtaccagaggccagcaaaagccatgccaccacggagcctgagcagactgagccggagcagagagagcccacaccctatcctgatgagagaagctttcagtatgcagacatctatgagcagatgatgcttactgggcttggccctgcatgccccactagagagcctccacttggagcagctggggattggcccccatgcctctcaaccaaggaggcagctgccggccgaaacacatctgcagagaaggagctttcatctcctatctcacccaagagcctccagtctgacactccaaccttcagctatgcagccctggcaggacccactgtacccccaaggccagagccagggccaagtatggagcccagcctcaccccacctgcagttcccccccgtgctcctatcctgagcaaaggcccaagcccccctcttaatggtaacatcctgagctgcagcccagataggaggtccccatcccccaaggaatcaggccggagtcactgggatgacagcactagtgactcagaactggagaagggggctcgggaacagccagaaaaagaggcccaatccccaagtcctcctcaccccattcctatggggtcccccacattatggccagaaactgaggcacatgttagccctcccttggactcacacctggggcctgcccgacccagtctggacttccctgcttcagcctttggcttctcctcattgcagccagctcccccacagctgccctctccagctgaaccccgctcggcaccctgtggctcccttgccttctctggggatcgagctctggctctggctccaggaccccccaccagaacccggcatgatgaatacctggaagtgaccaaggcccccagcctggattcctcactgccccagctcccatcacccagttctcctggggcccctctcctctccaatctgccacgacctgcctcaccagccctgtctgagggctcctcctctgaggctaccacgcctgtgatttcaagtgtggcggagcgcttctctccaagccttgaggctgcagaacaggagtctggagagctggacccaggaatggaaccagctgcccacagcctctgggacctcactcctctgagcccagcacccccagcttcactggacttggccctagctccagctccaagcctgcctggagacatgggtgatggcatcctgccgtgccacctggagtgctcagaggcagccacggagaagccaagccccttccaggttccctctgaggattgtgcagccaatggcccaactgaaaccagccctaaccccccaggccctgccccagccaaggctgaaaatgaagaggctgcggcttgccctgcctgggaacgtggggcctggcctgaaggagctgagaggagctcccggcctgacacattgctctcccctgagcagccagtgtgtcctgcagggggctccgggggcccacccagcagtgcctctcctgaggtcgaagctgggccccagggatgtgccactgagcctcggccccatcgtggggagctctccccatccttcctgaacccacctctgcccccatccatagatgatagggacctctcaactgaggaagttcggctagtaggaagaggggggcggcgccgggtaggggggccagggaccactgggggcccatgccctgtgactgatgagacaccccctacatcagccagtgactcaggctcctcacagtcagattctgatgtcccgccagaaactgaggagtgtccgtccatcacagctgaggcagccctcgactcagatgaagatggagacttcctacctgtggacaaagctgggggtgtcagtggtactcaccaccccaggcctggccatgacccacctcctctcccacagccagacccccgcccatcccctccccgccctgatgtgtgcatggctgaccccgaggggctcagctcagagtctgggagagtagagaggctacgggagaaggaaaaggttcaggggcgagtagggcgtagggccccaggtaaggacaagccagtgtcccctgcacggcgtctggttcttcggggaaaacgctcacccacccctggtaaagggcctgcagatcgagcatcccgggccccacctcgaccacgcagcaccacaagccaggtcaccccagcagaggaaaaggatggacacagccccatgtccaaaggcctagtcaatggactcaaggcaggaccaatggccttgagttccaagggcagctctggtgcccctgtatatgtggatctcgcctacatcccgaatcattgcagtggcaagactgctgaccttgacttcttccgtcgagtgcgtgcatcctactatgtggtcagtgggaatgaccctgccaatggcgagccaagccgggctgtgctggatgccctgctggagggcaaggcccagtggggggagaatcttcaggtgactctgatccctactcatgacacggaggtgactcgtgagtggtaccaacaaactcatgagcagcagcaacaactgaatgtcctggtcctggctagcagcagcaccgtggtgatgcaggatgagtccttccctgcctgcaagattgagttctgaaagagccgccctcccttccccaaggatccactcccccagctcctttagagaatggctactgctgagtcctttggggttgagggagatgggagctagggggaggggagggagatgtcttgttgtggggacttgggctgggctaaatgggaggggttgtccctccccatcatccattcctgtgaggtgtctcaaaccaaagttaacagggagaggatgggggaggggacaaattagaataggatagcatctgatgcctgagaaccctctcctagcactgtcaaatgctggtattgaatggggactgaggatgggtctcagagagcaacctcctccctcgtagagggagattatatccccaactccagggacctctttatctcaatctatttatttggcatcctgggaaggatttccaatagtaatttatgtgacctggggcaggataccgtcagtgaggtgcccagagctgcaccctttcctccatttcccatcccccatctcctcaaccaccagggtctgagttctagcagggtcctgggggtatcccactgctatactgttctactgcttccctcagtatctgaatgtctcaatttaaaacttgaagctctttagaccaatagactggtgagaggagaaaggagcttatcccccagaccctgctttataccattcacatcccagggctgtgtccagacagcacaaaacggcaaggagagcccaagccccaatgccagaattcttccaaactccctgactctttgaagtttttactcaccccatttcaattatcctgatcccttctcatcccctgcttggcttctctgcatgtggtcatctgctgtggcttggtgtttaatgggttaaaaataagccactgcctgacatcccaacatttgacaccccagcaatgtgtgactcccccaacattccactatgccatcctgcagctgaaatgggaacactggctgcctctccaaacccgctcttggacagaggatctgggaggtggaagccaggccagaggacttggggaaaatgagatggaggaaggaaaaagggagaagctgagccacagcttaactcctacagagtgaaatgaaaacgggctgaaaataccaccccaggagaggacctcgccccaagcaagccagtgagcagccctgccagactactgccagactgagaaacccagaagctggtagtcatgtgggcttgccttctctgccaaacgactgggaaaccaaaatgagcccaccttgtgttcttcctagctccaccctccccgtgctgctgtgttctgctcctccccacgcttccctgctatagttcccagctgctgtaacggagccacctccaactctaacaataaaccaagttcattgc

SEQ ID NO: 314433 - DNA, 10217 bp, Homo sapiens
  misc_feature (6089)..(6089): n is a, c, g, or t
  misc_feature (6154)..(6154): n is a, c, g, or t
ttccctgaagctgccggctgaggccggagctgccgcctccatgagaggcttcctcctacaccccagggccagaggaccctttgccaccagagtgagatcctagagaccatcatcctggtaaatcccagtgcagacagcatcagctctgaggttcatcatcttcttagcagctcatcagcttataaactactaatcttgagtgggcaaagtttagagcctgggggagacctcatcctacagagtggcacctactcatatgaaaactttgcccaggtccttcacaaccccgagatttcccaattgctcagcaatagagaccctgggatacaggccttccttaccgtgtcctgcttaggggaaggtgattggagccacctgggattatccagttcccaagagaccctgcacctccggctaaaccctgagcccactctgcccaccatggacggcgtggctgagttctccgagtatgtctctgagactgtggacgtgccatccccatttgacctactagagccccccacctcagggggcttcctcaagctctccaagccttgttgctacatcttcccaggtggtcgtggggactctgccctctttgctgtcaatggtttcaacatcctggtggatggtggctctgatcgcaagtcctgtttttggaagctggtacggcacttggaccgcattgactcggtgctactcacacacattggggcagacaacctgccaggcatcaatggactactgcagcgcaaagtggcagagctagaggaggagcagtcccagggctctagcagttacagcgactgggtgaagaaccttatctctcctgagcttggagttgtctttttcaacgtgcctgagaagctgcggcttcctgatgcctcccggaaagccaagcgtagcattgaggaggcctgcctcactctgcagcacttaaaccgcctgggcatccaggctgagcctctatatcgtgtggtcagcaataccattgagccactgaccctcttccacaaaatgggtgtgggccggctggacatgtatgtcctcaaccctgtcaaggacagcaaggagatgcagttcctcatgcaaaagtgggcaggcaatagtaaagccaagacaggcatcgtgctgcccaatgggaaggaggctgagatctccgtgccctaccttacctctatcactgctctggtggtctggctaccagccaatcccactgagaagattgtgcgtgtgctttttccaggaaatgctccccaaaacaagatcttggagggcctagaaaagcttcggcatctggacttcctgcgttaccctgtggccacgcagaaggacctggcttctggggctgtgcctaccaacctcaagcccagcaaaatcaaacagcgggctgatagcaaggagagcctcaaagccactaccaagacggccgtgagcaagttggccaaacgggaggaggtggtagaagagggagccaaggaggcacgttcagagctggccaaggagttagccaagacagagaagaaggcaaaagagtcatctgagaagcccccagagaagcctgccaagcctgagagggtgaagacagagtcaagtgaggcactgaaggcagagaagcgaaagctgatcaaagacaaggtagggaaaaagcaccttaaagaaaagatatcaaagctggaagaaaaaaaagacaaggagaaaaaagagatcaaaaaggagaggaaagagctcaagaaggatgaaggaaggaaggaggagaagaaggatgccaagaaggaggagaagaggaaagataccaaacctgagctcaagaagatttccaagccagacctaaagccctttactcctgaggtacgtaagaccctctataaagccaaggtccctggaagagtcaaaatagacaggagccgtgctatccgtggggagaaggagctgtcttctgagccccagacacccccagcccagaagggaactgtaccactcccaaccatcagtgggcacagggagctggtcctatcctcaccagaggacctcacacaggactttgaggagatgaagcgtgaggagagggctttgctggctgaacaaagggacacaggactaggagataagccattccctctagacactgcagaggagggacccccaagtacagctatccagggaacaccaccctctgttccagggctgggacaagaagaacatgtgatgaaggagaaagagcttgtcccagaggtccctgaggaacaaggcagcaaggacagaggcctagactctggggctgaaacagaggaagagaaagatacctgggaggaaaagaagcagagggaagcagagaggctcccagacagaacagaagccagagaggaaagtgaacctgaagtaaaggaggatgtgatagaaaaggctgagttagaagaaatggaggaggtacacccttcagatgaggaggaagaggacgcgacaaaagctgagggtttttaccaaaaacatatgcaggaacccttgaaggtaactccaaggagccgggaggcttttgggggtcgggaattgggactccagggcaaggcccctgagaaggagacctcgttattcctaagcagcctgaccacacctgcaggagccactgagcatgtctcttacatccaggatgagacaatccctggctactcagagactgagcagaccatctcagatgaggagatccatgatgagccggaggagcgcccagctccacccagatttcatacaagtacatatgacctgcccgggcctgaaggtgctggcccattcgaagccagccaacctgccgatagtgctgttcctgctacctctggcaaagtctatggaacgccagagactgaactcacctaccccactaacatagtggctgcccctttggctgaagaggaacatgtgtcctcggccacttcaatcactgagtgtgacaaactttcttcctttgccacatcagtggctgaggaccaatctgtggcctcacttacagctccccagacagaggagacaggcaagagctccctgctgcttgacacagtcacaagcatcccttcctcccgtactgaagctacgcagggcttggactatgtgccatcagctggtaccatctcacccacctcctcactggaagaagacaagggcttcaaatcaccaccctgtgaggacttctctgtgactggggagtcagagaagagaggagagatcatagggaaaggcttgtctggagagagagctgtggaagaggaagaggaggagacagcaaacgtagagatgtctgagaaactttgcagtcaatatggaactccagtgtttagtgcccctgggcatgccctacatccaggagaaccagcccttggagaagcagaggagcggtgccttagcccagatgacagcacagtgaagatggcttctcctccaccatctggcccacccagtgccacccacacaccctttcatcagtccccagtggaagaaaagtctgagccccaagactttcaggaggcagactcctggggagacactaagcgcacaccaggtgtgggcaaagaagatgctgctgaggagacagtcaagccagggcctgaagagggcacactagagaaggaagagaaagttcctcctcccaggagcccccaggcccaggaagcacctgtcaacattgatgaggggcttacaggctgtaccattcaactgttgccagcacaggataaagcaatagtctttgagattatggaggcaggagagcccacaggcccaattctgggagcagaagcccttcccggaggtttgaggactttaccccaagaacctggcaaacctcagaaagatgaggtgctcagatatcctgaccgaagcctctctcctgaagatgcagaatccctctctgtcctcagcgtgccctccccagacactgccaaccaagagcctacccccaagtctccctgtggcctgacagaacagtacctacacaaagaccgttggccagaggtatctccagaagacacccagtcactttctctgtcagaagagagtcccagcaaggagacctccctggatgtctcttctaagcagctctctccagaaagccttggcaccctccagtttggggaactaaaccttgggaaggaagaaatggggcatctgatgcaggccgaggatacctctcaccacacagctcccatgtctgttccagagccccatgcagccacagcgtcacctcccacagatgggacaactcgatactctgcacagacagacatcacagatgacagccttgacaggaagtcacctgccagctcattctctcactctacaccttcaggaaatgggaagtacttacctggggcgatcacaagccctgatgaacacattctgacacctgatagctccttctccaagagtcctgagtctttgccaggccctgctgggaagataaagttccagggttgaaagacagaacctcagaacagaagaaggaacctgagccaaaggatgaagttttacagcagaaagacaaaactctggagcacaaggaggtggtagagccgaaggatacagccatctatcagaaagatgaggctctgcatgtaaagaatgaggctgtgaaacagcaggataaggctttagaacaaaagggcagagacttagagcaaaaagacacagccctagaacagaaggacaaggccctggaaccaaaagacaaagacttagaagaaaaagacaaggccctggaacagaaggataagattccagaagagaaagacaaagccttagaacaaaaggatacagccctggaacagaaggacaaggccctggaaccaaaagataaagacttggaacaaaaggacagggtcctagaacagaaggagaagatcccagaagagaaagacaaagccttagatcaaaaagtcagaagtgttgaacataaggctccggaggacacggtcgctgaaatgaaggacagagacctagaacagacagacaaagcccctgaacagaaacaccaggcccaggaacaaaaggataaagtctcagaaaagaaggatcaggccttagaacaaaaatactgggctttgggacagaaggatgaagccctggaacaaaacattcaggctctggaagagaaccaccaaactcaggagcaggagagcctagtgcaggaggataaaaccaggaaaccaaagatgctagaggaaaaatccccagaaaaggtcaaggccatggaagagaagttagaagctcttctggagaagaccaaagctctgggcctggaagagagcctagtgcaggagggcagggccagagagcaggaagaaaagtactggagggggcaggatgtggtccaggagtggcaagaaacatctcctaccagagaggagccggctggagaacagaaagagcttgccccggcatgggaggacacatctcctgagcaggacaataggtattggaggggcagagaggatgtggccttggaacaggacacatactggagggagctaagctgtgagcggaaggtctggttccctcacgagctggatggccagggggcccgcccacactacactgaggaacgggaaagcactttcctagatgagggcccagatgatgagcaagaagtacccctgcgggaacacgcaacccggagcccctgggcctcagacttcaaggatttccaggaatcctcaccacagaaggggctagaggtggagcgctggcttgctgaatcaccagttgggttgccaccagaggaagaggacaaactgacccgctctccctttgagatcatctcccctccagcttccccacctgagatggttggacaaagggttccttcagccccaggacaagagagtcctatcccagaccctaagctcatgccacacatgaagaatgaacccactactccctcatggctggctgacatcccaccctgggtgcccaaggacagacccctcccccctgcacccctctccccagctcctggtccccccacacctgccccggaatcccatactcctgcacccttctcttggggcacagccgagtatgacagtgtggtggctgcagtncaggagggggcagctgagttggaaggtgggccatactcccccctggggaaggactaccgcaaggntgaaggggaaagggaagaagaaggtagggctgaggctcctgacaaaagctcacacagctcaaaggtaccagaggccagcaaaagccatgccaccacggagcctgagcagactgagccggagcagagagagcccacaccctatcctgatgagagaagctttcagtatgcagacatctatgagcagatgatgcttactgggcttggccctgcatgccccactagagagcctccacttggagcagctggggattggcccccatgcctctcaaccaaggaggcagctgccggccgaaacacatctgcagagaaggagctttcatctcctatctcacccaagagcctccagtctgacactccaaccttcagctatgcagccctggcaggacccactgtacccccaaggccagagccagggccaagtatggagcccagcctcaccccacctgcagttcccccccgtgctcctatcctgagcaaaggcccaagcccccctcttaatggtaacatcctgagctgcagcccagataggaggtccccatcccccaaggaatcaggccggagtcactgggatgacagcactagtgactcagaactggagaagggggctcgggaacagccagaaaaagaggcccaatccccaagtcctcctcaccccattcctatggggtcccccacattatggccagaaactgaggcacatgttagccctcccttggactcacacctggggcctgcccgacccagtctggacttccctgcttcagcctttggcttctcctcattgcagccagctcccccacagctgccctctccagctgaaccccgctcggcaccctgtggctcccttgccttctctggggatcgagctctggctctggctccaggaccccccaccagaacccggcatgatgaatacctggaagtgaccaaggcccccagcctggattcctcactgccccagctcccatcacccagttctcctggggcccctctcctctccaatctgccacgacctgcctcaccagccctgtctgagggctcctcctctgaggctaccacgcctgtgatttcaagtgtggcggagcgcttctctccaagccttgaggctgcagaacaggagtctggagagctggacccaggaatggaaccagctgcccacagcctctgggacctcactcctctgagcccagcacccccagcttcactggacttggccctagctccagctccaagcctgcctggagacatgggtgatggcatcctgccgtgccacctggagtgctcagaggcagccacggagaagccaagccccttccaggttccctctgaggattgtgcagccaatggcccaactgaaaccagccctaaccccccaggccctgccccagccaaggctgaaaatgaagaggctgcggcttgccctgcctgggaacgtggggcctggcctgaaggagctgagaggagctcccggcctgacacattgctctcccctgagcagccagtgtgtcctgcagggggctccgggggcccacccagcagtgcctctcctgaggtcgaagctgggccccagggatgtgccactgagcctcggccccatcgtggggagctctccccatccttcctgaacccacctctgcccccatccatagatgatagggacctctcaactgaggaagttcggctagtaggaagaggggggcggcgccgggtaggggggccagggaccactgggggcccatgccctgtgactgatgagacaccccctacatcagccagtgactcaggctcctcacagtcagattctgatgtcccgccagaaactgaggagtgtccgtccatcacagctgaggcagccctcgactcagatgaagatggagacttcctacctgtggacaaagctgggggtgtcagtggtactcaccaccccaggcctggccatgacccacctcctctcccacagccagacccccgcccatcccctccccgccctgatgtgtgcatggctgaccccgaggggctcagctcagagtctgggagagtagagaggctacgggagaaggaaaaggttcaggggcgagtagggcgtagggccccaggtaaggacaagccagtgtcccctgcacggcgtctggttcttcggggaaaacgctcacccacccctggtaaagggcctgcagatcgagcatcccgggccccacctcgaccacgcagcaccacaagccaggtcaccccagcagaggaaaaggatggacacagccccatgtccaaaggcctagtcaatggactcaaggcaggaccaatggccttgagttccaagggcagctctggtgcccctgtatatgtggatctcgcctacatcccgaatcattgcagtggcaagactgctgaccttgacttcttccgtcgagtgcgtgcatcctactatgtggtcagtgggaatgaccctgccaatggcgagccaagccgggctgtgctggatgccctgctggagggcaaggcccagtggggggagaatcttcaggtgactctgatccctactcatgacacggaggtgactcgtgagtggtaccaacaaactcatgagcagcagcaacaactgaatgtcctggtcctggctagcagcagcaccgtggtgatgcaggatgagtccttccctgcctgcaagattgagttctgaaagagccgccctcccttccccaaggatccactcccccagctcctttagagaatggctactgctgagtcctttggggttgagggagatgggagctagggggaggggagggagatgtcttgttgtggggacttgggctgggctaaatgggaggggttgtccctccccatcatccattcctgtgaggtgtctcaaaccaaagttaacagggagaggatgggggaggggacaaattagaataggatagcatctgatgcctgagaaccctctcctagcactgtcaaatgctggtattgaatggggactgaggatgggtctcagagagcaacctcctccctcgtagagggagattatatccccaactccagggacctctttatctcaatctatttatttggcatcctgggaaggatttccaatagtaatttatgtgacctggggcaggataccgtcagtgaggtgcccagagctgcaccctttcctccatttcccatcccccatctcctcaaccaccagggtctgagttctagcagggtcctgggggtatcccactgctatactgttctactgcttccctcagtatctgaatgtctcaatttaaaacttgaagctctttagaccaatagactggtgagaggagaaaggagcttatcccccagaccctgctttataccattcacatcccagggctgtgtccagacagcacaaaacggcaaggagagcccaagccccaatgccagaattcttccaaactccctgactctttgaagtttttactcaccccatttcaattatcctgatcccttctcatcccctgcttggcttctctgcatgtggtcatctgctgtggcttggtgtttaatgggttaaaaataagccactgcctgacatcccaacatttgacaccccagcaatgtgtgactcccccaacattccactatgccatcctgcagctgaaatgggaacactggctgcctctccaaacccgctcttggacagaggatctgggaggtggaagccaggccagaggacttggggaaaatgagatggaggaaggaaaaagggagaagctgagccacagcttaactcctacagagtgaaatgaaaacgggctgaaaataccaccccaggagaggacctcgccccaagcaagccagtgagcagccctgccagactactgccagactgagaaacccagaagctggtagtcatgtgggcttgccttctctgccaaacgactgggaaaccaaaatgagcccaccttgtgttcttcctagctccaccctccccgtgctgctgtgttctgctcctccccacgcttccctgctatagttcccagctgctgtaacggagccacctccaactctaacaataaaccaagttcattgc

SEQ ID NO: 314434 - DNA, 6459 bp, Homo sapiens
  misc_feature (6111)..(6111): n is a, c, g, or t
  misc_feature (6176)..(6176): n is a, c, g, or t
ttccctgaagctgccggctgaggccggagctgccgcctccatgagaggcttcctcctacaccccagggccagaggaccctttgccaccagagtgagatcctagagaccatcatcctggtaaatcccagtgcagacagcatcagctctgaggttcatcatcttcttagcagctcatcagcttataaactactaatcttgagtgggcaaagtttagagcctgggggagacctcatcctacagagtggcacctactcatatgaaaactttgcccaggtccttcacaaccccgagatttcccaattgctcagcaatagagaccctgggatacaggccttccttaccgtgtcctgcttaggggaaggtgattggagccacctgggattatccagttcccaagagaccctgcacctccggctaaaccctgagcccactctgcccaccatggacggcgtggctgagttctccgagtatgtctctgagactgtggacgtgccatccccatttgacctactagagccccccacctcagggggcttcctcaagctctccaagccttgttgctacatcttcccaggtggtcgtggggactctgccctctttgctgtcaatggtttcaacatcctggtggatggtggctctgatcgcaagtcctgtttttggaagctggtacggcacttggaccgcattgactcggtgctactcacacacattggggcagacaacctgccaggcatcaatggactactgcagcgcaaagtggcagagctagaggaggagcagtcccagggctctagcagttacagcgactgggtgaagaaccttatctctcctgagcttggagttgtctttttcaacgtgcctgagaagctgcggcttcctgatgcctcccggaaagccaagcgtagcattgaggaggcctgcctcactctgcagcacttaaaccgcctgggcatccaggctgagcctctatatcgtgtggtcagcaataccattgagccactgaccctcttccacaaaatgggtgtgggccggctggacatgtatgtcctcaaccctgtcaaggacagcaaggagatgcagttcctcatgcaaaagtgggcaggcaatagtaaagccaagacaggcatcgtgctgcccaatgggaaggaggctgagatctccgtgccctaccttacctctatcactgctctggtggtctggctaccagccaatcccactgagaagattgtgcgtgtgctttttccaggaaatgctccccaaaacaagatcttggagggcctagaaaagcttcggcatctggacttcctgcgttaccctgtggccacgcagaaggacctggcttctggggctgtgcctaccaacctcaagcccagcaaaatcaaacagcgggctgatagcaaggagagcctcaaagccactaccaagacggccgtgagcaagttggccaaacgggaggaggtggtagaagagggagccaaggaggcacgttcagagctggccaaggagttagccaagacagagaagaaggcaaaagagtcatctgagaagcccccagagaagcctgccaagcctgagagggtgaagacagagtcaagtgaggcactgaaggcagagaagcgaaagctgatcaaagacaaggtagggaaaaagcaccttaaagaaaagatatcaaagctggaagaaaaaaaagacaaggagaaaaaagagatcaaaaaggagaggaaagagctcaagaaggatgaaggaaggaaggaggagaagaaggatgccaagaaggaggagaagaggaaagataccaaacctgagctcaagaagatttccaagccagacctaaagccctttactcctgaggtacgtaagaccctctataaagccaaggtccctggaagagtcaaaatagacaggagccgtgctatccgtggggagaaggagctgtcttctgagccccagacacccccagcccagaagggaactgtaccactcccaaccatcagtgggcacagggagctggtcctatcctcaccagaggacctcacacaggactttgaggagatgaagcgtgaggagagggctttgctggctgaacaaagggacacaggactaggagataagccattccctctagacactgcagaggagggacccccaagtacagctatccagggaacaccaccctctgttccagggctgggacaagaagaacatgtgatgaaggagaaagagcttgtcccagaggtccctgaggaacaaggcagcaaggacagaggcctagactctggggctgaaacagaggaagagaaagatacctgggaggaaaagaagcagagggaagcagagaggctcccagacagaacagaagccagagaggaaagtgaacctgaagtaaaggaggatgtgatagaaaaggctgagttagaagaaatggaggaggtacacccttcagatgaggaggaagaggacgcgacaaaagctgagggtttttaccaaaaacatatgcaggaacccttgaaggtaactccaaggagccgggaggcttttgggggtcgggaattgggactccagggcaaggcccctgagaaggagacctcgttattcctaagcagcctgaccacacctgcaggagccactgagcatgtctcttacatccaggatgagacaatccctggctactcagagactgagcagaccatctcagatgaggagatccatgatgagccggaggagcgcccagctccacccagatttcatacaagtacatatgacctgcccgggcctgaaggtgctggcccattcgaagccagccaacctgccgatagtgctgttcctgctacctctggcaaagtctatggaacgccagagactgaactcacctaccccactaacatagtggctgcccctttggctgaagaggaacatgtgtcctcggccacttcaatcactgagtgtgacaaactttcttcctttgccacatcagtggctgaggaccaatctgtggcctcacttacagctccccagacagaggagacaggcaagagctccctgctgcttgacacagtcacaagcatcccttcctcccgtactgaagctacgcagggcttggactatgtgccatcagctggtaccatctcacccacctcctcactggaagaagacaagggcttcaaatcaccaccctgtgaggacttctctgtgactggggagtcagagaagagaggagagatcatagggaaaggcttgtctggagagagagctgtggaagaggaagaggaggagacagcaaacgtagagatgtctgagaaactttgcagtcaatatggaactccagtgtttagtgcccctgggcatgccctacatccaggagaaccagcccttggagaagcagaggagcggtgccttagcccagatgacagcacagtgaagatggcttctcctccaccatctggcccacccagtgccacccacacaccctttcatcagtccccagtggaagaaaagtctgagccccaagactttcaggaggcagactcctggggagacactaagcgcacaccaggtgtgggcaaagaagatgctgctgaggagacagtcaagccagggcctgaagagggcacactagagaaggaagagaaagttcctcctcccaggagcccccaggcccaggaagcacctgtcaacattgatgaggggcttacaggctgtaccattcaactgttgccagcacaggataaagcaatagtctttgagattatggaggcaggagagcccacaggcccaattctgggagcagaagcccttcccggaggtttgaggactttaccccaagaacctggcaaacctcagaaagatgaggtgctcagatatcctgaccgaagcctctctcctgaagatgcagaatccctctctgtcctcagcgtgccctccccagacactgccaaccaagagcctacccccaagtctccctgtggcctgacagaacagtacctacacaaagaccgttggccagaggtatctccagaagacacccagtcactttctctgtcagaagagagtcccagcaaggagacctccctggatgtctcttctaagcagctctctccagaaagccttggcaccctccagtttggggaactaaaccttgggaaggaagaaatggggcatctgatgcaggccgaggatacctctcaccacacagctcccatgtctgttccagagccccatgcagccacagcgtcacctcccacagatgggacaactcgatactctgcacagacagacatcacagatgacagccttgacaggaagtcacctgccagctcattctctcactctacaccttcaggaaatgggaagtacttacctggggcgatcacaagccctgatgaacacattctgacacctgatagctccttctccaagagtcctgagtctttgccaggccctgccttggaggacattgccataaagtgggaagataaagttccagggttgaaagacagaacctcagaacagaagaaggaacctgagccaaaggatgaagttttacagcagaaagacaaaactctggagcacaaggaggtggtagagccgaaggatacagccatctatcagaaagatgaggctctgcatgtaaagaatgaggctgtgaaacagcaggataaggctttagaacaaaagggcagagacttagagcaaaaagacacagccctagaacagaaggacaaggccctggaaccaaaagacaaagacttagaagaaaaagacaaggccctggaacagaaggataagattccagaagagaaagacaaagccttagaacaaaaggatacagccctggaacagaaggacaaggccctggaaccaaaagataaagacttggaacaaaaggacagggtcctagaacagaaggagaagatcccagaagagaaagacaaagccttagatcaaaaagtcagaagtgttgaacataaggctccggaggacacggtcgctgaaatgaaggacagagacctagaacagacagacaaagcccctgaacagaaacaccaggcccaggaacaaaaggataaagtctcagaaaagaaggatcaggccttagaacaaaaatactgggctttgggacagaaggatgaagccctggaacaaaacattcaggctctggaagagaaccaccaaactcaggagcaggagagcctagtgcaggaggataaaaccaggaaaccaaagatgctagaggaaaaatccccagaaaaggtcaaggccatggaagagaagttagaagctcttctggagaagaccaaagctctgggcctggaagagagcctagtgcaggagggcagggccagagagcaggaagaaaagtactggagggggcaggatgtggtccaggagtggcaagaaacatctcctaccagagaggagccggctggagaacagaaagagcttgccccggcatgggaggacacatctcctgagcaggacaataggtattggaggggcagagaggatgtggccttggaacaggacacatactggagggagctaagctgtgagcggaaggtctggttccctcacgagctggatggccagggggcccgcccacactacactgaggaacgggaaagcactttcctagatgagggcccagatgatgagcaagaagtacccctgcgggaacacgcaacccggagcccctgggcctcagacttcaaggatttccaggaatcctcaccacagaaggggctagaggtggagcgctggcttgctgaatcaccagttgggttgccaccagaggaagaggacaaactgacccgctctccctttgagatcatctcccctccagcttccccacctgagatggttggacaaagggttccttcagccccaggacaagagagtcctatcccagaccctaagctcatgccacacatgaagaatgaacccactactccctcatggctggctgacatcccaccctgggtgcccaaggacagacccctcccccctgcacccctctccccagctcctggtccccccacacctgccccggaatcccatactcctgcacccttctcttggggcacagccgagtatgacagtgtggtggctgcagtncaggagggggcagctgagttggaaggtgggccatactcccccctggggaaggactaccgcaaggntgaaggggaaagggaagaagaaggtagggctgaggctcctgacaaaagctcacacagctcaaaggtaccagaggccagcaaaagccatgccaccacggagcctgagcagactgagccggagcagagagagcccacaccctatcctgatgagagaagctttcagtatgcagacatctatgagcagatgatgcttactgggcttggccctgcatgccccactagagagcctccacttggttgagaggcatgggggccaatccccagctgctccaagccggaattc

SEQ ID NO: 314435 - DNA, 5112 bp, Homo sapiens
ttccctgaagctgccggctgaggccggagctgccgcctccatgagaggcttcctcctacaccccagggccagaggaccctttgccaccagagtgagatcctagagaccatcatcctggtaaatcccagtgcagacagcatcagctctgaggttcatcatcttcttagcagctcatcagcttataaactactaatcttgagtgggcaaagtttagagcctgggggagacctcatcctacagagtggcacctactcatatgaaaactttgcccaggtccttcacaaccccgagatttcccaattgctcagcaatagagaccctgggatacaggccttccttaccgtgtcctgcttaggggaaggtgattggagccacctgggattatccagttcccaagagaccctgcacctccggctaaaccctgagcccactctgcccaccatggacggcgtggctgagttctccgagtatgtctctgagactgtggacgtgccatccccatttgacctactagagccccccacctcagggggcttcctcaagctctccaagccttgttgctacatcttcccaggtggtcgtggggactctgccctctttgctgtcaatggtttcaacatcctggtggatggtggctctgatcgcaagtcctgtttttggaagctggtacggcacttggaccgcattgactcggtgctactcacacacattggggcagacaacctgccaggcatcaatggactactgcagcgcaaagtggcagagctagaggaggagcagtcccagggctctagcagttacagcgactgggtgaagaaccttatctctcctgagcttggagttgtctttttcaacgtgcctgagaagctgcggcttcctgatgcctcccggaaagccaagcgtagcattgaggaggcctgcctcactctgcagcacttaaaccgcctgggcatccaggctgagcctctatatcgtgtggtcagcaataccattgagccactgaccctcttccacaaaatgggtgtgggccggctggacatgtatgtcctcaaccctgtcaaggacagcaaggagatgcagttcctcatgcaaaagtgggcaggcaatagtaaagccaagacaggcatcgtgctgcccaatgggaaggaggctgagatctccgtgccctaccttacctctatcactgctctggtggtctggctaccagccaatcccactgagaagattgtgcgtgtgctttttccaggaaatgctccccaaaacaagatcttggagggcctagaaaagcttcggcatctggacttcctgcgttaccctgtggccacgcagaaggacctggcttctggggctgtgcctaccaacctcaagcccagcaaaatcaaacagcgggctgatagcaaggagagcctcaaagccactaccaagacggccgtgagcaagttggccaaacgggaggaggtggtagaagagggagccaaggaggcacgttcagagctggccaaggagttagccaagacagagaagaaggcaaaagagtcatctgagaagcccccagagaagcctgccaagcctgagagggtgaagacagagtcaagtgaggcactgaaggcagagaagcgaaagctgatcaaagacaaggtagggaaaaagcaccttaaagaaaagatatcaaagctggaagaaaaaaaagacaaggagaaaaaagagatcaaaaaggagaggaaagagctcaagaaggatgaaggaaggaaggaggagaagaaggatgccaagaaggaggagaagaggaaagataccaaacctgagctcaagaagatttccaagccagacctaaagccctttactcctgaggtacgtaagaccctctataaagccaaggtccctggaagagtcaaaatagacaggagccgtgctatccgtggggagaaggagctgtcttctgagccccagacacccccagcccagaagggaactgtaccactcccaaccatcagtgggcacagggagctggtcctatcctcaccagaggacctcacacaggactttgaggagatgaagcgtgaggagagggctttgctggctgaacaaagggacacaggactaggagataagccattccctctagacactgcagaggagggacccccaagtacagctatccagggaacaccaccctctgttccagggctgggacaagaagaacatgtgatgaaggagaaagagcttgtcccagaggtccctgaggaacaaggcagcaaggacagaggcctagactctggggctgaaacagaggaagagaaagatacctgggaggaaaagaagcagagggaagcagagaggctcccagacagaacagaagccagagaggaaagtgaacctgaagtaaaggaggatgtgatagaaaaggctgagttagaagaaatggaggaggtacacccttcagatgaggaggaagaggacgcgacaaaagctgagggtttttaccaaaaacatatgcaggaacccttgaaggtaactccaaggagccgggaggcttttgggggtcgggaattgggactccagggcaaggcccctgagaaggagacctcgttattcctaagcagcctgaccacacctgcaggagccactgagcatgtctcttacatccaggatgagacaatccctggctactcagagactgagcagaccatctcagatgaggagatccatgatgagccggaggagcgcccagctccacccagatttcatacaagtacatatgacctgcccgggcctgaaggtgctggcccattcgaagccagccaacctgccgatagtgctgttcctgctacctctggcaaagtctatggaacgccagagactgaactcacctaccccactaacatagtggctgcccctttggctgaagaggaacatgtgtcctcggccacttcaatcactgagtgtgacaaactttcttcctttgccacatcagtggctgaggaccaatctgtggcctcacttacagctccccagacagaggagacaggcaagagctccctgctgcttgacacagtcacaagcatcccttcctcccgtactgaagctacgcagggcttggactatgtgccatcagctggtaccatctcacccacctcctcactggaagaagacaagggcttcaaatcaccaccctgtgaggacttctctgtgactggggagtcagagaagagaggagagatcatagggaaaggcttgtctggagagagagctgtggaagaggaagaggaggagacagcaaacgtagagatgtctgagaaactttgcagtcaatatggaactccagtgtttagtgcccctgggcatgccctacatccaggagaaccagcccttggagaagcagaggagcggtgccttagcccagatgacagcacagtgaagatggcttctcctccaccatctggcccacccagtgccacccacacaccctttcatcagtccccagtggaagaaaagtctgagccccaagactttcaggaggcagactcctggggagacactaagcgcacaccaggtgtgggcaaagaagatgctgctgaggagacagtcaagccagggcctgaagagggcacactagagaaggaagagaaagttcctcctcccaggagcccccaggcccaggaagcacctgtcaacattgatgaggggcttacaggctgtaccattcaactgttgccagcacaggataaagcaatagtctttgagattatggaggcaggagagcccacaggcccaattctgggagcagaagcccttcccggaggtttgaggactttaccccaagaacctggcaaacctcagaaagatgaggtgctcagatatcctgaccgaagcctctctcctgaagatgcagaatccctctctgtcctcagcgtgccctccccagacactgccaaccaagagcctacccccaagtctccctgtggcctgacagaacagtacctacacaaagaccgttggccagaggtatctccagaagacacccagtcactttctctgtcagaagagagtcccagcaaggagacctccctggatgtctcttctaagcagctctctccagaaagccttggcaccctccagtttggggaactaaaccttgggaaggaagaaatggggcatctgatgcaggccgaggatacctctcaccacacagctcccatgtctgttccagagccccatgcagccacagcgtcacctcccacagatgggacaactcgatactctgcacagacagacatcacagatgacagccttgacaggaagtcacctgccagctcattctctcactctacaccttcaggaaatgggaagtacttacctggggcgatcacaagccctgatgaacacattctgacacctgatagctccttctccaagagtcctgagtctttgccaggccctgccttggaggacattgccataaagtgggaagataaagttccagggttgaaagacagaacctcagaacagaagaaggaacctgatcccttctcatcccctgcttggcttctctgcatgtggtcatctgctgtggcttggtgtttaatgggttaaaaataagccactgcctgacatcccaacatttgacaccccagcaatgtgtgactcccccaacattccactatgccatcctgcagctgaaatgggaacactggctgcctctccaaacccgctcttggacagaggatctgggaggtggaagccaggccagaggacttggggaaaatgagatggaggaaggaaaaagggagaagctgagccacagcttaactcctacagagtgaaatgaaaacgggctgaaaataccaccccaggagaggacctcgccccaagcaagccagtgagcagccctgccagactactgccagactgagaaacccagaagctggtagtcatgtgggcttgccttctctgccaaacgactgggaaaccaaaatgagcccaccttgtgttcttcctagctccaccctccccgtgctgctgtgttctgctcctccccacgcttccctgctatagttcccagctgctgtaacggagccacctccaactctaacaataaaccaagttcattgc

SEQ ID NO: 314436 - DNA, 920 bp, Homo sapiens
gtccatatgagctgtctccagggaagggaagtcagatgagtcaggatagggcatattctagcagggtcctgggggtatcccactgctatactgttctactgcttccctcagtatctgaatgtctcaatttaaaacttgaagctctttagaccaatagactggtgagaggagaaaggagcttatcccccagaccctgctttataccattcacatcccagggctgtgtccagacagcacaaaacggcaaggagagcccaagccccaatgccagaattcttccaaactccctgactctttgaagtttttactcaccccatttcaattatcctgatcccttctcatcccctgcttggcttctctgcatgtggtcatctgctgtggcttggtgtttaatgggttaaaaataagccactgcctgacatcccaacatttgacaccccagcaatgtgtgactcccccaacattccactatgccatcctgcagctgaaatgggaacactggctgcctctccaaacccgctcttggacagaggatctgggaggtggaagccaggccagaggacttggggaaaatgagatggaggaaggaaaaagggagaagctgagccacagcttaactcctacagagtgaaatgaaaacgggctgaaaataccaccccaggagaggacctcgccccaagcaagccagtgagcagccctgccagactactgccagactgagaaacccagaagctggtagtcatgtgggcttgccttctctgccaaacgactgggaaaccaaaatgagcccaccttgtgttcttcctagctccaccctccccgtgctgctgtgttctgctcctccccacgcttccctgctatagttcccagctgctgtaacggagccacctccaactctaacaataaaccaagttcattgc

SEQ ID NO: 314437 - DNA, 10239 bp, Homo sapiens
  misc_feature (6111)..(6111): n is a, c, g, or t
  misc_feature (6176)..(6176): n is a, c, g, or t
ttccctgaagctgccggctgaggccggagctgccgcctccatgagaggcttcctcctacaccccagggccagaggaccctttgccaccagagtgagatcctagagaccatcatcctggtaaatcccagtgcagacagcatcagctctgaggttcatcatcttcttagcagctcatcagcttataaactactaatcttgagtgggcaaagtttagagcctgggggagacctcatcctacagagtggcacctactcatatgaaaactttgcccaggtccttcacaaccccgagatttcccaattgctcagcaatagagaccctgggatacaggccttccttaccgtgtcctgcttaggggaaggtgattggagccacctgggattatccagttcccaagagaccctgcacctccggctaaaccctgagcccactctgcccaccatggacggcgtggctgagttctccgagtatgtctctgagactgtggacgtgccatccccatttgacctactagagccccccacctcagggggcttcctcaagctctccaagccttgttgctacatcttcccaggtggtcgtggggactctgccctctttgctgtcaatggtttcaacatcctggtggatggtggctctgatcgcaagtcctgtttttggaagctggtacggcacttggaccgcattgactcggtgctactcacacacattggggcagacaacctgccaggcatcaatggactactgcagcgcaaagtggcagagctagaggaggagcagtcccagggctctagcagttacagcgactgggtgaagaaccttatctctcctgagcttggagttgtctttttcaacgtgcctgagaagctgcggcttcctgatgcctcccggaaagccaagcgtagcattgaggaggcctgcctcactctgcagcacttaaaccgcctgggcatccaggctgagcctctatatcgtgtggtcagcaataccattgagccactgaccctcttccacaaaatgggtgtgggccggctggacatgtatgtcctcaaccctgtcaaggacagcaaggagatgcagttcctcatgcaaaagtgggcaggcaatagtaaagccaagacaggcatcgtgctgcccaatgggaaggaggctgagatctccgtgccctaccttacctctatcactgctctggtggtctggctaccagccaatcccactgagaagattgtgcgtgtgctttttccaggaaatgctccccaaaacaagatcttggagggcctagaaaagcttcggcatctggacttcctgcgttaccctgtggccacgcagaaggacctggcttctggggctgtgcctaccaacctcaagcccagcaaaatcaaacagcgggctgatagcaaggagagcctcaaagccactaccaagacggccgtgagcaagttggccaaacgggaggaggtggtagaagagggagccaaggaggcacgttcagagctggccaaggagttagccaagacagagaagaaggcaaaagagtcatctgagaagcccccagagaagcctgccaagcctgagagggtgaagacagagtcaagtgaggcactgaaggcagagaagcgaaagctgatcaaagacaaggtagggaaaaagcaccttaaagaaaagatatcaaagctggaagaaaaaaaagacaaggagaaaaaagagatcaaaaaggagaggaaagagctcaagaaggatgaaggaaggaaggaggagaagaaggatgccaagaaggaggagaagaggaaagataccaaacctgagctcaagaagatttccaagccagacctaaagccctttactcctgaggtacgtaagaccctctataaagccaaggtccctggaagagtcaaaatagacaggagccgtgctatccgtggggagaaggagctgtcttctgagccccagacacccccagcccagaagggaactgtaccactcccaaccatcagtgggcacagggagctggtcctatcctcaccagaggacctcacacaggactttgaggagatgaagcgtgaggagagggctttgctggctgaacaaagggacacaggactaggagataagccattccctctagacactgcagaggagggacccccaagtacagctatccagggaacaccaccctctgttccagggctgggacaagaagaacatgtgatgaaggagaaagagcttgtcccagaggtccctgaggaacaaggcagcaaggacagaggcctagactctggggctgaaacagaggaagagaaagatacctgggaggaaaagaagcagagggaagcagagaggctcccagacagaacagaagccagagaggaaagtgaacctgaagtaaaggaggatgtgatagaaaaggctgagttagaagaaatggaggaggtacacccttcagatgaggaggaagaggacgcgacaaaagctgagggtttttaccaaaaacatatgcaggaacccttgaaggtaactccaaggagccgggaggcttttgggggtcgggaattgggactccagggcaaggcccctgagaaggagacctcgttattcctaagcagcctgaccacacctgcaggagccactgagcatgtctcttacatccaggatgagacaatccctggctactcagagactgagcagaccatctcagatgaggagatccatgatgagccggaggagcgcccagctccacccagatttcatacaagtacatatgacctgcccgggcctgaaggtgctggcccattcgaagccagccaacctgccgatagtgctgttcctgctacctctggcaaagtctatggaacgccagagactgaactcacctaccccactaacatagtggctgcccctttggctgaagaggaacatgtgtcctcggccacttcaatcactgagtgtgacaaactttcttcctttgccacatcagtggctgaggaccaatctgtggcctcacttacagctccccagacagaggagacaggcaagagctccctgctgcttgacacagtcacaagcatcccttcctcccgtactgaagctacgcagggcttggactatgtgccatcagctggtaccatctcacccacctcctcactggaagaagacaagggcttcaaatcaccaccctgtgaggacttctctgtgactggggagtcagagaagagaggagagatcatagggaaaggcttgtctggagagagagctgtggaagaggaagaggaggagacagcaaacgtagagatgtctgagaaactttgcagtcaatatggaactccagtgtttagtgcccctgggcatgccctacatccaggagaaccagcccttggagaagcagaggagcggtgccttagcccagatgacagcacagtgaagatggcttctcctccaccatctggcccacccagtgccacccacacaccctttcatcagtccccagtggaagaaaagtctgagccccaagactttcaggaggcagactcctggggagacactaagcgcacaccaggtgtgggcaaagaagatgctgctgaggagacagtcaagccagggcctgaagagggcacactagagaaggaagagaaagttcctcctcccaggagcccccaggcccaggaagcacctgtcaacattgatgaggggcttacaggctgtaccattcaactgttgccagcacaggataaagcaatagtctttgagattatggaggcaggagagcccacaggcccaattctgggagcagaagcccttcccggaggtttgaggactttaccccaagaacctggcaaacctcagaaagatgaggtgctcagatatcctgaccgaagcctctctcctgaagatgcagaatccctctctgtcctcagcgtgccctccccagacactgccaaccaagagcctacccccaagtctccctgtggcctgacagaacagtacctacacaaagaccgttggccagaggtatctccagaagacacccagtcactttctctgtcagaagagagtcccagcaaggagacctccctggatgtctcttctaagcagctctctccagaaagccttggcaccctccagtttggggaactaaaccttgggaaggaagaaatggggcatctgatgcaggccgaggatacctctcaccacacagctcccatgtctgttccagagccccatgcagccacagcgtcacctcccacagatgggacaactcgatactctgcacagacagacatcacagatgacagccttgacaggaagtcacctgccagctcattctctcactctacaccttcaggaaatgggaagtacttacctggggcgatcacaagccctgatgaacacattctgacacctgatagctccttctccaagagtcctgagtctttgccaggccctgccttggaggacattgccataaagtgggaagataaagttccagggttgaaagacagaacctcagaacagaagaaggaacctgagccaaaggatgaagttttacagcagaaagacaaaactctggagcacaaggaggtggtagagccgaaggatacagccatctatcagaaagatgaggctctgcatgtaaagaatgaggctgtgaaacagcaggataaggctttagaacaaaagggcagagacttagagcaaaaagacacagccctagaacagaaggacaaggccctggaaccaaaagacaaagacttagaagaaaaagacaaggccctggaacagaaggataagattccagaagagaaagacaaagccttagaacaaaaggatacagccctggaacagaaggacaaggccctggaaccaaaagataaagacttggaacaaaaggacagggtcctagaacagaaggagaagatcccagaagagaaagacaaagccttagatcaaaaagtcagaagtgttgaacataaggctccggaggacacggtcgctgaaatgaaggacagagacctagaacagacagacaaagcccctgaacagaaacaccaggcccaggaacaaaaggataaagtctcagaaaagaaggatcaggccttagaacaaaaatactgggctttgggacagaaggatgaagccctggaacaaaacattcaggctctggaagagaaccaccaaactcaggagcaggagagcctagtgcaggaggataaaaccaggaaaccaaagatgctagaggaaaaatccccagaaaaggtcaaggccatggaagagaagttagaagctcttctggagaagaccaaagctctgggcctggaagagagcctagtgcaggagggcagggccagagagcaggaagaaaagtactggagggggcaggatgtggtccaggagtggcaagaaacatctcctaccagagaggagccggctggagaacagaaagagcttgccccggcatgggaggacacatctcctgagcaggacaataggtattggaggggcagagaggatgtggccttggaacaggacacatactggagggagctaagctgtgagcggaaggtctggttccctcacgagctggatggccagggggcccgcccacactacactgaggaacgggaaagcactttcctagatgagggcccagatgatgagcaagaagtacccctgcgggaacacgcaacccggagcccctgggcctcagacttcaaggatttccaggaatcctcaccacagaaggggctagaggtggagcgctggcttgctgaatcaccagttgggttgccaccagaggaagaggacaaactgacccgctctccctttgagatcatctcccctccagcttccccacctgagatggttggacaaagggttccttcagccccaggacaagagagtcctatcccagaccctaagctcatgccacacatgaagaatgaacccactactccctcatggctggctgacatcccaccctgggtgcccaaggacagacccctcccccctgcacccctctccccagctcctggtccccccacacctgccccggaatcccatactcctgcacccttctcttggggcacagccgagtatgacagtgtggtggctgcagtncaggagggggcagctgagttggaaggtgggccatactcccccctggggaaggactaccgcaaggntgaaggggaaagggaagaagaaggtagggctgaggctcctgacaaaagctcacacagctcaaaggtaccagaggccagcaaaagccatgccaccacggagcctgagcagactgagccggagcagagagagcccacaccctatcctgatgagagaagctttcagtatgcagacatctatgagcagatgatgcttactgggcttggccctgcatgccccactagagagcctccacttggagcagctggggattggcccccatgcctctcaaccaaggaggcagctgccggccgaaacacatctgcagagaaggagctttcatctcctatctcacccaagagcctccagtctgacactccaaccttcagctatgcagccctggcaggacccactgtacccccaaggccagagccagggccaagtatggagcccagcctcaccccacctgcagttcccccccgtgctcctatcctgagcaaaggcccaagcccccctcttaatggtaacatcctgagctgcagcccagataggaggtccccatcccccaaggaatcaggccggagtcactgggatgacagcactagtgactcagaactggagaagggggctcgggaacagccagaaaaagaggcccaatccccaagtcctcctcaccccattcctatggggtcccccacattatggccagaaactgaggcacatgttagccctcccttggactcacacctggggcctgcccgacccagtctggacttccctgcttcagcctttggcttctcctcattgcagccagctcccccacagctgccctctccagctgaaccccgctcggcaccctgtggctcccttgccttctctggggatcgagctctggctctggctccaggaccccccaccagaacccggcatgatgaatacctggaagtgaccaaggcccccagcctggattcctcactgccccagctcccatcacccagttctcctggggcccctctcctctccaatctgccacgacctgcctcaccagccctgtctgagggctcctcctctgaggctaccacgcctgtgatttcaagtgtggcggagcgcttctctccaagccttgaggctgcagaacaggagtctggagagctggacccaggaatggaaccagctgcccacagcctctgggacctcactcctctgagcccagcacccccagcttcactggacttggccctagctccagctccaagcctgcctggagacatgggtgatggcatcctgccgtgccacctggagtgctcagaggcagccacggagaagccaagccccttccaggttccctctgaggattgtgcagccaatggcccaactgaaaccagccctaaccccccaggccctgccccagccaaggctgaaaatgaagaggctgcggcttgccctgcctgggaacgtggggcctggcctgaaggagctgagaggagctcccggcctgacacattgctctcccctgagcagccagtgtgtcctgcagggggctccgggggcccacccagcagtgcctctcctgaggtcgaagctgggccccagggatgtgccactgagcctcggccccatcgtggggagctctccccatccttcctgaacccacctctgcccccatccatagatgatagggacctctcaactgaggaagttcggctagtaggaagaggggggcggcgccgggtaggggggccagggaccactgggggcccatgccctgtgactgatgagacaccccctacatcagccagtgactcaggctcctcacagtcagattctgatgtcccgccagaaactgaggagtgtccgtccatcacagctgaggcagccctcgactcagatgaagatggagacttcctacctgtggacaaagctgggggtgtcagtggtactcaccaccccaggcctggccatgacccacctcctctcccacagccagacccccgcccatcccctccccgccctgatgtgtgcatggctgaccccgaggggctcagctcagagtctgggagagtagagaggctacgggagaaggaaaaggttcaggggcgagtagggcgtagggccccaggtaaggacaagccagtgtcccctgcacggcgtctggttcttcggggaaaacgctcacccacccctggtaaagggcctgcagatcgagcatcccgggccccacctcgaccacgcagcaccacaagccaggtcaccccagcagaggaaaaggatggacacagccccatgtccaaaggcctagtcaatggactcaaggcaggaccaatggccttgagttccaagggcagctctggtgcccctgtatatgtggatctcgcctacatcccgaatcattgcagtggcaagactgctgaccttgacttcttccgtcgagtgcgtgcatcctactatgtggtcagtgggaatgaccctgccaatggcgagccaagccgggctgtgctggatgccctgctggagggcaaggcccagtggggggagaatcttcaggtgactctgatccctactcatgacacggaggtgactcgtgagtggtaccaacaaactcatgagcagcagcaacaactgaatgtcctggtcctggctagcagcagcaccgtggtgatgcaggatgagtccttccctgcctgcaagattgagttctgaaagagccgccctcccttccccaaggatccactcccccagctcctttagagaatggctactgctgagtcctttggggttgagggagatgggagctagggggaggggagggagatgtcttgttgtggggacttgggctgggctaaatgggaggggttgtccctccccatcatccattcctgtgaggtgtctcaaaccaaagttaacagggagaggatgggggaggggacaaattagaataggatagcatctgatgcctgagaaccctctcctagcactgtcaaatgctggtattgaatggggactgaggatgggtctcagagagcaacctcctccctcgtagagggagattatatccccaactccagggacctctttatctcaatctatttatttggcatcctgggaaggatttccaatagtaatttatgtgacctggggcaggataccgtcagtgaggtgcccagagctgcaccctttcctccatttcccatcccccatctcctcaaccaccagggtctgagttctagcagggtcctgggggtatcccactgctatactgttctactgcttccctcagtatctgaatgtctcaatttaaaacttgaagctctttagaccaatagactggtgagaggagaaaggagcttatcccccagaccctgctttataccattcacatcccagggctgtgtccagacagcacaaaacggcaaggagagcccaagccccaatgccagaattcttccaaactccctgactctttgaagtttttactcaccccatttcaattatcctgatcccttctcatcccctgcttggcttctctgcatgtggtcatctgctgtggcttggtgtttaatgggttaaaaataagccactgcctgacatcccaacatttgacaccccagcaatgtgtgactcccccaacattccactatgccatcctgcagctgaaatgggaacactggctgcctctccaaacccgctcttggacagaggatctgggaggtggaagccaggccagaggacttggggaaaatgagatggaggaaggaaaaagggagaagctgagccacagcttaactcctacagagtgaaatgaaaacgggctgaaaataccaccccaggagaggacctcgccccaagcaagccagtgagcagccctgccagactactgccagactgagaaacccagaagctggtagtcatgtgggcttgccttctctgccaaacgactgggaaaccaaaatgagcccaccttgtgttcttcctagctccaccctccccgtgctgctgtgttctgctcctccccacgcttccctgctatagttcccagctgctgtaacggagccacctccaactctaacaataaaccaagttcattgc

SEQ ID NO: 314438 - DNA, 10266 bp, Homo sapiens
  misc_feature (6111)..(6111): n is a, c, g, or t
  misc_feature (6176)..(6176): n is a, c, g, or t
ttccctgaagctgccggctgaggccggagctgccgcctccatgagaggcttcctcctacaccccagggccagaggaccctttgccaccagagtgagatcctagagaccatcatcctggtaaatcccagtgcagacagcatcagctctgaggttcatcatcttcttagcagctcatcagcttataaactactaatcttgagtgggcaaagtttagagcctgggggagacctcatcctacagagtggcacctactcatatgaaaactttgcccaggtccttcacaaccccgagatttcccaattgctcagcaatagagaccctgggatacaggccttccttaccgtgtcctgcttaggggaaggtgattggagccacctgggattatccagttcccaagagaccctgcacctccggctaaaccctgagcccactctgcccaccatggacggcgtggctgagttctccgagtatgtctctgagactgtggacgtgccatccccatttgacctactagagccccccacctcagggggcttcctcaagctctccaagccttgttgctacatcttcccaggtggtcgtggggactctgccctctttgctgtcaatggtttcaacatcctggtggatggtggctctgatcgcaagtcctgtttttggaagctggtacggcacttggaccgcattgactcggtgctactcacacacattggggcagacaacctgccaggcatcaatggactactgcagcgcaaagtggcagagctagaggaggagcagtcccagggctctagcagttacagcgactgggtgaagaaccttatctctcctgagcttggagttgtctttttcaacgtgcctgagaagctgcggcttcctgatgcctcccggaaagccaagcgtagcattgaggaggcctgcctcactctgcagcacttaaaccgcctgggcatccaggctgagcctctatatcgtgtggtcagcaataccattgagccactgaccctcttccacaaaatgggtgtgggccggctggacatgtatgtcctcaaccctgtcaaggacagcaaggagatgcagttcctcatgcaaaagtgggcaggcaatagtaaagccaagacaggcatcgtgctgcccaatgggaaggaggctgagatctccgtgccctaccttacctctatcactgctctggtggtctggctaccagccaatcccactgagaagattgtgcgtgtgctttttccaggaaatgctccccaaaacaagatcttggagggcctagaaaagcttcggcatctggacttcctgcgttaccctgtggccacgcagaaggacctggcttctggggctgtgcctaccaacctcaagcccagcaaaatcaaacagcgggctgatagcaaggagagcctcaaagccactaccaagacggccgtgagcaagttggccaaacgggaggaggtggtagaagagggagccaaggaggcacgttcagagctggccaaggagttagccaagacagagaagaaggcaaaagagtcatctgagaagcccccagagaagcctgccaagcctgagagggtgaagacagagtcaagtgaggcactgaaggcagagaagcgaaagctgatcaaagacaaggtagggaaaaagcaccttaaagaaaagatatcaaagctggaagaaaaaaaagacaaggagaaaaaagagatcaaaaaggagaggaaagagctcaagaaggatgaaggaaggaaggaggagaagaaggatgccaagaaggaggagaagaggaaagataccaaacctgagctcaagaagatttccaagccagacctaaagccctttactcctgaggtacgtaagaccctctataaagccaaggtccctggaagagtcaaaatagacaggagccgtgctatccgtggggagaaggagctgtcttctgagccccagacacccccagcccagaagggaactgtaccactcccaaccatcagtgggcacagggagctggtcctatcctcaccagaggacctcacacaggactttgaggagatgaagcgtgaggagagggctttgctggctgaacaaagggacacaggactaggagataagccattccctctagacactgcagaggagggacccccaagtacagctatccagggaacaccaccctctgttccagggctgggacaagaagaacatgtgatgaaggagaaagagcttgtcccagaggtccctgaggaacaaggcagcaaggacagaggcctagactctggggctgaaacagaggaagagaaagatacctgggaggaaaagaagcagagggaagcagagaggctcccagacagaacagaagccagagaggaaagtgaacctgaagtaaaggaggatgtgatagaaaaggctgagttagaagaaatggaggaggtacacccttcagatgaggaggaagaggacgcgacaaaagctgagggtttttaccaaaaacatatgcaggaacccttgaaggtaactccaaggagccgggaggcttttgggggtcgggaattgggactccagggcaaggcccctgagaaggagacctcgttattcctaagcagcctgaccacacctgcaggagccactgagcatgtctcttacatccaggatgagacaatccctggctactcagagactgagcagaccatctcagatgaggagatccatgatgagccggaggagcgcccagctccacccagatttcatacaagtacatatgacctgcccgggcctgaaggtgctggcccattcgaagccagccaacctgccgatagtgctgttcctgctacctctggcaaagtctatggaacgccagagactgaactcacctaccccactaacatagtggctgcccctttggctgaagaggaacatgtgtcctcggccacttcaatcactgagtgtgacaaactttcttcctttgccacatcagtggctgaggaccaatctgtggcctcacttacagctccccagacagaggagacaggcaagagctccctgctgcttgacacagtcacaagcatcccttcctcccgtactgaagctacgcagggcttggactatgtgccatcagctggtaccatctcacccacctcctcactggaagaagacaagggcttcaaatcaccaccctgtgaggacttctctgtgactggggagtcagagaagagaggagagatcatagggaaaggcttgtctggagagagagctgtggaagaggaagaggaggagacagcaaacgtagagatgtctgagaaactttgcagtcaatatggaactccagtgtttagtgcccctgggcatgccctacatccaggagaaccagcccttggagaagcagaggagcggtgccttagcccagatgacagcacagtgaagatggcttctcctccaccatctggcccacccagtgccacccacacaccctttcatcagtccccagtggaagaaaagtctgagccccaagactttcaggaggcagactcctggggagacactaagcgcacaccaggtgtgggcaaagaagatgctgctgaggagacagtcaagccagggcctgaagagggcacactagagaaggaagagaaagttcctcctcccaggagcccccaggcccaggaagcacctgtcaacattgatgaggggcttacaggctgtaccattcaactgttgccagcacaggataaagcaatagtctttgagattatggaggcaggagagcccacaggcccaattctgggagcagaagcccttcccggaggtttgaggactttaccccaagaacctggcaaacctcagaaagatgaggtgctcagatatcctgaccgaagcctctctcctgaagatgcagaatccctctctgtcctcagcgtgccctccccagacactgccaaccaagagcctacccccaagtctccctgtggcctgacagaacagtacctacacaaagaccgttggccagaggtatctccagaagacacccagtcactttctctgtcagaagagagtcccagcaaggagacctccctggatgtctcttctaagcagctctctccagaaagccttggcaccctccagtttggggaactaaaccttgggaaggaagaaatggggcatctgatgcaggccgaggatacctctcaccacacagctcccatgtctgttccagagccccatgcagccacagcgtcacctcccacagatgggacaactcgatactctgcacagacagacatcacagatgacagccttgacaggaagtcacctgccagctcattctctcactctacaccttcaggaaatgggaagtacttacctggggcgatcacaagccctgatgaacacattctgacacctgatagctccttctccaagagtcctgagtctttgccaggccctgccttggaggacattgccataaagtgggaagataaagttccagggttgaaagacagaacctcagaacagaagaaggaacctgagccaaaggatgaagttttacagcagaaagacaaaactctggagcacaaggaggtggtagagccgaaggatacagccatctatcagaaagatgaggctctgcatgtaaagaatgaggctgtgaaacagcaggataaggctttagaacaaaagggcagagacttagagcaaaaagacacagccctagaacagaaggacaaggccctggaaccaaaagacaaagacttagaagaaaaagacaaggccctggaacagaaggataagattccagaagagaaagacaaagccttagaacaaaaggatacagccctggaacagaaggacaaggccctggaaccaaaagataaagacttggaacaaaaggacagggtcctagaacagaaggagaagatcccagaagagaaagacaaagccttagatcaaaaagtcagaagtgttgaacataaggctccggaggacacggtcgctgaaatgaaggacagagacctagaacagacagacaaagcccctgaacagaaacaccaggcccaggaacaaaaggataaagtctcagaaaagaaggatcaggccttagaacaaaaatactgggctttgggacagaaggatgaagccctggaacaaaacattcaggctctggaagagaaccaccaaactcaggagcaggagagcctagtgcaggaggataaaaccaggaaaccaaagatgctagaggaaaaatccccagaaaaggtcaaggccatggaagagaagttagaagctcttctggagaagaccaaagctctgggcctggaagagagcctagtgcaggagggcagggccagagagcaggaagaaaagtactggagggggcaggatgtggtccaggagtggcaagaaacatctcctaccagagaggagccggctggagaacagaaagagcttgccccggcatgggaggacacatctcctgagcaggacaataggtattggaggggcagagaggatgtggccttggaacaggacacatactggagggagctaagctgtgagcggaaggtctggttccctcacgagctggatggccagggggcccgcccacactacactgaggaacgggaaagcactttcctagatgagggcccagatgatgagcaagaagtacccctgcgggaacacgcaacccggagcccctgggcctcagacttcaaggatttccaggaatcctcaccacagaaggggctagaggtggagcgctggcttgctgaatcaccagttgggttgccaccagaggaagaggacaaactgacccgctctccctttgagatcatctcccctccagcttccccacctgagatggttggacaaagggttccttcagccccaggacaagagagtcctatcccagaccctaagctcatgccacacatgaagaatgaacccactactccctcatggctggctgacatcccaccctgggtgcccaaggacagacccctcccccctgcacccctctccccagctcctggtccccccacacctgccccggaatcccatactcctgcacccttctcttggggcacagccgagtatgacagtgtggtggctgcagtncaggagggggcagctgagttggaaggtgggccatactcccccctggggaaggactaccgcaaggntgaaggggaaagggaagaagaaggtagggctgaggctcctgacaaaagctcacacagctcaaaggtaccagaggccagcaaaagccatgccaccacggagcctgagcagactgagccggagcagagagagcccacaccctatcctgatgagagaagctttcagtatgcagacatctatgagcagatgatgcttactgggcttggccctgcatgccccactagagagcctccacttggagcagctggggattggcccccatgcctctcaaccaaggaggcagctgccggccgaaacacatctgcagagaaggagctttcatctcctatctcacccaagagcctccagtctgacactccaaccttcagctatgcagccctggcaggacccactgtacccccaaggccagagccagggccaagtatggagcccagcctcaccccacctgcagttcccccccgtgctcctatcctgagcaaaggcccaagcccccctcttaatggtaacatcctgagctgcagcccagataggaggtccccatcccccaaggaatcaggccggagtcactgggatgacagcactagtgactcagaactggagaagggggctcgggaacagccagaaaaagaggcccaatccccaagtcctcctcaccccattcctatggggtcccccacattatggccagaaactgaggcacatgttagccctcccttggactcacacctggggcctgcccgacccagtctggacttccctgcttcagcctttggcttctcctcattgcagccagctcccccacagctgccctctccagctgaaccccgctcggcaccctgtggctcccttgccttctctggggatcgagctctggctctggctccaggaccccccaccagaacccggcatgatgaatacctggaagtgaccaaggcccccagcctggattcctcactgccccagctcccatcacccagttctcctggggcccctctcctctccaatctgccacgacctgcctcaccagccctgtctgagggctcctcctctgaggctaccacgcctgtgatttcaagtgtggcggagcgcttctctccaagccttgaggctgcagaacaggagtctggagagctggacccaggaatggaaccagctgcccacagcctctgggacctcactcctctgagcccagcacccccagcttcactggacttggccctagctccagctccaagcctgcctggagacatgggtgatggcatcctgccgtgccacctggagtgctcagaggcagccacggagaagccaagccccttccaggttccctctgaggattgtgcagccaatggcccaactgaaaccagccctaaccccccaggccctgccccagccaaggctgaaaatgaagaggctgcggcttgccctgcctgggaacgtggggcctggcctgaaggagctgagaggagctcccggcctgacacattgctctcccctgagcagccagtgtgtcctgcagggggctccgggggcccacccagcagtgcctctcctgaggtcgaagctgggccccagggatgtgccactgagcctcggccccatcgtggggagctctccccatccttcctgaacccacctctgcccccatccatagatgatagggacctctcaactgaggaagttcggctagtaggaagaggggggcggcgccgggtaggggggccagggaccactgggggcccatgccctgtgactgatgagacaccccctacatcagccagtgactcaggctcctcacagtcagattctgatgtcccgccagaaactgaggagtgtccgtccatcacagctgaggcagccctcgactcagatgaagatggagacttcctacctgtggacaaagctgggggtgtcagtggtactcaccaccccaggcctggccatgacccacctcctctcccacagccagacccccgcccatcccctccccgccctgatgtgtgcatggctgaccccgaggggctcagctcagagtctgggagagtagagaggctacgggagaaggaaaaggttcaggggcgagtagggcgtagggccccaggtaaggacaagccagtgtcccctgcacggcgtctggttcttcggggaaaacgctcacccacccctggtaaagggcctgcagatcgagcatcccgggccccacctcgaccacgcagcaccacaagccaggtcaccccagcagaggaaaaggatggacacagccccatgtccaaaggcctagtcaatggactcaaggcaggaccaatggccttgagttccaagggcagctctggtgcccctgtatatgtggatctcgcctacatcccgaatcattgcagtggcaagactgctgaccttgacttcttccgtcgagtgcgtgcatcctactatgtggtcagtgggaatgaccctgccaatggcgagccaagccgggctgtgctggatgccctgctggagggcaaggcccagtggggggagaatcttcaggtgactctgatccctactcatgacacggaggtgactcgtgagtggtaccaacaaactcatgagcagcagcaacaactgaatgtcctggtcctggctagcagcagcaccgtggtgatgcaggatgagtccttccctgcctgcaagattgagttctgaaagagccgccctcccttccccaaggatccactcccccagctcctttagagaatggctactgctgagtcctttggggttgagggagatgggagctagggggaggggagggagatgtcttgttgtggggacttgggctgggctaaatgggaggggttgtccctccccatcatccattcctgtgaggtgtctcaaaccaaagttaacagggagaggatgggggaggggacaaattagaataggatagcatctgatgcctgagaaccctctcctagcactgtcaaatgctggtattgaatggggactgaggatgggtctcagagagcaacctcctccctcgtagagggagattatatccccaactccagggacctctttatctcaatctatttatttggcatcctgggaaggatttccaatagtaatttatgtgacctggggcaggataccgtcagtgaggtgcccagagctgcaccctttcctccatttcccatcccccatctcctcaaccaccagggtctgagttctagcagggtcctgggggtatcccactgctatactgttctactgcttccctcagtatctgaatgtctcaatttaaaacttgaagctctttagaccaatagactggtgagaggagaaaggagcttatcccccagaccctgctttataccattcacatcccagggctgtgtccagacagcacaaaacggcaaggagagcccaagccccaatgccagaattcttccaaactccctgactctttgaagtttttactcaccccatttcaattatcctgatcccttctcatcccctgcttggcttctctgcatgtggtcatctgctgtggcttggtgtttaatgggttaaaaataagccactgcctgacatcccaacatttgacaccccagcaatgtgtgactcccccaacattccactatgccatcctgcagctgaaatgggaacactggctgcctctccaaacccgctcttggacagaggatctgggaggtggaagccaggccagaggacttggggaaaatgagatggaggaaggaaaaagggagaagctgagccacagcttaactcctacagagtgaaatgaaaacgggctgaaaataccaccccaggagaggacctcgccccaagcaagccagtgagcagccctgccagactactgccagactgagaaacccagaagctggtagtcatgtgggcttgccttctctgccaaacgactgggaaaccaaaatgagcccaccttgtgttcttcctagctccaccctccccgtgctgctgtgttctgctcctccccacgcttccctgctatagttcccagctgctgtaacggagccacctccaactctaacaataaaccaagttcattgcacacagtctctagtgatcctctaggct

SEQ ID NO: 314439 - DNA, 7020 bp, Homo sapiens
  misc_feature (2892)..(2892): n is a, c, g, or t
  misc_feature (2957)..(2957): n is a, c, g, or t
cgattgctgatggctgactcttgaggatccccttcctctcctcccacctcggagacagcaaacgtagagatgtctgagaaactttgcagtcaatatggaactccagtgtttagtgcccctgggcatgccctacatccaggagaaccagcccttggagaagcagaggagcggtgccttagcccagatgacagcacagtgaagatggcttctcctccaccatctggcccacccagtgccacccacacaccctttcatcagtccccagtggaagaaaagtctgagccccaagactttcaggaggcagactcctggggagacactaagcgcacaccaggtgtgggcaaagaagatgctgctgaggagacagtcaagccagggcctgaagagggcacactagagaaggaagagaaagttcctcctcccaggagcccccaggcccaggaagcacctgtcaacattgatgaggggcttacaggctgtaccattcaactgttgccagcacaggataaagcaatagtctttgagattatggaggcaggagagcccacaggcccaattctgggagcagaagcccttcccggaggtttgaggactttaccccaagaacctggcaaacctcagaaagatgaggtgctcagatatcctgaccgaagcctctctcctgaagatgcagaatccctctctgtcctcagcgtgccctccccagacactgccaaccaagagcctacccccaagtctccctgtggcctgacagaacagtacctacacaaagaccgttggccagaggtatctccagaagacacccagtcactttctctgtcagaagagagtcccagcaaggagacctccctggatgtctcttctaagcagctctctccagaaagccttggcaccctccagtttggggaactaaaccttgggaaggaagaaatggggcatctgatgcaggccgaggatacctctcaccacacagctcccatgtctgttccagagccccatgcagccacagcgtcacctcccacagatgggacaactcgatactctgcacagacagacatcacagatgacagccttgacaggaagtcacctgccagctcattctctcactctacaccttcaggaaatgggaagtacttacctggggcgatcacaagccctgatgaacacattctgacacctgatagctccttctccaagagtcctgagtctttgccaggccctgccttggaggacattgccataaagtgggaagataaagttccagggttgaaagacagaacctcagaacagaagaaggaacctgagccaaaggatgaagttttacagcagaaagacaaaactctggagcacaaggaggtggtagagccgaaggatacagccatctatcagaaagatgaggctctgcatgtaaagaatgaggctgtgaaacagcaggataaggctttagaacaaaagggcagagacttagagcaaaaagacacagccctagaacagaaggacaaggccctggaaccaaaagacaaagacttagaagaaaaagacaaggccctggaacagaaggataagattccagaagagaaagacaaagccttagaacaaaaggatacagccctggaacagaaggacaaggccctggaaccaaaagataaagacttggaacaaaaggacagggtcctagaacagaaggagaagatcccagaagagaaagacaaagccttagatcaaaaagtcagaagtgttgaacataaggctccggaggacacggtcgctgaaatgaaggacagagacctagaacagacagacaaagcccctgaacagaaacaccaggcccaggaacaaaaggataaagtctcagaaaagaaggatcaggccttagaacaaaaatactgggctttgggacagaaggatgaagccctggaacaaaacattcaggctctggaagagaaccaccaaactcaggagcaggagagcctagtgcaggaggataaaaccaggaaaccaaagatgctagaggaaaaatccccagaaaaggtcaaggccatggaagagaagttagaagctcttctggagaagaccaaagctctgggcctggaagagagcctagtgcaggagggcagggccagagagcaggaagaaaagtactggagggggcaggatgtggtccaggagtggcaagaaacatctcctaccagagaggagccggctggagaacagaaagagcttgccccggcatgggaggacacatctcctgagcaggacaataggtattggaggggcagagaggatgtggccttggaacaggacacatactggagggagctaagctgtgagcggaaggtctggttccctcacgagctggatggccagggggcccgcccacactacactgaggaacgggaaagcactttcctagatgagggcccagatgatgagcaagaagtacccctgcgggaacacgcaacccggagcccctgggcctcagacttcaaggatttccaggaatcctcaccacagaaggggctagaggtggagcgctggcttgctgaatcaccagttgggttgccaccagaggaagaggacaaactgacccgctctccctttgagatcatctcccctccagcttccccacctgagatggttggacaaagggttccttcagccccaggacaagagagtcctatcccagaccctaagctcatgccacacatgaagaatgaacccactactccctcatggctggctgacatcccaccctgggtgcccaaggacagacccctcccccctgcacccctctccccagctcctggtccccccacacctgccccggaatcccatactcctgcacccttctcttggggcacagccgagtatgacagtgtggtggctgcagtncaggagggggcagctgagttggaaggtgggccatactcccccctggggaaggactaccgcaaggntgaaggggaaagggaagaagaaggtagggctgaggctcctgacaaaagctcacacagctcaaaggtaccagaggccagcaaaagccatgccaccacggagcctgagcagactgagccggagcagagagagcccacaccctatcctgatgagagaagctttcagtatgcagacatctatgagcagatgatgcttactgggcttggccctgcatgccccactagagagcctccacttggagcagctggggattggcccccatgcctctcaaccaaggaggcagctgccggccgaaacacatctgcagagaaggagctttcatctcctatctcacccaagagcctccagtctgacactccaaccttcagctatgcagccctggcaggacccactgtacccccaaggccagagccagggccaagtatggagcccagcctcaccccacctgcagttcccccccgtgctcctatcctgagcaaaggcccaagcccccctcttaatggtaacatcctgagctgcagcccagataggaggtccccatcccccaaggaatcaggccggagtcactgggatgacagcactagtgactcagaactggagaagggggctcgggaacagccagaaaaagaggcccaatccccaagtcctcctcaccccattcctatggggtcccccacattatggccagaaactgaggcacatgttagccctcccttggactcacacctggggcctgcccgacccagtctggacttccctgcttcagcctttggcttctcctcattgcagccagctcccccacagctgccctctccagctgaaccccgctcggcaccctgtggctcccttgccttctctggggatcgagctctggctctggctccaggaccccccaccagaacccggcatgatgaatacctggaagtgaccaaggcccccagcctggattcctcactgccccagctcccatcacccagttctcctggggcccctctcctctccaatctgccacgacctgcctcaccagccctgtctgagggctcctcctctgaggctaccacgcctgtgatttcaagtgtggcggagcgcttctctccaagccttgaggctgcagaacaggagtctggagagctggacccaggaatggaaccagctgcccacagcctctgggacctcactcctctgagcccagcacccccagcttcactggacttggccctagctccagctccaagcctgcctggagacatgggtgatggcatcctgccgtgccacctggagtgctcagaggcagccacggagaagccaagccccttccaggttccctctgaggattgtgcagccaatggcccaactgaaaccagccctaaccccccaggccctgccccagccaaggctgaaaatgaagaggctgcggcttgccctgcctgggaacgtggggcctggcctgaaggagctgagaggagctcccggcctgacacattgctctcccctgagcagccagtgtgtcctgcagggggctccgggggcccacccagcagtgcctctcctgaggtcgaagctgggccccagggatgtgccactgagcctcggccccatcgtggggagctctccccatccttcctgaacccacctctgcccccatccatagatgatagggacctctcaactgaggaagttcggctagtaggaagaggggggcggcgccgggtaggggggccagggaccactgggggcccatgccctgtgactgatgagacaccccctacatcagccagtgactcaggctcctcacagtcagattctgatgtcccgccagaaactgaggagtgtccgtccatcacagctgaggcagccctcgactcagatgaagatggagacttcctacctgtggacaaagctgggggtgtcagtggtactcaccaccccaggcctggccatgacccacctcctctcccacagccagacccccgcccatcccctccccgccctgatgtgtgcatggctgaccccgaggggctcagctcagagtctgggagagtagagaggctacgggagaaggaaaaggttcaggggcgagtagggcgtagggccccaggtaaggacaagccagtgtcccctgcacggcgtctggttcttcggggaaaacgctcacccacccctggtaaagggcctgcagatcgagcatcccgggccccacctcgaccacgcagcaccacaagccaggtcaccccagcagaggaaaaggatggacacagccccatgtccaaaggcctagtcaatggactcaaggcaggaccaatggccttgagttccaagggcagctctggtgcccctgtatatgtggatctcgcctacatcccgaatcattgcagtggcaagactgctgaccttgacttcttccgtcgagtgcgtgcatcctactatgtggtcagtgggaatgaccctgccaatggcgagccaagccgggctgtgctggatgccctgctggagggcaaggcccagtggggggagaatcttcaggtgactctgatccctactcatgacacggaggtgactcgtgagtggtaccaacaaactcatgagcagcagcaacaactgaatgtcctggtcctggctagcagcagcaccgtggtgatgcaggatgagtccttccctgcctgcaagattgagttctgaaagagccgccctcccttccccaaggatccactcccccagctcctttagagaatggctactgctgagtcctttggggttgagggagatgggagctagggggaggggagggagatgtcttgttgtggggacttgggctgggctaaatgggaggggttgtccctccccatcatccattcctgtgaggtgtctcaaaccaaagttaacagggagaggatgggggaggggacaaattagaataggatagcatctgatgcctgagaaccctctcctagcactgtcaaatgctggtattgaatggggactgaggatgggtctcagagagcaacctcctccctcgtagagggagattatatccccaactccagggacctctttatctcaatctatttatttggcatcctgggaaggatttccaatagtaatttatgtgacctggggcaggataccgtcagtgaggtgcccagagctgcaccctttcctccatttcccatcccccatctcctcaaccaccagggtctgagttctagcagggtcctgggggtatcccactgctatactgttctactgcttccctcagtatctgaatgtctcaatttaaaacttgaagctctttagaccaatagactggtgagaggagaaaggagcttatcccccagaccctgctttataccattcacatcccagggctgtgtccagacagcacaaaacggcaaggagagcccaagccccaatgccagaattcttccaaactccctgactctttgaagtttttactcaccccatttcaattatcctgatcccttctcatcccctgcttggcttctctgcatgtggtcatctgctgtggcttggtgtttaatgggttaaaaataagccactgcctgacatcccaacatttgacaccccagcaatgtgtgactcccccaacattccactatgccatcctgcagctgaaatgggaacactggctgcctctccaaacccgctcttggacagaggatctgggaggtggaagccaggccagaggacttggggaaaatgagatggaggaaggaaaaagggagaagctgagccacagcttaactcctacagagtgaaatgaaaacgggctgaaaataccaccccaggagaggacctcgccccaagcaagccagtgagcagccctgccagactactgccagactgagaaacccagaagctggtagtcatgtgggcttgccttctctgccaaacgactgggaaaccaaaatgagcccaccttgtgttcttcctagctccaccctccccgtgctgctgtgttctgctcctccccacgcttccctgctatagttcccagctgctgtaacggagccacctccaactctaacaataaaccaagttcattgc

SEQ ID NO: 314440 - DNA, 802 bp, Homo sapiens
aggcagacgggaacctgagactttgtccaaacctcggctggaaggctggtcttggcactcggcgtcttagctagtggatttatcgcattaagactgtacttgggcctttttcatgatgacttgggtctcaatccttggagcagctgaaagaacagctcgggccacctgtggatgcacccacaatgaaatcagaggccacgtgaggtttgcaaggcagagtggcctgcagttttaactcgggcactatggcaatgcagacccaaaccaattgtgccagttctttgctgggtggcaaagtgttttcaggcttgtggtcactcctgatttctgtttggaagcacagttctctctctaaggagaatggaaacttggaaaggcctgtaaaatcggaaagcctgtaaaaggccgtagagtggagatgtataaaaatgtacggtcacccatgttttaggggttgaccgggagcggggcgaggaggagggtgggtatgaggcggtagcggaccgcggagtcgagacctacccgaacgacgcgggcgagcggggctttggacgccggtggagacgcaggcgagggtattaaagataatcaaacattatcaagaagaaggacaaggaactgaagttgttcaaggagtgctttgggtctggttgtagaagatcggttgaaattaccaatgcttttcttttcctcagcacacagaggatgatgctgactttgatgaatcccatatcagatgggaatgatggggagcttggcatgtgaacttgatcttcttcacggggggggattaggcccttat

SEQ ID NO: 314441 - DNA, 1695 bp, Homo sapiens
acgtttgcacgccgtgcgtaacgtgcattctggcggtgccgggagcggggcgaggaggagggtgggtatgaggcggtagcggaccgcggagtcgagacctacccgaacgacgcgggcgagcggggctttggacgccggtggagacgcaggcgagactccagcgggaggaagaagaggcctttgccagcagtcagagcagccaaggggcccaatccctcacattctccaagtttgaaggaaagaaaaccaacaagaagacccgcaaggttaccacagtgaagaaatcttcagtacgtcttccagggtcggatcaaagaaggatattgaaatggattccaggcgtgtgcctcgagacaagctggcctgcatcaccaagtgcagcaagcacatcttcgatgccatcaagatcacctagaacgagctggcgtcagcagatgacttcctccccaccctcatctacattgttttgaagggcaacccccatgccttcagtctaatatccagtatatcacgtgcttctgcaatccaagccgactgatgactggagaggatggctactatttcaccaatctggtgagtaagtgagttcttggcgttgtggagaaggactaggaaggtggtggttttggggatgtgataggtcactcaggcccatgacaggtgaatgcttctgtgtgagaaggcagcacggctgaggaagctcactttgcatcagggagcacaaggaccaggccgtacagacactccgcctccccgcacttgatcagagattgtgtttatcctacagaaacagatgacatgtgttgggcatcactccccacggtcctgggtagaagagtccttcacttggcagggctttttcaaccaatgaataaggcaaattatatataagttaataatgccatttcgaaccgagacagatggcagctaaatgaagtttaattaaagaatgagcgcggggcccttttcattgggtactgcatctacttcgaccacaaaagacgaagtgaccccaacttcaagaacaggcttcgagatggaagaaagaaacagaagcttgccaaggagagagctgggctttccaagttacctgaccttaaagatgctgaagctgttcagaagttcttccttgaagaaatacagcttggtgaagagttactagctcaaggtgaatatgagaagggcgtagaccatctgacaaatggaattgctgtgtgtggacagccacagcagttactgcaggccttacagcaaactcttccaccactagtgttccagatgcttttgactaagctcccaacaattagagaattctaagtgctcagagcttggctgaagatgatgtggaatgagaaacaaatgttaacataataaaatctcagttaaaaatatttaaaaaattcttggtagttgagcagctctgggggaataagggcaaatatccttgttatgaactacactgaaatctaccaaagttaatgtttactttgtgtaggtccatttgtctattttatttatttttcccagtgaaaagtgtattttgatagagaacttttcattttataaatacactatgagttactgaaaattcatatcatggatttcatttattcctgaaacatagttaaaatgtacatatgacatggcttatgttaaaaatacccagtgctcagttttgaaagataggcacaaaaa

SEQ ID NO: 314442 - DNA, 2293 bp, Homo sapiens
aggcagacgggaacctgagactttgtccaaacctcggctggaaggctggtcttggcactcggcgtcttagctagtggatttatcgcattaagactgtacttgggcctttttcatgatgacttgggtctcaatccttggagcagctgaaagaacagctcgggccacctgtggatgcacccacaatgaaatcagaggccacgtgaggtttgcaaggcagagtggcctgcagttttaactcgggcactatggcaatgcagacccaaaccaattgtgccagttctttgctgggtggcaaagtgttttcaggcttgtggtcactcctgatttctgtttggaagcacagttctctctctaaggagaatggaaacttggaaaggcctgtaaaatcggaaagcctgtaaaaggccgtagagtggagatgtataaaaatgtacggtcacccatgttttaggggttgaccgggagcggggcgaggaggagggtgggtatgaggcggtagcggaccgcggagtcgagacctacccgaacgacgcgggcgagcggggctttggacgccggtggagacgcaggcgagcaggaagaagatgagccttaggtctgaacgccgaggaattcatgtggatcctgtgcaagaaaggatgtggttactgtggcaaccctacctggcagggtttctgctccaagtgctggagggaagagtagcacaaagccaggcagaagcagattcaggagtactgggagctggtggaacgactccagcgggaggaagaagaggcctttgccagcagtcagagcagccaaggggcccaatccctcacattctccaagtttgaaggaaagaaaaccaacaagaagacccgcaaggttaccacagtgaagaaatcttcagtacgtcttccagggtcggatcaaagaaggatattgaaatggattccaggcgtgtgcctcgagacaagctggcctgcatcaccaagtgcagcaagcacatcttcgatgccatcaagatcacctagaacgagctggcgtcagcagatgacttcctccccaccctcatctacattgttttgaagggcaacccccatgccttcagtctaatatccagtatatcacgtgcttctgcaatccaagccgactgatgactggagaggatggctactatttcaccaatctggtgagtaagtgagttcttggcgttgtggagaaggactaggaaggtggtggttttggggatgtgataggtcactcaggcccatgacaggtgaatgcttctgtgtgagaaggcagcacggctgaggaagctcactttgcatcagggagcacaaggaccaggccgtacagacactccgcctccccgcacttgatcagagattgtgtttatcctacagaaacagatgacatgtgttgggcatcactccccacggtcctgggtagaagagtccttcacttggcagggctttttcaaccaatgaataaggcaaattatatataagttaataatgccatttcgaaccgagacagatggcagctaaatgaagtttaattaaagaatgagcgcggggcccttttcattgggtactgcatctacttcgaccacaaaagacgaagtgaccccaacttcaagaacaggcttcgagatggaagaaagaaacagaagcttgccaaggagagagctgggctttccaagttacctgaccttaaagatgctgaagctgttcagaagttcttccttgaagaaatacagcttggtgaagagttactagctcaaggtgaatatgagaagggcgtagaccatctgacaaatggaattgctgtgtgtggacagccacagcagttactgcaggccttacagcaaactcttccaccactagtgttccagatgcttttgactaagctcccaacaattagagaattctaagtgctcagagcttggctgaagatgatgtggaatgagaaacaaatgttaacataataaaatctcagttaaaaatatttaaaaaattcttggtagttgagcagctctgggggaataagggcaaatatccttgttatgaactacactgaaatctaccaaagttaatgtttactttgtgtaggtccatttgtctattttatttatttttcccagtgaaaagtgtattttgatagagaacttttcattttataaatacactatgagttactgaaaattcatatcatggatttcatttattcctgaaacatagttaaaatgtacatatgacatggcttatgttaaaaatacccagtgctcagttttgaaagataggcacaaaaa

SEQ ID NO: 314443 - DNA, 2390 bp, Homo sapiens
aggcagacgggaacctgagactttgtccaaacctcggctggaaggctggtcttggcactcggcgtcttagctagtggatttatcgcattaagactgtacttgggcctttttcatgatgacttgggtctcaatccttggagcagctgaaagaacagctcgggccacctgtggatgcacccacaatgaaatcagaggccacgtgaggtttgcaaggcagagtggcctgcagttttaactcgggcactatggcaatgcagacccaaaccaattgtgccagttctttgctgggtggcaaagtgttttcaggcttgtggtcactcctgatttctgtttggaagcacagttctctctctaaggagaatggaaacttggaaaggcctgtaaaatcggaaagcctgtaaaaggccgtagagtggagatgtataaaaatgtacggtcacccatgttttaggggttgaccgggagcggggcgaggaggagggtgggtatgaggcggtagcggaccgcggagtcgagacctacccgaacgacgcgggcgagcggggctttggacgccggtggagacgcaggcgagcaggaagaagatgagccttaggtctgaacgccgaggaattcatgtggatcctgtgcaagaaaggatgtggttactgtggcaaccctacctggcagggtttctgctccaagtgctggagggaagagtagcacaaagccaggcagaagcagattcaggagtactgggagctggtggaacgactccagcgggaggaagaagaggcctttgccagcagtcagagcagccaaggggcccaatccctcacattctccaagtttgaaggaaagaaaaccaacaagaagacccgcaaggttaccacagtgaagaaatcttcagtacgtcttccagggtcggatcaaagaagggctggagtgcaatggcgcgatctcggctcactgcaacctccacctattgggttcaagtgattctcctgcctcagcctcccaatagctgggattacagatattgaaatggattccaggcgtgtgcctcgagacaagctggcctgcatcaccaagtgcagcaagcacatcttcgatgccatcaagatcacctagaacgagctggcgtcagcagatgacttcctccccaccctcatctacattgttttgaagggcaacccccatgccttcagtctaatatccagtatatcacgtgcttctgcaatccaagccgactgatgactggagaggatggctactatttcaccaatctggtgagtaagtgagttcttggcgttgtggagaaggactaggaaggtggtggttttggggatgtgataggtcactcaggcccatgacaggtgaatgcttctgtgtgagaaggcagcacggctgaggaagctcactttgcatcagggagcacaaggaccaggccgtacagacactccgcctccccgcacttgatcagagattgtgtttatcctacagaaacagatgacatgtgttgggcatcactccccacggtcctgggtagaagagtccttcacttggcagggctttttcaaccaatgaataaggcaaattatatataagttaataatgccatttcgaaccgagacagatggcagctaaatgaagtttaattaaagaatgagcgcggggcccttttcattgggtactgcatctacttcgaccacaaaagacgaagtgaccccaacttcaagaacaggcttcgagatggaagaaagaaacagaagcttgccaaggagagagctgggctttccaagttacctgaccttaaagatgctgaagctgttcagaagttcttccttgaagaaatacagcttggtgaagagttactagctcaaggtgaatatgagaagggcgtagaccatctgacaaatggaattgctgtgtgtggacagccacagcagttactgcaggccttacagcaaactcttccaccactagtgttccagatgcttttgactaagctcccaacaattagagaattctaagtgctcagagcttggctgaagatgatgtggaatgagaaacaaatgttaacataataaaatctcagttaaaaatatttaaaaaattcttggtagttgagcagctctgggggaataagggcaaatatccttgttatgaactacactgaaatctaccaaagttaatgtttactttgtgtaggtccatttgtctattttatttatttttcccagtgaaaagtgtattttgatagagaacttttcattttataaatacactatgagttactgaaaattcatatcatggatttcatttattcctgaaacatagttaaaatgtacatatgacatggcttatgttaaaaatacccagtgctcagttttgaaagataggcacaaaaa

SEQ ID NO: 314444 - DNA, 1002 bp, Homo sapiens
  misc_feature (14)..(14): n is a, c, g, or t
  misc_feature (17)..(17): n is a, c, g, or t
gggggcaggcgcanganccgcgctctgggcctctgctcaggctctgccgcggacgacctcgaggcccttagttgactgggaccggaagtggcgtgtgctcggcctttctgtgttcctggcccgcggccgtcgggtgtgagctgcgccgaccgctctgagggttcgtggcccaccgctccttcgcggtccctgccgccaccgtccacgctcagcgttgtagagaagatggtgggtcggaacagcgccatcgccgccggtgtatgcggggcccttttcattgggtactgcatctacttcgaccacaaaagacgaagtgaccccaacttcaagaacaggcttcgagatggaagaaagaaacagaagcttgccaaggagagagctgggctttccaagttacctgaccttaaagatgctgaagctgttcagaagttcttccttgaagaaatacagcttggtgaagagttactagctcaaggtgaatatgagaagggcgtagaccatctgacaaatggaattgctgtgtgtggacagccacagcagttactgcaggccttacagcaaactcttccaccactagtgttccagatgcttttgactaagctcccaacaattagagaattctaagtgctcagagcttggctgaagatgatgtggaatgagaaacaaatgttaacataataaaatctcagttaaaaatatttaaaaaattcttggtagttgagcagctctgggggaataagggcaaatatccttgttatgaactacactgaaatctaccaaagttaatgtttactttgtgtaggtccatttgtctattttatttatttttcccagtgaaaagtgtattttgatagagaacttttcattttataaatacactatgagttactgaaaattcatatcatggatttcatttattcctgaaacatagttaaaatgtacatatgacatggcttatgttaaaaatacccagtgctcagttttgaaagataggcacaaaaa

SEQ ID NO: 314445 - DNA, 1890 bp, Homo sapiens
aggtaccttcagtgaaccaccagacaccaacatctgttgacttcctgatcttgaacttgccagcttcctgaactcaggaagaagatgagccttaggtctgaacgccgaggaattcatgtggatcctgtgcaagaaaggatgtggttactgtggcaaccctacctggcagggtttctgctccaagtgctggagggaagagtagcacaaagccaggcagaagcagattcaggagtactgggagctggtggaacgactccagcgggaggaagaagaggcctttgccagcagtcagagcagccaaggggcccaatccctcacattctccaagtttgaaggaaagaaaaccaacaagaagacccgcaaggttaccacagtgaagaaatcttcagtacgtcttccagggtcggatcaaagaagggctggagtgcaatggcgcgatctcggctcactgcaacctccacctattgggttcaagtgattctcctgcctcagcctcccaatagctgggattacagatattgaaatggattccaggcgtgtgcctcgagacaagctggcctgcatcaccaagtgcagcaagcacatcttcgatgccatcaagatcacctagaacgagctggcgtcagcagatgacttcctccccaccctcatctacattgttttgaagggcaacccccatgccttcagtctaatatccagtatatcacgtgcttctgcaatccaagccgactgatgactggagaggatggctactatttcaccaatctggtgagtaagtgagttcttggcgttgtggagaaggactaggaaggtggtggttttggggatgtgataggtcactcaggcccatgacaggtgaatgcttctgtgtgagaaggcagcacggctgaggaagctcactttgcatcagggagcacaaggaccaggccgtacagacactccgcctccccgcacttgatcagagattgtgtttatcctacagaaacagatgacatgtgttgggcatcactccccacggtcctgggtagaagagtccttcacttggcagggctttttcaaccaatgaataaggcaaattatatataagttaataatgccatttcgaaccgagacagatggcagctaaatgaagtttaattaaagaatgagcgcggggcccttttcattgggtactgcatctacttcgaccacaaaagacgaagtgaccccaacttcaagaacaggcttcgagatggaagaaagaaacagaagcttgccaaggagagagctgggctttccaagttacctgaccttaaagatgctgaagctgttcagaagttcttccttgaagaaatacagcttggtgaagagttactagctcaaggtgaatatgagaagggcgtagaccatctgacaaatggaattgctgtgtgtggacagccacagcagttactgcaggccttacagcaaactcttccaccactagtgttccagatgcttttgactaagctcccaacaattagagaattctaagtgctcagagcttggctgaagatgatgtggaatgagaaacaaatgttaacataataaaatctcagttaaaaatatttaaaaaattcttggtagttgagcagctctgggggaataagggcaaatatccttgttatgaactacactgaaatctaccaaagttaatgtttactttgtgtaggtccatttgtctattttatttatttttcccagtgaaaagtgtattttgatagagaacttttcattttataaatacactatgagttactgaaaattcatatcatggatttcatttattcctgaaacatagttaaaatgtacatatgacatggcttatgttaaaaatacccagtgctcagttttgaaagataggcacaaaaa

SEQ ID NO: 314446 - DNA, 1062 bp, Homo sapiens
tcctcgaatcgacggtttctcccggtagcttaactttctcaattcttttcgtcccatcagcatggtatctgctcaatgctgctaatgacctccaggaagatcgcttggacaaacaaattcttggtaggcacagagaggagatttcgatcttcattggagagaggtcattcagctctgtcacctgcttcatagcggaggcatgtcgtcgtagcgctccgccttgctcgggcagccgcgcccgctgcagcagctgtcccggtcccccatgccatttcgaaccgagacagatggcagctaaatgaagtttaattaaagaatgagcgcggggcccttttcattgggtactgcatctacttcgaccacaaaagacgaagtgaccccaacttcaagaacaggcttcgagatggaagaaagaaacagaagcttgccaaggagagagctgggctttccaagttacctgaccttaaagatgctgaagctgttcagaagttcttccttgaagaaatacagcttggtgaagagttactagctcaaggtgaatatgagaagggcgtagaccatctgacaaatggaattgctgtgtgtggacagccacagcagttactgcaggccttacagcaaactcttccaccactagtgttccagatgcttttgactaagctcccaacaattagagaattctaagtgctcagagcttggctgaagatgatgtggaatgagaaacaaatgttaacataataaaatctcagttaaaaatatttaaaaaattcttggtagttgagcagctctgggggaataagggcaaatatccttgttatgaactacactgaaatctaccaaagttaatgtttactttgtgtaggtccatttgtctattttatttatttttcccagtgaaaagtgtattttgatagagaacttttcattttataaatacactatgagttactgaaaattcatatcatggatttcatttattcctgaaacatagttaaaatgtacatatgacatggcttatgttaaaaatacccagtgctcagttttgaaagataggcacaaaaa

SEQ ID NO: 314447 - DNA, 1419 bp, Homo sapiens
acgtttgcacgccgtgcgtaacgtgcattctggcggtgccgggagcggggcgaggaggagggtgggtatgaggcggtagcggaccgcggagtcgagacctacccgaacgacgcgggcgagcggggctttggacgccggtggagacgcaggcgagactccagcgggaggaagaagaggcctttgccagcagtcagagcagccaaggggcccaatccctcacattctccaagtttgaaggaaagaaaaccaacaagaagacccgcaaggttaccacagtgaagaaatcttcagtacgtcttccagggtcggatcaaagaaggatattgaaatggattccaggcgtgtgcctcgagacaagctggcctgcatcaccaagtgcagcaagcacatcttcgatgccatcaagatcacctagaacgagctggcgtcagcagatgacttcctccccaccctcatctacattgttttgaagggcaacccccatgccttcagtctaatatccagtatatcacgtgcttctgcaatccaagccgactgatgactggagaggatggctactatttcaccaatctggtgagtaagtgagttcttggcgttgtggagaaggactaggaaggtggtggttttggggatgtgataggtcactcaggcccatgacaggtgaatgcttctgtgtgagaaggcagcacggctgaggaagctcactttgcatcagggagcacaaggaccaggccgtacagacactccgcctccccgcacttgatcagagattgtgtttatcctacagaaacagatgacatgtgttgggcatcactccccacggtcctgggtagaagagtccttcacttggcagggctttttcaaccaatgaataaggcaaattatatataagttaataatgccatttcgaaccgagacagatggcagctaaatgaagtttaattaaagaatgagcgcggggcccttttcattgggtactgcatctacttcgaccacaaaagacgaagtgaccccaacttcaagaacaggcttcgagatggaagaaagaaacagaagcttgccaaggagagagctgggctttccaagttacctgaccttaaagatgctgaagctgttcagaagttcttccttgaagaaatacagcttggtgaagagttactagctcaaggtgaatatgagaagggcgtagaccatctgacaaatggaattgctgtgtgtggacagccacagcagttactgcaggccttacagcaaactcttccaccactagtgttccagatgacatagctgactcagcgtggtcaacaaacgagcgccgtgttaaatccgtcatgcccgggtataaatcatgtacgtcggtgaaacacgcctcccggtcaatgatgtatcccgagtgtaacacgtccgcacaagttaaac

SEQ ID NO: 314448 - DNA, 2242 bp, Homo sapiens
acgtttgcacgccgtgcgtaacgtgcattctggcggtgccgggagcggggcgaggaggagggtgggtatgaggcggtagcggaccgcggagtcgagacctacccgaacgacgcgggcgagcggggctttggacgccggtggagacgcaggcgagactccagcgggaggaagaagaggcctttgccagcagtcagagcagccaaggggcccaatccctcacattctccaagtttgaaggaaagaaaaccaacaagaagacccgcaaggttaccacagtgaagaaatcttcagtacgtcttccagggtcggatcaaagaaggatattgaaatggattccaggcgtgtgcctcgagacaagctggcctgcatcaccaagtgcagcaagcacatcttcgatgccatcaagatcacctagaacgagctggcgtcagcagatgacttcctccccaccctcatctacattgttttgaagggcaacccccatgccttcagtctaatatccagtatatcacgtgcttctgcaatccaagccgactgatgactggagaggatggctactatttcaccaatctggtgagtaagtgagttcttggcgttgtggagaaggactaggaaggtggtggttttggggatgtgataggtcactcaggcccatgacaggtgaatgcttctgtgtgagaaggcagcacggctgaggaagctcactttgcatcagggagcacaaggaccaggccgtacagacactccgcctccccgcacttgatcagagattgtgtttatcctacagaaacagatgacatgtgttgggcatcactccccacggtcctgggtagaagagtccttcacttggcagggctttttcaaccaatgaataaggcaaattatatataagttaataatgccatttcgaaccgagacagatggcagctaaatgaagtttaattaaagaatgagcgcggggcccttttcattgggtactgcatctacttcgaccacaaaagacgaagtgaccccaacttcaagaacaggcttcgagatggaagaaagaaacagaagcttgccaaggagagagctgggctttccaagttacctgaccttaaagatgctgaagctgttcagaagttcttccttgaagaaatacagcttggtgaagagttactagctcaagaggctgggcactcactgcagctggctaatgatgaccatgtggacatgctttcgggccttcaggatcttctccagccagtggatgtcgtacgtgttggggttccggaaagggatgtcaggtggtggctcacacctgcgatcccagcactttgggaggccaaggcgggtggatcgcttgagcccagaagatcaagaccagtctgggcaacatggtgaaacctcgtctctactaaaaatagaaaaattagccgggagtggtggcgcacgcttgtagtcccagctacttgagaggctggggcaggaggattgcctaagcccatgaggtggaggctgcagtgagcagacattgcaccactgtactccagcctgggcaacagagtgagacgctgtttaaaaaaaaaaaaagaaaatcaacatacacaaaatgtgggtcatgggcagagcagccatgtccccagggagcaggcaggccagctgggggctcctgaaggctaggctggctgcagagggagggagggcctccccctttccccgggaggagggcttggtgtgctgaccctgaccacagacactgactgtatttctcgttgaagagttccttcacctgctcctgcaggatcacctccccaagtctgttggtatcatcttcatctaaagaggaagacaagggggcctgagagttggcactggcttggccaccagacctgctgcttctcccaccaggcatccctgacctgccaaaacattctctgcaggccctgcctactcccattgctggagtgcagaggcgcgatctcagcttactgcaacctccacctcccaggttcaagtgattctcctgcgtcagccccccaagtagctggaatcacaggcaccgcaccaccatgcctagctaatttttgtattttttagtagagacgggttttcatcatgttgctcaggctggtctcaaactcttgggctcaggtgatccacccgccttggcctcccaaagtgttgggattacaggcgtgagccactgtgcctggctgtagctggtttctagccccagttgttggtctgtccatccatccat

SEQ ID NO: 314449 - DNA, 1202 bp, Homo sapiens
aagttgtatgtttcaggagaaagaggcaggaactattgtagtacacctgggtctggatcccagctgacccaccatgaccttgactttcaccctccccatggtcttgccctctctgttccccgttccagaggctgggcactcactgcagctggctaatgatgaccatgtggacatgctttcgggccttcaggatcttctccagccagtggatgtcgtacgtgttggggttccggaaagggatgtcaggtggtggctcacacctgcgatcccagcactttgggaggccaaggcgggtggatcgcttgagcccagaagatcaagaccagtctgggcaacatggtgaaacctcgtctctactaaaaatagaaaaattagccgggagtggtggcgcacgcttgtagtcccagctacttgagaggctggggcaggaggattgcctaagcccatgaggtggaggctgcagtgagcagacattgcaccactgtactccagcctgggcaacagagtgagacgctgtttaaaaaaaaaaaaagaaaatcaacatacacaaaatgtgggtcatgggcagagcagccatgtccccagggagcaggcaggccagctgggggctcctgaaggctaggctggctgcagagggagggagggcctccccctttccccgggaggagggcttggtgtgctgaccctgaccacagacactgactgtatttctcgttgaagagttccttcacctgctcctgcaggatcacctccccaagtctgttggtatcatcttcatctaaagaggaagacaagggggcctgagagttggcactggcttggccaccagacctgctgcttctcccaccaggcatccctgacctgccaaaacattctctgcaggccctgcctactcccattgctggagtgcagaggcgcgatctcagcttactgcaacctccacctcccaggttcaagtgattctcctgcgtcagccccccaagtagctggaatcacaggcaccgcaccaccatgcctagctaatttttgtattttttagtagagacgggttttcatcatgttgctcaggctggtctcaaactcttgggctcaggtgatccacccgccttggcctcccaaagtgttgggattacaggcgtgagccactgtgcctggctgtagctggtttctagccccagttgttggtctgtccatccatccat

SEQ ID NO: 314450 - DNA, 882 bp, Homo sapiens
ggaacatcctgggaaattaaaaagcctgctaccccaaaaaaaaaaaaaaaaaaaaaaaaaaaaaaattaactaggctagtgcctgtagcccaatctactctggaggctgaggttggaggatcatttcagcctgagcagttgaggcagaagtgagctgtgatctggccaccgtactccagcctgggtgacagagtgagaccttgattaagacaaaacaaaacaaaaacaaaacaaaaaaaacaaacacaaggtgactttaagttgaagagcaagcacttgccatttgagccttagccagaactataaactgtaatgtgggtgaggttgtccttttccatatttccttcttcttcacagaggttgatttttagaaaacttagagaaaaacaaccaagtgttgacttcagtaacttctatgatcgtaactagctagtagaattaattgtcatttatatttttaaagggttttttttttttaaagcaaattgtctctttgtgaagaacatgtgcgttccttagacactgtctagctgctgaaaatgacggatttctggtttttggttggtttgttttcggagatgcaaaatgagcatatgtaccttaacggttcccaccacctttattttgccagtaatttaatttgagaaaattagttagttttgccctgttttcttcatctaaatatggaaatgtttaaatctgtgttctgctaggtactgatgacctcaagatatattccctggtgagatggactttctcagaatatgaggactgcatgcctggcacacttgaaatgttagcgtttcatttttcaagaggattaaagccctcatatgtttattttcctttaaaaaactacttaaggcagcacaaattggtaaa

SEQ ID NO: 314451 - DNA, 587 bp, Homo sapiens
aggtaccttcagtgaaccaccagacaccaacatctgttgacttcctgatcttgaacttgccagcttcctgaactcaggaagaagatgagccttaggtctgaacgccgaggaattcatgtggatcctgtgcaagaaaggatgtggttactgtggcaaccctacctggcagggtttctgctccaagtgctggagggaagagtagcacaaagccaggcagaagcagattcaggagtactgggagctggtggaacgactccagcgggaggaagaagaggcctttgccagcagtcagagcagccaaggggcccaatccctcacattctccaagtttgaaggaaagaaaaccaacaagaagacccgcaaggttaccacagtgaagaaatcttcagtacgtcttccagggtcggatcaaagaagggtactgatgacctcaagatatattccctggtgagatggactttctcagaatatgaggactgcatgcctggcacacttgaaatgttagcgtttcatttttcaagaggattaaagccctcatatgtttattttcctttaaaaaactacttaaggcagcacaaattggtaaa

SEQ ID NO: 314452 - DNA, 436 bp, Homo sapiens
ttatttatttcactgagcttgttggggaaaaggactagacttgatttctttcatgtaacctagagcagttgctgaatgagcatgagaggatcccatttgaaatctgtagtgcatgaagagccgtccatcctgtagctatgtgagacctcagactgatttggcatatttagtctctaggtctaaaatctttagatcctcctgaattaatggagtaataaccttcaggtatagagaaatcttggagaatatctagatcattctaatcctctcttgaattgcagactccagcgggaggaagaagaggcctttgccagcagtcagagcagccaaggggcccaatccctcacattctccaagtttgaaggaaagaaaaccaacaagaagacccgcaaggttaccacagtgaagaaatcttcagtacgtcttccagggtcgg

SEQ ID NO: 314453 - DNA, 693 bp, Homo sapiens
ggaaagggggttagtgaggattccttcataactttagagatgaaacatgattttcctattgcttcttttttgtgattcttttctcatgggaaatactgtcttttctgctttgtagatattgaaatggattccaggcgtgtgcctcgagacaagctggcctgcatcaccaagtgcagcaagcacatcttcgatgccatcaagatcacctagaacgagctggcgtcagcagatgacttcctccccaccctcatctacattgttttgaagggcaacccccatgccttcagtctaatatccagtatatcacgtgcttctgcaatccaagccgactgatgactggagaggatggctactatttcaccaatctggtgagtaagtgagttcttggcgttgtggagaaggactaggaaggtggtggttttggggatgtgataggtcactcaggcccatgacaggtgaatgcttctgtgtgagaaggcagcacggctgaggaagctcactttgcatcagggagcacaaggaccaggccgtacagacactccgcctccccgcacttgatcagagattgtgtttatcctacagaaacagatgacatgtgttgggcatcactccccacggtcctgggtagaagagtccttcacttggcagggctttttcaaccaatgaataaggcaaattatatataagttaata

SEQ ID NO: 314454 - DNA, 444 bp, Homo sapiens
tgttttgaagggcaacccccatgccttcagtctaatatccagtatatcacgtgcttctgcaatccaagccgactgatgactggagaggatggctactatttcaccaatctggtgagtaagtgagttcttggcgttgtggagaaggactaggaaggtggtggttttggggatgtgataggtcactcaggcccatgacaggtgaatgcttctgtgtgagaaggcagcacggctgaggaagctcactttgcatcagggagcacaaggaccaggccgtacagacactccgcctccccgcacttgatcagagattgtgtttatcctacagaaacagatgacatgtgttgggcatcactccccacggtcctgggtagaagagtccttcacttggcagggctttttcaaccaatgaataaggcaaattatatataagttaataatgccatt

SEQ ID NO: 314455 - DNA, 1792 bp, Homo sapiens
acgtttgcacgccgtgcgtaacgtgcattctggcggtgccgggagcggggcgaggaggagggtgggtatgaggcggtagcggaccgcggagtcgagacctacccgaacgacgcgggcgagcggggctttggacgccggtggagacgcaggcgagactccagcgggaggaagaagaggcctttgccagcagtcagagcagccaaggggcccaatccctcacattctccaagtttgaaggaaagaaaaccaacaagaagacccgcaaggttaccacagtgaagaaatcttcagtacgtcttccagggtcggatcaaagaagggctggagtgcaatggcgcgatctcggctcactgcaacctccacctattgggttcaagtgattctcctgcctcagcctcccaatagctgggattacagatattgaaatggattccaggcgtgtgcctcgagacaagctggcctgcatcaccaagtgcagcaagcacatcttcgatgccatcaagatcacctagaacgagctggcgtcagcagatgacttcctccccaccctcatctacattgttttgaagggcaacccccatgccttcagtctaatatccagtatatcacgtgcttctgcaatccaagccgactgatgactggagaggatggctactatttcaccaatctggtgagtaagtgagttcttggcgttgtggagaaggactaggaaggtggtggttttggggatgtgataggtcactcaggcccatgacaggtgaatgcttctgtgtgagaaggcagcacggctgaggaagctcactttgcatcagggagcacaaggaccaggccgtacagacactccgcctccccgcacttgatcagagattgtgtttatcctacagaaacagatgacatgtgttgggcatcactccccacggtcctgggtagaagagtccttcacttggcagggctttttcaaccaatgaataaggcaaattatatataagttaataatgccatttcgaaccgagacagatggcagctaaatgaagtttaattaaagaatgagcgcggggcccttttcattgggtactgcatctacttcgaccacaaaagacgaagtgaccccaacttcaagaacaggcttcgagatggaagaaagaaacagaagcttgccaaggagagagctgggctttccaagttacctgaccttaaagatgctgaagctgttcagaagttcttccttgaagaaatacagcttggtgaagagttactagctcaaggtgaatatgagaagggcgtagaccatctgacaaatggaattgctgtgtgtggacagccacagcagttactgcaggccttacagcaaactcttccaccactagtgttccagatgcttttgactaagctcccaacaattagagaattctaagtgctcagagcttggctgaagatgatgtggaatgagaaacaaatgttaacataataaaatctcagttaaaaatatttaaaaaattcttggtagttgagcagctctgggggaataagggcaaatatccttgttatgaactacactgaaatctaccaaagttaatgtttactttgtgtaggtccatttgtctattttatttatttttcccagtgaaaagtgtattttgatagagaacttttcattttataaatacactatgagttactgaaaattcatatcatggatttcatttattcctgaaacatagttaaaatgtacatatgacatggcttatgttaaaaatacccagtgctcagttttgaaagataggcacaaaaa

SEQ ID NO: 314456 - DNA, 1585 bp, Homo sapiens
acgtttgcacgccgtgcgtaacgtgcattctggcggtgccgggagcggggcgaggaggagggtgggtatgaggcggtagcggaccgcggagtcgagacctacccgaacgacgcgggcgagcggggctttggacgccggtggagacgcaggcgagactccagcgggaggaagaagaggcctttgccagcagtcagagcagccaaggggcccaatccctcacattctccaagtttgaaggaaagaaaaccaacaagaagacccgcaaggttaccacagtgaagaaatcttcagtacgtcttccagggtcggatcaaagaaggatattgaaatggattccaggcgtgtgcctcgagacaagctggcctgcatcaccaagtgcagcaagcacatcttcgatgccatcaagatcacctagaacgagctggcgtcagcagatgacttcctccccaccctcatctacattgttttgaagggcaacccccatgccttcagtctaatatccagtatatcacgtgcttctgcaatccaagccgactgatgactggagaggatggctactatttcaccaatctggtgagtaagtgagttcttggcgttgtggagaaggactaggaaggtggtggttttggggatgtgataggtcactcaggcccatgacaggtgaatgcttctgtgtgagaaggcagcacggctgaggaagctcactttgcatcagggagcacaaggaccaggccgtacagacactccgcctccccgcacttgatcagagattgtgtttatcctacagaaacagatgacatgtgttgggcatcactccccacggtcctgggtagaagagtccttcacttggcagggctttttcaaccaatgaataaggcaaattatatataagttaataatgccatttcgaaccgagacagatggcagctaaatgaagtttaattaaagaatgagcgcggggcccttttcattgggtactgcatctacttcgaccacaaaagacgaagtgaccccaacttcaagaacaggcttcgagatggaagaaagaaacagaagcttgccaaggagagagctgggctttccaagttacctgaccttaaagatgctgaagctgttcagaagttcttccttgaagaaatacagcttggtgaagagttactagctcaaggtgaatatgagaagggcgtagaccatctgacaaatggaattgctgtgtgtggacagccacagcagttactgcaggccttacagcaaactcttccaccactagtgttccagatgcttttgactaagctcccaacaattagagaattctaagtgctcagagcttggctgaagatgatgtggaatgagaaacaaatgttaacataataaaatctcagttaaaaatatttaaaaaattcttggtagttgagcagctctgggggaataagggcaaatatccttgttatgaactacactgaaatctaccaaagttaatgtttactttgtgtaggtccatttgtctattttatttatttttcccagtgaaaagtgtattttgatagagaacttttcattttataaatacactatgagttactga

SEQ ID NO: 314457 - DNA, 948 bp, Homo sapiens
  misc_feature (14)..(14): n is a, c, g, or t
  misc_feature (17)..(17): n is a, c, g, or t
gggggcaggcgcanganccgcgctctgggcctctgctcaggctctgccgcggacgacctcgaggcccttagttgactgggaccggaagtggcgtgtgctcggcctttctgtgttcctggcccgcggccgtcgggtgtgagctgcgccgaccgctctgagggttcgtggcccaccgctccttcgcggtccctgccgccaccgtccacgctcagcgttgtagagaagatggtgggtcggaacagcgccatcgccgccggtgtatgcggggcccttttcattgggtactgcatctacttcgaccgccagaagcttgccaaggagagagctgggctttccaagttacctgaccttaaagatgctgaagctgttcagaagttcttccttgaagaaatacagcttggtgaagagttactagctcaaggtgaatatgagaagggcgtagaccatctgacaaatggaattgctgtgtgtggacagccacagcagttactgcaggccttacagcaaactcttccaccactagtgttccagatgcttttgactaagctcccaacaattagagaattctaagtgctcagagcttggctgaagatgatgtggaatgagaaacaaatgttaacataataaaatctcagttaaaaatatttaaaaaattcttggtagttgagcagctctgggggaataagggcaaatatccttgttatgaactacactgaaatctaccaaagttaatgtttactttgtgtaggtccatttgtctattttatttatttttcccagtgaaaagtgtattttgatagagaacttttcattttataaatacactatgagttactgaaaattcatatcatggatttcatttattcctgaaacatagttaaaatgtacatatgacatggcttatgttaaaaatacccagtgctcagttttgaaagataggcacaaaaa

SEQ ID NO: 314458 - DNA, 5007 bp, Homo sapiens
tctgaagcgaatcagtgggaagtggcctacagtgggtcggctaccgaatacaccttcacccacttgaaaccaggcactttgtacaaactccgagcatgctgcatcagtaccggcggacacagccagtgttctgaaagtctccctgttcgcacactaagcattgcaccaggtcaatgtcgaccaccgagggttttgggtagaccaaagcacaaagaagtccacttagagtgggatgttcctgcatcggaaagtggctgtgaggtctcagagtacagcgtggagatgacggagcccgaagacgtagcctcggaagtgtaccatggcccagagctggagtgcaccgtcggcaacctgcttcctggaaccgtgtatcgcttccgggtgagggctctgaatgatggagggtatggtccctattctgatgtctcagaaattaccactgctgcagggcctcctggacaatgcaaagcaccttgtatttcttgtacacctgatggatgtgtcttagtgggttgggagagtcctgatagttctggtgctgacatctcagagtacaggttggaatggggagaagatgaagaatccttagaactcatttatcatgggacagacacccgttttgaaataagagacctgttgcctgctgcacagtattgctgtagactacaggccttcaatcaagcaggggcagggccgtacagtgaacttgtcctttgccagacgccagcgtctgcccctgaccccgtctccactctctgtgtcctggaggaggagccccttgatgcctaccctgattcaccttctgcgtgccttgtactgaactgggaagagccgtgcaataacggatctgaaatccttgcttacaccattgatctaggagacactagcattaccgtgggcaacaccaccatgcatgttatgaaagatctccttccagaaaccacctaccggatcagaattcaggctataaatgaaattggagctggaccatttagtcagttcattaaagcaaaaactcggccattaccacccttgcctcctaggctagaatgtgctgctgctggtcctcagagcctgaagctaaaatggggagacagtaactccaagacacatgctgctgaggacattgtgtacacactacagctggaggacagaaacaagaggtttatttcaatctacagaggacccagccacacctacaaggtccagagactgacggaattcacatgctactccttcagaatccaggcagcaagcgaggctggagaagggcccttctcagaaacctataccttcagcacaaccaaaagtgtcccccccaccatcaaagcacctcgagtaacacagttagaaggaaattcatgtgaaattttatgggagacggtaccatcaatgaaaggtgaccctgttaactacattctgcaggtattggttggaagagaatctgagtacaaacaggtgtacaagggagaagaagccacattccaaatctcaggcctccagaccaacacagactacaggttccgcgtatgtgcgtgtcgtcgctgtttagacacctctcaggagctaagcggagccttcagcccctctgcggcttttgtattacaacgaagtgaggtcatgcttacaggggacatggggagcttagatgatcccaaaatgaagagcatgatgcctactgatgaacagtttgcagccatcattgtgcttggctttgcaactttgtccattttatttgcctttatattacagtacttcttaatgaagtaaacccaacaaaactagaggtatgaattaatgctacacattttaatacacacatttattcagatactcccctttttaaagcccttttgttttttgatttatatactctgttttacagatttagctagaaaaaaaatgtcagtgttttggtgcacctttttgaaatgcaaaactaggaaaaggttaaactggattttttttttaaaaaaaaagaaaaaaaaagaagaaaagtataccagataccaaaagctagctttcttatgttttcctttaaattttcagatttaccttcattctgttttcactgatgtcttttgcaagcctttgatttttttttttttgttacagtttagtaatttatattcaccagtcacttcttatgtcttgaacatctgtatctgtaaacatgaatcaccgtgtgtgtacttacagggctaggatttcagtgttgtcagagtattaccacacagcaacagcaacatacagaagatatgttcactcagataagactgccctaaacaaccattttgtcactcagttatttaactgtgtttagctcatttaaatcaaaatgtgtactttaatctaaaatgttttaataatctgtatttcttataattttaacactatgagctgcctatataagaaatcaagtaaccagaatgcacctataaattatggagcattgtaggattttaccacatcaattcatagcagtaactttaagagggcattgtgcaatagttagttgttttcttgttcagctattttaaaggctgctttaacttgtttgtttgtctttgtatataactacttctaatctaatcactagagttattatattctgttatgtttgaccagaattatatgacaagaactggtgacagtttagtgcctctgcccattgtccatgatttacactaattgtgagcagtcttcttatgtgtcagctcattatttttgaaacatttgcctttaggctgttctttgaggtatcaatgaagtgattgaatttcaataccttaattcagtgcacataatactaatgtaacagcagatgaaaattgataaaacccaaaagagagtcatctaaatttgtagttcctatttctgtgggtttgcctggccatggttggagagggaatggtgtttgatggtaaacacagggtgtttggggatcaaggagcctagattctctccctggatctgtcactaacttgctgcgtgacctgaacacgtcactttacctctctgtgcctcagttttcccatgcatgaaaaataaaataaaataaaacggggattctaatgtttgtaagtgctttgagatctttgaccaacaggtgctattggagtgcaaagtgttactcttacgtgtttattttgagtcatgagataatcaattttaacccaaagtcattggattatttatatgaagtccataatgttcgagtacctcagggacatttaagagttggaggtgcaaatatattccaaaagggtgcaacagacacagtgtatccccctgcttctgtttttgtatatttttgctacttggtttttcttgatcatagctattttgtgcttgatctttattgtctaagatgcagtatcctgtactagcttataatattcccataccaaagtcatggggaaacaaacattattttgtttttggtttatttatactatattctgcatacagtactttaaatgccaattacagtgcaatctttatttattgtaaaattttttaagtgtacttatgtactaattttcccttgtagcatgttatatttttgtgttttatacttttgtaattttaggtcagtcttgttccttggcaacatctgtagtattattaatcttctgacattttcttatgtttttaaaaagataagagcatctagtgcattaaatgccaaaaaaaaaatacattatcagtgattgaaacgtttacatgtacccaaaaaccataatcatctcttggaagaaaatgctgagatcaatgaattattctgtgtgcctatattgacgtagtgagtactagagagttctgtattttattattgactataataattagtttaattagctttgcaaactgatggcatcaaggtaaatatatttttgccaaagttctggccttccaaaactcacccccttatttaaatgtgtgctatgacccactatgaccacagcatctgcattttctaaaaaattccatgcaggtgttttggggagaggtattttttaagcaatgaaaattcaactgagtacaaagccccctcttggggggttggggaagtctcttttttgaaacacttcagaactgctgctataaagaaattctctaattggttgaatttttttttaagtaaatagtactttaggccaaaatttatatgaatatttgatcttcttgagattttcatactatcatttaaccaccaggaagctgaagtgtgtgaagtacaaagctgacagcactttattttattgctctccattatttggtattcattatattccttcagtcagaaaattattactctctatggcactgttttttatcacaaatatgtatatgtgatattgatatataactatatatattgccatcacacacgaacaataaaataaagtgttctattaacctgatctctttgcccttttgctatgtgaggagtgaatgagtggccttctgatgctctgactcttctctgtatgtcaaactcatccctggcacaagaaattccagtcatgtgaagcaaactgccctttgtcctcaaagaaattgttgaaaaagaaaactttttaaagagattttttgcatattctctgccttgttcttatcaacttgaaatgttggcattttctaaccttgttttgttggctacaataattcagtattcatgtcaaaattgagaagtgccctaattgaatgtgtttgaatgttatccttgcacaattctttaaattgaaagataaaatgttttacctcactgttggacatacattccaagcttttcaactctaggagaaaaagaaaatcatgttttcctgtattgtaaattttagactatttcatatacattgtattaaaactgccatatcaattttaatgtatagattttgcaaatattatgctatatgtaatacctaactgtatctgtagtgtatatgtaatatatttatgcccaataaatgttttaattctttctgacttaaaaaaaaaaat

SEQ ID NO: 314459 - DNA, 4218 bp, Homo sapiens
aggtgatctagaggatccctggcgcgtctgaactgggaagagccgtgcaataacggatctgaaatccttgcttacaccattgatctaggagacactagcattaccgtgggcaacaccaccatgcatgttatgaaagatctccttccagaaaccacctaccggatcagaattcaggctataaatgaaattggagctggaccatttagtcagttcattaaagcaaaaactcggccattaccacccttgcctcctaggctagaatgtgctgctgctggtcctcagagcctgaagctaaaatggggagacagtaactccaagacacatgctgctgaggacattgtgtacacactacagctggaggacagaaacaagaggtttatttcaatctacagaggacccagccacacctacaaggtccagagactgacggaattcacatgctactccttcagaatccaggcagcaagcgaggctggagaagggcccttctcagaaacctataccttcagcacaaccaaaagtgtcccccccaccatcaaagcacctcgagtaacacagttagaaggaaattcatgtgaaattttatgggagacggtaccatcaatgaaaggtgaccctgttaactacattctgcaggtattggttggaagagaatctgagtacaaacaggtgtacaagggagaagaagccacattccaaatctcaggcctccagaccaacacagactacaggttccgcgtatgtgcgtgtcgtcgctgtttagacacctctcaggagctaagcggagccttcagcccctctgcggcttttgtattacaacgaagtgaggtcatgcttacaggggacatggggagcttagatgatcccaaaatgaagagcatgatgcctactgatgaacagtttgcagccatcattgtgcttggctttgcaactttgtccattttatttgcctttatattacagtacttcttaatgaagtaaacccaacaaaactagaggtatgaattaatgctacacattttaatacacacatttattcagatactcccctttttaaagcccttttgttttttgatttatatactctgttttacagatttagctagaaaaaaaatgtcagtgttttggtgcacctttttgaaatgcaaaactaggaaaaggttaaactggattttttttttaaaaaaaaagaaaaaaaaagaagaaaagtataccagataccaaaagctagctttcttatgttttcctttaaattttcagatttaccttcattctgttttcactgatgtcttttgcaagcctttgatttttttttttttgttacagtttagtaatttatattcaccagtcacttcttatgtcttgaacatctgtatctgtaaacatgaatcaccgtgtgtgtacttacagggctaggatttcagtgttgtcagagtattaccacacagcaacagcaacatacagaagatatgttcactcagataagactgccctaaacaaccattttgtcactcagttatttaactgtgtttagctcatttaaatcaaaatgtgtactttaatctaaaatgttttaataatctgtatttcttataattttaacactatgagctgcctatataagaaatcaagtaaccagaatgcacctataaattatggagcattgtaggattttaccacatcaattcatagcagtaactttaagagggcattgtgcaatagttagttgttttcttgttcagctattttaaaggctgctttaacttgtttgtttgtctttgtatataactacttctaatctaatcactagagttattatattctgttatgtttgaccagaattatatgacaagaactggtgacagtttagtgcctctgcccattgtccatgatttacactaattgtgagcagtcttcttatgtgtcagctcattatttttgaaacatttgcctttaggctgttctttgaggtatcaatgaagtgattgaatttcaataccttaattcagtgcacataatactaatgtaacagcagatgaaaattgataaaacccaaaagagagtcatctaaatttgtagttcctatttctgtgggtttgcctggccatggttggagagggaatggtgtttgatggtaaacacagggtgtttggggatcaaggagcctagattctctccctggatctgtcactaacttgctgcgtgacctgaacacgtcactttacctctctgtgcctcagttttcccatgcatgaaaaataaaataaaataaaacggggattctaatgtttgtaagtgctttgagatctttgaccaacaggtgctattggagtgcaaagtgttactcttacgtgtttattttgagtcatgagataatcaattttaacccaaagtcattggattatttatatgaagtccataatgttcgagtacctcagggacatttaagagttggaggtgcaaatatattccaaaagggtgcaacagacacagtgtatccccctgcttctgtttttgtatatttttgctacttggtttttcttgatcatagctattttgtgcttgatctttattgtctaagatgcagtatcctgtactagcttataatattcccataccaaagtcatggggaaacaaacattattttgtttttggtttatttatactatattctgcatacagtactttaaatgccaattacagtgcaatctttatttattgtaaaattttttaagtgtacttatgtactaattttcccttgtagcatgttatatttttgtgttttatacttttgtaattttaggtcagtcttgttccttggcaacatctgtagtattattaatcttctgacattttcttatgtttttaaaaagataagagcatctagtgcattaaatgccaaaaaaaaaatacattatcagtgattgaaacgtttacatgtacccaaaaaccataatcatctcttggaagaaaatgctgagatcaatgaattattctgtgtgcctatattgacgtagtgagtactagagagttctgtattttattattgactataataattagtttaattagctttgcaaactgatggcatcaaggtaaatatatttttgccaaagttctggccttccaaaactcacccccttatttaaatgtgtgctatgacccactatgaccacagcatctgcattttctaaaaaattccatgcaggtgttttggggagaggtattttttaagcaatgaaaattcaactgagtacaaagccccctcttggggggttggggaagtctcttttttgaaacacttcagaactgctgctataaagaaattctctaattggttgaatttttttttaagtaaatagtactttaggccaaaatttatatgaatatttgatcttcttgagattttcatactatcatttaaccaccaggaagctgaagtgtgtgaagtacaaagctgacagcactttattttattgctctccattatttggtattcattatattccttcagtcagaaaattattactctctatggcactgttttttatcacaaatatgtatatgtgatattgatatataactatatatattgccatcacacacgaacaataaaataaagtgttctattaacctgatctctttgcccttttgctatgtgaggagtgaatgagtggccttctgatgctctgactcttctctgtatgtcaaactcatccctggcacaagaaattccagtcatgtgaagcaaactgccctttgtcctcaaagaaattgttgaaaaagaaaactttttaaagagattttttgcatattctctgccttgttcttatcaacttgaaatgttggcattttctaaccttgttttgttggctacaataattcagtattcatgtcaaaattgagaagtgccctaattgaatgtgtttgaatgttatccttgcacaattctttaaattgaaagataaaatgttttacctcactgttggacatacattccaagcttttcaactctaggagaaaaagaaaatcatgttttcctgtattgtaaattttagactatttcatatacattgtattaaaactgccatatcaattttaatgtatagattttgcaaatattatgctatatgtaatacctaactgtatctgtagtgtatatgtaatatatttatgcccaataaatgttttaattctttctgacttaaaaaaaaaaat

SEQ ID NO: 314460 - DNA, 4005 bp, Homo sapiens
aggtgatctagaggatccctggcgcgtctgaactgggaagagccgtgcaataacggatctgaaatccttgcttacaccattgatctaggagacactagcattaccgtgggcaacaccaccatgcatgttatgaaagatctccttccagaaaccacctaccggtttatttcaatctacagaggacccagccacacctacaaggtccagagactgacggaattcacatgctactccttcagaatccaggcagcaagcgaggctggagaagggcccttctcagaaacctataccttcagcacaaccaaaagtgtcccccccaccatcaaagcacctcgagtaacacagttagaaggaaattcatgtgaaattttatgggagacggtaccatcaatgaaaggtgaccctgttaactacattctgcaggtattggttggaagagaatctgagtacaaacaggtgtacaagggagaagaagccacattccaaatctcaggcctccagaccaacacagactacaggttccgcgtatgtgcgtgtcgtcgctgtttagacacctctcaggagctaagcggagccttcagcccctctgcggcttttgtattacaacgaagtgaggtcatgcttacaggggacatggggagcttagatgatcccaaaatgaagagcatgatgcctactgatgaacagtttgcagccatcattgtgcttggctttgcaactttgtccattttatttgcctttatattacagtacttcttaatgaagtaaacccaacaaaactagaggtatgaattaatgctacacattttaatacacacatttattcagatactcccctttttaaagcccttttgttttttgatttatatactctgttttacagatttagctagaaaaaaaatgtcagtgttttggtgcacctttttgaaatgcaaaactaggaaaaggttaaactggattttttttttaaaaaaaaagaaaaaaaaagaagaaaagtataccagataccaaaagctagctttcttatgttttcctttaaattttcagatttaccttcattctgttttcactgatgtcttttgcaagcctttgatttttttttttttgttacagtttagtaatttatattcaccagtcacttcttatgtcttgaacatctgtatctgtaaacatgaatcaccgtgtgtgtacttacagggctaggatttcagtgttgtcagagtattaccacacagcaacagcaacatacagaagatatgttcactcagataagactgccctaaacaaccattttgtcactcagttatttaactgtgtttagctcatttaaatcaaaatgtgtactttaatctaaaatgttttaataatctgtatttcttataattttaacactatgagctgcctatataagaaatcaagtaaccagaatgcacctataaattatggagcattgtaggattttaccacatcaattcatagcagtaactttaagagggcattgtgcaatagttagttgttttcttgttcagctattttaaaggctgctttaacttgtttgtttgtctttgtatataactacttctaatctaatcactagagttattatattctgttatgtttgaccagaattatatgacaagaactggtgacagtttagtgcctctgcccattgtccatgatttacactaattgtgagcagtcttcttatgtgtcagctcattatttttgaaacatttgcctttaggctgttctttgaggtatcaatgaagtgattgaatttcaataccttaattcagtgcacataatactaatgtaacagcagatgaaaattgataaaacccaaaagagagtcatctaaatttgtagttcctatttctgtgggtttgcctggccatggttggagagggaatggtgtttgatggtaaacacagggtgtttggggatcaaggagcctagattctctccctggatctgtcactaacttgctgcgtgacctgaacacgtcactttacctctctgtgcctcagttttcccatgcatgaaaaataaaataaaataaaacggggattctaatgtttgtaagtgctttgagatctttgaccaacaggtgctattggagtgcaaagtgttactcttacgtgtttattttgagtcatgagataatcaattttaacccaaagtcattggattatttatatgaagtccataatgttcgagtacctcagggacatttaagagttggaggtgcaaatatattccaaaagggtgcaacagacacagtgtatccccctgcttctgtttttgtatatttttgctacttggtttttcttgatcatagctattttgtgcttgatctttattgtctaagatgcagtatcctgtactagcttataatattcccataccaaagtcatggggaaacaaacattattttgtttttggtttatttatactatattctgcatacagtactttaaatgccaattacagtgcaatctttatttattgtaaaattttttaagtgtacttatgtactaattttcccttgtagcatgttatatttttgtgttttatacttttgtaattttaggtcagtcttgttccttggcaacatctgtagtattattaatcttctgacattttcttatgtttttaaaaagataagagcatctagtgcattaaatgccaaaaaaaaaatacattatcagtgattgaaacgtttacatgtacccaaaaaccataatcatctcttggaagaaaatgctgagatcaatgaattattctgtgtgcctatattgacgtagtgagtactagagagttctgtattttattattgactataataattagtttaattagctttgcaaactgatggcatcaaggtaaatatatttttgccaaagttctggccttccaaaactcacccccttatttaaatgtgtgctatgacccactatgaccacagcatctgcattttctaaaaaattccatgcaggtgttttggggagaggtattttttaagcaatgaaaattcaactgagtacaaagccccctcttggggggttggggaagtctcttttttgaaacacttcagaactgctgctataaagaaattctctaattggttgaatttttttttaagtaaatagtactttaggccaaaatttatatgaatatttgatcttcttgagattttcatactatcatttaaccaccaggaagctgaagtgtgtgaagtacaaagctgacagcactttattttattgctctccattatttggtattcattatattccttcagtcagaaaattattactctctatggcactgttttttatcacaaatatgtatatgtgatattgatatataactatatatattgccatcacacacgaacaataaaataaagtgttctattaacctgatctctttgcccttttgctatgtgaggagtgaatgagtggccttctgatgctctgactcttctctgtatgtcaaactcatccctggcacaagaaattccagtcatgtgaagcaaactgccctttgtcctcaaagaaattgttgaaaaagaaaactttttaaagagattttttgcatattctctgccttgttcttatcaacttgaaatgttggcattttctaaccttgttttgttggctacaataattcagtattcatgtcaaaattgagaagtgccctaattgaatgtgtttgaatgttatccttgcacaattctttaaattgaaagataaaatgttttacctcactgttggacatacattccaagcttttcaactctaggagaaaaagaaaatcatgttttcctgtattgtaaattttagactatttcatatacattgtattaaaactgccatatcaattttaatgtatagattttgcaaatattatgctatatgtaatacctaactgtatctgtagtgtatatgtaatatatttatgcccaataaatgttttaattctttctgacttaaaaaaaaaaat

SEQ ID NO: 314461 - DNA, 3283 bp, Homo sapiens
aaagctggaagctcagcgcgccttgcaggtcgaacaactagtggatccaaagcaaaactagaggtatgaattaatgctacacattttaatacacacatttattcagatactcccctttttaaagcccttttgttttttgatttatatactctgttttacagatttagctagaaaaaaaatgtcagtgttttggtgcacctttttgaaatgcaaaactaggaaaaggttaaactggattttttttttaaaaaaaaagaaaaaaaaagaagaaaagtataccagataccaaaagctagctttcttatgttttcctttaaattttcagatttaccttcattctgttttcactgatgtcttttgcaagcctttgatttttttttttttgttacagtttagtaatttatattcaccagtcacttcttatgtcttgaacatctgtatctgtaaacatgaatcaccgtgtgtgtacttacagggctaggatttcagtgttgtcagagtattaccacacagcaacagcaacatacagaagatatgttcactcagataagactgccctaaacaaccattttgtcactcagttatttaactgtgtttagctcatttaaatcaaaatgtgtactttaatctaaaatgttttaataatctgtatttcttataattttaacactatgagctgcctatataagaaatcaagtaaccagaatgcacctataaattatggagcattgtaggattttaccacatcaattcatagcagtaactttaagagggcattgtgcaatagttagttgttttcttgttcagctattttaaaggctgctttaacttgtttgtttgtctttgtatataactacttctaatctaatcactagagttattatattctgttatgtttgaccagaattatatgacaagaactggtgacagtttagtgcctctgcccattgtccatgatttacactaattgtgagcagtcttcttatgtgtcagctcattatttttgaaacatttgcctttaggctgttctttgaggtatcaatgaagtgattgaatttcaataccttaattcagtgcacataatactaatgtaacagcagatgaaaattgataaaacccaaaagagagtcatctaaatttgtagttcctatttctgtgggtttgcctggccatggttggagagggaatggtgtttgatggtaaacacagggtgtttggggatcaaggagcctagattctctccctggatctgtcactaacttgctgcgtgacctgaacacgtcactttacctctctgtgcctcagttttcccatgcatgaaaaataaaataaaataaaacggggattctaatgtttgtaagtgctttgagatctttgaccaacaggtgctattggagtgcaaagtgttactcttacgtgtttattttgagtcatgagataatcaattttaacccaaagtcattggattatttatatgaagtccataatgttcgagtacctcagggacatttaagagttggaggtgcaaatatattccaaaagggtgcaacagacacagtgtatccccctgcttctgtttttgtatatttttgctacttggtttttcttgatcatagctattttgtgcttgatctttattgtctaagatgcagtatcctgtactagcttataatattcccataccaaagtcatggggaaacaaacattattttgtttttggtttatttatactatattctgcatacagtactttaaatgccaattacagtgcaatctttatttattgtaaaattttttaagtgtacttatgtactaattttcccttgtagcatgttatatttttgtgttttatacttttgtaattttaggtcagtcttgttccttggcaacatctgtagtattattaatcttctgacattttcttatgtttttaaaaagataagagcatctagtgcattaaatgccaaaaaaaaaatacattatcagtgattgaaacgtttacatgtacccaaaaaccataatcatctcttggaagaaaatgctgagatcaatgaattattctgtgtgcctatattgacgtagtgagtactagagagttctgtattttattattgactataataattagtttaattagctttgcaaactgatggcatcaaggtaaatatatttttgccaaagttctggccttccaaaactcacccccttatttaaatgtgtgctatgacccactatgaccacagcatctgcattttctaaaaaattccatgcaggtgttttggggagaggtattttttaagcaatgaaaattcaactgagtacaaagccccctcttggggggttggggaagtctcttttttgaaacacttcagaactgctgctataaagaaattctctaattggttgaatttttttttaagtaaatagtactttaggccaaaatttatatgaatatttgatcttcttgagattttcatactatcatttaaccaccaggaagctgaagtgtgtgaagtacaaagctgacagcactttattttattgctctccattatttggtattcattatattccttcagtcagaaaattattactctctatggcactgttttttatcacaaatatgtatatgtgatattgatatataactatatatattgccatcacacacgaacaataaaataaagtgttctattaacctgatctctttgcccttttgctatgtgaggagtgaatgagtggccttctgatgctctgactcttctctgtatgtcaaactcatccctggcacaagaaattccagtcatgtgaagcaaactgccctttgtcctcaaagaaattgttgaaaaagaaaactttttaaagagattttttgcatattctctgccttgttcttatcaacttgaaatgttggcattttctaaccttgttttgttggctacaataattcagtattcatgtcaaaattgagaagtgccctaattgaatgtgtttgaatgttatccttgcacaattctttaaattgaaagataaaatgttttacctcactgttggacatacattccaagcttttcaactctaggagaaaaagaaaatcatgttttcctgtattgtaaattttagactatttcatatacattgtattaaaactgccatatcaattttaatgtatagattttgcaaatattatgctatatgtaatacctaactgtatctgtagtgtatatgtaatatatttatgcccaataaatgttttaattctttctgacttaaaaaaaaaaat

SEQ ID NO: 314462 - DNA, 2616 bp, Homo sapiens
tcggtaccccttttggggtctttgctcaagtaaccagaatgcacctataaattatggagcattgtaggattttaccacatcaattcatagcagtaactttaagagggcattgtgcaatagttagttgttttcttgttcagctattttaaaggctgctttaacttgtttgtttgtctttgtatataactacttctaatctaatcactagagttattatattctgttatgtttgaccagaattatatgacaagaactggtgacagtttagtgcctctgcccattgtccatgatttacactaattgtgagcagtcttcttatgtgtcagctcattatttttgaaacatttgcctttaggctgttctttgaggtatcaatgaagtgattgaatttcaataccttaattcagtgcacataatactaatgtaacagcagatgaaaattgataaaacccaaaagagagtcatctaaatttgtagttcctatttctgtgggtttgcctggccatggttggagagggaatggtgtttgatggtaaacacagggtgtttggggatcaaggagcctagattctctccctggatctgtcactaacttgctgcgtgacctgaacacgtcactttacctctctgtgcctcagttttcccatgcatgaaaaataaaataaaataaaacggggattctaatgtttgtaagtgctttgagatctttgaccaacaggtgctattggagtgcaaagtgttactcttacgtgtttattttgagtcatgagataatcaattttaacccaaagtcattggattatttatatgaagtccataatgttcgagtacctcagggacatttaagagttggaggtgcaaatatattccaaaagggtgcaacagacacagtgtatccccctgcttctgtttttgtatatttttgctacttggtttttcttgatcatagctattttgtgcttgatctttattgtctaagatgcagtatcctgtactagcttataatattcccataccaaagtcatggggaaacaaacattattttgtttttggtttatttatactatattctgcatacagtactttaaatgccaattacagtgcaatctttatttattgtaaaattttttaagtgtacttatgtactaattttcccttgtagcatgttatatttttgtgttttatacttttgtaattttaggtcagtcttgttccttggcaacatctgtagtattattaatcttctgacattttcttatgtttttaaaaagataagagcatctagtgcattaaatgccaaaaaaaaaatacattatcagtgattgaaacgtttacatgtacccaaaaaccataatcatctcttggaagaaaatgctgagatcaatgaattattctgtgtgcctatattgacgtagtgagtactagagagttctgtattttattattgactataataattagtttaattagctttgcaaactgatggcatcaaggtaaatatatttttgccaaagttctggccttccaaaactcacccccttatttaaatgtgtgctatgacccactatgaccacagcatctgcattttctaaaaaattccatgcaggtgttttggggagaggtattttttaagcaatgaaaattcaactgagtacaaagccccctcttggggggttggggaagtctcttttttgaaacacttcagaactgctgctataaagaaattctctaattggttgaatttttttttaagtaaatagtactttaggccaaaatttatatgaatatttgatcttcttgagattttcatactatcatttaaccaccaggaagctgaagtgtgtgaagtacaaagctgacagcactttattttattgctctccattatttggtattcattatattccttcagtcagaaaattattactctctatggcactgttttttatcacaaatatgtatatgtgatattgatatataactatatatattgccatcacacacgaacaataaaataaagtgttctattaacctgatctctttgcccttttgctatgtgaggagtgaatgagtggccttctgatgctctgactcttctctgtatgtcaaactcatccctggcacaagaaattccagtcatgtgaagcaaactgccctttgtcctcaaagaaattgttgaaaaagaaaactttttaaagagattttttgcatattctctgccttgttcttatcaacttgaaatgttggcattttctaaccttgttttgttggctacaataattcagtattcatgtcaaaattgagaagtgccctaattgaatgtgtttgaatgttatccttgcacaattctttaaattgaaagataaaatgttttacctcactgttggacatacattccaagcttttcaactctaggagaaaaagaaaatcatgttttcctgtattgtaaattttagactatttcatatacattgtattaaaactgccatatcaattttaatgtatagattttgcaaatattatgctatatgtaatacctaactgtatctgtagtgtatatgtaatatatttatgcccaataaatgttttaattctttctgacttaaaaaaaaaaat

SEQ ID NO: 314463 - DNA, 1180 bp, Homo sapiens
tctgaagcgaatcagtgggaagtggcctacagtgggtcggctaccgaatacaccttcacccacttgaaaccaggcactttgtacaaactccgagcatgctgcatcagtaccggcggacacagccagtgttctgaaagtctccctgttcgcacactaagcattgcaccaggtcaatgtcgaccaccgagggttttgggtagaccaaagcacaaagaagtccacttagagtgggatgttcctgcatcggaaagtggctgtgaggtctcagagtacagcgtggagatgacggagcccgaagacgtagcctcggaagtgtaccatggcccagagctggagtgcaccgtcggcaacctgcttcctggaaccgtgtatcgcttccgggtgagggctctgaatgatggagggtatggtccctattctgatgtctcagaaattaccactgctgcagggcctcctggacaatgcaaagcaccttgtatttcttgtacacctgatggatgtgtcttagtgggttgggagagtcctgatagttctggtgctgacatctcagagtacaggttggaatggggagaagatgaagaatccttagaactcatttatcatgggacagacacccgttttgaaataagagacctgttgcctgctgcacagtattgctgtagactacaggccttcaatcaagcaggggcagggccgtacagtgaacttgtcctttgccagacgccagcgtctgcccctgaccccgtctccactctctgtgtcctggaggaggagccccttgatgcctaccctgattcaccttctgcgtgccttgtactgaactgggaagagccgtgcaataacggatctgaaatccttgcttacaccattgatctaggagacactagcattaccgtgggcaacaccaccatgcatgttatgaaagatctccttccagaaaccacctaccggatcagaattcaggctataaatgaaattggagctggaccatttagtcagttcattaaagcaaaaactcggccattaccacccttgcctcctaggctagaatgtgctgctgctggtcctcagagcctgaagctaaaatggggagacaagtgcatacaagatcaagaacatacacatcgtgtctgagtaaacagctagtgaccatggaacagctataccactgagtacgagt

SEQ ID NO: 314464 - DNA, 326 bp, Homo sapiens
cctataattttgggattattttatcaatgtaattaaataaacttcagtggacccgctttggagagtatggataacatcattcagaaacttttatttttatatctcttttttggtgggcatggattcttttgtaagggagatactgaggccggccacctatgtgatattttgctcaacttgtgtgaaatctggtgcactttggtcaactggaagcacaaagtgttctaagatgaaaaaaattcttcattcccagatgttcctgcatcggaaagtggctgtgaggtctcagagtacagcgtggagatgacggagcccgaagacgtagc

SEQ ID NO: 314465 - DNA, 4021 bp, Homo sapiens
cgcggccgtatctagaggatccgacgcaatatcgtcattaccacccttgcctcctaggctagaatgtgctgctgctggtcctcagagcctgaagctaaaatggggagacagtaactccaagacacatgctgctgaggacattgtgtacacactacagctggaggacagaaacaagaggtttatttcaatctacagaggacccagccacacctacaaggtccagagactgacggaattcacatgctactccttcagaatccaggcagcaagcgaggctggagaagggcccttctcagaaacctataccttcagcacaaccaaaagtgtcccccccaccatcaaagcacctcgagtaacacagttagaaggaaattcatgtgaaattttatgggagacggtaccatcaatgaaaggtgaccctgttaactacattctgcaggtattggttggaagagaatctgagtacaaacaggtgtacaagggagaagaagccacattccaaatctcaggcctccagaccaacacagactacaggttccgcgtatgtgcgtgtcgtcgctgtttagacacctctcaggagctaagcggagccttcagcccctctgcggcttttgtattacaacgaagtgaggtcatgcttacaggggacatggggagcttagatgatcccaaaatgaagagcatgatgcctactgatgaacagtttgcagccatcattgtgcttggctttgcaactttgtccattttatttgcctttatattacagtacttcttaatgaagtaaacccaacaaaactagaggtatgaattaatgctacacattttaatacacacatttattcagatactcccctttttaaagcccttttgttttttgatttatatactctgttttacagatttagctagaaaaaaaatgtcagtgttttggtgcacctttttgaaatgcaaaactaggaaaaggttaaactggattttttttttaaaaaaaaagaaaaaaaaagaagaaaagtataccagataccaaaagctagctttcttatgttttcctttaaattttcagatttaccttcattctgttttcactgatgtcttttgcaagcctttgatttttttttttttgttacagtttagtaatttatattcaccagtcacttcttatgtcttgaacatctgtatctgtaaacatgaatcaccgtgtgtgtacttacagggctaggatttcagtgttgtcagagtattaccacacagcaacagcaacatacagaagatatgttcactcagataagactgccctaaacaaccattttgtcactcagttatttaactgtgtttagctcatttaaatcaaaatgtgtactttaatctaaaatgttttaataatctgtatttcttataattttaacactatgagctgcctatataagaaatcaagtaaccagaatgcacctataaattatggagcattgtaggattttaccacatcaattcatagcagtaactttaagagggcattgtgcaatagttagttgttttcttgttcagctattttaaaggctgctttaacttgtttgtttgtctttgtatataactacttctaatctaatcactagagttattatattctgttatgtttgaccagaattatatgacaagaactggtgacagtttagtgcctctgcccattgtccatgatttacactaattgtgagcagtcttcttatgtgtcagctcattatttttgaaacatttgcctttaggctgttctttgaggtatcaatgaagtgattgaatttcaataccttaattcagtgcacataatactaatgtaacagcagatgaaaattgataaaacccaaaagagagtcatctaaatttgtagttcctatttctgtgggtttgcctggccatggttggagagggaatggtgtttgatggtaaacacagggtgtttggggatcaaggagcctagattctctccctggatctgtcactaacttgctgcgtgacctgaacacgtcactttacctctctgtgcctcagttttcccatgcatgaaaaataaaataaaataaaacggggattctaatgtttgtaagtgctttgagatctttgaccaacaggtgctattggagtgcaaagtgttactcttacgtgtttattttgagtcatgagataatcaattttaacccaaagtcattggattatttatatgaagtccataatgttcgagtacctcagggacatttaagagttggaggtgcaaatatattccaaaagggtgcaacagacacagtgtatccccctgcttctgtttttgtatatttttgctacttggtttttcttgatcatagctattttgtgcttgatctttattgtctaagatgcagtatcctgtactagcttataatattcccataccaaagtcatggggaaacaaacattattttgtttttggtttatttatactatattctgcatacagtactttaaatgccaattacagtgcaatctttatttattgtaaaattttttaagtgtacttatgtactaattttcccttgtagcatgttatatttttgtgttttatacttttgtaattttaggtcagtcttgttccttggcaacatctgtagtattattaatcttctgacattttcttatgtttttaaaaagataagagcatctagtgcattaaatgccaaaaaaaaaatacattatcagtgattgaaacgtttacatgtacccaaaaaccataatcatctcttggaagaaaatgctgagatcaatgaattattctgtgtgcctatattgacgtagtgagtactagagagttctgtattttattattgactataataattagtttaattagctttgcaaactgatggcatcaaggtaaatatatttttgccaaagttctggccttccaaaactcacccccttatttaaatgtgtgctatgacccactatgaccacagcatctgcattttctaaaaaattccatgcaggtgttttggggagaggtattttttaagcaatgaaaattcaactgagtacaaagccccctcttggggggttggggaagtctcttttttgaaacacttcagaactgctgctataaagaaattctctaattggttgaatttttttttaagtaaatagtactttaggccaaaatttatatgaatatttgatcttcttgagattttcatactatcatttaaccaccaggaagctgaagtgtgtgaagtacaaagctgacagcactttattttattgctctccattatttggtattcattatattccttcagtcagaaaattattactctctatggcactgttttttatcacaaatatgtatatgtgatattgatatataactatatatattgccatcacacacgaacaataaaataaagtgttctattaacctgatctctttgcccttttgctatgtgaggagtgaatgagtggccttctgatgctctgactcttctctgtatgtcaaactcatccctggcacaagaaattccagtcatgtgaagcaaactgccctttgtcctcaaagaaattgttgaaaaagaaaactttttaaagagattttttgcatattctctgccttgttcttatcaacttgaaatgttggcattttctaaccttgttttgttggctacaataattcagtattcatgtcaaaattgagaagtgccctaattgaatgtgtttgaatgttatccttgcacaattctttaaattgaaagataaaatgttttacctcactgttggacatacattccaagcttttcaactctaggagaaaaagaaaatcatgttttcctgtattgtaaattttagactatttcatatacattgtattaaaactgccatatcaattttaatgtatagattttgcaaatattatgctatatgtaatacctaactgtatctgtagtgtatatgtaatatatttatgcccaataaatgttttaattctttctgacttaaaaaaaaaaat

SEQ ID NO: 314466 - DNA, 3079 bp, Homo sapiens
tctgaagcgaatcagtgggaagtggcctacagtgggtcggctaccgaatacaccttcacccacttgaaaccaggcactttgtacaaactccgagcatgctgcatcagtaccggcggacacagccagtgttctgaaagtctccctgttcgcacactaagcattgcaccaggtcaatgtcgaccaccgagggttttgggtagaccaaagcacaaagaagtccacttagagtgggatgttcctgcatcggaaagtggctgtgaggtctcagagtacagcgtggagatgacggagcccgaagacgtagcctcggaagtgtaccatggcccagagctggagtgcaccgtcggcaacctgcttcctggaaccgtgtatcgcttccgggtgagggctctgaatgatggagggtatggtccctattctgatgtctcagaaattaccactgctgcagggcctcctggacaatgcaaagcaccttgtatttcttgtacacctgatggatgtgtcttagtgggttgggagagtcctgatagttctggtgctgacatctcagagtacaggttggaatggggagaagatgaagaatccttagaactcatttatcatgggacagacacccgttttgaaataagagacctgttgcctgctgcacagtattgctgtagactacaggccttcaatcaagcaggggcagggccgtacagtgaacttgtcctttgccagacgccagcgtctgcccctgaccccgtctccactctctgtgtcctggaggaggagccccttgatgcctaccctgattcaccttctgcgtgccttgtactgaactgggaagagccgtgcaataacggatctgaaatccttgcttacaccattgatctaggagacactagcattaccgtgggcaacaccaccatgcatgttatgaaagatctccttccagaaaccacctaccggatcagaattcaggctataaatgaaattggagctggaccatttagtcagttcattaaagcaaaaactcggccattaccacccttgcctcctaggctagaatgtgctgctgctggtcctcagagcctgaagctaaaatggggagacagtaactccaagacacatgctgctgaggacattgtgtacacactacagctggaggacagaaacaagaggtttatttcaatctacagaggacccagccacacctacaaggtccagagactgacggaattcacatgctactccttcagaatccaggcagcaagcgaggctggagaagggcccttctcagaaacctataccttcagcacaaccaaaagtgtcccccccaccatcaaagcacctcgagtaacacagttagaaggaaattcatgtgaaattttatgggagacggtaccatcaatgaaaggtgaccctgttaactacattctgcaggtattggttggaagagaatctgagtacaaacaggtgtacaagggagaagaagccacattccaaatctcaggcctccagaccaacacagactacaggttccgcgtatgtgcgtgtcgtcgctgtttagacacctctcaggagctaagcggagccttcagcccctctgcggcttttgtattacaacgaagtgaggtcatgcttacaggggacatggggagcttagatgatcccaaaatgaagagcatgatgcctactgatgaacagtttgcagccatcattgtgcttggctttgcaactttgtccattttatttgcctttatattacagtacttcttaatgaagtaaacccaacaaaactagaggtatgaattaatgctacacattttaatacacacatttattcagatactcccctttttaaagcccttttgttttttgatttatatactctgttttacagatttagctagaaaaaaaatgtcagtgttttggtgcacctttttgaaatgcaaaactaggaaaaggttaaactggattttttttttaaaaaaaaagaaaaaaaaagaagaaaagtataccagataccaaaagctagctttcttatgttttcctttaaattttcagatttaccttcattctgttttcactgatgtcttttgcaagcctttgatttttttttttttgttacagtttagtaatttatattcaccagtcacttcttatgtcttgaacatctgtatctgtaaacatgaatcaccgtgtgtgtacttacagggctaggatttcagtgttgtcagagtattaccacacagcaacagcaacatacagaagatatgttcactcagataagactgccctaaacaaccattttgtcactcagttatttaactgtgtttagctcatttaaatcaaaatgtgtactttaatctaaaatgttttaataatctgtatttcttataattttaacactatgagctgcctatataagaaatcaagtaaccagaatgcacctataaattatggagcattgtaggattttaccacatcaattcatagcagtaactttaagagggcattgtgcaatagttagttgttttcttgttcagctattttaaaggctgctttaacttgtttgtttgtctttgtatataactacttctaatctaatcactagagttattatattctgttatgtttgaccagaattatatgacaagaactggtgacagtttagtgcctctgcccattgtccatgatttacactaattgtgagcagtcttcttatgtgtcagctcattatttttgaaacatttgcctttaggctgttctttgaggtatcaatgaagtgattgaatttcaataccttaattcagtgcacataatactaatgtaacagcagatgaaaattgataaaacccaaaagagagtcatctaaatttgtagttcctatttctgtgggtttgcctggccatggttggagagggaatggtgtttgatggtaaacacagggtgtttggggatcaaggagcctagattctctccctggatctgtcactaacttgctgcgtgacctgaacacgtcactttacctctctgtgcctcagttttcccatgcatgaaaaataaaataaaataaaacggggattctaatgtt

SEQ ID NO: 314467 - DNA, 1288 bp, Homo sapiens
ggagccaccagcagaacctcttcaatatcttgcatgttacagatttcactgctcccaccagcttggagacaacatgtggttcttgacaactctgctcctttgggggtgggcaagtggacaccacaaaggcagtgatcactttgcagcctccatgggtcagcgtgttccaagaggaaaccgtaaccttgcactgtgaggtgctccatctgcctgggagcagctctacacagtggtttctcaatggcacagccactcagacctcgacccccagctacagaatcacctctgccagtgtcaatgacagtggtgaatacaggtgccagagaggtctctcagggcgaagtgaccccatacagctggaaatccacagaggctggctactactgcaggtctccagcagagtcttcacggaaggagaacctctggccttgaggtgtcatgcgtggaaggataagctggtgtacaatgtgctttactatcgaaatggcaaagcctttaagtttttccactggaattctaacctcaccattctgaaaaccaacataagtcacaatggcacctaccattgctcaggcatgggaaagcatcgctacacatcagcaggaatatctgtcactgtgaaagagctatttccagctccagtgctgaatgcatctgtgacatccccactcctggaggggaatctggtcaccctgagctgtgaaacaaagttgctcttgcagaggcctggtttgcagctttacttctccttctacatgggcagcaagaccctgcgaggcaggaacacatcctctgaataccaaatactaactgctagaagagaagactctgggttatactggtgcgaggctgccacagaggatggaaatgtccttaagcgcagccctgagttggagcttcaagtgcttggcctccagttaccaactcctgtctggtttcatgtccttttctatctggcagtgggaataatgtttttagtgaacactgttctctgggtgacaatacgtaaagaactgaaaagaaagaaaaagtgggatttagaaatctctttggattctggaggccaagcacttgaagctccaactcagggctgcgcttaaggacatttacatcctctgaataccaaatactaactgctagaagagaagactctgggttatactggtgcgaggctgccacagagtcttctcttctagcagttagtatttggtacttcagaggatgtgttcctgcctcgcagggtcttgcagctttacttctccttctacatgggcagcaagctttagag

SEQ ID NO: 314468 - DNA, 888 bp, Homo sapiens
ggagccaccagcagaacctcttcaatatcttgcatgttacagatttcactgctcccaccagcttggagacaacatgtggttcttgacaactctgctcctttgggggttccagttgatgggcaagtgggtgagtgatctctaactcagcttctccttctatgccactttcctacttccaaaggatgggtcctattaacctgcagaagagcatatagggaaagcagagaaagaagaaagatttataaattatgtaaaatctcccatattcagagcatgattttcataaaaactatgatttgtaagctttctttctaaagttttctgaatgagctctttcctctgagcgaaatgcctgaatgtatatataacagcaggaaagggccagaattgcacaaacactaaagtagtctgctgacactgaagtagtctgctgggtttcccaacatcccctaaaccagtcccctttacaagaaagcagagtgggttttttctcctcagaaagagccaggcaaatactgaaggcttcaaagagaggagtttgaacctccgtttccaatgtacaagctgctgaagccctgcaatgtactctcagagacagtatagctcagaggataaggaaaacagctccgcttggcttgcccaagtctaaaaccctgcttcattgctcccaacagaaaaacctacatcagtaatttaatcctcaggagccccagattcccaacacccagatgaggatttaataacaatgaacagaggtctctgcagcaggaggacactcttaaaggctggcttttgtaggtttccacttgcctatttttcaaataaatctaaatatgtatttttcccttgtgctatccacaaaagcctcaccagttgctcagagccctc

SEQ ID NO: 314469 - DNA, 1422 bp, Homo sapiens
ggagccaccagcagaacctcttcaatatcttgcatgttacagatttcactgctcccaccagcttggagacaacatgtggttcttgacaactctgctcctttgggggtgggcaagtggacaccacaaaggcagtgatcactttgcagcctccatgggtcagcgtgttccaagaggaaaccgtaaccttgcactgtgaggtgctccatctgcctgggagcagctctacacagtggtttctcaatggcacagccactcagacctcgacccccagctacagaatcacctctgccagtgtcaatgacagtggtgaatacaggtgccagagaggtctctcagggcgaagtgaccccatacagctggaaatccacagaggctggctactactgcaggtctccagcagagtcttcacggaaggagaacctctggccttgaggtgtcatgcgtggaaggataagctggtgtacaatgtgctttactatcgaaatggcaaagcctttaagtttttccactggaattctaacctcaccattctgaaaaccaacataagtcacaatggcacctaccattgctcaggcatgggaaagcatcgctacacatcagcaggaatatctgtcactgtgaaagagctatttccagctccagtgctgaatgcatctgtgacatccccactcctggaggggaatctggtcaccctgagctgtgaaacaaagttgctcttgcagaggcctggtttgcagctttacttctccttctacatgggcagcaagaccctgcgaggcaggaacacatcctctgaataccaaatactaactgctagaagagaagactctgggttatactggtgcgaggctgccacagaggatggaaatgtccttaagcgcagccctgagttggagcttcaagtgcttggcctccagttaccaactcctgtctggtttcatgtccttttctatctggcagtgggaataatgtttttagtgaacactgttctctgggtgacaatacgtaaagaactgaaaagaaagaaaaagtgggatttagaaatctctttggattctggtcatgagaagaaggtaatttccagccttcaagaagacagacatttagaagaagagctgaaatgtcaggaacaaaaagaagaacagctgcaggaaggggtgcaccggaaggagccccagggggccacgtagcagcggctcagtgggtggccatcgatctggaccgtcccctgcccacttgctccccgtgagcactgcgtacaaacatccaaaagttcaacaacaccagaactgtgtgtctcatggtatgtaactcttaaagcaaataaatgaactgacttcaactgggatacatttggaaatgtggtcatcaaagatgacttgaaatgaggcctactctaaagaattcttgaaaaacttaaaa

SEQ ID NO: 314470 - DNA, 322 bp, Homo sapiens
aacctcaccattctgaaaaccaacataagtcacaatggcacctaccattgctcaggcatgggaaagcatcgctacacatcagcaggaatatctgtcactgtgaaaggtattgtattggaatagtcatagaactgatagtccctccccctgagggaccatcataaatattctaaactcctcactttaatttacaagtgaagaaaccgggctccagagaggtaaactgcattactaaaggccacaccatgaccagtagctggaaccagaactgaggtctctgggtcctagtccaatactctttccagtgtaccgcaacccccat

SEQ ID NO: 314471 - DNA, 1348 bp, Homo sapiens
ggagccaccagcagaacctcttcaatatcttgcatgttacagatttcactgctcccaccagcttggagacaacatgtggttcttgacaactctgctcctttgggggtgggcaagtggacaccacaaaggcagtgatcactttgcagcctccatgggtcagcgtgttccaagaggaaaccgtaaccttgcactgtgaggtgctccatctgcctgggagcagctctacacagtggtttctcaatggcacagccactcagacctcgacccccagctacagaatcacctctgccagtgtcaatgacagtggtgaatacaggtgccagagaggtctctcagggcgaagtgaccccatacagctggaaatccacagaggctggctactactgcaggtctccagcagagtcttcacggaaggagaacctctggccttgaggtgtcatgcgtggaaggataagctggtgtacaatgtgctttactatcgaaatggcaaagcctttaagtttttccactggaattctaacctcaccattctgaaaaccaacataagtcacaatggcacctaccattgctcaggcatgggaaagcatcgctacacatcagcaggaatatctgtcactgtgaaagagctatttccagctccagtgctgaatgcatctgtgacatccccactcctggaggggaatctggtcaccctgagctgtgaaacaaagttgctcttgcagaggcctggtttgcagctttacttctccttctacatgggcagcaagaccctgcgaggcaggaacacatcctctgaataccaaatactaactgctagaagagaagactctgggttatactggtgcgaggctgccacagaggatggaaatgtccttaagcgcagccctgagttggagcttcaagtgcttggcctccagttaccaactcctgtctggtttcatgtccttttctatctggcagtgggaataatgtttttagtgaacactgttctctgggtgacaatacgtaaagaactgaaaagaaagaaaaagtgggatttagaaatctctttggattctggtcatgagaagaaggtaatttccagccttcaagaagacagacatttagaagaagagctgaaatgtcaggaacaaaaagaagaacagctgcaggaaggggtgcaccggaaggagccccagggggccacgtagcagcggctcagtgggtggccatcgatctggaccgtcccctgcccacttgctccccgtgagcactgcgtacaaacatccaaaagttcaacaacaccagaactgtgtgtctcatggtatgtaactcttaaagcaaataaatgaactgacttcaactggga

SEQ ID NO: 314472 - DNA, 1082 bp, Homo sapiens
ggagccaccagcagaacctcttcaatatcttgcatgttacagatttcactgctcccaccagcttggagacaacatgtggttcttgacaactctgctcctttggggggctggctactactgcaggtctccagcagagtcttcacggaaggagaacctctggccttgaggtgtcatgcgtggaaggataagctggtgtacaatgtgctttactatcgaaatggcaaagcctttaagtttttccactggaattctaacctcaccattctgaaaaccaacataagtcacaatggcacctaccattgctcaggcatgggaaagcatcgctacacatcagcaggaatatctgtcactgtgaaagagctatttccagctccagtgctgaatgcatctgtgacatccccactcctggaggggaatctggtcaccctgagctgtgaaacaaagttgctcttgcagaggcctggtttgcagctttacttctccttctacatgggcagcaagaccctgcgaggcaggaacacatcctctgaataccaaatactaactgctagaagagaagactctgggttatactggtgcgaggctgccacagaggatggaaatgtccttaagcgcagccctgagttggagcttcaagtgcttggcctccagttaccaactcctgtctggtttcatgtccttttctatctggcagtgggaataatgtttttagtgaacactgttctctgggtgacaatacgtaaagaactgaaaagaaagaaaaagtgggatttagaaatctctttggattctggtcatgagaagaaggtaatttccagccttcaagaagacagacatttagaagaagagctgaaatgtcaggaacaaaaagaagaacagctgcaggaaggggtgcaccggaaggagccccagggggccacgtagcagcggctcagtgggtggccatcgatctggaccgtcccctgcccacttgctccccgtgagcactgcgtacaaacatccaaaagttcaacaacaccagaactgtgtgtctcatggtatgtaactcttaaagcaaataaatgaactgacttcaactggga

SEQ ID NO: 314473 - DNA, 440 bp, Homo sapiens
  misc_feature (5)..(5): n is a, c, g, or t
  misc_feature (64)..(64): n is a, c, g, or t
  misc_feature (144)..(144): n is a, c, g, or t
  misc_feature (151)..(151): n is a, c, g, or t
ttatncctcccgggccccgtatgtgtgggggaattgtgaaccgggataaccaatttccaccacngggaaacagcctatgacatgattccgaatttaaatacgacctcacctataggggaatttggcccctcgaggcccaagaantcgggcncgaggattggaatcattgtcttttaaaccagtggtttatgtcagggtatagcgtttcaagggatttgagggtcagatggggaaatgtagccccttattttgccagtgtgaagcagataccctgcttttctttacagtagcggagtcagcttaagagctttaaaggtcctaaacttcaaaaacattacagtgccccatcctccgccttaatgtaattcaaaatacaaacaatactaaactgtaaaataaatgtaacaaagtccaataaagtttttatttttttctcatga

SEQ ID NO: 314474 - DNA, 475 bp, Homo sapiens
  misc_feature (36)..(36): n is a, c, g, or t
  misc_feature (48)..(48): n is a, c, g, or t
  misc_feature (68)..(68): n is a, c, g, or t
  misc_feature (103)..(104): n is a, c, g, or t
ccccccccgcctaaccgtccggacccccctgtgggncccccccactgnccccctcaccccagtcgggnccctccagccgaacccctccgagtgcccccaaggnncccccacggaaccccacaaagggtcgtctccttcaccgaaaacccatataccttttaagtttgtttcaactaaaatattaagtgaatgctttgcaagtttgactgtatgcaggtttatatcagaaggtgagattgaataatgcttgatgcagaatcgaaacttctcatttatctgtatattatgtttacttctaaggatatagcacaaagggaacattttttgtttaaagtgaactacagctgtgctgtgaagagagttctttataaagcctgtaggttcttttaactttggtttaaaatgtaagataggaaaatgttggatatttgaggccatgcttaatatatttatattgcagtatcctttaaaagca

SEQ ID NO: 314475 - DNA, 419 bp, Homo sapiens
  misc_feature (33)..(33): n is a, c, g, or t
  misc_feature (35)..(35): n is a, c, g, or t
tcggagtactctagaggatcgccccgggagccntnacctacctcatgctctgcttggcttccttgtacatcatgatgaccctgaccagctggtacagccctgatgcaaagtttcagagcatgaccagcaagtggccagctgtgtgggtcaagatcagctccagctgggtctgcctcctgctttacgtctggacccttgtggctccacttgtcctcaccagtcgggacttcagctgaacctctgagtgccaaggacaccactggaactcacaaaggcacccaactcagtgatgtcctaattactgctggatgactcaagccacaccatgcctatgttctcaggtgaagaagaataatagaaaccacatagatgggtaggtgtaccaagcattaaacagacagtatccacaaaaaagtaag

SEQ ID NO: 314476 - DNA, 4682 bp, Homo sapiens
catccgtgcgtctgtggaaggctgcgtttccggcctgagaaaccgtcatgtttctggggagtcacctcagctggcagttaccaccgtgttagaaagcagcctcaggaccggccacctccatcactggcgtcaccatgggggctgtgctgggtgtcttctccctcgccagctgggttccatgcctctgcagcggtgcctcatgtttgctgtgtagttgctgtcctaacagtaagaattccacggtgactcgcctcatttatgctttcattctcctcctgagcactgtcgtatcctatatcatgcagagaaaagagatggaaacttacttgaagaagattcctggattttgtgaagggggatttaaaatccatgaggctgatataaatgcagataaagattgtgatgtgctggttggttataaagctgtgtatcggatcagctttgccatggccatctttttctttgtcttttctctgctcatgttcaaagtaaaaacaagtaaagatctccgagcggcagtacacaatgggttttggttcttcaaaattgctgcccttattggaatcatggttggctctttctacatccctgggggctatttcagctcagtctggtttgttgttggcatgataggggccgccctcttcatcctcattcagctggtgctgctggtagattttgctcattcttggaatgaatcatgggtaaatcgaatggaagaaggaaacccaaggttgtggtatgctgctttactgtctttcacaagcgccttttatatcctgtcaatcatctgtgtcgggctgctctatacatattacaccaaaccagatggctgcacagaaaacaagttcttcatcagtattaacctgatcctttgcgttgtggcttctattatatcgatccacccaaaaattcaggaacaccagcctcgctccggcctcttgcagtcctccctcatcaccctctacactatgtacctcacctggtcagccatgtccaatgaacctgatcgttcctgcaatcccaacctgatgagctttattacacgcataactgcaccaaccctggctcctggaaattcaactgctgtggtccctacccctactccaccatcaaagagtgggtctttactggattcagataattttattggactgtttgtctttgttctctgcctcttgtattctagcatccgcacttccactaatagccaagtagacaagctgaccctgtcagggagtgacagcgtcatccttggtgatacaactaccagtggtgccagtgatgaagaagatggacagcctcggcgggctgtggacaacgagaaagagggagtgcagtatagctactccttattccacctcatgctctgcttggcttccttgtacatcatgatgaccctgaccagctggtacagccctgatgcaaagtttcagagcatgaccagcaagtggccagctgtgtgggtcaagatcagctccagctgggtctgcctcctgctttacgtctggacccttgtggctccacttgtcctcaccagtcgggacttcagctgaacctctgagtgccaaggacaccactggaactcacaaaggtctccttcaccgaaaacccatataccttttaagtttgtttcaactaaaatattaagtgaatgctttgcaagtttgactgtatgcaggtttatatcagaaggtgagattgaataatgcttgatgcagaatcgaaacttctcatttatctgtatattatgtttacttctaaggatatagcacaaagggaacattttttgtttaaagtgaactacagctgtgctgtgaagagagttctttataaagcctgtaggttcttttaactttggtttaaaatgtaagataggaaaatgttggatatttgaggccatgcttaatatatttatattgcagtatcctttaaaagcaaaaaaaaaaaaatgcatttatattacagttttcctctatgaaagtccttacttatatgatacaagcactgtgttttgtgcttaaactcttcagcggggtagcatcaaagttcttggggaaggatcgtatatgtgggtcccttccctagaagaatggttgctgatatggctactgcttctacatcttgagttttttaatttactttttttacactgtagcattgagactgcttgattcaagtctggtgctttgccagatgtattaatttccataaatgctttgtgagtttggttaaaatgaagattcacttgggaaaacactgcagctttagtctgtgttactatcttgttatgagtatgtaaaagtaaaatgcatgtgaatttatcatatttgcactatgaaggtatttggttaaaatacaaagacttttaagattttaaggccctttcttccaacagcttttatagttagcagccattctttattttctggatagccaggttttatcacgcttctagtcaggatgctcctattccttctaaaaattacggtctgactagtgagcaaagtcttgaatttattcaaaagtcctaaataccttctctaggtaagacacttggtagatgagagacggaaggcattgtcaagaaccattttcatgagaggtggtgtgcaaaaaggtagaataaaagagttctttcaacaaagatttactgtctattctgtactagaccctgtaggttttggggtacagtgttaaacatgatagaggctctgccgtcttggactttaatagcttagagaagagagcaaatgagctgacaggtggttataatgtgaattagtgctgtggtttaggaattggagagaactcaaaggagaggtatttggtgtaatggtaggctttctggagaaaatgatatttaagccaagaactcttagaagttagctaagagagagatgggaaaatgagacgacattgctggagtagataaaactgcatgttaaaggcaggaagatggggaaaaaaagttcagtaaagctggaatggggaaatgtagtcagggactgaattttaaagggctttatcaacctcagtaaagagtttggaccttatgttgagggtggctgaaaacatattcatagtgtcatgaacaaattttatcttcagtcacttgggctgatatatagagaatggatttagagagatgagaccaggtgcagtccatatgagatgtgaaatagagaagtggaatcgtagggacggggagaaattgacaggtgagggctacttagcaattagaatttttttttttcaattttaatttttttttttgagacggagtcttgctctgtcgcccaggctggagtgcaatggtgcgatctccgctcactgcaggctccgcctcccgggttcacgccattctcccgcctcagcctccctagtagctgggactacaggcacccaccaccacgcctggctaattttttttgtatttttagtagagacagggtttcaccatgttagccaggatggtctcgatctcctgacctcgtgatccacctgccgcggcctcccaaagttctaggattactggcatgagccaccgtgcctggccagcaattagaattttaacactggcagttatgaataatatgaaggagaggtagatttctgagtgattctggtttaaccagctgggtggatggtggttccacgtattcaggtggcaaacaggaaaaacatgtgttcgaagaagaatggaggtaggtggtctcttaagaatggttaagaggcttgggagtcagactgcttgggtttgcatcccagctttgccgttttctggctatcaaacttgtcagctattatttgttgagtacgtactatttgatttatgaccacaggcagctgagcctcagtgttggtgcctagtgtacaagattgttaaagaataaagttattttgcaaagtgtaacccatttttagcactgacatagcactgacagtagctgctgatctcattatgggctaaaataagacaatattcaaaggtcagagatatctagccagaatctgatggaggctggatttcagattttgttacagaattagacagaggaacacagaggggacaggctcagttagggtggaggtgtggggtagggaagcaggacttgatataaattattggaatcattgtcttttaaaccagtggtttatgtcagggtatagcgtttcaagggatttgagggtcagatggggaaatgtagccccttattttgccagtgtgaagcagataccctgcttttctttacagtagcggagtcagcttaagagctttaaaggtcctaaacttcaaaaacattacagtgccccatcctccgccttaatgtaattcaaaatacaaacaatactaaactgtaaaataaatgtaacaaagtccaataaagtttttatttttttctcatgatgataactgatattaatttgaagtaacaaatgctctttaaaagtcgggaggcagtgtccctgctttgcttggtcctaccttaagaagtagtgaagtctgcctcttagtaggaaaaccagtagtctaatcaagactcaagtgaattatacatgtgaatgctgaattatatacaagcatgagtaagacagcattctgaataaggccaggatcatcatttaaagcaggggagtattttgagtcatcagatctcagggtggcctttcattccaga

SEQ ID NO: 314477 - DNA, 4440 bp, Homo sapiens
actaccatctcctctcttctttcagacttctccgtcttgttctctcgtttcttctcctcctaccctagaaaccgtcatgtttctggggagtcacctcagctggcagttaccaccgtgttagaaagcagcctcaggaccggccacctccatcactggcgtcaccatgggggctgtgctgggtgtcttctccctcgccagctgggttccatgcctctgcagcggtgcctcatgtttgctgtgtagttgctgtcctaacagtaagaattccacggtgactcgcctcatttatgctttcattctcctcctgagcactgtcgtatcctatatcatgcagagaaaagagatggaaacttacttgaagaagattcctggattttgtgaagggggatttaaaatccatgaggctgatataaatgcagataaagattgtgatgtgctggttggttataaagctgtgtatcggatcagctttgccatggccatctttttctttgtcttttctctgctcatgttcaaagtaaaaacaagtaaagatctccgagcggcagtacacaatgggttttggttcttcaaaattgctgcccttattggaatcatggttggctctttctacatccctgggggctatttcagctcagtctggtttgttgttggcatgataggggccgccctcttcatcctcattcagctggtgctgctggtagattttgctcattcttggaatgaatcatgggtaaatcgaatggaagaaggaaacccaaggttgtggtatgctgctttactgtctttcacaagcgccttttatatcctgtcaatcatctgtgtcgggctgctctatacatattacaccaaaccagatggctgcacagaaaacaagttcttcatcagtattaacctgatcctttgcgttgtggcttctattatatcgatccacccaaaaattcaggaacaccagcctcgctccggcctcttgcagtcctccctcatcaccctctacactatgtacctcacctggtcagccatgtccaatgaacctgatcgttcctgcaatcccaacctgatgagctttattacacgcataactgcaccaaccctggctcctggaaattcaactgctgtggtccctacccctactccaccatcaaagagtgggtctttactggattcagataattttattggactgtttgtctttgttctctgcctcttgtattctagcatccgcacttccactaatagccaagtagacaagctgaccctgtcagggagtgacagcgtcatccttggtgatacaactaccagtggtgccagtgatgaagaagatggacagcctcggcgggctgtggacaacgagaaagagggagtgcagtatagctactccttattccacctcatgctctgcttggcttccttgtacatcatgatgaccctgaccagctggtacagccctgatgcaaagtttcagagcatgaccagcaagtggccagctgtgtgggtcaagatcagctccagctgggtctgcctcctgctttacgtctggacccttgtggctccacttgtcctcaccagtcgggacttcagctgaacctctgagtgccaaggacaccactggaactcacaaaggtctccttcaccgaaaacccatataccttttaagtttgtttcaactaaaatattaagtgaatgctttgcaagtttgactgtatgcaggtttatatcagaaggtgagattgaataatgcttgatgcagaatcgaaacttctcatttatctgtatattatgtttacttctaaggatatagcacaaagggaacattttttgtttaaagtgaactacagctgtgctgtgaagagagttctttataaagcctgtaggttcttttaactttggtttaaaatgtaagataggaaaatgttggatatttgaggccatgcttaatatatttatattgcagtatcctttaaaagcaaaaaaaaaaaaatgcatttatattacagttttcctctatgaaagtccttacttatatgatacaagcactgtgttttgtgcttaaactcttcagcggggtagcatcaaagttcttggggaaggatcgtatatgtgggtcccttccctagaagaatggttgctgatatggctactgcttctacatcttgagttttttaatttactttttttacactgtagcattgagactgcttgattcaagtctggtgctttgccagatgtattaatttccataaatgctttgtgagtttggttaaaatgaagattcacttgggaaaacactgcagctttagtctgtgttactatcttgttatgagtatgtaaaagtaaaatgcatgtgaatttatcatatttgcactatgaaggtatttggttaaaatacaaagacttttaagattttaaggccctttcttccaacagcttttatagttagcagccattctttattttctggatagccaggttttatcacgcttctagtcaggatgctcctattccttctaaaaattacggtctgactagtgagcaaagtcttgaatttattcaaaagtcctaaataccttctctaggtaagacacttggtagatgagagacggaaggcattgtcaagaaccattttcatgagaggtggtgtgcaaaaaggtagaataaaagagttctttcaacaaagatttactgtctattctgtactagaccctgtaggttttggggtacagtgttaaacatgatagaggctctgccgtcttggactttaatagcttagagaagagagcaaatgagctgacaggtggttataatgtgaattagtgctgtggtttaggaattggagagaactcaaaggagaggtatttggtgtaatggtaggctttctggagaaaatgatatttaagccaagaactcttagaagttagctaagagagagatgggaaaatgagacgacattgctggagtagataaaactgcatgttaaaggcaggaagatggggaaaaaaagttcagtaaagctggaatggggaaatgtagtcagggactgaattttaaagggctttatcaacctcagtaaagagtttggaccttatgttgagggtggctgaaaacatattcatagtgtcatgaacaaattttatcttcagtcacttgggctgatatatagagaatggatttagagagatgagaccaggtgcagtccatatgagatgtgaaatagagaagtggaatcgtagggacggggagaaattgacaggtgagggctacttagcaattagaatttttttttttcaattttaatttttttttttgagacggagtcttgctctgtcgcccaggctggagtgcaatggtgcgatctccgctcactgcaggctccgcctcccgggttcacgccattctcccgcctcagcctccctagtagctgggactacaggcacccaccaccacgcctggctaattttttttgtatttttagtagagacagggtttcaccatgttagccaggatggtctcgatctcctgacctcgtgatccacctgccgcggcctcccaaagttctaggattactggcatgagccaccgtgcctggccagcaattagaattttaacactggcagttatgaataatatgaaggagaggtagatttctgagtgattctggtttaaccagctgggtggatggtggttccacgtattcaggtggcaaacaggaaaaacatgtgttcgaagaagaatggaggtaggtggtctcttaagaatggttaagaggcttgggagtcagactgcttgggtttgcatcccagctttgccgttttctggctatcaaacttgtcagctattatttgttgagtacgtactatttgatttatgaccacaggcagctgagcctcagtgttggtgcctagtgtacaagattgttaaagaataaagttattttgcaaagtgtaacccatttttagcactgacatagcactgacagtagctgctgatctcattatgggctaaaataagacaatattcaaaggtcagagatatctagccagaatctgatggaggctggatttcagattttgttacagaattagacagaggaacacagaggggacaggctcagttagggtggaggtgtggggtagggaagcaggacttgatataaattattggaatcattgtcttttaaaccagtggtttatgtcagggtatagcgtttcaagggatttgagggtcagatggggaaatgtagccccttattttgccagtgtgaagcagataccctgcttttctttacagtagcggagtcagcttaagagctttaaaggtcctaaacttcaaaaacattacagtgccccatcctccgccttaatgtaattcaaaatacaaacaatactaaactgtaaaataaatgtaacaaagtccaataaagtttttatttttttctcatga

SEQ ID NO: 314478 - DNA, 3747 bp, Homo sapiens
  misc_feature (3739)..(3739): n is a, c, g, or t
catccgtgcgtctgtggaaggctgcgtttccggcctgagaaaccgtcatgtttctggggagtcacctcagctggcagttaccaccgtgttagaaagcagcctcaggaccggccacctccatcactggcgtcaccatgggggctgtgctgggtgtcttctccctcgccagctgggttccatgcctctgcagcggtgcctcatgtttgctgtgtagttgctgtcctaacagtaagaattccacggtgactcgcctcatttatgctttcattctcctcctgagcactgtcgtatcctatatcatgcagagaaaagagatggaaacttacttgaagaagattcctggattttgtgaagggggatttaaaatccatgaggctgatataaatgcagataaagattgtgatgtgctggttggttataaagctgtgtatcggatcagctttgccatggccatctttttctttgtcttttctctgctcatgttcaaagtaaaaacaagtaaagatctccgagcggcagtacacaatgggttttggttcttcaaaattgctgcccttattggaatcatggttggctctttctacatccctgggggctatttcagctcagtctggtttgttgttggcatgataggggccgccctcttcatcctcattcagctggtgctgctggtagattttgctcattcttggaatgaatcatgggtaaatcgaatggaagaaggaaacccaaggttgtggtatgctgctttactgtctttcacaagcgccttttatatcctgtcaatcatctgtgtcgggctgctctatacatattacaccaaaccagatggctgcacagaaaacaagttcttcatcagtattaacctgatcctttgcgttgtggcttctattatatcgatccacccaaaaattcaggaacaccagcctcgctccggcctcttgcagtcctccctcatcaccctctacactatgtacctcacctggtcagccatgtccaatgaacctgatcgttcctgcaatcccaacctgatgagctttattacacgcataactgcaccaaccctggctcctggaaattcaactgctgtggtccctacccctactccaccatcaaagagtgggtctttactggattcagataattttattggactgtttgtctttgttctctgcctcttgtattctagcatccgcacttccactaatagccaagtagacaagctgaccctgtcagggagtgacagcgtcatccttggtgatacaactaccagtggtgccagtgatgaagaagatggacagcctcggcgggctgtggacaacgagaaagagggagtgcagtatagctactccttattccacctcatgctctgcttggcttccttgtacatcatgatgaccctgaccagctggtacagccctgatgcaaagtttcagagcatgaccagcaagtggccagctgtgtgggtcaagatcagctccagctgggtctgcctcctgctttacgtctggacccttgtggctccacttgtcctcaccagtcgggacttcagctgaacctctgagtgccaaggacaccactggaactcacaaaggtctccttcaccgaaaacccatataccttttaagtttgtttcaactaaaatattaagtgaatgctttgcaagtttgactgtatgcaggtttatatcagaaggtgagattgaataatgcttgatgcagaatcgaaacttctcatttatctgtatattatgtttacttctaaggatatagcacaaagggaacattttttgtttaaagtgaactacagctgtgctgtgaagagagttctttataaagcctgtaggttcttttaactttggtttaaaatgtaagataggaaaatgttggatatttgaggccatgcttaatatatttatattgcagtatcctttaaaagcaaaaaaaaaaaaatgcatttatattacagttttcctctatgaaagtccttacttatatgatacaagcactgtgttttgtgcttaaactcttcagcggggtagcatcaaagttcttggggaaggatcgtatatgtgggtcccttccctagaagaatggttgctgatatggctactgcttctacatcttgagttttttaatttactttttttacactgtagcattgagactgcttgattcaagtctggtgctttgccagatgtattaatttccataaatgctttgtgagtttggttaaaatgaagattcacttgggaaaacactgcagctttagtctgtgttactatcttgttatgagtatgtaaaagtaaaatgcatgtgaatttatcatatttgcactatgaaggtatttggttaaaatacaaagacttttaagattttaaggccctttcttccaacagcttttatagttagcagccattctttattttctggatagccaggttttatcacgcttctagtcaggatgctcctattccttctaaaaattacggtctgactagtgagcaaagtcttgaatttattcaaaagtcctaaataccttctctaggtaagacacttggtagatgagagacggaaggcattgtcaagaaccattttcatgagaggtggtgtgcaaaaaggtagaataaaagagttctttcaacaaagatttactgtctattctgtactagaccctgtaggttttggggtacagtgttaaacatgatagaggctctgccgtcttggactttaatagcttagagaagagagcaaatgagctgacaggtggttataatgtgaattagtgctgtggtttaggaattggagagaactcaaaggagaggtatttggtgtaatggtaggctttctggagaaaatgatatttaagccaagaactcttagaagttagctaagagagagatgggaaaatgagacgacattgctggagtagataaaactgcatgttaaaggcaggaagatggggaaaaaaagttcagtaaagctggaatggggaaatgtagtcagggactgaattttaaagggctttatcaacctcagtaaagagtttggaccttatgttgagggtggctgaaaacatattcatagtgtcatgaacaaattttatcttcagtcacttgggctgatatatagagaatggatttagagagatgagaccaggtgcagtccatatgagatgtgaaatagagaagtggaatcgtagggacggggagaaattgacaggtgagggctacttagcaattagaatttttttttttcaattttaatttttttttttgagacggagtcttgctctgtcgcccaggctggagtgcaatggtgcgatctccgctcactgcaggctccgcctcccgggttcacgccattctcccgcctcagcctccctagtagctgggactacaggcacccaccaccacgcctggctaattttttttgtatttttagtagagacagggtttcaccatgttagccaggatggtctcgatctcctgacctcgtgatccacctgccgcggcctcccaaagttctaggattactggcatggtgactcatgcctgtaatcccagcaatttgggagacagaggcggaaggatcacctgagcctaggagttcaagaccagcctgagcaacagcaggagccccaccccccgtgtctacaaacaaatttaaaaattaactgggcatggtggctgaagtgggagaatggaagaatcacttgagcccaagatttgaggctgcantgagctat

SEQ ID NO: 314479 - DNA, 2374 bp, Homo sapiens
catccgtgcgtctgtggaaggctgcgtttccggcctgagaaaccgtcatgtttctggggagtcacctcagctggcagttaccaccgtgttagaaagcagcctcaggaccggccacctccatcactggcgtcaccatgggggctgtgctgggtgtcttctccctcgccagctgggttccatgcctctgcagcggtgcctcatgtttgctgtgtagttgctgtcctaacagtaagaattccacggtgactcgcctcatttatgctttcattctcctcctgagcactgtcgtatcctatatcatgcagagaaaagagatggaaacttacttgaagaagattcctggattttgtgaagggggatttaaaatccatgaggctgatataaatgcagataaagattgtgatgtgctggttggttataaagctgtgtatcggatcagctttgccatggccatctttttctttgtcttttctctgctcatgttcaaagtaaaaacaagtaaagatctccgagcggcagtacacaatgggttttggttcttcaaaattgctgcccttattggaatcatggttggctctttctacatccctgggggctatttcagctcagtctggtttgttgttggcatgataggggccgccctcttcatcctcattcagctggtgctgctggtagattttgctcattcttggaatgaatcatgggtaaatcgaatggaagaaggaaacccaaggttgtggtatgctgctttactgtctttcacaagcgccttttatatcctgtcaatcatctgtgtcgggctgctctatacatattacaccaaaccagatggctgcacagaaaacaagttcttcatcagtattaacctgatcctttgcgttgtggcttctattatatcgatccacccaaaaattcaggaacaccagcctcgctccggcctcttgcagtcctccctcatcaccctctacactatgtacctcacctggtcagccatgtccaatgaacctgatcgttcctgcaatcccaacctgatgagctttattacacgcataactgcaccaaccctggctcctggaaattcaactgctgtggtccctacccctactccaccatcaaagagtgggtctttactggattcagataattttattggactgtttgtctttgttctctgcctcttgtattctagcatccgcacttccactaatagccaagtagacaagctgaccctgtcagggagtgacagcgtcatccttggtgatacaactaccagtggtgccagtgatgaagaagatggacagcctcggcgggctgtggacaacgagaaagagggagtgcagtatagctactccttattccacctcatgctctgcttggcttccttgtacatcatgatgaccctgaccagctggtacagccctgatgcaaagtttcagagcatgaccagcaagtggccagctgtgtgggtcaagatcagctccagctgggtctgcctcctgctttacgtctggacccttgtggctccacttgtcctcaccagtcgggacttcagctgaacctctgagtgccaaggacaccactggaactcacaaaggtctccttcaccgaaaacccatataccttttaagtttgtttcaactaaaatattaagtgaatgctttgcaagtttgactgtatgcaggtttatatcagaaggtgagattgaataatgcttgatgcagaatcgaaacttctcatttatctgtatattatgtttacttctaaggatatagcacaaagggaacattttttgtttaaagtgaactacagctgtgctgtgaagagagttctttataaagcctgtaggttcttttaactttggtttaaaatgtaagataggaaaatgttggatatttgaggccatgcttaatatatttatattgcagtatcctttaaaagcaaaaaaaaaaaaatgcatttatattacagttttcctctatgaaagtccttacttatatgatacaagcactgtgttttgtgcttaaactcttcagcggggtagcatcaaagttcttggggaaggatcgtatatgtgggtcccttccctagaagaatggttgctgatatggctactgcttctacatcttgagttttttaatttactttttttacactgtagcattgagactgcttgattcaagtctggtgctttgccagatgtattaatttccataaatgctttgtgagtttggttaaaatgaagattcacttgggaaaacactgcagctttagtctgtgttactatcttgttatgagtatgtaaaagtaaaatgcatgtgaatttatcatatttgcactatgaaggtatttggttaaaatacaaagacttttaaga

SEQ ID NO: 314480 - DNA, 4185 bp, Homo sapiens
catccgtgcgtctgtggaaggctgcgtttccggcctgagaaaccgtcatgtttctggggagtcacctcagctggcagttaccaccgtgttagaaagcagcctcaggaccggccacctccatcactggcgtcaccatgggggctgtgctgggtgtcttctccctcgccagctgggttccatgcctctgcagcggtgcctcatgtttgctgtgtagttgctgtcctaacagtaagaattccacggtgactcgcctcatttatgctttcattctcctcctgagcactgtcgtatcctatatcatgcagagaaaagagatggaaacttacttgaagaagattcctggattttgtgaagggggatttaaaatccatgaggctgatataaatgcagataaagattgtgatgtgctggttggttataaagctgtgtatcggatcagctttgccatggccatctttttctttgtcttttctctgctcatgttcaaagtaaaaacaagtaaagatctccgagcggcagtacacaatgggttttggttcttcaaaattgctgcccttattggaatcatggttggctctttctacatccctgggggctatttcagctcagtctggtttgttgttggcatgataggggccgccctcttcatcctcattcagctggtgctgctggtagattttgctcattcttggaatgaatcatgggtaaatcgaatggaagaaggaaacccaaggttgtggtatgctgctttactgtctttcacaagcgccttttatatcctgtcaatcatctgtgtcgggctgctctatacatattacaccaaaccagatggctgcacagaaaacaagttcttcatcagtattaacctgatcctttgcgttgtggcttctattatatcgatccacccaaaaattcaggaacaccagcctcgctccggcctcttgcagtcctccctcatcaccctctacactatgtacctcacctggtcagccatgtccaatgaacctgatcgttcctgcaatcccaacctgatgagctttattacacgcataactgcaccaaccctggctcctggaaattcaactgtgtggacaacgagaaagagggagtgcagtatagctactccttattccacctcatgctctgcttggcttccttgtacatcatgatgaccctgaccagctggtacagccctgatgcaaagtttcagagcatgaccagcaagtggccagctgtgtgggtcaagatcagctccagctgggtctgcctcctgctttacgtctggacccttgtggctccacttgtcctcaccagtcgggacttcagctgaacctctgagtgccaaggacaccactggaactcacaaaggtctccttcaccgaaaacccatataccttttaagtttgtttcaactaaaatattaagtgaatgctttgcaagtttgactgtatgcaggtttatatcagaaggtgagattgaataatgcttgatgcagaatcgaaacttctcatttatctgtatattatgtttacttctaaggatatagcacaaagggaacattttttgtttaaagtgaactacagctgtgctgtgaagagagttctttataaagcctgtaggttcttttaactttggtttaaaatgtaagataggaaaatgttggatatttgaggccatgcttaatatatttatattgcagtatcctttaaaagcaaaaaaaaaaaaatgcatttatattacagttttcctctatgaaagtccttacttatatgatacaagcactgtgttttgtgcttaaactcttcagcggggtagcatcaaagttcttggggaaggatcgtatatgtgggtcccttccctagaagaatggttgctgatatggctactgcttctacatcttgagttttttaatttactttttttacactgtagcattgagactgcttgattcaagtctggtgctttgccagatgtattaatttccataaatgctttgtgagtttggttaaaatgaagattcacttgggaaaacactgcagctttagtctgtgttactatcttgttatgagtatgtaaaagtaaaatgcatgtgaatttatcatatttgcactatgaaggtatttggttaaaatacaaagacttttaagattttaaggccctttcttccaacagcttttatagttagcagccattctttattttctggatagccaggttttatcacgcttctagtcaggatgctcctattccttctaaaaattacggtctgactagtgagcaaagtcttgaatttattcaaaagtcctaaataccttctctaggtaagacacttggtagatgagagacggaaggcattgtcaagaaccattttcatgagaggtggtgtgcaaaaaggtagaataaaagagttctttcaacaaagatttactgtctattctgtactagaccctgtaggttttggggtacagtgttaaacatgatagaggctctgccgtcttggactttaatagcttagagaagagagcaaatgagctgacaggtggttataatgtgaattagtgctgtggtttaggaattggagagaactcaaaggagaggtatttggtgtaatggtaggctttctggagaaaatgatatttaagccaagaactcttagaagttagctaagagagagatgggaaaatgagacgacattgctggagtagataaaactgcatgttaaaggcaggaagatggggaaaaaaagttcagtaaagctggaatggggaaatgtagtcagggactgaattttaaagggctttatcaacctcagtaaagagtttggaccttatgttgagggtggctgaaaacatattcatagtgtcatgaacaaattttatcttcagtcacttgggctgatatatagagaatggatttagagagatgagaccaggtgcagtccatatgagatgtgaaatagagaagtggaatcgtagggacggggagaaattgacaggtgagggctacttagcaattagaatttttttttttcaattttaatttttttttttgagacggagtcttgctctgtcgcccaggctggagtgcaatggtgcgatctccgctcactgcaggctccgcctcccgggttcacgccattctcccgcctcagcctccctagtagctgggactacaggcacccaccaccacgcctggctaattttttttgtatttttagtagagacagggtttcaccatgttagccaggatggtctcgatctcctgacctcgtgatccacctgccgcggcctcccaaagttctaggattactggcatgagccaccgtgcctggccagcaattagaattttaacactggcagttatgaataatatgaaggagaggtagatttctgagtgattctggtttaaccagctgggtggatggtggttccacgtattcaggtggcaaacaggaaaaacatgtgttcgaagaagaatggaggtaggtggtctcttaagaatggttaagaggcttgggagtcagactgcttgggtttgcatcccagctttgccgttttctggctatcaaacttgtcagctattatttgttgagtacgtactatttgatttatgaccacaggcagctgagcctcagtgttggtgcctagtgtacaagattgttaaagaataaagttattttgcaaagtgtaacccatttttagcactgacatagcactgacagtagctgctgatctcattatgggctaaaataagacaatattcaaaggtcagagatatctagccagaatctgatggaggctggatttcagattttgttacagaattagacagaggaacacagaggggacaggctcagttagggtggaggtgtggggtagggaagcaggacttgatataaattattggaatcattgtcttttaaaccagtggtttatgtcagggtatagcgtttcaagggatttgagggtcagatggggaaatgtagccccttattttgccagtgtgaagcagataccctgcttttctttacagtagcggagtcagcttaagagctttaaaggtcctaaacttcaaaaacattacagtgccccatcctccgccttaatgtaattcaaaatacaaacaatactaaactgtaaaataaatgtaacaaagtccaataaagtttttatttttttctcatga

SEQ ID NO: 314481 - DNA, 1940 bp, Homo sapiens
catccgtgcgtctgtggaaggctgcgtttccggcctgagaaaccgtcatgtttctggggagtcacctcagctggcagttaccaccgtgttagaaagcagcctcaggaccggccacctccatcactggcgtcaccatgggggctgtgctgggtgtcttctccctcgccagctgggttccatgcctctgcagcggtgcctcatgtttgctgtgtagttgctgtcctaacagtaagaattccacggtgactcgcctcatttatgctttcattctcctcctgagcactgtcgtatcctatatcatgcagagaaaagagatggaaacttacttgaagaagattcctggattttgtgaagggggatttaaaatccatgaggctgatataaatgcagataaagattgtgatgtgctggttggttataaagctgtgtatcggatcagctttgccatggccatctttttctttgtcttttctctgctcatgttcaaagtaaaaacaagtaaagatctccgagcggcagtacacaatgggttttggttcttcaaaattgctgcccttattggaatcatggttggctctttctacatccctgggggctatttcagctcagtctggtttgttgttggcatgataggggccgccctcttcatcctcattcagctggtgctgctggtagattttgctcattcttggaatgaatcatgggtaaatcgaatggaagaaggaaacccaaggttgtggtatgctgctttactgtctttcacaagcgccttttatatcctgtcaatcatctgtgtcgggctgctctatacatattacaccaaaccagatggctgcacagaaaacaagttcttcatcagtattaacctgatcctttgcgttgtggcttctattatatcgatccacccaaaaattcaggaacaccagcctcgctccggcctcttgcagtcctccctcatcaccctctacactatgtacctcacctggtcagccatgtccaatgaacctgatcgttcctgcaatcccaacctgatgagctttattacacgcataactgcaccaaccctggctcctggaaattcaactgctgtggtccctacccctactccaccatcaaagagtgggtctttactggattcagataattttattggactgtttgtctttgttctctgcctcttgtattctagcatccgcacttccactaatagccaagtagacaagctgaccctgtcagggagtgacagcgtcatccttggtgatacaactaccagtggtgccagtgatgaagaagatggacagcctcggcgggctgtggacaacgagaaagagggagtgcagtatagctactccttattccacctcatgctctgcttggcttccttgtacatcatgatgaccctgaccagctggtacagccctgatgcaaagtttcagagcatgaccagcaagtggccagctgtgtgggtcaagatcagctccagctgggtctgcctcctgctttacgtctggacccttgtggctccacttgtcctcaccagtcgggacttcagctgaacctctgagtgccaaggacaccactggaactcacaaaggtctccttcaccgaaaacccatataccttttaagtttgtttcaactaaaatattaagtgaatgctttgcaagtttgactgtatgcaggtttatatcagaaggtgagattgaataatgcttgatgcagaatcgaaacttctcatttatctgtatattatgtttacttctaaggatatagcacaaagggaacattttttgtttaaagtgaactacagctgtgctgtgaagagagttctttataaagcctgtaggttcttttaactttggtttaaaatgtaagataggaaaatgttggatatttgaggccatgcttaatatatttatattgcagtatcctttaaaagca

SEQ ID NO: 314482 - DNA, 4357 bp, Homo sapiens
catccgtgcgtctgtggaaggctgcgtttccggcctgagaaaccgtcatgtttctggggagtcacctcagctggcagttaccaccgtgttagaaagcagcctcaggaccggccacctccatcactggcgtcaccatgggggctgtgctgggtgtcttctccctcgccagctgggttccatgcctctgcagcggtgcctcatgtttgctgtgtagttgctgtcctaacagtaagaattccacggtgactcgcctcatttatgctttcattctcctcctgagcactgtcgtatcctatatcatgcagagaaaagagatggaaacttacttgaagaagattcctggattttgtgaagggggattttataaagctgtgtatcggatcagctttgccatggccatctttttctttgtcttttctctgctcatgttcaaagtaaaaacaagtaaagatctccgagcggcagtacacaatgggttttggttcttcaaaattgctgcccttattggaatcatggttggctctttctacatccctgggggctatttcagctcagtctggtttgttgttggcatgataggggccgccctcttcatcctcattcagctggtgctgctggtagattttgctcattcttggaatgaatcatgggtaaatcgaatggaagaaggaaacccaaggttgtggtatgctgctttactgtctttcacaagcgccttttatatcctgtcaatcatctgtgtcgggctgctctatacatattacaccaaaccagatggctgcacagaaaacaagttcttcatcagtattaacctgatcctttgcgttgtggcttctattatatcgatccacccaaaaattcaggaacaccagcctcgctccggcctcttgcagtcctccctcatcaccctctacactatgtacctcacctggtcagccatgtccaatgaacctgatcgttcctgcaatcccaacctgatgagctttattacacgcataactgcaccaaccctggctcctggaaattcaactgctgtggtccctacccctactccaccatcaaagagtgggtctttactggattcagataattttattggactgtttgtctttgttctctgcctcttgtattctagcatccgcacttccactaatagccaagtagacaagctgaccctgtcagggagtgacagcgtcatccttggtgatacaactaccagtggtgccagtgatgaagaagatggacagcctcggcgggctgtggacaacgagaaagagggagtgcagtatagctactccttattccacctcatgctctgcttggcttccttgtacatcatgatgaccctgaccagctggtacagccctgatgcaaagtttcagagcatgaccagcaagtggccagctgtgtgggtcaagatcagctccagctgggtctgcctcctgctttacgtctggacccttgtggctccacttgtcctcaccagtcgggacttcagctgaacctctgagtgccaaggacaccactggaactcacaaaggtctccttcaccgaaaacccatataccttttaagtttgtttcaactaaaatattaagtgaatgctttgcaagtttgactgtatgcaggtttatatcagaaggtgagattgaataatgcttgatgcagaatcgaaacttctcatttatctgtatattatgtttacttctaaggatatagcacaaagggaacattttttgtttaaagtgaactacagctgtgctgtgaagagagttctttataaagcctgtaggttcttttaactttggtttaaaatgtaagataggaaaatgttggatatttgaggccatgcttaatatatttatattgcagtatcctttaaaagcaaaaaaaaaaaaatgcatttatattacagttttcctctatgaaagtccttacttatatgatacaagcactgtgttttgtgcttaaactcttcagcggggtagcatcaaagttcttggggaaggatcgtatatgtgggtcccttccctagaagaatggttgctgatatggctactgcttctacatcttgagttttttaatttactttttttacactgtagcattgagactgcttgattcaagtctggtgctttgccagatgtattaatttccataaatgctttgtgagtttggttaaaatgaagattcacttgggaaaacactgcagctttagtctgtgttactatcttgttatgagtatgtaaaagtaaaatgcatgtgaatttatcatatttgcactatgaaggtatttggttaaaatacaaagacttttaagattttaaggccctttcttccaacagcttttatagttagcagccattctttattttctggatagccaggttttatcacgcttctagtcaggatgctcctattccttctaaaaattacggtctgactagtgagcaaagtcttgaatttattcaaaagtcctaaataccttctctaggtaagacacttggtagatgagagacggaaggcattgtcaagaaccattttcatgagaggtggtgtgcaaaaaggtagaataaaagagttctttcaacaaagatttactgtctattctgtactagaccctgtaggttttggggtacagtgttaaacatgatagaggctctgccgtcttggactttaatagcttagagaagagagcaaatgagctgacaggtggttataatgtgaattagtgctgtggtttaggaattggagagaactcaaaggagaggtatttggtgtaatggtaggctttctggagaaaatgatatttaagccaagaactcttagaagttagctaagagagagatgggaaaatgagacgacattgctggagtagataaaactgcatgttaaaggcaggaagatggggaaaaaaagttcagtaaagctggaatggggaaatgtagtcagggactgaattttaaagggctttatcaacctcagtaaagagtttggaccttatgttgagggtggctgaaaacatattcatagtgtcatgaacaaattttatcttcagtcacttgggctgatatatagagaatggatttagagagatgagaccaggtgcagtccatatgagatgtgaaatagagaagtggaatcgtagggacggggagaaattgacaggtgagggctacttagcaattagaatttttttttttcaattttaatttttttttttgagacggagtcttgctctgtcgcccaggctggagtgcaatggtgcgatctccgctcactgcaggctccgcctcccgggttcacgccattctcccgcctcagcctccctagtagctgggactacaggcacccaccaccacgcctggctaattttttttgtatttttagtagagacagggtttcaccatgttagccaggatggtctcgatctcctgacctcgtgatccacctgccgcggcctcccaaagttctaggattactggcatgagccaccgtgcctggccagcaattagaattttaacactggcagttatgaataatatgaaggagaggtagatttctgagtgattctggtttaaccagctgggtggatggtggttccacgtattcaggtggcaaacaggaaaaacatgtgttcgaagaagaatggaggtaggtggtctcttaagaatggttaagaggcttgggagtcagactgcttgggtttgcatcccagctttgccgttttctggctatcaaacttgtcagctattatttgttgagtacgtactatttgatttatgaccacaggcagctgagcctcagtgttggtgcctagtgtacaagattgttaaagaataaagttattttgcaaagtgtaacccatttttagcactgacatagcactgacagtagctgctgatctcattatgggctaaaataagacaatattcaaaggtcagagatatctagccagaatctgatggaggctggatttcagattttgttacagaattagacagaggaacacagaggggacaggctcagttagggtggaggtgtggggtagggaagcaggacttgatataaattattggaatcattgtcttttaaaccagtggtttatgtcagggtatagcgtttcaagggatttgagggtcagatggggaaatgtagccccttattttgccagtgtgaagcagataccctgcttttctttacagtagcggagtcagcttaagagctttaaaggtcctaaacttcaaaaacattacagtgccccatcctccgccttaatgtaattcaaaatacaaacaatactaaactgtaaaataaatgtaacaaagtccaataaagtttttatttttttctcatga

SEQ ID NO: 314483 - DNA, 4273 bp, Homo sapiens
catccgtgcgtctgtggaaggctgcgtttccggcctgagaaaccgtcatgtttctggggagtcacctcagctggcagttaccaccgtgttagaaagcagcctcaggaccggccacctccatcactggcgtcaccatgggggctgtgctgggtgtcttctccctcgccagctgggttccatgcctctgcagcggtgcctcatgtttgctgtgtagttgctgtcctaacagtaagaattccacggtgactcgcctcatttatgctttcattctcctcctgagcactgtcgtatcctatatcatgcagagaaaagagatggaaacttacttgaagaagattcctggattttgtgaagggggatttaaaatccatgaggctgatataaatgcagataaagattgtgatgtgctggttggttataaagctgtgtatcggatcagctttgccatggccatctttttctttgtcttttctctgctcatgttcaaagtaaaaacaagtaaagatctccgagcggcagtacacaatgggttttggttcttcaaaattgctgcccttattggaatcatggttggctctttctacatccctgggggctatttcagctcagctttactgtctttcacaagcgccttttatatcctgtcaatcatctgtgtcgggctgctctatacatattacaccaaaccagatggctgcacagaaaacaagttcttcatcagtattaacctgatcctttgcgttgtggcttctattatatcgatccacccaaaaattcaggaacaccagcctcgctccggcctcttgcagtcctccctcatcaccctctacactatgtacctcacctggtcagccatgtccaatgaacctgatcgttcctgcaatcccaacctgatgagctttattacacgcataactgcaccaaccctggctcctggaaattcaactgctgtggtccctacccctactccaccatcaaagagtgggtctttactggattcagataattttattggactgtttgtctttgttctctgcctcttgtattctagcatccgcacttccactaatagccaagtagacaagctgaccctgtcagggagtgacagcgtcatccttggtgatacaactaccagtggtgccagtgatgaagaagatggacagcctcggcgggctgtggacaacgagaaagagggagtgcagtatagctactccttattccacctcatgctctgcttggcttccttgtacatcatgatgaccctgaccagctggtacagccctgatgcaaagtttcagagcatgaccagcaagtggccagctgtgtgggtcaagatcagctccagctgggtctgcctcctgctttacgtctggacccttgtggctccacttgtcctcaccagtcgggacttcagctgaacctctgagtgccaaggacaccactggaactcacaaaggtctccttcaccgaaaacccatataccttttaagtttgtttcaactaaaatattaagtgaatgctttgcaagtttgactgtatgcaggtttatatcagaaggtgagattgaataatgcttgatgcagaatcgaaacttctcatttatctgtatattatgtttacttctaaggatatagcacaaagggaacattttttgtttaaagtgaactacagctgtgctgtgaagagagttctttataaagcctgtaggttcttttaactttggtttaaaatgtaagataggaaaatgttggatatttgaggccatgcttaatatatttatattgcagtatcctttaaaagcaaaaaaaaaaaaatgcatttatattacagttttcctctatgaaagtccttacttatatgatacaagcactgtgttttgtgcttaaactcttcagcggggtagcatcaaagttcttggggaaggatcgtatatgtgggtcccttccctagaagaatggttgctgatatggctactgcttctacatcttgagttttttaatttactttttttacactgtagcattgagactgcttgattcaagtctggtgctttgccagatgtattaatttccataaatgctttgtgagtttggttaaaatgaagattcacttgggaaaacactgcagctttagtctgtgttactatcttgttatgagtatgtaaaagtaaaatgcatgtgaatttatcatatttgcactatgaaggtatttggttaaaatacaaagacttttaagattttaaggccctttcttccaacagcttttatagttagcagccattctttattttctggatagccaggttttatcacgcttctagtcaggatgctcctattccttctaaaaattacggtctgactagtgagcaaagtcttgaatttattcaaaagtcctaaataccttctctaggtaagacacttggtagatgagagacggaaggcattgtcaagaaccattttcatgagaggtggtgtgcaaaaaggtagaataaaagagttctttcaacaaagatttactgtctattctgtactagaccctgtaggttttggggtacagtgttaaacatgatagaggctctgccgtcttggactttaatagcttagagaagagagcaaatgagctgacaggtggttataatgtgaattagtgctgtggtttaggaattggagagaactcaaaggagaggtatttggtgtaatggtaggctttctggagaaaatgatatttaagccaagaactcttagaagttagctaagagagagatgggaaaatgagacgacattgctggagtagataaaactgcatgttaaaggcaggaagatggggaaaaaaagttcagtaaagctggaatggggaaatgtagtcagggactgaattttaaagggctttatcaacctcagtaaagagtttggaccttatgttgagggtggctgaaaacatattcatagtgtcatgaacaaattttatcttcagtcacttgggctgatatatagagaatggatttagagagatgagaccaggtgcagtccatatgagatgtgaaatagagaagtggaatcgtagggacggggagaaattgacaggtgagggctacttagcaattagaatttttttttttcaattttaatttttttttttgagacggagtcttgctctgtcgcccaggctggagtgcaatggtgcgatctccgctcactgcaggctccgcctcccgggttcacgccattctcccgcctcagcctccctagtagctgggactacaggcacccaccaccacgcctggctaattttttttgtatttttagtagagacagggtttcaccatgttagccaggatggtctcgatctcctgacctcgtgatccacctgccgcggcctcccaaagttctaggattactggcatgagccaccgtgcctggccagcaattagaattttaacactggcagttatgaataatatgaaggagaggtagatttctgagtgattctggtttaaccagctgggtggatggtggttccacgtattcaggtggcaaacaggaaaaacatgtgttcgaagaagaatggaggtaggtggtctcttaagaatggttaagaggcttgggagtcagactgcttgggtttgcatcccagctttgccgttttctggctatcaaacttgtcagctattatttgttgagtacgtactatttgatttatgaccacaggcagctgagcctcagtgttggtgcctagtgtacaagattgttaaagaataaagttattttgcaaagtgtaacccatttttagcactgacatagcactgacagtagctgctgatctcattatgggctaaaataagacaatattcaaaggtcagagatatctagccagaatctgatggaggctggatttcagattttgttacagaattagacagaggaacacagaggggacaggctcagttagggtggaggtgtggggtagggaagcaggacttgatataaattattggaatcattgtcttttaaaccagtggtttatgtcagggtatagcgtttcaagggatttgagggtcagatggggaaatgtagccccttattttgccagtgtgaagcagataccctgcttttctttacagtagcggagtcagcttaagagctttaaaggtcctaaacttcaaaaacattacagtgccccatcctccgccttaatgtaattcaaaatacaaacaatactaaactgtaaaataaatgtaacaaagtccaataaagtttttatttttttctcatga

SEQ ID NO: 314484 - DNA, 3525 bp, Homo sapiens
gcacgtggtaccttccaatcatagaagcggcacttgtgaagtcacggaaacagacacagagagcatagtgtgttttatgaaactcctaagcaattaagccatcacatcaagtagtaactgatgacagtgacgtcagtcttatgatgacaggcagcagttcagaactttaagcaggatcttcagaaagctttcagtctccaaagtaggaacagctcagcagtaagtgtcttgtatacaggccagtggcagcagttcattgtcatggcccctttctgatttgtcttccttgggatcactttccagcatccgcacttccactaatagccaagtagacaagctgaccctgtcagggagtgacagcgtcatccttggtgatacaactaccagtggtgccagtgatgaagaagatggacagcctcggcgggctgtggacaacgagaaagagggagtgcagtatagctactccttattccacctcatgctctgcttggcttccttgtacatcatgatgaccctgaccagctggtacagccctgatgcaaagtttcagagcatgaccagcaagtggccagctgtgtgggtcaagatcagctccagctgggtctgcctcctgctttacgtctggacccttgtggctccacttgtcctcaccagtcgggacttcagctgaacctctgagtgccaaggacaccactggaactcacaaaggtctccttcaccgaaaacccatataccttttaagtttgtttcaactaaaatattaagtgaatgctttgcaagtttgactgtatgcaggtttatatcagaaggtgagattgaataatgcttgatgcagaatcgaaacttctcatttatctgtatattatgtttacttctaaggatatagcacaaagggaacattttttgtttaaagtgaactacagctgtgctgtgaagagagttctttataaagcctgtaggttcttttaactttggtttaaaatgtaagataggaaaatgttggatatttgaggccatgcttaatatatttatattgcagtatcctttaaaagcaaaaaaaaaaaaatgcatttatattacagttttcctctatgaaagtccttacttatatgatacaagcactgtgttttgtgcttaaactcttcagcggggtagcatcaaagttcttggggaaggatcgtatatgtgggtcccttccctagaagaatggttgctgatatggctactgcttctacatcttgagttttttaatttactttttttacactgtagcattgagactgcttgattcaagtctggtgctttgccagatgtattaatttccataaatgctttgtgagtttggttaaaatgaagattcacttgggaaaacactgcagctttagtctgtgttactatcttgttatgagtatgtaaaagtaaaatgcatgtgaatttatcatatttgcactatgaaggtatttggttaaaatacaaagacttttaagattttaaggccctttcttccaacagcttttatagttagcagccattctttattttctggatagccaggttttatcacgcttctagtcaggatgctcctattccttctaaaaattacggtctgactagtgagcaaagtcttgaatttattcaaaagtcctaaataccttctctaggtaagacacttggtagatgagagacggaaggcattgtcaagaaccattttcatgagaggtggtgtgcaaaaaggtagaataaaagagttctttcaacaaagatttactgtctattctgtactagaccctgtaggttttggggtacagtgttaaacatgatagaggctctgccgtcttggactttaatagcttagagaagagagcaaatgagctgacaggtggttataatgtgaattagtgctgtggtttaggaattggagagaactcaaaggagaggtatttggtgtaatggtaggctttctggagaaaatgatatttaagccaagaactcttagaagttagctaagagagagatgggaaaatgagacgacattgctggagtagataaaactgcatgttaaaggcaggaagatggggaaaaaaagttcagtaaagctggaatggggaaatgtagtcagggactgaattttaaagggctttatcaacctcagtaaagagtttggaccttatgttgagggtggctgaaaacatattcatagtgtcatgaacaaattttatcttcagtcacttgggctgatatatagagaatggatttagagagatgagaccaggtgcagtccatatgagatgtgaaatagagaagtggaatcgtagggacggggagaaattgacaggtgagggctacttagcaattagaatttttttttttcaattttaatttttttttttgagacggagtcttgctctgtcgcccaggctggagtgcaatggtgcgatctccgctcactgcaggctccgcctcccgggttcacgccattctcccgcctcagcctccctagtagctgggactacaggcacccaccaccacgcctggctaattttttttgtatttttagtagagacagggtttcaccatgttagccaggatggtctcgatctcctgacctcgtgatccacctgccgcggcctcccaaagttctaggattactggcatgagccaccgtgcctggccagcaattagaattttaacactggcagttatgaataatatgaaggagaggtagatttctgagtgattctggtttaaccagctgggtggatggtggttccacgtattcaggtggcaaacaggaaaaacatgtgttcgaagaagaatggaggtaggtggtctcttaagaatggttaagaggcttgggagtcagactgcttgggtttgcatcccagctttgccgttttctggctatcaaacttgtcagctattatttgttgagtacgtactatttgatttatgaccacaggcagctgagcctcagtgttggtgcctagtgtacaagattgttaaagaataaagttattttgcaaagtgtaacccatttttagcactgacatagcactgacagtagctgctgatctcattatgggctaaaataagacaatattcaaaggtcagagatatctagccagaatctgatggaggctggatttcagattttgttacagaattagacagaggaacacagaggggacaggctcagttagggtggaggtgtggggtagggaagcaggacttgatataaattattggaatcattgtcttttaaaccagtggtttatgtcagggtatagcgtttcaagggatttgagggtcagatggggaaatgtagccccttattttgccagtgtgaagcagataccctgcttttctttacagtagcggagtcagcttaagagctttaaaggtcctaaacttcaaaaacattacagtgccccatcctccgccttaatgtaattcaaaatacaaacaatactaaactgtaaaataaatgtaacaaagtccaataaagtttttatttttttctcatga

SEQ ID NO: 314485 - DNA, 1708 bp, Homo sapiens
  misc_feature (1653)..(1653): n is a, c, g, or t
catccgtgcgtctgtggaaggctgcgtttccggcctgagaaaccgtcatgtttctggggagtcacctcagctggcagttaccaccgtgttagaaagcagcctcaggaccggccacctccatcactggcgtcaccatgggggctgtgctgggtgtcttctccctcgccagctgggttccatgcctctgcagcggtgcctcatgtttgctgtgtagttgctgtcctaacagtaagaattccacggtgactcgcctcatttatgctttcattctcctcctgagcactgtcgtatcctatatcatgcagagaaaagagatggaaacttacttgaagaagattcctggattttgtgaagggggatttaaaatccatgaggctgatataaatgcagataaagattgtgatgtgctggttggttataaagctgtgtatcggatcagctttgccatggccatctttttctttgtcttttctctgctcatgttcaaagtaaaaacaagtaaagatctccgagcggcagtacacaatgggttttggttcttcaaaattgctgcccttattggaatcatggttggctctttctacatccctgggggctatttcagctcagtctggtttgttgttggcatgataggggccgccctcttcatcctcattcagctggtgctgctggtagattttgctcattcttggaatgaatcatgggtaaatcgaatggaagaaggaaacccaaggttgtggtatgctgctttactgtctttcacaagcgccttttatatcctgtcaatcatctgtgtcgggctgctctatacatattacaccaaaccagatggctgcacagaaaacaagttcttcatcagtattaacctgatcctttgcgttgtggcttctattatatcgatccacccaaaaattcaggaacaccagcctcgctccggcctcttgcagtcctccctcatcaccctctacactatgtacctcacctggtcagccatgtccaatgaacctgatcgttcctgcaatcccaacctgatgagctttattacacgcataactgcaccaaccctggctcctggaaattcaactgctgtggtccctacccctactccaccatcaaagagtgggtctttactggattcagataattttattggactgtttgtctttgttctctgcctcttgtattctagcatccgcacttccactaatagccaagtagacaagctgaccctgtcagggagtgacagcgtcatccttggtgatacaactaccagtggtgccagtgatgaagaagatggacagcctcggcgggctgtggacaacgagaaagagggagtgcagtatagctactccttattccacctcatgctctgcttggcttccttgtacatcatgatgaccctgaccagctggtacagccctgatgcaaagtttcagagcatgaccagcaagtggccagctgtgtgggtcaagatcagctccagctgggtctgcctcctgctttacgtctggacccttgtggctccacttgtcctcaccagtcgggacttcagctgaacctctgagtgccaaggacaccactggaactcacaaaggtctccttcaccgaaaacccatataccttttaagtttgtttcagagattgataatgctngatgagaatcgaacttctcattatctgatatatgttacttctaggtatagcccaa

SEQ ID NO: 314486 - DNA, 2946 bp, Homo sapiens
  misc_feature (36)..(36): n is a, c, g, or t
  misc_feature (48)..(48): n is a, c, g, or t
  misc_feature (68)..(68): n is a, c, g, or t
  misc_feature (103)..(104): n is a, c, g, or t
ccccccccgcctaaccgtccggacccccctgtgggncccccccactgnccccctcaccccagtcgggnccctccagccgaacccctccgagtgcccccaaggnncccccacggaaccccacaaagggtcgtctccttcaccgaaaacccatataccttttaagtttgtttcaactaaaatattaagtgaatgctttgcaagtttgactgtatgcaggtttatatcagaaggtgagattgaataatgcttgatgcagaatcgaaacttctcatttatctgtatattatgtttacttctaaggatatagcacaaagggaacattttttgtttaaagtgaactacagctgtgctgtgaagagagttctttataaagcctgtaggttcttttaactttggtttaaaatgtaagataggaaaatgttggatatttgaggccatgcttaatatatttatattgcagtatcctttaaaagcaaaaaaaaaaaaatgcatttatattacagttttcctctatgaaagtccttacttatatgatacaagcactgtgttttgtgcttaaactcttcagcggggtagcatcaaagttcttggggaaggatcgtatatgtgggtcccttccctagaagaatggttgctgatatggctactgcttctacatcttgagttttttaatttactttttttacactgtagcattgagactgcttgattcaagtctggtgctttgccagatgtattaatttccataaatgctttgtgagtttggttaaaatgaagattcacttgggaaaacactgcagctttagtctgtgttactatcttgttatgagtatgtaaaagtaaaatgcatgtgaatttatcatatttgcactatgaaggtatttggttaaaatacaaagacttttaagattttaaggccctttcttccaacagcttttatagttagcagccattctttattttctggatagccaggttttatcacgcttctagtcaggatgctcctattccttctaaaaattacggtctgactagtgagcaaagtcttgaatttattcaaaagtcctaaataccttctctaggtaagacacttggtagatgagagacggaaggcattgtcaagaaccattttcatgagaggtggtgtgcaaaaaggtagaataaaagagttctttcaacaaagatttactgtctattctgtactagaccctgtaggttttggggtacagtgttaaacatgatagaggctctgccgtcttggactttaatagcttagagaagagagcaaatgagctgacaggtggttataatgtgaattagtgctgtggtttaggaattggagagaactcaaaggagaggtatttggtgtaatggtaggctttctggagaaaatgatatttaagccaagaactcttagaagttagctaagagagagatgggaaaatgagacgacattgctggagtagataaaactgcatgttaaaggcaggaagatggggaaaaaaagttcagtaaagctggaatggggaaatgtagtcagggactgaattttaaagggctttatcaacctcagtaaagagtttggaccttatgttgagggtggctgaaaacatattcatagtgtcatgaacaaattttatcttcagtcacttgggctgatatatagagaatggatttagagagatgagaccaggtgcagtccatatgagatgtgaaatagagaagtggaatcgtagggacggggagaaattgacaggtgagggctacttagcaattagaatttttttttttcaattttaatttttttttttgagacggagtcttgctctgtcgcccaggctggagtgcaatggtgcgatctccgctcactgcaggctccgcctcccgggttcacgccattctcccgcctcagcctccctagtagctgggactacaggcacccaccaccacgcctggctaattttttttgtatttttagtagagacagggtttcaccatgttagccaggatggtctcgatctcctgacctcgtgatccacctgccgcggcctcccaaagttctaggattactggcatgagccaccgtgcctggccagcaattagaattttaacactggcagttatgaataatatgaaggagaggtagatttctgagtgattctggtttaaccagctgggtggatggtggttccacgtattcaggtggcaaacaggaaaaacatgtgttcgaagaagaatggaggtaggtggtctcttaagaatggttaagaggcttgggagtcagactgcttgggtttgcatcccagctttgccgttttctggctatcaaacttgtcagctattatttgttgagtacgtactatttgatttatgaccacaggcagctgagcctcagtgttggtgcctagtgtacaagattgttaaagaataaagttattttgcaaagtgtaacccatttttagcactgacatagcactgacagtagctgctgatctcattatgggctaaaataagacaatattcaaaggtcagagatatctagccagaatctgatggaggctggatttcagattttgttacagaattagacagaggaacacagaggggacaggctcagttagggtggaggtgtggggtagggaagcaggacttgatataaattattggaatcattgtcttttaaaccagtggtttatgtcagggtatagcgtttcaagggatttgagggtcagatggggaaatgtagccccttattttgccagtgtgaagcagataccctgcttttctttacagtagcggagtcagcttaagagctttaaaggtcctaaacttcaaaaacattacagtgccccatcctccgccttaatgtaattcaaaatacaaacaatactaaactgtaaaataaatgtaacaaagtccaataaagtttttatttttttctcatga

SEQ ID NO: 314487 - DNA, 2876 bp, Homo sapiens
  misc_feature (43)..(43): n is a, c, g, or t
agggtcgacatctagaggagaccccggggtttcccctcttgtntctactaaaaatacaacaaaaattagccaggcgtggaggtgggtgcctgtagtcccagcactaaaatattaagtgaatgctttgcaagtttgactgtatgcaggtttatatcagaaggtgagattgaataatgcttgatgcagaatcgaaacttctcatttatctgtatattatgtttacttctaaggatatagcacaaagggaacattttttgtttaaagtgaactacagctgtgctgtgaagagagttctttataaagcctgtaggttcttttaactttggtttaaaatgtaagataggaaaatgttggatatttgaggccatgcttaatatatttatattgcagtatcctttaaaagcaaaaaaaaaaaaatgcatttatattacagttttcctctatgaaagtccttacttatatgatacaagcactgtgttttgtgcttaaactcttcagcggggtagcatcaaagttcttggggaaggatcgtatatgtgggtcccttccctagaagaatggttgctgatatggctactgcttctacatcttgagttttttaatttactttttttacactgtagcattgagactgcttgattcaagtctggtgctttgccagatgtattaatttccataaatgctttgtgagtttggttaaaatgaagattcacttgggaaaacactgcagctttagtctgtgttactatcttgttatgagtatgtaaaagtaaaatgcatgtgaatttatcatatttgcactatgaaggtatttggttaaaatacaaagacttttaagattttaaggccctttcttccaacagcttttatagttagcagccattctttattttctggatagccaggttttatcacgcttctagtcaggatgctcctattccttctaaaaattacggtctgactagtgagcaaagtcttgaatttattcaaaagtcctaaataccttctctaggtaagacacttggtagatgagagacggaaggcattgtcaagaaccattttcatgagaggtggtgtgcaaaaaggtagaataaaagagttctttcaacaaagatttactgtctattctgtactagaccctgtaggttttggggtacagtgttaaacatgatagaggctctgccgtcttggactttaatagcttagagaagagagcaaatgagctgacaggtggttataatgtgaattagtgctgtggtttaggaattggagagaactcaaaggagaggtatttggtgtaatggtaggctttctggagaaaatgatatttaagccaagaactcttagaagttagctaagagagagatgggaaaatgagacgacattgctggagtagataaaactgcatgttaaaggcaggaagatggggaaaaaaagttcagtaaagctggaatggggaaatgtagtcagggactgaattttaaagggctttatcaacctcagtaaagagtttggaccttatgttgagggtggctgaaaacatattcatagtgtcatgaacaaattttatcttcagtcacttgggctgatatatagagaatggatttagagagatgagaccaggtgcagtccatatgagatgtgaaatagagaagtggaatcgtagggacggggagaaattgacaggtgagggctacttagcaattagaatttttttttttcaattttaatttttttttttgagacggagtcttgctctgtcgcccaggctggagtgcaatggtgcgatctccgctcactgcaggctccgcctcccgggttcacgccattctcccgcctcagcctccctagtagctgggactacaggcacccaccaccacgcctggctaattttttttgtatttttagtagagacagggtttcaccatgttagccaggatggtctcgatctcctgacctcgtgatccacctgccgcggcctcccaaagttctaggattactggcatgagccaccgtgcctggccagcaattagaattttaacactggcagttatgaataatatgaaggagaggtagatttctgagtgattctggtttaaccagctgggtggatggtggttccacgtattcaggtggcaaacaggaaaaacatgtgttcgaagaagaatggaggtaggtggtctcttaagaatggttaagaggcttgggagtcagactgcttgggtttgcatcccagctttgccgttttctggctatcaaacttgtcagctattatttgttgagtacgtactatttgatttatgaccacaggcagctgagcctcagtgttggtgcctagtgtacaagattgttaaagaataaagttattttgcaaagtgtaacccatttttagcactgacatagcactgacagtagctgctgatctcattatgggctaaaataagacaatattcaaaggtcagagatatctagccagaatctgatggaggctggatttcagattttgttacagaattagacagaggaacacagaggggacaggctcagttagggtggaggtgtggggtagggaagcaggacttgatataaattattggaatcattgtcttttaaaccagtggtttatgtcagggtatagcgtttcaagggatttgagggtcagatggggaaatgtagccccttattttgccagtgtgaagcagataccctgcttttctttacagtagcggagtcagcttaagagctttaaaggtcctaaacttcaaaaacattacagtgccccatcctccgccttaatgtaattcaaaatacaaacaatactaaactgtaaaataaatgtaacaaagtccaataaagtttttatttttttctcatga

SEQ ID NO: 314488 - DNA, 1289 bp, Homo sapiens
catccgtgcgtctgtggaaggctgcgtttccggcctgagaaaccgtcatgtttctggggagtcacctcagctggcagttaccaccgtgttagaaagcagcctcaggaccggccacctccatcactggcgtcaccatgggggctgtgctgggtgtcttctccctcgccagctgggttccatgcctctgcagcggtgcctcatgtttgctgtgtagttgctgtcctaacagtaagaattccacggtgactcgcctcatttatgctttcattctcctcctgagcactgtcgtatcctatatcatgcagagaaaagagatggaaacttacttgaagaagattcctggattttgtgaagggggatttaaaatccatgaggctgatataaatgcagataaagattgtgatgtgctggttggttataaagctgtgtatcggatcagctttgccatggccatctttttctttgtcttttctctgctcatgttcaaagtaaaaacaagtaaagatctccgagcggcagtacacaatgggttttggttcttcaaaattgctgcccttattggaatcatggttggctctttctacatccctgggggctatttcagctcagtctggtttgttgttggcatgataggggccgccctcttcatcctcattcagctggtgctgctggtagattttgctcattcttggaatgaatcatgggtaaatcgaatggaagaaggaaacccaaggttgtggtatgctgctttactgtctttcacaagcgccttttatatcctgtcaatcatctgtgtcgggctgctctatacatattacaccaaaccagatggctgcacagaaaacaagttcttcatcagtattaacctgatcctttgcgttgtggcttctattatatcgatccacccaaaaattcaggaacaccagcctcgctccggcctcttgcagtcctccctcatcaccctctacactatgtacctcacctggtcagccatgtccaatgaacctgagcccctcacatgaggttgcagcttttggctcgatccttgtgtatctcgccctcattcccccggtctggccgtcctgacagctgagcggatcgctgcattccccggcgtgagtcagttcggcgcagctgcctatggccacggccaagggaggccactgtagccacatggaagacatccctgacgctgcgctcagaggaccgggaggagcactcaacataggacacagcccccacctgcttggaaagcacagtgccctgatcatgtgtcacagggataagcc

SEQ ID NO: 314489 - DNA, 1255 bp, Homo sapiens
catccgtgcgtctgtggaaggctgcgtttccggcctgagaaaccgtcatgtttctggggagtcacctcagctggcagttaccaccgtgttagaaagcagcctcaggaccggccacctccatcactggcgtcaccatgggggctgtgctgggtgtcttctccctcgccagctgggttccatgcctctgcagcggtgcctcatgtttgctgtgtagttgctgtcctaacagtaagaattccacggtgactcgcctcatttatgctttcattctcctcctgagcactgtcgtatcctatatcatgcagagaaaagagatggaaacttacttgaagaagattcctggattttgtgaagggggatttaaaatccatgaggctgatataaatgcagataaagattgtgatgtgctggttggttataaagctgtgtatcggatcagctttgccatggccatctttttctttgtcttttctctgctcatgttcaaagtaaaaacaagtaaagatctccgagcggcagtacacaatgggttttggttcttcaaaattgctgcccttattggaatcatggttggctctttctacatccctgggggctatttcagctcagtctggtttgttgttggcatgataggggccgccctcttcatcctcattcagctggtgctgctggtagattttgctcattcttggaatgaatcatgggtaaatcgaatggaagaaggaaacccaaggttgtggtatgctgctttactgtctttcacaagcgccttttatatcctgtcaatcatctgtgtcgggctgctctatacatattacaccaaaccagatggctgcacagaaaacaagttcttcatcagtattaacctgatcctttgcgttgtggcttctattatatcgatccacccaaaaattcaggaacaacagcctcctccaactcattttttctcaacaaacttatttttccagcagaagaatcccagtcttcttagagaacccagtgactttttgcaccttaaatctgtgaaatcctcatgttttcttctgccgtatccatagttcaaacaaagatgaggcaaagctagatgcattcctgaaggaacccaagaaattcctctctttatttctctggaatgaaatgaattctctagacgaccagttctaaccttcaaaaaccaaacctgtttgtgagatctccttcaaatactactgtagaccccagtgattattcattaaattttaaaatatttgtttta

SEQ ID NO: 314490 - DNA, 1799 bp, Homo sapiens
tctccgccttaccattacaccaaatacctctcctttgagttctccccaattcctaaaccacagcactaattcacattataaccacctgtcagctcatttgctctgccgtcttggactttaatagcttagagaagagagcaaatgagctgacaggtggttataatgtgaattagtgctgtggtttaggaattggagagaactcaaaggagaggtatttggtgtaatggtaggctttctggagaaaatgatatttaagccaagaactcttagaagttagctaagagagagatgggaaaatgagacgacattgctggagtagataaaactgcatgttaaaggcaggaagatggggaaaaaaagttcagtaaagctggaatggggaaatgtagtcagggactgaattttaaagggctttatcaacctcagtaaagagtttggaccttatgttgagggtggctgaaaacatattcatagtgtcatgaacaaattttatcttcagtcacttgggctgatatatagagaatggatttagagagatgagaccaggtgcagtccatatgagatgtgaaatagagaagtggaatcgtagggacggggagaaattgacaggtgagggctacttagcaattagaatttttttttttcaattttaatttttttttttgagacggagtcttgctctgtcgcccaggctggagtgcaatggtgcgatctccgctcactgcaggctccgcctcccgggttcacgccattctcccgcctcagcctccctagtagctgggactacaggcacccaccaccacgcctggctaattttttttgtatttttagtagagacagggtttcaccatgttagccaggatggtctcgatctcctgacctcgtgatccacctgccgcggcctcccaaagttctaggattactggcatgagccaccgtgcctggccagcaattagaattttaacactggcagttatgaataatatgaaggagaggtagatttctgagtgattctggtttaaccagctgggtggatggtggttccacgtattcaggtggcaaacaggaaaaacatgtgttcgaagaagaatggaggtaggtggtctcttaagaatggttaagaggcttgggagtcagactgcttgggtttgcatcccagctttgccgttttctggctatcaaacttgtcagctattatttgttgagtacgtactatttgatttatgaccacaggcagctgagcctcagtgttggtgcctagtgtacaagattgttaaagaataaagttattttgcaaagtgtaacccatttttagcactgacatagcactgacagtagctgctgatctcattatgggctaaaataagacaatattcaaaggtcagagatatctagccagaatctgatggaggctggatttcagattttgttacagaattagacagaggaacacagaggggacaggctcagttagggtggaggtgtggggtagggaagcaggacttgatataaattattggaatcattgtcttttaaaccagtggtttatgtcagggtatagcgtttcaagggatttgagggtcagatggggaaatgtagccccttattttgccagtgtgaagcagataccctgcttttctttacagtagcggagtcagcttaagagctttaaaggtcctaaacttcaaaaacattacagtgccccatcctccgccttaatgtaattcaaaatacaaacaatactaaactgtaaaataaatgtaacaaagtccaataaagtttttatttttttctcatga

SEQ ID NO: 314491 - DNA, 880 bp, Homo sapiens
  misc_feature (839)..(839): n is a, c, g, or t
  misc_feature (841)..(841): n is a, c, g, or t
catccgtgcgtctgtggaaggctgcgtttccggcctgagaaaccgtcatgtttctggggagtcacctcagctggcagttaccaccgtgttagaaagcagcctcaggaccggccacctccatcactggcgtcaccatgggggctgtgctgggtgtcttctccctcgccagctgggttccatgcctctgcagcggtgcctcatgtttgctgtgtagttgctgtcctaacagtaagaattccacggtgactcgcctcatttatgctttcattctcctcctgagcactgtcgtatcctatatcatgcagagaaaagagatggaaacttacttgaagaagattcctggattttgtgaagggggatttaaaatccatgaggctgatataaatgcagataaagattgtgatgtgctggttggttataaagctgtgtatcggatcagctttgccatggccatctttttctttgtcttttctctgctcatgttcaaagtaaaaacaagtaaagatctccgagcggcagtacacaatgggttttggttcttcaaaattgctgcccttattggaatcatggttggctctttctacatccctgggggctatttcagctcagtctggttagtggtaggatgataggggcagcctcttcatcctcattcagatggtgtgtggtaattagtcatctgggatgctatggtaatcgatgagaagaaccaggtggaatgtgctatgctcaaggcttatacggacacggtggggcaatttaacacgagggaaaagttaaatcgactggggtatcccatgactcgctgtcacaattgtgtggtttttttggcattttcnangccaaaggacacaccaaaacaccggccacacgacggagg

SEQ ID NO: 314492 - DNA, 584 bp, Homo sapiens
catccgtgcgtctgtggaaggctgcgtttccggcctgagaaaccgtcatgtttctggggagtcacctcagctggcagttaccaccgtgttagaaagcagcctcaggaccggccacctccatcactggcgtcaccatgggggctgtgctgggtgtcttctccctcgccagctgggttccatgcctctgcagcggtgcctcatgtttgctgtgtagttgctgtcctaacagtaagaattccacggtgactcgcctcatttatgctttcattctcctcctgagcactgtcgtatcctatatcatgcagagaaaagagatggaaacttacttgaagaagattcctggattttgtgaagggggatttaaaatccatgaggctgatataaatgcagataaagattgtgatgtgctggttggttataaagctgtgtatcggatcagctttgccatggccatctttttctttgtcttttctctgctcatgttcaaagtaaaaacaagtaaagatctccgagcggcagtacacaatgggttttggttttttaatatttaaactcacccggtttggttgtgcgtgggccccccc

SEQ ID NO: 314493 - DNA, 679 bp, Homo sapiens
catccgtgcgtctgtggaaggctgcgtttccggcctgagaaaccgtcatgtttctggggagtcacctcagctggcagttaccaccgtgttagaaagcagcctcaggaccggccacctccatcactggcgtcaccatgggggctgtgctgggtgtcttctccctcgccagctggaaaatcctggtgagttgaaggccaggcatggtggctcacgccaggatggtctcaatctcctgacctcgtgatccgccggcctcccagagtgcttggattacaggttccatgcctctgcagcggtgcctcatgtttgctgtgtagttgctgtcctaacagtaagaattccacggtgactcgcctcatttatgctttcattctcctcctgagcactgtcgtatcctatatcatgcagagaaaagagatggaaacttacttgaagaaggtcgaagcatctaaactggactagttcttcacctttggaaggactcagtcgtagctggaaaatctcacaggaaagtggcacacagcctcttcatcctaaaagggcaaagaagagagaccatatttttttgaaactaagactcactctgttgcccaggctggagtgcagtgacatgatcttggctcactgcaacctccgcctccctggttcaagcaattctcctgcctcagcctcccgagta

SEQ ID NO: 314494 - DNA, 383 bp, Homo sapiens
ctctgtcttaacctacttcctaagcatggcatcaggtgacatctttagatttctactgtgatttaaaagaaaagacttatagtatcatttggaactcaggtcccaggcttcccttggcacaagctaaaacatattttaaaaggtctgaaacccagtagaaagcttttaagaatgccgttgagtttggaatcttgctgtactgctggagacagaatgtctttaccacctctgtcttgttttaattgaaatccgttcagaatgttggatcttctgaaatgttactctatggtagagaataactttgttctcttggttcttgtagtctggtttgttgttggcatgataggggccgccctcttcatcctcattcagctggtgctgct

SEQ ID NO: 314495 - DNA, 899 bp, Homo sapiens
  misc_feature (897)..(899): n is a, c, g, or t
catccgtgcgtctgtggaaggctgcgtttccggcctgagaaaccgtcatgtttctggggagtcacctcagctggcagttaccaccgtgttagaaagcagcctcaggaccggccacctccatcactggcgtcaccatgggggctgtgctgggtgtcttctccctcgccagctgggttccatgcctctgcagcggtgcctcatgtttgctgtgtagttgctgtcctaacagtaagaattccacggtgactcgcctcatttatgctttcattctcctcctgagcactgtcgtatcctatatcatgcagagaaaagagatggaaacttacttgaagaagattcctggattttgtgaagggggatttaaaatccatgaggctgatataaatgcagataaagattgtgatgtgctggttggttataaagctgtgtatcggatcagctttgccatggccatctttttctttgtcttttctctgctcatgttcaaagtaaaaacaagtaaagatctccgagcggcagtacacaatgggttttggttcttcaaaattgctgcccttattggaatcatggttggctctttctacatccctgggggctatttcagctcagtctggtttgttgttggcatgataggggccgccctcttcatcctcattcagctggtgctgctggtagattttgctcattcttggaatgaatcatgggtaaatcgaatggaagaaggaaacccaaggttgtggtatgctgctttacgctgtcacaagcgccttttatcggcacaatgggtgggggcataattacccaccatgggggcgaacagctacaggtacgactgcggggttatgtccaatgactccgtggccatcccttctgctgcctctcttcctgcgtgttttnnn

SEQ ID NO: 314496 - DNA, 4411 bp, Homo sapiens
catccgtgcgtctgtggaaggctgcgtttccggcctgagaaaccgtcatgtttctggggagtcacctcagctggcagttaccaccgtgttagaaagcagcctcaggaccggccacctccatcactggcgtcaccatgggggctgtgctgggtgtcttctccctcgccagctgggttccatgcctctgcagcggtgcctcatgtttgctgtgtagttgctgtcctaacagtaagaattccacggtgactcgcctcatttatgctttcattctcctcctgagcactgtcgtatcctatatcatgcagagaaaagagatggaaacttacttgaagaagattcctggattttgtgaagggggatttaaaatccatgaggctgatataaatgcagataaagattgtgatgtgctggttggttataaagctgtgtatcggatcagctttgccatggccatctttttctttgtcttttctctgctcatgttcaaagtaaaaacaagtaaagatctccgagcggcagtacacaatgggttttggttcttcaaaattgctgcccttattggaatcatggttggctctttctacatccctgggggctatttcagctcagtctggtttgttgttggcatgataggggccgccctcttcatcctcattcagctggtgctgctggtagattttgctcattcttggaatgaatcatgggtaaatcgaatggaagaaggaaacccaaggttgtggtatgctgctttactgtctttcacaagcgccttttatatcctgtcaatcatctgtgtcgggctgctctatacatattacaccaaaccagatggctgcacagaaaacaagttcttcatcagtattaacctgatcctttgcgttgtggcttctattatatcgatccacccaaaaattcaggaacaccagcctcgctccggcctcttgcagtcctccctcatcaccctctacactatgtacctcacctggtcagccatgtccaatgaacctgatcgttcctgcaatcccaacctgatgagctttattacacgcataactgcaccaaccctggctcctggaaattcaactgctgtggtccctacccctactccaccatcaaagagtgggtctttactggattcagataattttattggactgtttgtctttgttctctgcctcttgtattctagcatccgcacttccactaatagccaagtagacaagctgaccctgtcagggagtgacagcgtcatccttggtgatacaactaccagtggtgccagtgatgaagaagatggacagcctcggcgggctgtggacaacgagaaagagggagtgcagtatagctactccttattccacctcatgctctgcttggcttccttgtacatcatgatgaccctgaccagctggtacagccctgatgcaaagtttcagagcatgaccagcaagtggccagctgtgtgggtcaagatcagctccagctgggtctgcctcctgctttacgtctggacccttgtggctccacttgtcctcaccagtcgggacttcagctgaacctctgagtgccaaggacaccactggaactcacaaaggtctccttcaccgaaaacccatataccttttaagtttgtttcaactaaaatattaagtgaatgctttgcaagtttgactgtatgcaggtttatatcagaaggtgagattgaataatgcttgatgcagaatcgaaacttctcatttatctgtatattatgtttacttctaaggatatagcacaaagggaacattttttgtttaaagtgaactacagctgtgctgtgaagagagttctttataaagcctgtaggttcttttaactttggtttaaaatgtaagataggaaaatgttggatatttgaggccatgcttaatatatttatattgcagtatcctttaaaagcaaaaaaaaaaaaatgcatttatattacagttttcctctatgaaagtccttacttatatgatacaagcactgtgttttgtgcttaaactcttcagcggggtagcatcaaagttcttggggaaggatcgtatatgtgggtcccttccctagaagaatggttgctgatatggctactgcttctacatcttgagttttttaatttactttttttacactgtagcattgagactgcttgattcaagtctggtgctttgccagatgtattaatttccataaatgctttgtgagtttggttaaaatgaagattcacttgggaaaacactgcagctttagtctgtgttactatcttgttatgagtatgtaaaagtaaaatgcatgtgaatttatcatatttgcactatgaaggtatttggttaaaatacaaagacttttaagattttaaggccctttcttccaacagcttttatagttagcagccattctttattttctggatagccaggttttatcacgcttctagtcaggatgctcctattccttctaaaaattacggtctgactagtgagcaaagtcttgaatttattcaaaagtcctaaataccttctctaggtaagacacttggtagatgagagacggaaggcattgtcaagaaccattttcatgagaggtggtgtgcaaaaaggtagaataaaagagttctttcaacaaagatttactgtctattctgtactagaccctgtaggttttggggtacagtgttaaacatgatagaggctctgccgtcttggactttaatagcttagagaagagagcaaatgagctgacaggtggttataatgtgaattagtgctgtggtttaggaattggagagaactcaaaggagaggtatttggtgtaatggtaggctttctggagaaaatgatatttaagccaagaactcttagaagttagctaagagagagatgggaaaatgagacgacattgctggagtagataaaactgcatgttaaaggcaggaagatggggaaaaaaagttcagtaaagctggaatggggaaatgtagtcagggactgaattttaaagggctttatcaacctcagtaaagagtttggaccttatgttgagggtggctgaaaacatattcatagtgtcatgaacaaattttatcttcagtcacttgggctgatatatagagaatggatttagagagatgagaccaggtgcagtccatatgagatgtgaaatagagaagtggaatcgtagggacggggagaaattgacaggtgagggctacttagcaattagaatttttttttttcaattttaatttttttttttgagacggagtcttgctctgtcgcccaggctggagtgcaatggtgcgatctccgctcactgcaggctccgcctcccgggttcacgccattctcccgcctcagcctccctagtagctgggactacaggcacccaccaccacgcctggctaattttttttgtatttttagtagagacagggtttcaccatgttagccaggatggtctcgatctcctgacctcgtgatccacctgccgcggcctcccaaagttctaggattactggcatgagccaccgtgcctggccagcaattagaattttaacactggcagttatgaataatatgaaggagaggtagatttctgagtgattctggtttaaccagctgggtggatggtggttccacgtattcaggtggcaaacaggaaaaacatgtgttcgaagaagaatggaggtaggtggtctcttaagaatggttaagaggcttgggagtcagactgcttgggtttgcatcccagctttgccgttttctggctatcaaacttgtcagctattatttgttgagtacgtactatttgatttatgaccacaggcagctgagcctcagtgttggtgcctagtgtacaagattgttaaagaataaagttattttgcaaagtgtaacccatttttagcactgacatagcactgacagtagctgctgatctcattatgggctaaaataagacaatattcaaaggtcagagatatctagccagaatctgatggaggctggatttcagattttgttacagaattagacagaggaacacagaggggacaggctcagttagggtggaggtgtggggtagggaagcaggacttgatataaattattggaatcattgtcttttaaaccagtggtttatgtcagggtatagcgtttcaagggatttgagggtcagatggggaaatgtagccccttattttgccagtgtgaagcagataccctgcttttctttacagtagcggagtcagcttaagagctttaaaggtcctaaacttcaaaaacattacagtgccccatcctccgccttaatgtaattcaaaatacaaacaatactaaactgtaaaataaatgtaacaaagtccaataaagtttttatttttttctcatga

SEQ ID NO: 314497 - DNA, 2645 bp, Homo sapiens
catccgtgcgtctgtggaaggctgcgtttccggcctgagaaaccgtcatgtttctggggagtcacctcagctggcagttaccaccgtgttagaaagcagcctcaggaccggccacctccatcactggcgtcaccatgggggctgtgctgggtgtcttctccctcgccagctgggttccatgcctctgcagcggtgcctcatgtttgctgtgtagttgctgtcctaacagtaagaattccacggtgactcgcctcatttatgctttcattctcctcctgagcactgtcgtatcctatatcatgcagagaaaagagatggaaacttacttgaagaagattcctggattttgtgaagggggatttaaaatccatgaggctgatataaatgcagataaagattgtgatgtgctggttggttataaagctgtgtatcggatcagctttgccatggccatctttttctttgtcttttctctgctcatgttcaaagtaaaaacaagtaaagatctccgagcggcagtacacaatgggttttggttcttcaaaattgctgcccttattggaatcatggttggctctttctacatccctgggggctatttcagctcagtctggtttgttgttggcatgataggggccgccctcttcatcctcattcagctggtgctgctggtagattttgctcattcttggaatgaatcatgggtaaatcgaatggaagaaggaaacccaaggttgtggtatgctgctttactgtctttcacaagcgccttttatatcctgtcaatcatctgtgtcgggctgctctatacatattacaccaaaccagatggctgcacagaaaacaagttcttcatcagtattaacctgatcctttgcgttgtggcttctattatatcgatccacccaaaaattcaggaacaccagcctcgctccggcctcttgcagtcctccctcatcaccctctacactatgtacctcacctggtcagccatgtccaatgaacctgatcgttcctgcaatcccaacctgatgagctttattacacgcataactgcaccaaccctggctcctggaaattcaactgctgtggtccctacccctactccaccatcaaagagtgggtctttactggattcagataattttattggactgtttgtctttgttctctgcctcttgtattctagcatccgcacttccactaatagccaagtagacaagctgaccctgtcagggagtgacagcgtcatccttggtgatacaactaccagtggtgccagtgatgaagaagatggacagcctcggcgggctgtggacaacgagaaagagggagtgcagtatagctactccttattccacctcatgctctgcttggcttccttgtacatcatgatgaccctgaccagctggtacagccctgatgcaaagtttcagagcatgaccagcaagtggccagctgtgtgggtcaagatcagctccagctgggtctgcctcctgctttacgtctggacccttgtggctccacttgtcctcaccagtcgggacttcagctgaacctctgagtgccaaggacaccactggaactcacaaaggtctccttcaccgaaaacccatataccttttaagtttgtttcaactaaaatattaagtgaatgctttgcaagtttgactgtatgcaggtttatatcagaaggtgagattgaataatgcttgatgcagaatcgaaacttctcatttatctgtatattatgtttacttctaaggatatagcacaaagggaacattttttgtttaaagtgaactacagctgtgctgtgaagagagttctttataaagcctgtaggttcttttaactttggtttaaaatgtaagataggaaaatgttggatatttgaggccatgcttaatatatttatattgcagtatcctttaaaagcaaaaaaaaaaaaatgcatttatattacagttttcctctatgaaagtccttacttatatgatacaagcactgtgttttgtgcttaaactcttcagcggggtagcatcaaagttcttggggaaggatcgtatatgtgggtcccttccctagaagaatggttgctgatatggctactgcttctacatcttgagttttttaatttactttttttacactgtagcattgagactgcttgattcaagtctggtgctttgccagatgtattaatttccataaatgctttgtgagtttggttaaaatgaagattcacttgggaaaacactgcagctttagtctgtgttactatcttgttatgagtatgtaaaagtaaaatgcatgtgaatttatcatatttgcactatgaaggtatttggttaaaatacaaagacttttaagattttaaggccctttcttccaacagcttttatagttagcagccattctttattttctggatagccaggttttatcacgcttctagtcaggatgctcctattccttctaaaaattacggtctgactagtgagcaaagtcttgaatttattcaaaagtcctaaataccttctctaggtaagacacttggtagatgagagacggaaggcattgtcaagaaccattttcatgagaggtggtgtgcaaaaaggtagaataaaagagttctttcaaca

SEQ ID NO: 314498 - DNA, 3850 bp, Homo sapiens
catccgtgcgtctgtggaaggctgcgtttccggcctgagaaaccgtcatgtttctggggagtcacctcagctggcagttaccaccgtgttagaaagcagcctcaggaccggccacctccatcactggcgtcaccatgggggctgtgctgggtgtcttctccctcgccagctgggttccatgcctctgcagcggtgcctcatgtttgctgtgtagttgctgtcctaacagtaagaattccacggtgactcgcctcatttatgctttcattctcctcctgagcactgtcgtatcctatatcatgcagagaaaagagatggaaacttacttgaagaagattcctggattttgtgaagggggatttaaaatccatgaggctgatataaatgcagataaagattgtgatgtgctggttggttataaagctgtgtatcggatcagctttgccatggccatctttttctttgtcttttctctgctcatgttcaaagtaaaaacaagtaaagatctccgagcggcagtacacaatgggttttggttcttcaaaattgctgcccttattggaatcatggttggctctttctacatccctgggggctatttcagctcagtctggtttgttgttggcatgataggggccgccctcttcatcctcattcagctggtgctgctggtagattttgctcattcttggaatgaatcatgggtaaatcgaatggaagaaggaaacccaaggttgtggtatgctgctttactgtctttcacaagcgccttttatatcctgtcaatcatctgtgtcgggctgctctatacatattacaccaaaccagatggctgcacagaaaacaagttcttcatcagtattaacctgatcctttgcgttgtggcttctattatatcgatccacccaaaaattcaggaacaccagcctcgctccggcctcttgcagtcctccctcatcaccctctacactatgtacctcacctggtcagccatgtccaatgaacctgatcgttcctgcaatcccaacctgatgagctttattacacgcataactgcaccaaccctggctcctggaaattcaactgctgtggtccctacccctactccaccatcaaagagtgggtctttactggattcagataattttattggactgtttgtctttgttctctgcctcttgtattctagcatccgcacttccactaatagccaagtagacaagctgaccctgtcagggagtgacagcgtcatccttggtgatacaactaccagtggtgccagtgatgaagaagatggacagcctcggcgggctgtggacaacgagaaagagggagtgcagtatagctactccttattccacctcatgctctgcttggcttccttgtacatcatgatgaccctgaccagctggtacagccctgatgcaaagtttcagagcatgaccagcaagtggccagctgtgtgggtcaagatcagctccagctgggtctgcctcctgctttacgtctggacccttgtggctccacttgtcctcaccagtcgggacttcagctgaacctctgagtgccaaggacaccactggaactcacaaaggtctccttcaccgaaaacccatataccttttaagtttgtttcaactaaaatattaagtgaatgctttgcaagtttgactgtatgcaggtttatatcagaaggtgagattgaataatgcttgatgcagaatcgaaacttctcatttatctgtatattatgtttacttctaaggatatagcacaaagggaacattttttgtttaaagtgaactacagctgtgctgtgaagagagttctttataaagcctgtaggttcttttaactttggtttaaaatgtaagataggaaaatgttggatatttgaggccatgcttaatatatttatattgcagtatcctttaaaagcaaaaaaaaaaaaatgcatttatattacagttttcctctatgaaagtccttacttatatgatacaagcactgtgttttgtgcttaaactcttcagcggggtagcatcaaagttcttggggaaggatcgtatatgtgggtcccttccctagaagaatggttgctgatatggctactgcttctacatcttgagttttttaatttactttttttacactgtagcattgagactgcttgattcaagtctggtgctttgccagatgtattaatttccataaatgctttgtgagtttggttaaaatgaagattcacttgggaaaacactgcagctttagtctgtgttactatcttgttatgagtatgtaaaagtaaaatgcatgtgaatttatcatatttgcactatgaaggtatttggttaaaatacaaagacttttaagattttaaggccctttcttccaacagcttttatagttagcagccattctttattttctggatagccaggttttatcacgcttctagtcaggatgctcctattccttctaaaaattacggtctgactagtgagcaaagtcttgaatttattcaaaagtcctaaataccttctctaggtaagacacttggtagatgagagacggaaggcattgtcaagaaccattttcatgagaggtggtgtgcaaaaaggtagaataaaagagttctttcaacaaagatttactgtctattctgtactagaccctgtaggttttggggtacagtgttaaacatgatagaggctctgccgtcttggactttaatagcttagagaagagagcaaatgagctgacaggtggttataatgtgaattagtgctgtggtttaggaattggagagaactcaaaggagaggtatttggtgtaatggtaggctttctggagaaaatgatatttaagccaagaactcttagaagttagctaagagagagatgggaaaatgagacgacattgctggagtagataaaactgcatgttaaaggcaggaagatggggaaaaaaagttcagtaaagctggaatggggaaatgtagtcagggactgaattttaaagggctttatcaacctcagtaaagagtttggaccttatgttgagggtggctgaaaacatattcatagtgtcatgaacaaattttatcttcagtcacttgggctgatatatagagaatggatttagagagatgagaccaggtgcagtccatatgagatgtgaaatagagaagtggaatcgtagggacggggagaaattgacaggtgagggctacttagcaattagaatttttttttttcaattttaatttttttttttgagacggagtcttgctctgtcgcccaggctggagtgcaatggtgcgatctccgctcactgcaggctccgcctcccgggttcacgccattctcccgcctcagcctccctagtagctgggactacaggcacccaccaccacgcctggctaattttttttgtatttttagtagagacagggtttcaccatgttagccaggatggtctcgatctcctgacctcgtgatccacctgccgcggcctcccaaagttctaggattactggcatgagccaccgtgcctggccagcaattagaattttaacactggcagttatgaataatatgaaggagaggtagatttctgagtgattctggtttaaccagctgggtggatggtggttccacgtattcaggtggcagctttttgtgagggtcagtttggccgataaacacgtctgtgcctgcaagacagttatgaagttgagaggataaggaggtgtcggcagggagaggcatggcctcactcactgcttcacgagtgaaagaccgtgtctggattaaggaggggaggtaattcctgagtggctcagagtctg

SEQ ID NO: 314499 - DNA, 2379 bp, Homo sapiens
catccgtgcgtctgtggaaggctgcgtttccggcctgagaaaccgtcatgtttctggggagtcacctcagctggcagttaccaccgtgttagaaagcagcctcaggaccggccacctccatcactggcgtcaccatgggggctgtgctgggtgtcttctccctcgccagctgggttccatgcctctgcagcggtgcctcatgtttgctgtgtagttgctgtcctaacagtaagaattccacggtgactcgcctcatttatgctttcattctcctcctgagcactgtcgtatcctatatcatgcagagaaaagagatggaaacttacttgaagaagattcctggattttgtgaagggggatttaaaatccatgaggctgatataaatgcagataaagattgtgatgtgctggttggttataaagctgtgtatcggatcagctttgccatggccatctttttctttgtcttttctctgctcatgttcaaagtaaaaacaagtaaagatctccgagcggcagtacacaatgggttttggttcttcaaaattgctgcccttattggaatcatggttggctctttctacatccctgggggctatttcagctcagtctggtttgttgttggcatgataggggccgccctcttcatcctcattcagctggtgctgctggtagattttgctcattcttggaatgaatcatgggtaaatcgaatggaagaaggaaacccaaggttgtggtatgctgctttactgtctttcacaagcgccttttatatcctgtcaatcatctgtgtcgggctgctctatacatattacaccaaaccagatggctgcacagaaaacaagttcttcatcagtattaacctgatcctttgcgttgtggcttctattatatcgatccacccaaaaattcaggaacaccagcctcgctccggcctcttgcagtcctccctcatcaccctctacactatgtacctcacctggtcagccatgtccaatgaacctgatcgttcctgcaatcccaacctgatgagctttattacacgcataactgcaccaaccctggctcctggaaattcaactgctgtggtccctacccctactccaccatcaaagagtgggtctttactggattcagataattttattggactgtttgtctttgttctctgcctcttgtattctagcatccgcacttccactaatagccaagtagacaagctgaccctgtcagggagtgacagcgtcatccttggtgatacaactaccagtggtgccagtgatgaagaagatggacagcctcggcgggctgtggacaacgagaaagagggagtgcagtatagctactccttattccacctcatgctctgcttggcttccttgtacatcatgatgaccctgaccagctggtacagccctgatgcaaagtttcagagcatgaccagcaagtggccagctgtgtgggtcaagatcagctccagctgggtctgcctcctgctttacgtctggacccttgtggctccacttgtcctcaccagtcgggacttcagctgaacctctgagtgccaaggacaccactggaactcacaaaggtctccttcaccgaaaacccatataccttttaagtttgtttcaactaaaatattaagtgaatgctttgcaagtttgactgtatgcaggtttatatcagaaggtgagattgaataatgcttgatgcagaatcgaaacttctcatttatctgtatattatgtttacttctaaggatatagcacaaagggaacattttttgtttaaagtgaactacagctgtgctgtgaagagagttctttataaagcctgtaggttcttttaactttggtttaaaatgtaagataggaaaatgttggatatttgaggccatgcttaatatatttatattgcagtatcctttaaaagcaaaaaaaaaaaaatgcatttatattacagttttcctctatgaaagtccttacttatatgatacaagcactgtgttttgtgcttaaactcttcagcggggtagcatcaaagttcttggggaaggatcgtatatgtgggtcccttccctagaagaatggttgctgatatggctactgcttctacatcttgagttttttaatttactttttttacactgtagcattgagactgcttgattcaagtctggtgctttgccagatgtattaatttccataaatgctttgtgagtttggttaaaatgaagattcacttgggaaaacactgcagctttagtctgtgttactatcttgttatgagtatgtaaaagtaaaatgcatcgcatggatcataccagccctgagcatggtaatttcggactggccataccacgacgctttcaga

SEQ ID NO: 314500 - DNA, 4514 bp, Homo sapiens
catccgtgcgtctgtggaaggctgcgtttccggcctgagaaaccgtcatgtttctggggagtcacctcagctggcagttaccaccgtgttagaaagcagcctcaggaccggccacctccatcactggcgtcaccatgggggctgtgctgggtgtcttctccctcgccagctggaaaatcctggtgagttgaaggccaggcatggtggctcacgccaggatggtctcaatctcctgacctcgtgatccgccggcctcccagagtgcttggattacaggttccatgcctctgcagcggtgcctcatgtttgctgtgtagttgctgtcctaacagtaagaattccacggtgactcgcctcatttatgctttcattctcctcctgagcactgtcgtatcctatatcatgcagagaaaagagatggaaacttacttgaagaagattcctggattttgtgaagggggatttaaaatccatgaggctgatataaatgcagataaagattgtgatgtgctggttggttataaagctgtgtatcggatcagctttgccatggccatctttttctttgtcttttctctgctcatgttcaaagtaaaaacaagtaaagatctccgagcggcagtacacaatgggttttggttcttcaaaattgctgcccttattggaatcatggttggctctttctacatccctgggggctatttcagctcagtctggtttgttgttggcatgataggggccgccctcttcatcctcattcagctggtgctgctggtagattttgctcattcttggaatgaatcatgggtaaatcgaatggaagaaggaaacccaaggttgtggtatgctgctttactgtctttcacaagcgccttttatatcctgtcaatcatctgtgtcgggctgctctatacatattacaccaaaccagatggctgcacagaaaacaagttcttcatcagtattaacctgatcctttgcgttgtggcttctattatatcgatccacccaaaaattcaggaacaccagcctcgctccggcctcttgcagtcctccctcatcaccctctacactatgtacctcacctggtcagccatgtccaatgaacctgatcgttcctgcaatcccaacctgatgagctttattacacgcataactgcaccaaccctggctcctggaaattcaactgctgtggtccctacccctactccaccatcaaagagtgggtctttactggattcagataattttattggactgtttgtctttgttctctgcctcttgtattctagcatccgcacttccactaatagccaagtagacaagctgaccctgtcagggagtgacagcgtcatccttggtgatacaactaccagtggtgccagtgatgaagaagatggacagcctcggcgggctgtggacaacgagaaagagggagtgcagtatagctactccttattccacctcatgctctgcttggcttccttgtacatcatgatgaccctgaccagctggtacagccctgatgcaaagtttcagagcatgaccagcaagtggccagctgtgtgggtcaagatcagctccagctgggtctgcctcctgctttacgtctggacccttgtggctccacttgtcctcaccagtcgggacttcagctgaacctctgagtgccaaggacaccactggaactcacaaaggtctccttcaccgaaaacccatataccttttaagtttgtttcaactaaaatattaagtgaatgctttgcaagtttgactgtatgcaggtttatatcagaaggtgagattgaataatgcttgatgcagaatcgaaacttctcatttatctgtatattatgtttacttctaaggatatagcacaaagggaacattttttgtttaaagtgaactacagctgtgctgtgaagagagttctttataaagcctgtaggttcttttaactttggtttaaaatgtaagataggaaaatgttggatatttgaggccatgcttaatatatttatattgcagtatcctttaaaagcaaaaaaaaaaaaatgcatttatattacagttttcctctatgaaagtccttacttatatgatacaagcactgtgttttgtgcttaaactcttcagcggggtagcatcaaagttcttggggaaggatcgtatatgtgggtcccttccctagaagaatggttgctgatatggctactgcttctacatcttgagttttttaatttactttttttacactgtagcattgagactgcttgattcaagtctggtgctttgccagatgtattaatttccataaatgctttgtgagtttggttaaaatgaagattcacttgggaaaacactgcagctttagtctgtgttactatcttgttatgagtatgtaaaagtaaaatgcatgtgaatttatcatatttgcactatgaaggtatttggttaaaatacaaagacttttaagattttaaggccctttcttccaacagcttttatagttagcagccattctttattttctggatagccaggttttatcacgcttctagtcaggatgctcctattccttctaaaaattacggtctgactagtgagcaaagtcttgaatttattcaaaagtcctaaataccttctctaggtaagacacttggtagatgagagacggaaggcattgtcaagaaccattttcatgagaggtggtgtgcaaaaaggtagaataaaagagttctttcaacaaagatttactgtctattctgtactagaccctgtaggttttggggtacagtgttaaacatgatagaggctctgccgtcttggactttaatagcttagagaagagagcaaatgagctgacaggtggttataatgtgaattagtgctgtggtttaggaattggagagaactcaaaggagaggtatttggtgtaatggtaggctttctggagaaaatgatatttaagccaagaactcttagaagttagctaagagagagatgggaaaatgagacgacattgctggagtagataaaactgcatgttaaaggcaggaagatggggaaaaaaagttcagtaaagctggaatggggaaatgtagtcagggactgaattttaaagggctttatcaacctcagtaaagagtttggaccttatgttgagggtggctgaaaacatattcatagtgtcatgaacaaattttatcttcagtcacttgggctgatatatagagaatggatttagagagatgagaccaggtgcagtccatatgagatgtgaaatagagaagtggaatcgtagggacggggagaaattgacaggtgagggctacttagcaattagaatttttttttttcaattttaatttttttttttgagacggagtcttgctctgtcgcccaggctggagtgcaatggtgcgatctccgctcactgcaggctccgcctcccgggttcacgccattctcccgcctcagcctccctagtagctgggactacaggcacccaccaccacgcctggctaattttttttgtatttttagtagagacagggtttcaccatgttagccaggatggtctcgatctcctgacctcgtgatccacctgccgcggcctcccaaagttctaggattactggcatgagccaccgtgcctggccagcaattagaattttaacactggcagttatgaataatatgaaggagaggtagatttctgagtgattctggtttaaccagctgggtggatggtggttccacgtattcaggtggcaaacaggaaaaacatgtgttcgaagaagaatggaggtaggtggtctcttaagaatggttaagaggcttgggagtcagactgcttgggtttgcatcccagctttgccgttttctggctatcaaacttgtcagctattatttgttgagtacgtactatttgatttatgaccacaggcagctgagcctcagtgttggtgcctagtgtacaagattgttaaagaataaagttattttgcaaagtgtaacccatttttagcactgacatagcactgacagtagctgctgatctcattatgggctaaaataagacaatattcaaaggtcagagatatctagccagaatctgatggaggctggatttcagattttgttacagaattagacagaggaacacagaggggacaggctcagttagggtggaggtgtggggtagggaagcaggacttgatataaattattggaatcattgtcttttaaaccagtggtttatgtcagggtatagcgtttcaagggatttgagggtcagatggggaaatgtagccccttattttgccagtgtgaagcagataccctgcttttctttacagtagcggagtcagcttaagagctttaaaggtcctaaacttcaaaaacattacagtgccccatcctccgccttaatgtaattcaaaatacaaacaatactaaactgtaaaataaatgtaacaaagtccaataaagtttttatttttttctcatga

SEQ ID NO: 314501 - DNA, 1958 bp, Homo sapiens
catccgtgcgtctgtggaaggctgcgtttccggcctgagaaaccgtcatgtttctggggagtcacctcagctggcagttaccaccgtgttagaaagcagcctcaggaccggccacctccatcactggcgtcaccatgggggctgtgctgggtgtcttctccctcgccagctgggttccatgcctctgcagcggtgcctcatgtttgctgtgtagttgctgtcctaacagtaagaattccacggtgactcgcctcatttatgctttcattctcctcctgagcactgtcgtatcctatatcatgcagagaaaagagatggaaacttacttgaagaagattcctggattttgtgaagggggatttaaaatccatgaggctgatataaatgcagataaagattgtgatgtgctggttggttataaagctgtgtatcggatcagctttgccatggccatctttttctttgtcttttctctgctcatgttcaaagtaaaaacaagtaaagatctccgagcggcagtacacaatgggttttggttcttcaaaattgctgcccttattggaatcatggttggctctttctacatccctgggggctatttcagctcagtctggtttgttgttggcatgataggggccgccctcttcatcctcattcagctggtgctgctggtagattttgctcattcttggaatgaatcatgggtaaatcgaatggaagaaggaaacccaaggttgtggtatgctgctttactgtctttcacaagcgccttttatatcctgtcaatcatctgtgtcgggctgctctatacatattacaccaaaccagatggctgcacagaaaacaagttcttcatcagtattaacctgatcctttgcgttgtggcttctattatatcgatccacccaaaaattcaggaacaccagcctcgctccggcctcttgcagtcctccctcatcaccctctacactatgtacctcacctggtcagccatgtccaatgaacctgatcgttcctgcaatcccaacctgatgagctttattacacgcataactgcaccaaccctggctcctggaaattcaactgctgtggtccctacccctactccaccatcaaagagtgggtctttactggattcagataattttattggactgtttgtctttgttctctgcctcttgtattctagcatccgcacttccactaatagccaagtagacaagctgaccctgtcagggagtgacagcgtcatccttggtgatacaactaccagtggtgccagtgatgaagaagatggacagcctcggcgggctgtggacaacgagaaagagggagtgcagtatagctactccttattccacctcatgctctgcttggcttccttgtacatcatgatgaccctgaccagctggtacagccctgatgcaaagtttcagagcatgaccagcaagtggccagctgtgtgggtcaagatcagctccagctgggtctgcctcctgctttacgtctggacccttgtggctccacttgtcctcaccagtcgggacttcagctgaacctctgagtgccaaggacaccactggaactcacaaaggtctccttcaccgaaaacccatataccttttaagtttgtttcaactaaaatattaagtgaatgctttgcaagtttgactgtatgcaggtttatatcagaaggtgagattgaataatgcttgatgcagaatcgaaacttctcatttatctgtatattatgtttacttctaaggatatagcacaaagggaacattttttgtttaaagtgaactacagctgtgctgtgaagagagttctttataaagcctgtaggttcttttaactttggtttaaaatgtaagataggaaaatgttggatataaacaatactaaactgtaaaataaatgtaacaaagtccaataaagtttttatttttttctcatga

SEQ ID NO: 314502 - DNA, 3734 bp, Homo sapiens
ctggcattaacagggatgccttatctcacaggattctactcaaaagaccttattattgaagcagcaaacactttactgtctttcacaagcgccttttatatcctgtcaatcatctgtgtcgggctgctctatacatattacaccaaaccagatggctgcacagaaaacaagttcttcatcagtattaacctgatcctttgcgttgtggcttctattatatcgatccacccaaaaattcaggaacaccagcctcgctccggcctcttgcagtcctccctcatcaccctctacactatgtacctcacctggtcagccatgtccaatgaacctgatcgttcctgcaatcccaacctgatgagctttattacacgcataactgcaccaaccctggctcctggaaattcaactgctgtggtccctacccctactccaccatcaaagagtgggtctttactggattcagataattttattggactgtttgtctttgttctctgcctcttgtattctagcatccgcacttccactaatagccaagtagacaagctgaccctgtcagggagtgacagcgtcatccttggtgatacaactaccagtggtgccagtgatgaagaagatggacagcctcggcgggctgtggacaacgagaaagagggagtgcagtatagctactccttattccacctcatgctctgcttggcttccttgtacatcatgatgaccctgaccagctggtacagccctgatgcaaagtttcagagcatgaccagcaagtggccagctgtgtgggtcaagatcagctccagctgggtctgcctcctgctttacgtctggacccttgtggctccacttgtcctcaccagtcgggacttcagctgaacctctgagtgccaaggacaccactggaactcacaaaggtctccttcaccgaaaacccatataccttttaagtttgtttcaactaaaatattaagtgaatgctttgcaagtttgactgtatgcaggtttatatcagaaggtgagattgaataatgcttgatgcagaatcgaaacttctcatttatctgtatattatgtttacttctaaggatatagcacaaagggaacattttttgtttaaagtgaactacagctgtgctgtgaagagagttctttataaagcctgtaggttcttttaactttggtttaaaatgtaagataggaaaatgttggatatttgaggccatgcttaatatatttatattgcagtatcctttaaaagcaaaaaaaaaaaaatgcatttatattacagttttcctctatgaaagtccttacttatatgatacaagcactgtgttttgtgcttaaactcttcagcggggtagcatcaaagttcttggggaaggatcgtatatgtgggtcccttccctagaagaatggttgctgatatggctactgcttctacatcttgagttttttaatttactttttttacactgtagcattgagactgcttgattcaagtctggtgctttgccagatgtattaatttccataaatgctttgtgagtttggttaaaatgaagattcacttgggaaaacactgcagctttagtctgtgttactatcttgttatgagtatgtaaaagtaaaatgcatgtgaatttatcatatttgcactatgaaggtatttggttaaaatacaaagacttttaagattttaaggccctttcttccaacagcttttatagttagcagccattctttattttctggatagccaggttttatcacgcttctagtcaggatgctcctattccttctaaaaattacggtctgactagtgagcaaagtcttgaatttattcaaaagtcctaaataccttctctaggtaagacacttggtagatgagagacggaaggcattgtcaagaaccattttcatgagaggtggtgtgcaaaaaggtagaataaaagagttctttcaacaaagatttactgtctattctgtactagaccctgtaggttttggggtacagtgttaaacatgatagaggctctgccgtcttggactttaatagcttagagaagagagcaaatgagctgacaggtggttataatgtgaattagtgctgtggtttaggaattggagagaactcaaaggagaggtatttggtgtaatggtaggctttctggagaaaatgatatttaagccaagaactcttagaagttagctaagagagagatgggaaaatgagacgacattgctggagtagataaaactgcatgttaaaggcaggaagatggggaaaaaaagttcagtaaagctggaatggggaaatgtagtcagggactgaattttaaagggctttatcaacctcagtaaagagtttggaccttatgttgagggtggctgaaaacatattcatagtgtcatgaacaaattttatcttcagtcacttgggctgatatatagagaatggatttagagagatgagaccaggtgcagtccatatgagatgtgaaatagagaagtggaatcgtagggacggggagaaattgacaggtgagggctacttagcaattagaatttttttttttcaattttaatttttttttttgagacggagtcttgctctgtcgcccaggctggagtgcaatggtgcgatctccgctcactgcaggctccgcctcccgggttcacgccattctcccgcctcagcctccctagtagctgggactacaggcacccaccaccacgcctggctaattttttttgtatttttagtagagacagggtttcaccatgttagccaggatggtctcgatctcctgacctcgtgatccacctgccgcggcctcccaaagttctaggattactggcatgagccaccgtgcctggccagcaattagaattttaacactggcagttatgaataatatgaaggagaggtagatttctgagtgattctggtttaaccagctgggtggatggtggttccacgtattcaggtggcaaacaggaaaaacatgtgttcgaagaagaatggaggtaggtggtctcttaagaatggttaagaggcttgggagtcagactgcttgggtttgcatcccagctttgccgttttctggctatcaaacttgtcagctattatttgttgagtacgtactatttgatttatgaccacaggcagctgagcctcagtgttggtgcctagtgtacaagattgttaaagaataaagttattttgcaaagtgtaacccatttttagcactgacatagcactgacagtagctgctgatctcattatgggctaaaataagacaatattcaaaggtcagagatatctagccagaatctgatggaggctggatttcagattttgttacagaattagacagaggaacacagaggggacaggctcagttagggtggaggtgtggggtagggaagcaggacttgatataaattattggaatcattgtcttttaaaccagtggtttatgtcagggtatagcgtttcaagggatttgagggtcagatggggaaatgtagccccttattttgccagtgtgaagcagataccctgcttttctttacagtagcggagtcagcttaagagctttaaaggtcctaaacttcaaaaacattacagtgccccatcctccgccttaatgtaattcaaaatacaaacaatactaaactgtaaaataaatgtaacaaagtccaataaagtttttatttttttctcatga

SEQ ID NO: 314503 - DNA, 1739 bp, Homo sapiens
catccgtgcgtctgtggaaggctgcgtttccggcctgagaaaccgtcatgtttctggggagtcacctcagctggcagttaccaccgtgttagaaagcagcctcaggaccggccacctccatcactggcgtcaccatgggggctgtgctgggtgtcttctccctcgccagctgggttccatgcctctgcagcggtgcctcatgtttgctgtgtagttgctgtcctaacagtaagaattccacggtgactcgcctcatttatgctttcattctcctcctgagcactgtcgtatcctatatcatgcagagaaaagagatggaaacttacttgaagaagattcctggattttgtgaagggggatttaaaatccatgaggctgatataaatgcagataaagattgtgatgtgctggttggttataaagctgtgtatcggatcagctttgccatggccatctttttctttgtcttttctctgctcatgttcaaagtaaaaacaagtaaagatctccgagcggcagtacacaatgggttttggttcttcaaaattgctgcccttattggaatcatggttggctctttctacatccctgggggctatttcagctcagtctggtttgttgttggcatgataggggccgccctcttcatcctcattcagctggtgctgctggtagattttgctcattcttggaatgaatcatgggtaaatcgaatggaagaaggaaacccaaggttgtggtatgctgctttactgtctttcacaagcgccttttatatcctgtcaatcatctgtgtcgggctgctctatacatattacaccaaaccagatggctgcacagaaaacaagttcttcatcagtattaacctgatcctttgcgttgtggcttctattatatcgatccacccaaaaattcaggaacaccagcctcgctccggcctcttgcagtcctccctcatcaccctctacactatgtacctcacctggtcagccatgtccaatgaacctgatcgttcctgcaatcccaacctgatgagctttattacacgcataactgcaccaaccctggctcctggaaattcaactgctgtggtccctacccctactccaccatcaaagagtgggtctttactggattcagataattttattggactgtttgtctttgttctctgcctcttgtattctagcatccgcacttccactaatagccaagtagacaagctgaccctgtcagggagtgacagcgtcatccttggtgatacaactaccagtggtgccagtgatgaagaagatggacagcctcggcgggctgtggacaacgagaaagagggagtgcagtatagctactccttattccacctcatgctctgcttggcttccttgtacatcatgatgaccctgaccagctggtacagccctgatgcaaagtttcagagcatgaccagcaagtggccagctgtgtgggtcaagatcagctccagctgggtctgcctcctgctttacgtctggacccttgtggctccacttgtcctcaccagtcgggacttcagctgaacctctgagtgccaaggacaccactggaactcacaaaggcacccaactcagtgatgtcctaattactgctggatgactcaagccacaccatgcctatgttctcaggtgaagaagaataatagaaaccacatagatgggtaggtgtaccaagcattaaacagacagtatccacaaaaaagtaag

SEQ ID NO: 314504 - DNA, 885 bp, Homo sapiens
catccgtgcgtctgtggaaggctgcgtttccggcctgagaaaccgtcatgtttctggggagtcacctcagctggcagttaccaccgtgttagaaagcagcctcaggaccggccacctccatcactggcgtcaccatgggggctgtgctgggtgtcttctccctcgccagctgggttccatgcctctgcagcggtgcctcatgtttgctgtgtagttgctgtcctaacagtaagaattccacggtgactcgcctcatttatgctttcattctcctcctgagcactgtcgtatcctatatcatgcagagaaaagagatggaaacttacttgaagaagattcctggattttgtgaagggggatttaaaatccatgaggctgatataaatgcagataaagattgtgatgtgctggttggttataaagctgtgtatcggatcagctttgccatggccatctttttctttgtcttttctctgctcatgttcaaagtaaaaacaagtaaagatctccgagcggcagtacacaatgggttttggttcttcaaaattgctgcccttattggaatcatggttggctctttctacatccctgggggctatttcagctcagtctggtttgttgttggcatgataggggccgccctcttcatcctcattcagctggtgctgctggtagattttgctcattcttggaatgaatcatgggtaaatcgaatggaagaaggccaggtgtggatgctgttactgtcttccagcgcttatatctgctggtcggctgctttcattaacacagatgtgcgaacaagttccaataacgactggggggttattgcctgacagccgctgagctcacatatcgcttattgcctttatctgcacgatcttt

SEQ ID NO: 314505 - DNA, 719 bp, Homo sapiens
catccgtgcgtctgtggaaggctgcgtttccggcctgagaaaccgtcatgtttctggggagtcacctcagctggcagttaccaccgtgttagaaagcagcctcaggaccggccacctccatcactggcgtcaccatgggggctgtgctgggtgtcttctccctcgccagctgggttccatgcctctgcagcggtgcctcatgtttgctgtgtagttgctgtcctaacagtaagaattccacggtgactcgcctcatttatgctttcattctcctcctgagcactgtcgtatcctatatcatgcagagaaaagagatggaaacttacttgaagaagattcctggattttgtgaagggggatttaaaatccatgaggctgatataaatgcagataaagattgtgatgtgctggttggttataaagctgtgtatcggatcagctttgccatggccatctttttctttgtcttttctctgctcatgttcaaagtaaaaacaagtaaagatctccgagcggcagtacacaatgggttttggttcttcaaaattgctgcccttattggaatcatggttggctctttctacatccctgggggctatttcagctcagggccattcaacgcgaggcgttgaatggccattcaacgcctccgggccattcaacgcctccgggccattcaagcgcctccgggccattcaagcgcctccgggcacatacaa

SEQ ID NO: 314506 - DNA, 584 bp, Homo sapiens
  misc_feature (584)..(584): n is a, c, g, or t
catccgtgcgtctgtggaaggctgcgtttccggcctgagaaaccgtcatgtttctggggagtcacctcagctggcagttaccaccgtgttagaaagcagcctcaggaccggccacctccatcactggcgtcaccatgggggctgtgctgggtgtcttctccctcgccagctgggttccatgcctctgcagcggtgcctcatgtttgctgtgtagttgctgtcctaacagtaagaattccacggtgactcgcctcatttatgctttcattctcctcctgagcactgtcgtatcctatatcatgcagagaaaagagatggaaacttacttgaagaagattcctggattttgtgaagggggatttaaaatccatgaggctgatataaatgcagataaagattgtgatgtgctggttggttataaagctgtgtatcggatcagctttgccatggccatctttttctttgtcttttctctgctcatgttcaaagtaaaaacaagtaaagatctccgagcggcagtacacaatgggtttgggtcttttttagctctctggtttggtggtcgcatgataggcgccgccttn

SEQ ID NO: 314507 - DNA, 1737 bp, Homo sapiens
tagatgacgggcacgaggacttggggccccacagcttgtagtagagcagctagggttcaaaaccaatcgtgctggctccaaaacccatggtgtttctacagcagccctttgccctccactgtcccctgcttctcccagcctcactctacacaagaccagaaggactggtctgtctctgactgatgcatgtcaccctcctttaacttcaggtggggcacaggagtctgtcaaataaaagaatatcggagaactgatattccacgtgcatcttcgtcctgagggctgcaccttgaaggaggggctacagggctgataaatgtccagatccagtcaggaaataaacccatgtctcaagaaggccgtagaacaggggtaggcggctggggagaaggactgaagcagtggagctagatagctgcagctttgggggacactgcatactctgcagctcactgcttctgggactgagaccagacgcgtgtgtccccaggctgcacgttcttcatgtggtgcaggtgaaaggagatgctggtgtatgtgaagcatgcgtgaagggacagtgagcacacaagggccaggccatcggttggggccggggggcaggggcacactacatactgctttctgacaccccaggcccaaaggtgctgctggtttaatggtaattaagcagattagccaccttctgttttatttaccacagttaccagctcagcaggtggtcacagaggaggtgctggcattgaggacagggtttaacttcagtcagccacggctcgttgaagctgctgggtgtgtttgcccgggtctgtttagcctcacgcagatgcctgctcccatctgtcactctttaaaatgctcttagtgaaagcctaaaatgtaaacagaggctgtgaaagcatatcacattcctatctttctctccagcctttgtagacctgcctgatttaatgcagcatcttgacaacaactttaaatactggaaaggactggacgaaatgaagctgcggaacctccgaccacctcctgaatagtgggagacaccacccagagccctgaagctttgttccttcggtcatttggaattcctgagggcagccagagctccttggtcctttcagtactaggcagaacagcccccgatctgcatagcctgtgaaagcccacggggacatcagtaaccttctgcagccaccatccaatgccattactgtcaagtgagacttggccactgtagcctgggcctgctgcaggagctcttcagaaaggcacatgaggaccacggtttgcctcagtttctggtaaaacacaaggtctggagtgcccctgcaaagggtattgatggacttcctgccagtgacagagcatgtctattgcaaacaattctctcagttacgttcagcacttaagaacggctaatggcaataggatctttagcaactttttcacatcatagaaggtgcaatcgctcacttgggaacactactgagagtgacttctcttttaaaattgagtagcagatgaaaaattaaaatttgaacttgattattaatatcaattaaaatgttttatttattttattaaaagctcaatattttctatgaattcaaaaatacttcagagccaaagccaacttcaaataccgtgaccaaatttacatgattcatattcattatgcattacttggtatacagacttattttcataatgcaaattaataaaatgacacttttactg

SEQ ID NO: 314508 - DNA, 1582 bp, Homo sapiens
gaagccttcacacatcccagaagggcctcaagccatttagttcacctcagaagccggtagtggccacataatggtcccttctggcccccagtctggctattcttcccctcccaaacacaggggcagaggctaagccccctcttccacttcagcaggtgggagttatgagaggaggaagtaagggggagtgccctttatttgggggtccaggacccctcttgtctgcagatggccactgaaaatatatgaccacttagactatggtgacctgacttttgtcagcaactcagaaggaggtggactttggaagttaagaaagaattgtcctattacctgaaatcagtttggggttgggatcattttttatcttaattgctttagcaatgtaagtgaatcagaactgaagtggaaaatgttcttgggtttatgttttcaacacaaagtatgacgatgcttacattccatttataggagtggcaaggaatttactatgccaaaaagaaaaacggagataatatacaacaaaatgtgaagataatacctgtcattggacagggagggtaagtggaaaaaacaagtacatcaatcaacatacagtgttttgggttattgcagaatttgctttgaatatttaagttaaggactgctgacagaagtgtcaaggtcaggtgtcatcacagaatggccttccagcatagtgttttcttggtgacttcctcatggctacagtctgaccctctacttgcagcccagagccaacatactctgggcagtcttgtttaagctgcgtggatacacaagaaactgaagtatttgtttaagtcagaatgtcactttagtaagttgtgtgataatactgactggtagactccctatattgaaaagattttttatctaatttgataggctatgtattatttctgcagagacctatcaaattagataaaaatattttaaatactaacagttatggacattcctatataaaacagatgtgactgtagattggaaaccagtatatatcaggagcctaaaactttcagacagtttatctcagaaacctatcttaaagaaataatatggtaagatgaaaattatgaatatgaattatagaacacctaaaatattgcagccattagaaatgatgatcatattcacaggttctaagatgagggccaaaaaaagtagaaatgatgatcatagaaaattaaattacctcatgcctgtaatcccagcactttgggaggccaaggtgggaaaatcccttgagcccaggagtttgggatccgcctgagcaatatagtgagacccccatccctacaaaaaatgtaaaaattagctaggtgtggtgacacacacctatcagttacttcagggggccgatgtgggagaatcgcttgatcttgggaggtcgaggctgcagtgagctatgatcatgccactgtactccagcctgggcaacaaagtaagacactgtctcaaaaggaaaaaaaaaaataaaatatgagaaaggttatgatacaatgttaaatgcaaaaagtaaaatgtaaaatgatagctagtgtttaatctcaatcatgta

SEQ ID NO: 314509 - DNA, 1097 bp, Homo sapiens
  misc_feature (237)..(237): n is a, c, g, or t
gatggagggaagagtcgggatcgataagaaagggattggggacatgtggtcactagcgcttgatgagaattccatgttcgatgttacaggatggccgtttacgagccgaagggatgaggtagccatgtatggtgatgcgtattccctcatagacctggcaagcactgaatccacaacgtatttgcctagaacttaccatatggattgctcgaggagctgtcctcagactctccctgnacagtgctcgcatgacaggttacatagttttctggtgtggtggatgcccagcaatatttcggaagaatatttttctcaggtaagttgctgcctcttttaagtttctagagagagagagagttaaaacccataaaatcatacgagataatggacttaacactaggaaatagggttctaaaaaaattctgtccttgtttgcaaggtaacaaatggtaactggtaacaaattttttttttcttaagaatattttattttccctttattcttgcaggatattttgttagatatagcatcctgggttgatgatttttttcctgaaagtacttttaaggagtcatctggtcttcatattctttctgagtagaaaaaacttctcttggggcagaaaaaaatattaggaaatatactggctaagatttttccagatttggtggagggcatatgcacatgcatatgcatacagattcaagaagcccagtgaaccttagcccatgtcagatgtgtcatagtcaagcagctaacaggctaaagataaatcttgcaatcagccagaggaaaagcgacacattacttataagaaaacagtgattctcatgtcctctgacttcccatcaaaaactatgaaggccagaagacacgggaacatctttaaagtgctgttagctttgggaggatcacttgagcccaggagtcttaagagcagcctgggcaacatggtgagaccttgtctctacaaaaaaattaaaagttagccgggcatagtgatgcactcctgtagtcccaagctacttgggaggctgaggcaggaggatcgcttgaagcccaggaggttgaggctgcagtgagccatgatcatgtc

SEQ ID NO: 314510 - DNA, 346 bp, Homo sapiens
gcgtggtggctcatacctgtaatcccagcactttgggaggtcgaggtaggaggaccccttgggcccaggagttcaagaccagcctgggcaacataaggagaacctgcctcaatcgtacttaaaaaaaaaattactgtccttgttttacagtttggtttaactttataatctgctaatctaatctataatagttcatagtctctcaaaactatgcctgctaaggtcatctaaacataataaaatctcctttaatggcattttcactaaaaattataccacaggatgtattgttatgatgctgacatgtatacatgcaactttttaagctagttcaaggattctggaa

SEQ ID NO: 314511 - DNA, 3865 bp, Homo sapiens
acgcgagatccgcgctcgccgccgcccgcccaggcggcgatgacacggcgcccgcggcggcccggaggcgccgggtgggccgtttgctgaccggatcgcggctacccgccagcgtgtccgcggcgccgccgccagcatgggctgtgccccgagcatccacatttccgagcgcctggtggccgaggacgcgcctagccccgcggcaccgccgctgtcgtccggcgggccgcgcctcccgcagggccagaagacggccgccttgccccggacccgcggcgccggcctcttggagtcggagcttcgcgacggcagcggcaagaaggtagcagtagctgatgtgcagtttggccccatgagatttcatcaagatcaacttcaggtacttttagtgtttaccaaagaagataaccaatgtaatggattctgcagggcatgtgaaaaagcagggtttaagtgtacagttaccaaggaggctcaggctgtccttgcctgtttcctggacaaacatcatgacattatcatcatagaccacagaaatcctcgacagctggatgcagaggcactgtgcaggtctatcagatcatcaaaactctcagaaaacacagttattgttggtgtagtacgcagggtggatagagaagagttgtccgtaatgcctttcatttctgctggatttacaaggaggtatgtagaaaaccccaacatcatggcctgctacaatgaactgctccagctggagtttggagaggtgcgatcacaactgaaactcagggcttgtaactcagtattcactgcattagaaaacagtgaagatgcaattgaaattacaagcgaagaccgttttatacagtatgcaaatcctgcatttgaaacaacaatgggctatcagtcaggtgaattaatagggaaggagttaggagaagtgcctataaatgaaaaaaaggctgacttgctcgatactataaattcatgcatcaggataggcaaggagtggcaaggaatttactatgccaaaaagaaaaacggagataatatacaacaaaatgtgaagataatacctgtcattggacagggaggaaaaattagacactatgtgtccattatcagagtgtgcaatggcaacaataaggctgagaaaatatccgaatgtgttcagtctgacactcatacagataatcagacaggcaaacataaagacaggagaaaaggctcactagacgtcaaagctgttgcctcccgtgcaactgaagtttccagccagagacgacactcttccatggcccggatacattccatgacaattgaggcgcccatcaccaaggtaatcaatattatcaatgctgcccaggaaagtagtcccatgcctgtgacagaagccctagaccgtgtgctggaaattctaagaaccactgagttatattcaccacagtttggtgctaaagatgatgatccccatgccaatgaccttgttgggggcttaatgtctgatggtttgcgaagactatcagggaatgaatatgttctttcaacaaaaaacactcaaatggtttcaagcaatataatcactcccatctcccttgatgatgtcccaccacggatagctcgggccatggaaaatgaggaatactgggactttgatatttttgaactggaggctgccacccacaataggcctttgatttatcttggtctcaaaatgtttgctcgctttggaatctgtgaattcttacactgctccgagtcaacgctaagatcatggttacaaattatcgaagccaattatcattcctccaatccctaccacaattctacacattctgctgatgtgcttcatgccactgcctattttctctccaaggagaggataaaggaaactttagatccaattgatgaggtcgctgcactcatcgcagccaccattcatgatgtggatcaccctgggagaaccaactccttcctgtgtaatgctggaagtgagctggccattttgtacaatgacactgctgtgctggagagccaccatgcggccttggccttccagctgaccactggagatgataaatgcaatatatttaaaaacatggagaggaatgattatcggacactgcgccaggggattatcgacatggtcttagccacagaaatgacaaagcactttgagcatgtcaacaaatttgtcaacagcatcaacaaacccttggcaacactagaagaaaatggggaaactgataaaaaccaggaagtgataaacactatgcttaggactccagagaaccggaccctaatcaaacgaatgctgattaaatgtgctgatgtgtccaatccctgccgacccctgcagtactgcatcgagtgggctgcacgcatttcggaagaatatttttctcagactgatgaagagaagcagcagggcttacctgtggtgatgccagtgtttgacagaaatacctgcagcatccccaaatcccaaatctctttcattgattacttcatcacagacatgtttgatgcttgggatgcctttgtagacctgcctgatttaatgcagcatcttgacaacaactttaaatactggaaaggactggacgaaatgaagctgcggaacctccgaccacctcctgaatagtgggagacaccacccagagccctgaagctttgttccttcggtcatttggaattcctgagggcagccagagctccttggtcctttcagtactaggcagaacagcccccgatctgcatagcctgtgaaagcccacggggacatcagtaaccttctgcagccaccatccaatgccattactgtcaagtgagacttggccactgtagcctgggcctgctgcaggagctcttcagaaaggcacatgaggaccacggtttgcctcagtttctggtaaaacacaaggtctggagtgcccctgcaaagggtattgatggacttcctgccagtgacagagcatgtctattgcaaacaattctctcagttacgttcagcacttaagaacggctaatggcaataggatctttagcaactttttcacatcatagaaggtgcaatcgctcacttgggaacactactgagagtgacttctcttttaaaattgagtagcagatgaaaaattaaaatttgaacttgattattaatatcaattaaaatgttttatttattttattaaaagctcaatattttctatgaattcaaaaatacttcagagccaaagccaacttcaaataccgtgaccaaatttacatgattcatattcattatgcattacttggtatacagacttattttcataatgcaaattaataaaatgacacttttactgcactatagaaatattcatgtatgttaaacttttctgattgaggctaactggaaaaagctggggtcgtattctaagtgctaaagaaggctgcttctactgtatagaacccagggctctgaaacagctctagccgcctaatgcacttcacaggtaactccccaaggtaaaactagactctcttgttggttcgcaaagaaaagttaggacttaacacttttttctaaaattttataattcaatttccaaaagtctactctattttatactgtttctacaaaatattccttataaaaacaaagaacaaaaattgaatatttaatgaattgacattttataaccaacctgtttttatctacggtgggaatctttgatgccagaaatttataaagaggttctgtatcttcacaccttgaataagcataataccataaaaaatgacacttgacatgtcaatgtatttgtcatttcattttaaactcgtatttgtggtttttttcccagataaaaatgaaattaaaccatttctttttaagaaa

SEQ ID NO: 314512 - DNA, 3348 bp, Homo sapiens
gaagccttcacacatcccagaagggcctcaagccatttagttcacctcagaagccggtagtggccacataatggtcccttctggcccccagtctggctattcttcccctcccaaacacaggggcagaggctaagccccctcttccacttcagcaggtgggagttatgagaggaggaagtaagggggagtgccctttatttgggggtccaggacccctcttgtctgcagatggccactgaaaatatatgaccacttagactatggtgacctgacttttgtcagcaactcagaaggaggtggactttggaagttaagaaagaattgtcctattacctgaaatcagtttggggttgggatcattttttatcttaattgctttagcaatgtaagtgaatcagaactgaagtggaaaatgttcttgggtttatgttttcaacacaaagtatgacgatgcttacattccatttataggagtggcaaggaatttactatgccaaaaagaaaaacggagataatatacaacaaaatgtgaagataatacctgtcattggacagggaggaaaaattagacactatgtgtccattatcagagtgtgcaatggcaacaataaggctgagaaaatatccgaatgtgttcagtctgacactcatacagataatcagacaggcaaacataaagacaggagaaaaggctcactagacgtcaaagctgttgcctcccgtgcaactgaagtttccagccagagacgacactcttccatggcccggatacattccatgacaattgaggcgcccatcaccaaggtaatcaatattatcaatgctgcccaggaaagtagtcccatgcctgtgacagaagccctagaccgtgtgctggaaattctaagaaccactgagttatattcaccacagtttggtgctaaagatgatgatccccatgccaatgaccttgttgggggcttaatgtctgatggtttgcgaagactatcagggaatgaatatgttctttcaacaaaaaacactcaaatggtttcaagcaatataatcactcccatctcccttgatgatgtcccaccacggatagctcgggccatggaaaatgaggaatactgggactttgatatttttgaactggaggctgccacccacaataggcctttgatttatcttggtctcaaaatgtttgctcgctttggaatctgtgaattcttacactgctccgagtcaacgctaagatcatggttacaaattatcgaagccaattatcattcctccaatccctaccacaattctacacattctgctgatgtgcttcatgccactgcctattttctctccaaggagaggataaaggaaactttagatccaattgatgaggtcgctgcactcatcgcagccaccattcatgatgtggatcaccctgggagaaccaactccttcctgtgtaatgctggaagtgagctggccattttgtacaatgacactgctgtgctggagagccaccatgcggccttggccttccagctgaccactggagatgataaatgcaatatatttaaaaacatggagaggaatgattatcggacactgcgccaggggattatcgacatggtcttagccacagaaatgacaaagcactttgagcatgtcaacaaatttgtcaacagcatcaacaaacccttggcaacactagaagaaaatggggaaactgataaaaaccaggaagtgataaacactatgcttaggactccagagaaccggaccctaatcaaacgaatgctgattaaatgtgctgatgtgtccaatccctgccgacccctgcagtactgcatcgagtgggctgcacgcatttcggaagaatatttttctcagactgatgaagagaagcagcagggcttacctgtggtgatgccagtgtttgacagaaatacctgcagcatccccaaatcccaaatctctttcattgattacttcatcacagacatgtttgatgcttgggatgcctttgtagacctgcctgatttaatgcagcatcttgacaacaactttaaatactggaaaggactggacgaaatgaagctgcggaacctccgaccacctcctgaatagtgggagacaccacccagagccctgaagctttgttccttcggtcatttggaattcctgagggcagccagagctccttggtcctttcagtactaggcagaacagcccccgatctgcatagcctgtgaaagcccacggggacatcagtaaccttctgcagccaccatccaatgccattactgtcaagtgagacttggccactgtagcctgggcctgctgcaggagctcttcagaaaggcacatgaggaccacggtttgcctcagtttctggtaaaacacaaggtctggagtgcccctgcaaagggtattgatggacttcctgccagtgacagagcatgtctattgcaaacaattctctcagttacgttcagcacttaagaacggctaatggcaataggatctttagcaactttttcacatcatagaaggtgcaatcgctcacttgggaacactactgagagtgacttctcttttaaaattgagtagcagatgaaaaattaaaatttgaacttgattattaatatcaattaaaatgttttatttattttattaaaagctcaatattttctatgaattcaaaaatacttcagagccaaagccaacttcaaataccgtgaccaaatttacatgattcatattcattatgcattacttggtatacagacttattttcataatgcaaattaataaaatgacacttttactgcactatagaaatattcatgtatgttaaacttttctgattgaggctaactggaaaaagctggggtcgtattctaagtgctaaagaaggctgcttctactgtatagaacccagggctctgaaacagctctagccgcctaatgcacttcacaggtaactccccaaggtaaaactagactctcttgttggttcgcaaagaaaagttaggacttaacacttttttctaaaattttataattcaatttccaaaagtctactctattttatactgtttctacaaaatattccttataaaaacaaagaacaaaaattgaatatttaatgaattgacattttataaccaacctgtttttatctacggtgggaatctttgatgccagaaatttataaagaggttctgtatcttcacaccttgaataagcataataccataaaaaatgacacttgacatgtcaatgtatttgtcatttcattttaaactcgtatttgtggtttttttcccagataaaaatgaaattaaaccatttctttttaagaaa

SEQ ID NO: 314513 - DNA, 2180 bp, Homo sapiens
aagggttgttgatgctgttgacaaatttgttgacatgctcaaagtgcttgtcatttctgtggctaagatcatggttacaaattatcgaagccaattatcattcctccaatccctaccacaattctacacattctgctgatgtgcttcatgccactgcctattttctctccaaggagaggataaaggaaactttagatccaattgatgaggtcgctgcactcatcgcagccaccattcatgatgtggatcaccctgggagaaccaactccttcctgtgtaatgctggaagtgagctggccattttgtacaatgacactgctgtgctggagagccaccatgcggccttggccttccagctgaccactggagatgataaatgcaatatatttaaaaacatggagaggaatgattatcggacactgcgccaggggattatcgacatggtcttagccacagaaatgacaaagcactttgagcatgtcaacaaatttgtcaacagcatcaacaaacccttggcaacactagaagaaaatggggaaactgataaaaaccaggaagtgataaacactatgcttaggactccagagaaccggaccctaatcaaacgaatgctgattaaatgtgctgatgtgtccaatccctgccgacccctgcagtactgcatcgagtgggctgcacgcatttcggaagaatatttttctcagactgatgaagagaagcagcagggcttacctgtggtgatgccagtgtttgacagaaatacctgcagcatccccaaatcccaaatctctttcattgattacttcatcacagacatgtttgatgcttgggatgcctttgtagacctgcctgatttaatgcagcatcttgacaacaactttaaatactggaaaggactggacgaaatgaagctgcggaacctccgaccacctcctgaatagtgggagacaccacccagagccctgaagctttgttccttcggtcatttggaattcctgagggcagccagagctccttggtcctttcagtactaggcagaacagcccccgatctgcatagcctgtgaaagcccacggggacatcagtaaccttctgcagccaccatccaatgccattactgtcaagtgagacttggccactgtagcctgggcctgctgcaggagctcttcagaaaggcacatgaggaccacggtttgcctcagtttctggtaaaacacaaggtctggagtgcccctgcaaagggtattgatggacttcctgccagtgacagagcatgtctattgcaaacaattctctcagttacgttcagcacttaagaacggctaatggcaataggatctttagcaactttttcacatcatagaaggtgcaatcgctcacttgggaacactactgagagtgacttctcttttaaaattgagtagcagatgaaaaattaaaatttgaacttgattattaatatcaattaaaatgttttatttattttattaaaagctcaatattttctatgaattcaaaaatacttcagagccaaagccaacttcaaataccgtgaccaaatttacatgattcatattcattatgcattacttggtatacagacttattttcataatgcaaattaataaaatgacacttttactgcactatagaaatattcatgtatgttaaacttttctgattgaggctaactggaaaaagctggggtcgtattctaagtgctaaagaaggctgcttctactgtatagaacccagggctctgaaacagctctagccgcctaatgcacttcacaggtaactccccaaggtaaaactagactctcttgttggttcgcaaagaaaagttaggacttaacacttttttctaaaattttataattcaatttccaaaagtctactctattttatactgtttctacaaaatattccttataaaaacaaagaacaaaaattgaatatttaatgaattgacattttataaccaacctgtttttatctacggtgggaatctttgatgccagaaatttataaagaggttctgtatcttcacaccttgaataagcataataccataaaaaatgacacttgacatgtcaatgtatttgtcatttcattttaaactcgtatttgtggtttttttcccagataaaaatgaaattaaaccatttctttttaagaaa

SEQ ID NO: 314514 - DNA, 1806 bp, Homo sapiens
cactgggtaatctgtttgttttgtttgtatcgtttgttttttgagacaggtcccgttactgtcgacatggtcttagccacagaaatgacaaagcactttgagcatgtcaacaaatttgtcaacagcatcaacaaacccttggcaacactagaagaaaatggggaaactgataaaaaccaggaagtgataaacactatgcttaggactccagagaaccggaccctaatcaaacgaatgctgattaaatgtgctgatgtgtccaatccctgccgacccctgcagtactgcatcgagtgggctgcacgcatttcggaagaatatttttctcagactgatgaagagaagcagcagggcttacctgtggtgatgccagtgtttgacagaaatacctgcagcatccccaaatcccaaatctctttcattgattacttcatcacagacatgtttgatgcttgggatgcctttgtagacctgcctgatttaatgcagcatcttgacaacaactttaaatactggaaaggactggacgaaatgaagctgcggaacctccgaccacctcctgaatagtgggagacaccacccagagccctgaagctttgttccttcggtcatttggaattcctgagggcagccagagctccttggtcctttcagtactaggcagaacagcccccgatctgcatagcctgtgaaagcccacggggacatcagtaaccttctgcagccaccatccaatgccattactgtcaagtgagacttggccactgtagcctgggcctgctgcaggagctcttcagaaaggcacatgaggaccacggtttgcctcagtttctggtaaaacacaaggtctggagtgcccctgcaaagggtattgatggacttcctgccagtgacagagcatgtctattgcaaacaattctctcagttacgttcagcacttaagaacggctaatggcaataggatctttagcaactttttcacatcatagaaggtgcaatcgctcacttgggaacactactgagagtgacttctcttttaaaattgagtagcagatgaaaaattaaaatttgaacttgattattaatatcaattaaaatgttttatttattttattaaaagctcaatattttctatgaattcaaaaatacttcagagccaaagccaacttcaaataccgtgaccaaatttacatgattcatattcattatgcattacttggtatacagacttattttcataatgcaaattaataaaatgacacttttactgcactatagaaatattcatgtatgttaaacttttctgattgaggctaactggaaaaagctggggtcgtattctaagtgctaaagaaggctgcttctactgtatagaacccagggctctgaaacagctctagccgcctaatgcacttcacaggtaactccccaaggtaaaactagactctcttgttggttcgcaaagaaaagttaggacttaacacttttttctaaaattttataattcaatttccaaaagtctactctattttatactgtttctacaaaatattccttataaaaacaaagaacaaaaattgaatatttaatgaattgacattttataaccaacctgtttttatctacggtgggaatctttgatgccagaaatttataaagaggttctgtatcttcacaccttgaataagcataataccataaaaaatgacacttgacatgtcaatgtatttgtcatttcattttaaactcgtatttgtggtttttttcccagataaaaatgaaattaaaccatttctttttaagaaa

SEQ ID NO: 314515 - DNA, 1808 bp, Homo sapiens
tttctttaggtcaatacgaacaacagagcggtggctgactacacataatgtttgggatcttacctgaagagcttctgcaaggaggcttccagatgtttaaagtttggcttgagttggggtgtcctcagaccccactgacatggagtagtcctcattctgagaacttggtatctgttatgagacatggtttggctgcgtgaggtggtgattggcttctcaccatgacaagccaccttaggctgccaggagaagctcttcctgggggaggggctgcccctaggtggagtggaaccagatgttggggtctcctgatcacattttctgctttacagactgatgaagagaagcagcagggcttacctgtggtgatgccagtgtttgacagaaatacctgcagcatccccaaatcccaaatctctttcattgattacttcatcacagacatgtttgatgcttgggatgcctttgtagacctgcctgatttaatgcagcatcttgacaacaactttaaatactggaaaggactggacgaaatgaagctgcggaacctccgaccacctcctgaatagtgggagacaccacccagagccctgaagctttgttccttcggtcatttggaattcctgagggcagccagagctccttggtcctttcagtactaggcagaacagcccccgatctgcatagcctgtgaaagcccacggggacatcagtaaccttctgcagccaccatccaatgccattactgtcaagtgagacttggccactgtagcctgggcctgctgcaggagctcttcagaaaggcacatgaggaccacggtttgcctcagtttctggtaaaacacaaggtctggagtgcccctgcaaagggtattgatggacttcctgccagtgacagagcatgtctattgcaaacaattctctcagttacgttcagcacttaagaacggctaatggcaataggatctttagcaactttttcacatcatagaaggtgcaatcgctcacttgggaacactactgagagtgacttctcttttaaaattgagtagcagatgaaaaattaaaatttgaacttgattattaatatcaattaaaatgttttatttattttattaaaagctcaatattttctatgaattcaaaaatacttcagagccaaagccaacttcaaataccgtgaccaaatttacatgattcatattcattatgcattacttggtatacagacttattttcataatgcaaattaataaaatgacacttttactgcactatagaaatattcatgtatgttaaacttttctgattgaggctaactggaaaaagctggggtcgtattctaagtgctaaagaaggctgcttctactgtatagaacccagggctctgaaacagctctagccgcctaatgcacttcacaggtaactccccaaggtaaaactagactctcttgttggttcgcaaagaaaagttaggacttaacacttttttctaaaattttataattcaatttccaaaagtctactctattttatactgtttctacaaaatattccttataaaaacaaagaacaaaaattgaatatttaatgaattgacattttataaccaacctgtttttatctacggtgggaatctttgatgccagaaatttataaagaggttctgtatcttcacaccttgaataagcataataccataaaaaatgacacttgacatgtcaatgtatttgtcatttcattttaaactcgtatttgtggtttttttcccagataaaaatgaaattaaaccatttctttttaagaaa

SEQ ID NO: 314516 - DNA, 2273 bp, Homo sapiens
tagatgacgggcacgaggacttggggccccacagcttgtagtagagcagctagggttcaaaaccaatcgtgctggctccaaaacccatggtgtttctacagcagccctttgccctccactgtcccctgcttctcccagcctcactctacacaagaccagaaggactggtctgtctctgactgatgcatgtcaccctcctttaacttcaggtggggcacaggagtctgtcaaataaaagaatatcggagaactgatattccacgtgcatcttcgtcctgagggctgcaccttgaaggaggggctacagggctgataaatgtccagatccagtcaggaaataaacccatgtctcaagaaggccgtagaacaggggtaggcggctggggagaaggactgaagcagtggagctagatagctgcagctttgggggacactgcatactctgcagctcactgcttctgggactgagaccagacgcgtgtgtccccaggctgcacgttcttcatgtggtgcaggtgaaaggagatgctggtgtatgtgaagcatgcgtgaagggacagtgagcacacaagggccaggccatcggttggggccggggggcaggggcacactacatactgctttctgacaccccaggcccaaaggtgctgctggtttaatggtaattaagcagattagccaccttctgttttatttaccacagttaccagctcagcaggtggtcacagaggaggtgctggcattgaggacagggtttaacttcagtcagccacggctcgttgaagctgctgggtgtgtttgcccgggtctgtttagcctcacgcagatgcctgctcccatctgtcactctttaaaatgctcttagtgaaagcctaaaatgtaaacagaggctgtgaaagcatatcacattcctatctttctctccagcctttgtagacctgcctgatttaatgcagcatcttgacaacaactttaaatactggaaaggactggacgaaatgaagctgcggaacctccgaccacctcctgaatagtgggagacaccacccagagccctgaagctttgttccttcggtcatttggaattcctgagggcagccagagctccttggtcctttcagtactaggcagaacagcccccgatctgcatagcctgtgaaagcccacggggacatcagtaaccttctgcagccaccatccaatgccattactgtcaagtgagacttggccactgtagcctgggcctgctgcaggagctcttcagaaaggcacatgaggaccacggtttgcctcagtttctggtaaaacacaaggtctggagtgcccctgcaaagggtattgatggacttcctgccagtgacagagcatgtctattgcaaacaattctctcagttacgttcagcacttaagaacggctaatggcaataggatctttagcaactttttcacatcatagaaggtgcaatcgctcacttgggaacactactgagagtgacttctcttttaaaattgagtagcagatgaaaaattaaaatttgaacttgattattaatatcaattaaaatgttttatttattttattaaaagctcaatattttctatgaattcaaaaatacttcagagccaaagccaacttcaaataccgtgaccaaatttacatgattcatattcattatgcattacttggtatacagacttattttcataatgcaaattaataaaatgacacttttactgcactatagaaatattcatgtatgttaaacttttctgattgaggctaactggaaaaagctggggtcgtattctaagtgctaaagaaggctgcttctactgtatagaacccagggctctgaaacagctctagccgcctaatgcacttcacaggtaactccccaaggtaaaactagactctcttgttggttcgcaaagaaaagttaggacttaacacttttttctaaaattttataattcaatttccaaaagtctactctattttatactgtttctacaaaatattccttataaaaacaaagaacaaaaattgaatatttaatgaattgacattttataaccaacctgtttttatctacggtgggaatctttgatgccagaaatttataaagaggttctgtatcttcacaccttgaataagcataataccataaaaaatgacacttgacatgtcaatgtatttgtcatttcattttaaactcgtatttgtggtttttttcccagataaaaatgaaattaaaccatttctttttaagaaa

SEQ ID NO: 314517 - DNA, 3329 bp, Homo sapiens
acgcgagatccgcgctcgccgccgcccgcccaggcggcgatgacacggcgcccgcggcggcccggaggcgccgggtgggccgtttgctgaccggatcgcggctacccgccagcgtgtccgcggcgccgccgccagcatgggctgtgccccgagcatccacatttccgagcgcctggtggccgaggacgcgcctagccccgcggcaccgccgctgtcgtccggcgggccgcgcctcccgcagggccagaagacggccgccttgccccggacccgcggcgccggcctcttggagtcggagcttcgcgacggcagcggcaagaaggtagcagtagctgatgtgcagtttggccccatgagatttcatcaagatcaacttcaggtacttttagtgtttaccaaagaagataaccaatgtaatggattctgcagggcatgtgaaaaagcagggtttaagtgtacagttaccaaggaggctcaggctgtccttgcctgtttcctggacaaacatcatgacattatcatcatagaccacagaaatcctcgacagctggatgcagaggcactgtgcaggtctatcagatcatcaaaactctcagaaaacacagttattgttggtgtagtacgcagggtggatagagaagagttgtccgtaatgcctttcatttctgctggatttacaaggaggtatgtagaaaaccccaacatcatggcctgctacaatgaactgctccagctggagtttggagaggtgcgatcacaactgaaactcagggcttgtaactcagtattcactgcattagaaaacagtgaagatgcaattgaaattacaagcgaagaccgttttatacagtatgcaaatcctgcatttgaaacaacaatgggctatcagtcaggtgaattaatagggaaggagttaggagaagtgcctataaatgaaaaaaaggctgacttgctcgatactataaattcatgcatcaggataggcaaggagtggcaaggaatttactatgccaaaaagaaaaacggagataatatacaacaaaatgtgaagataatacctgtcattggacagggaggaaaaattagacactatgtgtccattatcagagtgtgcaatggcaacaataaggctgagaaaatatccgaatgtgttcagtctgacactcatacagataatcagacaggcaaacataaagacaggagaaaaggctcactagacgtcaaagctgttgcctcccgtgcaactgaagtttccagccagagacgacactcttccatggcccggatacattccatgacaattgaggcgcccatcaccaaggtaatcaatattatcaatgctgcccaggaaagtagtcccatgcctgtgacagaagccctagaccgtgtgctggaaattctaagaaccactgagttatattcaccacagtttggtgctaaagatgatgatccccatgccaatgaccttgttgggggcttaatgtctgatggtttgcgaagactatcagggaatgaatatgttctttcaacaaaaaacactcaaatggtttcaagcaatataatcactcccatctcccttgatgatgtcccaccacggatagctcgggccatggaaaatgaggaatactgggactttgatatttttgaactggaggctgccacccacaataggcctttgatttatcttggtctcaaaatgtttgctcgctttggaatctgtgaattcttacactgctccgagtcaacgctaagatcatggttacaaattatcgaagccaattatcattcctccaatccctaccacaattctacacattctgctgatgtgcttcatgccactgcctattttctctccaaggagaggataaaggaaactttagatccaattgatgaggtcgctgcactcatcgcagccaccattcatgatgtggatcaccctgggagaaccaactccttcctgtgtaatgctggaagtgagctggccattttgtacaatgacactgctgtgctggagagccaccatgcggccttggccttccagctgaccactggagatgataaatgcaatatatttaaaaacatggagaggaatgattatcggacactgcgccaggggattatcgacatggtcttagccacagaaatgacaaagcactttgagcatgtcaacaaatttgtcaacagcatcaacaaacccttggcaacactagaagaaaatggggaaactgataaaaaccaggaagtgataaacactatgcttaggactccagagaaccggaccctaatcaaacgaatgctgattaaatgtgctgatgtgtccaatccctgccgacccctgcagtactgcatcgagtgggctgcacgcatttcggaagaatatttttctcagactgatgaagagaagcagcagggcttacctgtggtgatgccagtgtttgacagaaatacctgcagcatccccaaatcccaaatctctttcattgattacttcatcacagacatgtttgatgcttgggatgcctttgtagacctgcctgatttaatgcagcatcttgacaacaactttaaatactggaaaggactggacgaaatgaagctgcggaacctccgaccacctcctgaatagtgggagacaccacccagagccctgaagctttgttccttcggtcatttggaattcctgagggcagccagagctccttggtcctttcagtactaggcagaacagcccccgatctgcatagcctgtgaaagcccacggggacatcagtaaccttctgcagccaccatccaatgccattactgtcaagtgagacttggccactgtagcctgggcctgctgcaggagctcttcagaaaggcacatgaggaccacggtttgcctcagtttctggtaaaacacaaggtctggagtgcccctgcaaagggtattgatggacttcctgccagtgacagagcatgtctattgcaaacaattctctcagttacgttcagcacttaagaacggctaatggcaataggatctttagcaactttttcacatcatagaaggtgcaatcgctcacttgggaacactactgagagtgacttctcttttaaaattgagtagcagatgaaaaattaaaatttgaacttgattattaatatcaattaaaatgttttatttattttattaaaagctcaatattttctatgaattcaaaaatacttcagagccaaagccaacttcaaataccgtgaccaaatttacatgattcatattcattatgcattacttggtatacagacttattttcataatgcaaattaataaaatgacacttttactg

SEQ ID NO: 314518 - DNA, 2408 bp, Homo sapiens
acgcgagatccgcgctcgccgccgcccgcccaggcggcgatgacacggcgcccgcggcggcccggaggcgccgggtgggccgtttgctgaccggatcgcggctacccgccagcgtgtccgcggcgccgccgccagcatgggctgtgccccgagcatccacatttccgagcgcctggtggccgaggacgcgcctagccccgcggcaccgccgctgtcgtccggcgggccgcgcctcccgcagggccagaagacggccgccttgccccggacccgcggcgccggcctcttggagtcggagcttcgcgacggcagcggcaagaaggtagcagtagctgatgtgcagtttggccccatgagatttcatcaagatcaacttcaggtacttttagtgtttaccaaagaagataaccaatgtaatggattctgcagggcatgtgaaaaagcagggtttaagtgtacagttaccaaggaggctcaggctgtccttgcctgtttcctggacaaacatcatgacattatcatcatagaccacagaaatcctcgacagctggatgcagaggcactgtgcaggtctatcagatcatcaaaactctcagaaaacacagttattgttggtgtagtacgcagggtggatagagaagagttgtccgtaatgcctttcatttctgctggatttacaaggaggtatgtagaaaaccccaacatcatggcctgctacaatgaactgctccagctggagtttggagaggtgcgatcacaactgaaactcagggcttgtaactcagtattcactgcattagaaaacagtgaagatgcaattgaaattacaagcgaagaccgttttatacagtatgcaaatcctgcatttgaaacaacaatgggctatcagtcaggtgaattaatagggaaggagttaggagaagtgcctataaatgaaaaaaaggctgacttgctcgatactataaattcatgcatcaggataggcaaggagtggcaaggaatttactatgccaaaaagaaaaacggagataatatacaacaaaatgtgaagataatacctgtcattggacagggaggaaaaattagacactatgtgtccattatcagagtgtgcaatggcaacaataaggctgagaaaatatccgaatgtgttcagtctgacactcatacagataatcagacaggcaaacataaagacaggagaaaaggctcactagacgtcaaagctgttgcctcccgtgcaactgaagtttccagccagagacgacactcttccatggcccggatacattccatgacaattgaggcgcccatcaccaaggtaatcaatattatcaatgctgcccaggaaagtagtcccatgcctgtgacagaagccctagaccgtgtgctggaaattctaagaaccactgagttatattcaccacagtttggtgctaaagatgatgatccccatgccaatgaccttgttgggggcttaatgtctgatggtttgcgaagactatcagggaatgaatatgttctttcaacaaaaaacactcaaatggtttcaagcaatataatcactcccatctcccttgatgatgtcccaccacggatagctcgggccatggaaaatgaggaatactgggactttgatatttttgaactggaggctgccacccacaataggcctttgatttatcttggtctcaaaatgtttgctcgctttggaatctgtgaattcttacactgctccgagtcaacgctaagatcatggttacaaattatcgaagccaattatcattcctccaatccctaccacaattctacacattctgctgatgtgcttcatgccactgcctattttctctccaaggagaggataaaggtgagctgttgtttacctgccacatttaatgggcaggagcagtggggagagtctagtgcttctgcctccactaagatacatagcatgactgctcacgtgtgcagcctggcacaggaagggcaaggtcatacgaggaatcaggcaggaggccacattagctttgggaaattgatgtgttaattcatgacataatcccagctattccatgagggtacaagaggcagaatttggtcccggaggagaaacctaacaaggacaggatagggctattcttctgggggtctcactccaagcctgtacactagtagagccaagtaactgttggatatccccactttagggcctccatctgtacatgaaagtctgcagggctctaaggtcaggttcatcatctctgttcccagcactgctcccacccagggttatctacctaatccagggttccattatccaaccggatacccagattagaaaccgagagtcatccttggttctttccactcctcaaccccccacatctggttgatcatctgacctt

SEQ ID NO: 314519 - DNA, 1923 bp, Homo sapiens
acgcgagatccgcgctcgccgccgcccgcccaggcggcgatgacacggcgcccgcggcggcccggaggcgccgggtgggccgtttgctgaccggatcgcggctacccgccagcgtgtccgcggcgccgccgccagcatgggctgtgccccgagcatccacatttccgagcgcctggtggccgaggacgcgcctagccccgcggcaccgccgctgtcgtccggcgggccgcgcctcccgcagggccagaagacggccgccttgccccggacccgcggcgccggcctcttggagtcggagcttcgcgacggcagcggcaagaaggtagcagtagctgatgtgcagtttggccccatgagatttcatcaagatcaacttcaggtacttttagtgtttaccaaagaagataaccaatgtaatggattctgcagggcatgtgaaaaagcagggtttaagtgtacagttaccaaggaggctcaggctgtccttgcctgtttcctggacaaacatcatgacattatcatcatagaccacagaaatcctcgacagctggatgcagaggcactgtgcaggtctatcagatcatcaaaactctcagaaaacacagttattgttggtgtagtacgcagggtggatagagaagagttgtccgtaatgcctttcatttctgctggatttacaaggaggtatgtagaaaaccccaacatcatggcctgctacaatgaactgctccagctggagtttggagaggtgcgatcacaactgaaactcagggcttgtaactcagtattcactgcattagaaaacagtgaagatgcaattgaaattacaagcgaagaccgttttatacagtatgcaaatcctgcatttgaaacaacaatgggctatcagtcaggtgaattaatagggaaggagttaggagaagtgcctataaatgaaaaaaaggctgacttgctcgatactataaattcatgcatcaggataggcaaggagtggcaaggaatttactatgccaaaaagaaaaacggagataatatacaacaaaatgtgaagataatacctgtcattggacagggaggaaaaattagacactatgtgtccattatcagagtgtgcaatggcaacaataaggctgagaaaatatccgaatgtgttcagtctgacactcatacagataatcagacaggcaaacataaagacaggagaaaaggctcactagacgtcaaagctgttgcctcccgtgcaactgaagtttccagccagagacgacactcttccatggcccggatacattccatgacaattgaggcgcccatcaccaaggtaatcaatattatcaatgctgcccaggaaagtagtcccatgcctgtgacagaagccctagaccgtgtgctggaaattctaagaaccactgagttatattcaccacagtttggtgctaaagatgatgatccccatgccaatgaccttgttgggggcttaatgtctgatggtttgcgaagactatcagggaatgaatatgttctttcaacaaaaaacactcaaatggtttcaagcaatataatcactcccatctcccttgatgatgtcccaccacggatagctcgggccatggaaaatgaggaatactgggactttgatatttttgaactggaggctgccacccacaataggcctttgatttatcttggtctcaaaatgtttgctcgctttggaatctgtgaattcttacactgctccgagtcaacgctaagatcatggttacaaattatcgaagccaattatcattcctccaatccctaccacaattctacacattctgctgatgtgcttcatgccactgcctattttctctccaaggagaggataaaggaaactttagatccaattgatgtggctcgctgctacgggatcctctaagtcac

SEQ ID NO: 314520 - DNA, 1307 bp, Homo sapiens
acgcgagatccgcgctcgccgccgcccgcccaggcggcgatgacacggcgcccgcggcggcccggaggcgccgggtgggccgtttgctgaccggatcgcggctacccgccagcgtgtccgcggcgccgccgccagcatgggctgtgccccgagcatccacatttccgagcgcctggtggccgaggacgcgcctagccccgcggcaccgccgctgtcgtccggcgggccgcgcctcccgcagggccagaagacggccgccttgccccggacccgcggcgccggcctcttggagtcggagcttcgcgacggcagcggcaagaaggtagcagtagctgatgtgcagtttggccccatgagatttcatcaagatcaacttcaggtacttttagtgtttaccaaagaagataaccaatgtaatggattctgcagggcatgtgaaaaagcagggtttaagtgtacagttaccaaggaggctcaggctgtccttgcctgtttcctggacaaacatcatgacattatcatcatagaccacagaaatcctcgacagctggatgcagaggcactgtgcaggtctatcagatcatcaaaactctcagaaaacacagttattgttggtgtagtacgcagggtggatagagaagagttgtccgtaatgcctttcatttctgctggatttacaaggaggtatgtagaaaaccccaacatcatggcctgctacaatgaactgctccagctggagtttggagaggtgcgatcacaactgaaactcagggcttgtaactcagtattcactgcattagaaaacagtgaagatgcaattgaaattacaagcgaagaccgttttatacagtatgcaaatcctgcatttgaaacaacaatgggctatcagtcaggtgaattaatagggaaggagttaggagaagtgcctataaatgaaaaaaaggctgacttgctcgatactataaattcatgcatcaggataggcaaggagtggcaaggaatttactatgccaaaaagaaaaacggagataatatacaacaaaatgtgaagataatacctgtcattggacagggaggaaaaattagacactatgtgtccattatcagagtgtgcaatggcaacaataaggctgagaaaatatccgaatgtgttcagtctgacactcatacagataatcagacaggcaaacataaagacaggagaaaaggctcactagacgtcaaagctgttgcctcccgtgcaactgaagtttccagccagaggcgacacttttccatggcccgagctatccgtggtgggtcatcat

SEQ ID NO: 314521 - DNA, 431 bp, Homo sapiens
atctgattcatctaaaagtactcattacataacgaagtattatttaaattagtagagtaaaagaggtgagatgtaattgataaaaactatgtctatgttctttactgtgttattttgaagggtggatagagaagagttgtccgtaatgcctttcatttctgctggatttacaagggtatgtactcacttatttgttatacaagtataattcaatttgagaaattattttatctcagttcagtacccagcaaaagctttgtattaatttgaagaaaaaaaattgtctggccaggcgtggtggctcatacctgtaatcccagcactttgggaggtcgaggtaggaggaccccttgggcccaggagttcaagaccagcctgggcaacataaggagaacctgcctcaatcgtacttaaaaaaaaaattactgtcc

SEQ ID NO: 314522 - DNA, 400 bp, Homo sapiens
acgcgagatccgcgctcgccgccgcccgcccaggcggcgatgacacggcgcccgcggcggcccggaggcgccgggtgggccgtttgctgaccggatcgcggctacccgccagcgtgtccgcggcgccgccgccagcatgggctgtgccccgagcatccacatttccgagcgcctggtggccgaggacgcgcctagccccgcggcaccgccgctgtcgtccggcgggccgcgcctcccgcagggccagaagacggccgccttgccccggacccgcggcgccggcctcttggagtcggagcttcgcgacggcagcggcaagaaggtaaggggcgccgggcactctggggccgccgcgaaactcgggcccggccagtaagcaactttcccgcgagccgggcgg

SEQ ID NO: 314523 - DNA, 3549 bp, Homo sapiens
gcgacccttaagctatccggtcaataaacagtgaggtttaatattttgtttatttcacatgcatggaaagcaacttaaaagacagtgagtctatatttaatctattgctaggcggcatgtgaaaaagcagggtttaagtgtacagttaccaaggaggctcaggctgtccttgcctgtttcctggacaaacatcatgacattatcatcatagaccacagaaatcctcgacagctggatgcagaggcactgtgcaggtctatcagatcatcaaaactctcagaaaacacagttattgttggtgtagtacgcagggtggatagagaagagttgtccgtaatgcctttcatttctgctggatttacaaggaggtatgtagaaaaccccaacatcatggcctgctacaatgaactgctccagctggagtttggagaggtgcgatcacaactgaaactcagggcttgtaactcagtattcactgcattagaaaacagtgaagatgcaattgaaattacaagcgaagaccgttttatacagtatgcaaatcctgcatttgaaacaacaatgggctatcagtcaggtgaattaatagggaaggagttaggagaagtgcctataaatgaaaaaaaggctgacttgctcgatactataaattcatgcatcaggataggcaaggagtggcaaggaatttactatgccaaaaagaaaaacggagataatatacaacaaaatgtgaagataatacctgtcattggacagggaggaaaaattagacactatgtgtccattatcagagtgtgcaatggcaacaataaggctgagaaaatatccgaatgtgttcagtctgacactcatacagataatcagacaggcaaacataaagacaggagaaaaggctcactagacgtcaaagctgttgcctcccgtgcaactgaagtttccagccagagacgacactcttccatggcccggatacattccatgacaattgaggcgcccatcaccaaggtaatcaatattatcaatgctgcccaggaaagtagtcccatgcctgtgacagaagccctagaccgtgtgctggaaattctaagaaccactgagttatattcaccacagtttggtgctaaagatgatgatccccatgccaatgaccttgttgggggcttaatgtctgatggtttgcgaagactatcagggaatgaatatgttctttcaacaaaaaacactcaaatggtttcaagcaatataatcactcccatctcccttgatgatgtcccaccacggatagctcgggccatggaaaatgaggaatactgggactttgatatttttgaactggaggctgccacccacaataggcctttgatttatcttggtctcaaaatgtttgctcgctttggaatctgtgaattcttacactgctccgagtcaacgctaagatcatggttacaaattatcgaagccaattatcattcctccaatccctaccacaattctacacattctgctgatgtgcttcatgccactgcctattttctctccaaggagaggataaaggaaactttagatccaattgatgaggtcgctgcactcatcgcagccaccattcatgatgtggatcaccctgggagaaccaactccttcctgtgtaatgctggaagtgagctggccattttgtacaatgacactgctgtgctggagagccaccatgcggccttggccttccagctgaccactggagatgataaatgcaatatatttaaaaacatggagaggaatgattatcggacactgcgccaggggattatcgacatggtcttagccacagaaatgacaaagcactttgagcatgtcaacaaatttgtcaacagcatcaacaaacccttggcaacactagaagaaaatggggaaactgataaaaaccaggaagtgataaacactatgcttaggactccagagaaccggaccctaatcaaacgaatgctgattaaatgtgctgatgtgtccaatccctgccgacccctgcagtactgcatcgagtgggctgcacgcatttcggaagaatatttttctcagactgatgaagagaagcagcagggcttacctgtggtgatgccagtgtttgacagaaatacctgcagcatccccaaatcccaaatctctttcattgattacttcatcacagacatgtttgatgcttgggatgcctttgtagacctgcctgatttaatgcagcatcttgacaacaactttaaatactggaaaggactggacgaaatgaagctgcggaacctccgaccacctcctgaatagtgggagacaccacccagagccctgaagctttgttccttcggtcatttggaattcctgagggcagccagagctccttggtcctttcagtactaggcagaacagcccccgatctgcatagcctgtgaaagcccacggggacatcagtaaccttctgcagccaccatccaatgccattactgtcaagtgagacttggccactgtagcctgggcctgctgcaggagctcttcagaaaggcacatgaggaccacggtttgcctcagtttctggtaaaacacaaggtctggagtgcccctgcaaagggtattgatggacttcctgccagtgacagagcatgtctattgcaaacaattctctcagttacgttcagcacttaagaacggctaatggcaataggatctttagcaactttttcacatcatagaaggtgcaatcgctcacttgggaacactactgagagtgacttctcttttaaaattgagtagcagatgaaaaattaaaatttgaacttgattattaatatcaattaaaatgttttatttattttattaaaagctcaatattttctatgaattcaaaaatacttcagagccaaagccaacttcaaataccgtgaccaaatttacatgattcatattcattatgcattacttggtatacagacttattttcataatgcaaattaataaaatgacacttttactgcactatagaaatattcatgtatgttaaacttttctgattgaggctaactggaaaaagctggggtcgtattctaagtgctaaagaaggctgcttctactgtatagaacccagggctctgaaacagctctagccgcctaatgcacttcacaggtaactccccaaggtaaaactagactctcttgttggttcgcaaagaaaagttaggacttaacacttttttctaaaattttataattcaatttccaaaagtctactctattttatactgtttctacaaaatattccttataaaaacaaagaacaaaaattgaatatttaatgaattgacattttataaccaacctgtttttatctacggtgggaatctttgatgccagaaatttataaagaggttctgtatcttcacaccttgaataagcataataccataaaaaatgacacttgacatgtcaatgtatttgtcatttcattttaaactcgtatttgtggtttttttcccagataaaaatgaaattaaaccatttctttttaagaaa

SEQ ID NO: 314524 - DNA, 2557 bp, Homo sapiens
gatggacaggtgaattctttagccctttaaggaatttttccatgttacataaaacttttcagagtcttgaaaaagatggaaaacttccagatcattttgtcaaactcacaaaactctgacatcaacctgacaaagatagcactaaaagggggaagaaaactaaatcaattcccagttaatgtaagtggtgcctattttaaattttatttaaaattgtttctctcctttattaatattagtttatgctggtctaagtcaatatctcagactaaggacttttttggtgatgggtctagagaaagactggctgaggaggtgactcctatctgttgagaacacctgtattttggtaagtccttaacttgtgtgagactaacaaatatgcagaaatataactgtttcagggtggagataggaaaactagatttgctcacgtagtatgcttttcttagaaatctgaaatattcttacctgaaagtaataggggagaaagaaaactatacagaaggcttccttgccttcagtgtcataccccagtttttaaaagctctcttgttttcaggaaactttagatccaattgatgaggtcgctgcactcatcgcagccaccattcatgatgtggatcaccctgggagaaccaactccttcctgtgtaatgctggaagtgagctggccattttgtacaatgacactgctgtgctggagagccaccatgcggccttggccttccagctgaccactggagatgataaatgcaatatatttaaaaacatggagaggaatgattatcggacactgcgccaggggattatcgacatggtcttagccacagaaatgacaaagcactttgagcatgtcaacaaatttgtcaacagcatcaacaaacccttggcaacactagaagaaaatggggaaactgataaaaaccaggaagtgataaacactatgcttaggactccagagaaccggaccctaatcaaacgaatgctgattaaatgtgctgatgtgtccaatccctgccgacccctgcagtactgcatcgagtgggctgcacgcatttcggaagaatatttttctcagactgatgaagagaagcagcagggcttacctgtggtgatgccagtgtttgacagaaatacctgcagcatccccaaatcccaaatctctttcattgattacttcatcacagacatgtttgatgcttgggatgcctttgtagacctgcctgatttaatgcagcatcttgacaacaactttaaatactggaaaggactggacgaaatgaagctgcggaacctccgaccacctcctgaatagtgggagacaccacccagagccctgaagctttgttccttcggtcatttggaattcctgagggcagccagagctccttggtcctttcagtactaggcagaacagcccccgatctgcatagcctgtgaaagcccacggggacatcagtaaccttctgcagccaccatccaatgccattactgtcaagtgagacttggccactgtagcctgggcctgctgcaggagctcttcagaaaggcacatgaggaccacggtttgcctcagtttctggtaaaacacaaggtctggagtgcccctgcaaagggtattgatggacttcctgccagtgacagagcatgtctattgcaaacaattctctcagttacgttcagcacttaagaacggctaatggcaataggatctttagcaactttttcacatcatagaaggtgcaatcgctcacttgggaacactactgagagtgacttctcttttaaaattgagtagcagatgaaaaattaaaatttgaacttgattattaatatcaattaaaatgttttatttattttattaaaagctcaatattttctatgaattcaaaaatacttcagagccaaagccaacttcaaataccgtgaccaaatttacatgattcatattcattatgcattacttggtatacagacttattttcataatgcaaattaataaaatgacacttttactgcactatagaaatattcatgtatgttaaacttttctgattgaggctaactggaaaaagctggggtcgtattctaagtgctaaagaaggctgcttctactgtatagaacccagggctctgaaacagctctagccgcctaatgcacttcacaggtaactccccaaggtaaaactagactctcttgttggttcgcaaagaaaagttaggacttaacacttttttctaaaattttataattcaatttccaaaagtctactctattttatactgtttctacaaaatattccttataaaaacaaagaacaaaaattgaatatttaatgaattgacattttataaccaacctgtttttatctacggtgggaatctttgatgccagaaatttataaagaggttctgtatcttcacaccttgaataagcataataccataaaaaatgacacttgacatgtcaatgtatttgtcatttcattttaaactcgtatttgtggtttttttcccagataaaaatgaaattaaaccatttctttttaagaaa

SEQ ID NO: 314525 - DNA, 1705 bp, Homo sapiens
  misc_feature (55)..(55): n is a, c, g, or t
gtcggttccagaggatccccgtcgtcagcatcacaaccctggaacactagaaganaatggggaaactgataaaaaccaggaagtgataaacactatgcttaggactccagagaaccggaccctaatcaaacgaatgctgattaaatgtgctgatgtgtccaatccctgccgacccctgcagtactgcatcgagtgggctgcacgcatttcggaagaatatttttctcagactgatgaagagaagcagcagggcttacctgtggtgatgccagtgtttgacagaaatacctgcagcatccccaaatcccaaatctctttcattgattacttcatcacagacatgtttgatgcttgggatgcctttgtagacctgcctgatttaatgcagcatcttgacaacaactttaaatactggaaaggactggacgaaatgaagctgcggaacctccgaccacctcctgaatagtgggagacaccacccagagccctgaagctttgttccttcggtcatttggaattcctgagggcagccagagctccttggtcctttcagtactaggcagaacagcccccgatctgcatagcctgtgaaagcccacggggacatcagtaaccttctgcagccaccatccaatgccattactgtcaagtgagacttggccactgtagcctgggcctgctgcaggagctcttcagaaaggcacatgaggaccacggtttgcctcagtttctggtaaaacacaaggtctggagtgcccctgcaaagggtattgatggacttcctgccagtgacagagcatgtctattgcaaacaattctctcagttacgttcagcacttaagaacggctaatggcaataggatctttagcaactttttcacatcatagaaggtgcaatcgctcacttgggaacactactgagagtgacttctcttttaaaattgagtagcagatgaaaaattaaaatttgaacttgattattaatatcaattaaaatgttttatttattttattaaaagctcaatattttctatgaattcaaaaatacttcagagccaaagccaacttcaaataccgtgaccaaatttacatgattcatattcattatgcattacttggtatacagacttattttcataatgcaaattaataaaatgacacttttactgcactatagaaatattcatgtatgttaaacttttctgattgaggctaactggaaaaagctggggtcgtattctaagtgctaaagaaggctgcttctactgtatagaacccagggctctgaaacagctctagccgcctaatgcacttcacaggtaactccccaaggtaaaactagactctcttgttggttcgcaaagaaaagttaggacttaacacttttttctaaaattttataattcaatttccaaaagtctactctattttatactgtttctacaaaatattccttataaaaacaaagaacaaaaattgaatatttaatgaattgacattttataaccaacctgtttttatctacggtgggaatctttgatgccagaaatttataaagaggttctgtatcttcacaccttgaataagcataataccataaaaaatgacacttgacatgtcaatgtatttgtcatttcattttaaactcgtatttgtggtttttttcccagataaaaatgaaattaaaccatttctttttaagaaa

SEQ ID NO: 314526 - DNA, 1613 bp, Homo sapiens
gtaaccttctgcagccaccatccaatgccattactgtcaagtgagacttggccactgtagcctgggcctgctgcaggagctcttcagaaaggcacatgaggaccacggtttgcctcagtttctggtaaaacacaaggtctggagtgcccctgcaaagggtattgatggacttcctgccagtgtttgacagaaatacctgcagcatccccaaatcccaaatctctttcattgattacttcatcacagacatgtttgatgcttgggatgcctttgtagacctgcctgatttaatgcagcatcttgacaacaactttaaatactggaaaggactggacgaaatgaagctgcggaacctccgaccacctcctgaatagtgggagacaccacccagagccctgaagctttgttccttcggtcatttggaattcctgagggcagccagagctccttggtcctttcagtactaggcagaacagcccccgatctgcatagcctgtgaaagcccacggggacatcagtaaccttctgcagccaccatccaatgccattactgtcaagtgagacttggccactgtagcctgggcctgctgcaggagctcttcagaaaggcacatgaggaccacggtttgcctcagtttctggtaaaacacaaggtctggagtgcccctgcaaagggtattgatggacttcctgccagtgacagagcatgtctattgcaaacaattctctcagttacgttcagcacttaagaacggctaatggcaataggatctttagcaactttttcacatcatagaaggtgcaatcgctcacttgggaacactactgagagtgacttctcttttaaaattgagtagcagatgaaaaattaaaatttgaacttgattattaatatcaattaaaatgttttatttattttattaaaagctcaatattttctatgaattcaaaaatacttcagagccaaagccaacttcaaataccgtgaccaaatttacatgattcatattcattatgcattacttggtatacagacttattttcataatgcaaattaataaaatgacacttttactgcactatagaaatattcatgtatgttaaacttttctgattgaggctaactggaaaaagctggggtcgtattctaagtgctaaagaaggctgcttctactgtatagaacccagggctctgaaacagctctagccgcctaatgcacttcacaggtaactccccaaggtaaaactagactctcttgttggttcgcaaagaaaagttaggacttaacacttttttctaaaattttataattcaatttccaaaagtctactctattttatactgtttctacaaaatattccttataaaaacaaagaacaaaaattgaatatttaatgaattgacattttataaccaacctgtttttatctacggtgggaatctttgatgccagaaatttataaagaggttctgtatcttcacaccttgaataagcataataccataaaaaatgacacttgacatgtcaatgtatttgtcatttcattttaaactcgtatttgtggtttttttcccagataaaaatgaaattaaaccatttctttttaagaaa

SEQ ID NO: 314527 - DNA, 3170 bp, Homo sapiens
acgcgagatccgcgctcgccgccgcccgcccaggcggcgatgacacggcgcccgcggcggcccggaggcgccgggtgggccgtttgctgaccggatcgcggctacccgccagcgtgtccgcggcgccgccgccagcatgggctgtgccccgagcatccacatttccgagcgcctggtggccgaggacgcgcctagccccgcggcaccgccgctgtcgtccggcgggccgcgcctcccgcagggccagaagacggccgccttgccccggacccgcggcgccggcctcttggagtcggagcttcgcgacggcagcggcaagaaggtagcagtagctgatgtgcagtttggccccatgagatttcatcaagatcaacttcaggtacttttagtgtttaccaaagaagataaccaatgtaatggattctgcagggcatgtgaaaaagcagggtttaagtgtacagttaccaaggaggctcaggctgtccttgcctgtttcctggacaaacatcatgacattatcatcatagaccacagaaatcctcgacagctggatgcagaggcactgtgcaggtctatcagatcatcaaaactctcagaaaacacagttattgttggtgtagtacgcagggtggatagagaagagttgtccgtaatgcctttcatttctgctggatttacaaggaggtatgtagaaaaccccaacatcatggcctgctacaatgaactgctccagctggagtttggagaggtgcgatcacaactgaaactcagggcttgtaactcagtattcactgcattagaaaacagtgaagatgcaattgaaattacaagcgaagaccgttttatacagtatgcaaatcctgcatttgaaacaacaatgggctatcagtcaggtgaattaatagggaaggagttaggagaagtgcctataaatgaaaaaaaggctgacttgctcgatactataaattcatgcatcaggataggcaaggagtggcaaggaatttactatgccaaaaagaaaaacggagataatatacaacaaaatgtgaagataatacctgtcattggacagggaggaaaaattagacactatgtgtccattatcagagtgtgcaatggcaacaataaggctgagaaaatatccgaatgtgttcagtctgacactcatacagataatcagacaggcaaacataaagacaggagaaaaggctcactagacgtcaaagctgttgcctcccgtgcaactgaagtttccagccagagacgacactcttccatggcccggatacattccatgacaattgaggcgcccatcaccaaggtaatcaatattatcaatgctgcccaggaaagtagtcccatgcctgtgacagaagccctagaccgtgtgctggaaattctaagaaccactgagttatattcaccacagtttggtgctaaagatgatgatccccatgccaatgaccttgttgggggcttaatgtctgatggtttgcgaagactatcagggaatgaatatgttctttcaacaaaaaacactcaaatggtttcaagcaatataatcactcccatctcccttgatgatgtcccaccacggatagctcgggccatggaaaatgaggaatactgggactttgatatttttgaactggaggctgccacccacaataggcctttgatttatcttggtctcaaaatgtttgctcgctttggaatctgtgaattcttacactgctccgagtcaacgctaagatcatggttacaaattatcgaagccaattatcattcctccaatccctaccacaattctacacattctgctgatgtgcttcatgccactgcctattttctctccaaggagaggataaaggaaactttagatccaattgatgaggtcgctgcactcatcgcagccaccattcatgatgtggatcaccctgggagaaccaactccttcctgtgtaatgctggaagtgagctggccattttgtacaatgacactgctgtgctggagagccaccatgcggccttggccttccagctgaccactggagatgataaatgcaatatatttaaaaacatggagaggaatgattatcggacactgcgccaggggattatcgacatggtcttagccacagaaatgacaaagcactttgagcatgtcaacaaatttgtcaacagcatcaacaaacccttggcaacactagaagaaaatggggaaactgataaaaaccaggaagtgataaacactatgcttaggactccagagaaccggaccctaatcaaacgaatgctgattaaatgtgctgatgtgtccaatccctgccgacccctgcagtactgcatcgagtgggctgcacgcatttcggaagaatatttttctcaggtaagttgctgcctcttttaagtttctagagagagagagagttaaaacccataaaatcatacgagataatggacttaacactaggaaatagggttctaaaaaaattctgtccttgtttgcaaggtaacaaatggtaactggtaacaaattttttttttcttaagaatattttattttccctttattcttgcaggatattttgttagatatagcatcctgggttgatgatttttttcctgaaagtacttttaaggagtcatctggtcttcatattctttctgagtagaaaaaacttctcttggggcagaaaaaaatattaggaaatatactggctaagatttttccagatttggtggagggcatatgcacatgcatatgcatacagattcaagaagcccagtgaaccttagcccatgtcagatgtgtcatagtcaagcagctaacaggctaaagataaatcttgcaatcagccagaggaaaagcgacacattacttataagaaaacagtgattctcatgtcctctgacttcccatcaaaaactatgaaggccagaagacacgggaacatctttaaagtgctgttagctttgggaggatcacttgagcccaggagtcttaagagcagcctgggcaacatggtgagaccttgtctctacaaaaaaattaaaagttagccgggcatagtgatgcactcctgtagtcccaagctacttgggaggctgaggcaggaggatcgcttgaagcccaggaggttgaggctgcagtgagccatgatcatgtc

SEQ ID NO: 314528 - DNA, 2099 bp, Homo sapiens
acgcgagatccgcgctcgccgccgcccgcccaggcggcgatgacacggcgcccgcggcggcccggaggcgccgggtgggccgtttgctgaccggatcgcggctacccgccagcgtgtccgcggcgccgccgccagcatgggctgtgccccgagcatccacatttccgagcgcctggtggccgaggacgcgcctagccccgcggcaccgccgctgtcgtccggcgggccgcgcctcccgcagggccagaagacggccgccttgccccggacccgcggcgccggcctcttggagtcggagcttcgcgacggcagcggcaagaaggtagcagtagctgatgtgcagtttggccccatgagatttcatcaagatcaacttcaggtacttttagtgtttaccaaagaagataaccaatgtaatggattctgcagggcatgtgaaaaagcagggtttaagtgtacagttaccaaggaggctcaggctgtccttgcctgtttcctggacaaacatcatgacattatcatcatagaccacagaaatcctcgacagctggatgcagaggcactgtgcaggtctatcagatcatcaaaactctcagaaaacacagttattgttggtgtagtacgcagggtggatagagaagagttgtccgtaatgcctttcatttctgctggatttacaaggaggtatgtagaaaaccccaacatcatggcctgctacaatgaactgctccagctggagtttggagaggtgcgatcacaactgaaactcagggcttgtaactcagtattcactgcattagaaaacagtgaagatgcaattgaaattacaagcgaagaccgttttatacagtatgcaaatcctgcatttgaaacaacaatgggctatcagtcaggtgaattaatagggaaggagttaggagaagtgcctataaatgaaaaaaaggctgacttgctcgatactataaattcatgcatcaggataggcaaggagtggcaaggaatttactatgccaaaaagaaaaacggagataatatacaacaaaatgtgaagataatacctgtcattggacagggagggtaagtggaaaaaacaagtacatcaatcaacatacagtgttttgggttattgcagaatttgctttgaatatttaagttaaggactgctgacagaagtgtcaaggtcaggtgtcatcacagaatggccttccagcatagtgttttcttggtgacttcctcatggctacagtctgaccctctacttgcagcccagagccaacatactctgggcagtcttgtttaagctgcgtggatacacaagaaactgaagtatttgtttaagtcagaatgtcactttagtaagttgtgtgataatactgactggtagactccctatattgaaaagattttttatctaatttgataggctatgtattatttctgcagagacctatcaaattagataaaaatattttaaatactaacagttatggacattcctatataaaacagatgtgactgtagattggaaaccagtatatatcaggagcctaaaactttcagacagtttatctcagaaacctatcttaaagaaataatatggtaagatgaaaattatgaatatgaattatagaacacctaaaatattgcagccattagaaatgatgatcatattcacaggttctaagatgagggccaaaaaaagtagaaatgatgatcatagaaaattaaattacctcatgcctgtaatcccagcactttgggaggccaaggtgggaaaatcccttgagcccaggagtttgggatccgcctgagcaatatagtgagacccccatccctacaaaaaatgtaaaaattagctaggtgtggtgacacacacctatcagttacttcagggggccgatgtgggagaatcgcttgatcttgggaggtcgaggctgcagtgagctatgatcatgccactgtactccagcctgggcaacaaagtaagacactgtctcaaaaggaaaaaaaaaaataaaatatgagaaaggttatgatacaatgttaaatgcaaaaagtaaaatgtaaaatgatagctagtgtttaatctcaatcatgta

SEQ ID NO: 314529 - DNA, 2625 bp, Homo sapiens
taaaaatcgaggcggggccgagaggctgcggcggctgactaggttttcggaccgcggcgcggcggggaagagagactgcggcgggagggccaggccgtgggagagacgcgggaaagtgcgggtcgcagaggcacttgaccaccccgccctaggccgacccggcggacgcggcgtctggtgtgcgggcgctggggcgggtcccaggtctccccgctgcgctgcttgaggctcggccatggcccagcagagagccctgccccagagcaaggagacgctgctgcagtcctacaacaagcggctgaaggacgacattaagtccatcatggacaacttcaccgagatcatcaagaccgccaagattgaggacgagacgcaggtgtcacgggccactcagggtgaacaggacaattacgagatgcatgtgcgagccgccaacatcgtccgagccggcgagtccctgatgaagctggtgtccgacctcaagcagttcctgatcctcaatgacttcccctccgtgaacgaggccattgaccagcgcaaccagcagctgcgcacactgcaggaggagtgcgaccggaagctcatcacgctgcgagacgagatctccattgacctctacgagctggaggaggagtattactcgtccaggtataaatagcgctggactccccatgcagagcgggagcctgcctacctgggcctggccagcaggcagggctgccttctgctttttcaaattcttgctggtcttagcagtggagccatgcctgggtttcagagcagagctcctggccagagcgtttgaccgacagacaattcacatccatatgccagggccctgggcctttcccacagtgcaatgtgatgaaaaccacaggactcacgccagtcggataggccgagtctggagaagggaggcgcctggctgtatcccccgcaggccctcttccgagagccttcctcctcgggcagtgcgttctggggctgtgctgctcctgttaccttctgaatccatatgtagagatttcagccaaggctgggccagccttttttgggcagtcaggtccacacctatgtccagggcaccagggatgcaattccatgtggatgtcaccaaaccccagtgtggaggcagggacagtcatgggaatgtgggggatgaagcccaggcagggaatggccttgaaagccattggagctccaattcgtgacccactcagccttatccacggagctggagccaacctacgtgccaggccccgtgctgggtcccagggatgcagaagggtcaaaacccatcatcctgacccttgtggggctccgtaagaagctgaaaccttcgaccgtttgagctggaggggccctgagaaatcagagtctacgtatcatttacttagggggaaacttaggctggagacagggaggccttccactctgccccattagcttagaaaatcaagattcagtccagcagatgcagagtccatgtccatcttgtgccttctcctggacaaacctttccttcctggtggtggatttaaaatactcctttctgcccattggccatgctgggagccacagatatccagagccagcatgacctggggcttggtttccctgccctgggctcagtggcactgctgagctgcagcagtcctagagttttccaggggttctgagggaatctttggtccccagtactcattaactcagcagacatgaggcagcatttcctccacactagggtggctgagaggggtcctagggtgtttcagacccttctgggcatctccttccacagctgttcagttgtcggtctctttgaggcagccaccgtccctgagggcccctgcacagagcagctgtgggcctgtaattcagcctgcctgccttgccttggggcagggagagagggaacctgctcacggccctgcagcagagcagggcgcaaacccaggacatctgtgccaggcttcccatgccctcccccaacagtccctcagcttcacccagcggggcttccaggccagcctgtgtcccctcccgcaggcctcctgtccacaccagcgccccctggggggcctcacacagcccctgtggcagaagcagttgccctcctctgtacattgcctttaagcgaccaggtcctggccgagtttcctctgccccttcttgctggtcccccaaagggcgctccgctccctgccctgccctgccctgttccgcatgagctgcgcctctgtgctcgcctgccccctctctgcttgttagttgctctttctggctctgcctctcctttgctttcctcgggatgccactctgtgcccaggacggttctgagactgaacactgagggcaggagcaagggaggaagccaggggcgaggcaggccgcgggaaagccagggcccctgcctgcaggttagaaagaggcgagcgtggattgtcacagctgcgggcatgggaagggctagctgagctcttcacctgcatcctggctgccgtgaggattccccgtgttagaggtggggacgcctgctggaggccgcctggctgatgtagggctatcgggaagtgccagggcctgtgttcccaactgtcgcccccttcaggctaagtctcaggc

SEQ ID NO: 314530 - DNA, 2589 bp, Homo sapiens
taaaaatcgaggcggggccgagaggctgcggcggctgactaggttttcggaccgcggcgcggcggggaagagagactgcggcgggagggccaggccgtgggagagacgcgggaaagtgcgggtcgcagaggcacttgaccaccccgccctaggccgacccggcggacgcggcgtctggtgtcccaggtctccccgctgcgctgcttgaggctcggccatggcccagcagagagccctgccccagagcaaggagacgctgctgcagtcctacaacaagcggctgaaggacgacattaagtccatcatggacaacttcaccgagatcatcaagaccgccaagattgaggacgagacgcaggtgtcacgggccactcagggtgaacaggacaattacgagatgcatgtccgagccggcgagtccctgatgaagctggtgtccgacctcaagcagttcctgatcctcaatgacttcccctccgtgaacgaggccattgaccagcgcaaccagcagctgcgcacactgcaggaggagtgcgaccggaagctcatcacgctgcgagacgagatctccattgacctctacgagctggaggaggagtattactcgtccaggtataaatagcgctggactccccatgcagagcgggagcctgcctacctgggcctggccagcaggcagggctgccttctgctttttcaaattcttgctggtcttagcagtggagccatgcctgggtttcagagcagagctcctggccagagcgtttgaccgacagacaattcacatccatatgccagggccctgggcctttcccacagtgcaatgtgatgaaaaccacaggactcacgccagtcggataggccgagtctggagaagggaggcgcctggctgtatcccccgcaggccctcttccgagagccttcctcctcgggcagtgcgttctggggctgtgctgctcctgttaccttctgaatccatatgtagagatttcagccaaggctgggccagccttttttgggcagtcaggtccacacctatgtccagggcaccagggatgcaattccatgtggatgtcaccaaaccccagtgtggaggcagggacagtcatgggaatgtgggggatgaagcccaggcagggaatggccttgaaagccattggagctccaattcgtgacccactcagccttatccacggagctggagccaacctacgtgccaggccccgtgctgggtcccagggatgcagaagggtcaaaacccatcatcctgacccttgtggggctccgtaagaagctgaaaccttcgaccgtttgagctggaggggccctgagaaatcagagtctacgtatcatttacttagggggaaacttaggctggagacagggaggccttccactctgccccattagcttagaaaatcaagattcagtccagcagatgcagagtccatgtccatcttgtgccttctcctggacaaacctttccttcctggtggtggatttaaaatactcctttctgcccattggccatgctgggagccacagatatccagagccagcatgacctggggcttggtttccctgccctgggctcagtggcactgctgagctgcagcagtcctagagttttccaggggttctgagggaatctttggtccccagtactcattaactcagcagacatgaggcagcatttcctccacactagggtggctgagaggggtcctagggtgtttcagacccttctgggcatctccttccacagctgttcagttgtcggtctctttgaggcagccaccgtccctgagggcccctgcacagagcagctgtgggcctgtaattcagcctgcctgccttgccttggggcagggagagagggaacctgctcacggccctgcagcagagcagggcgcaaacccaggacatctgtgccaggcttcccatgccctcccccaacagtccctcagcttcacccagcggggcttccaggccagcctgtgtcccctcccgcaggcctcctgtccacaccagcgccccctggggggcctcacacagcccctgtggcagaagcagttgccctcctctgtacattgcctttaagcgaccaggtcctggccgagtttcctctgccccttcttgctggtcccccaaagggcgctccgctccctgccctgccctgccctgttccgcatgagctgcgcctctgtgctcgcctgccccctctctgcttgttagttgctctttctggctctgcctctcctttgctttcctcgggatgccactctgtgcccaggacggttctgagactgaacactgagggcaggagcaagggaggaagccaggggcgaggcaggccgcgggaaagccagggcccctgcctgcaggttagaaagaggcgagcgtggattgtcacagctgcgggcatgggaagggctagctgagctcttcacctgcatcctggctgccgtgaggattccccgtgttagaggtggggacgcctgctggaggccgcctggctgatgtagggctatcgggaagtgccagggcctgtgttcccaactgtcgcccccttcaggctaagtctcaggc

SEQ ID NO: 314531 - DNA, 2299 bp, Homo sapiens
taaaaatcgaggcggggccgagaggctgcggcggctgactaggttttcggaccgcggcgcggcggggaagagagactgcggcgggagggccaggccgtgggagagacgcgggaaagtgcgggtcgcagaggcacttgaccaccccgccctaggccgacccggcggacgcggcgtctggtgtgcgggcgctggggcgggtcccaggtctccccgctgcgctgcttgaggctcggccatggcccagcagagagccctgccccagagcaaggagacgctgctgcagtcctacaacaagcggctgaaggacgacattaagtccatcatggacaacttcaccgagatcatcaagaccgccaagattgaggacgagacgcaggtgtcacgggccactcagggtgaacaggacaattacgagatgcatgtgcgagccgccaacatcgtccgagccggcgagtccctgatgaagctggtgtccgacctcaagcagttcctgatcctcaatgacttcccctccgtgaacgaggccattgaccagcgcaaccagcagctgcgcacactgcaggaggagtgcgaccggaagctcatcacgctgcgagacgagatctccattgacctctacgagctggaggaggagtattactcgtccaggtataaatagcgctggactccccatgcagagcgggagcctgcctacctgggcctggccagcaggcagggctgccttctgctttttcaaattcttgctggtcttagcagtggagccatgcctgggtttcagagcagagctcctggccagagcgtttgaccgacagacaattcacatccatatgccagggccctgggcctttcccacagtgcaatgtgatgaaaaccacaggactcacgccagtcggataggccgagtctggagaagggaggcgcctggctgtatcccccgcaggccctcttccgagagccttcctcctcgggcagtgcgttctggggctgtgctgctcctgttacctttgaaaccttcgaccgtttgagctggaggggccctgagaaatcagagtctacgtatcatttacttagggggaaacttaggctggagacagggaggccttccactctgccccattagcttagaaaatcaagattcagtccagcagatgcagagtccatgtccatcttgtgccttctcctggacaaacctttccttcctggtggtggatttaaaatactcctttctgcccattggccatgctgggagccacagatatccagagccagcatgacctggggcttggtttccctgccctgggctcagtggcactgctgagctgcagcagtcctagagttttccaggggttctgagggaatctttggtccccagtactcattaactcagcagacatgaggcagcatttcctccacactagggtggctgagaggggtcctagggtgtttcagacccttctgggcatctccttccacagctgttcagttgtcggtctctttgaggcagccaccgtccctgagggcccctgcacagagcagctgtgggcctgtaattcagcctgcctgccttgccttggggcagggagagagggaacctgctcacggccctgcagcagagcagggcgcaaacccaggacatctgtgccaggcttcccatgccctcccccaacagtccctcagcttcacccagcggggcttccaggccagcctgtgtcccctcccgcaggcctcctgtccacaccagcgccccctggggggcctcacacagcccctgtggcagaagcagttgccctcctctgtacattgcctttaagcgaccaggtcctggccgagtttcctctgccccttcttgctggtcccccaaagggcgctccgctccctgccctgccctgccctgttccgcatgagctgcgcctctgtgctcgcctgccccctctctgcttgttagttgctctttctggctctgcctctcctttgctttcctcgggatgccactctgtgcccaggacggttctgagactgaacactgagggcaggagcaagggaggaagccaggggcgaggcaggccgcgggaaagccagggcccctgcctgcaggttagaaagaggcgagcgtggattgtcacagctgcgggcatgggaagggctagctgagctcttcacctgcatcctggctgccgtgaggattccccgtgttagaggtggggacgcctgctggaggccgcctggctgatgtagggctatcgggaagtgccagggcctgtgttcccaactgtcgcccccttcaggctaagtctcaggc

SEQ ID NO: 314532 - DNA, 1447 bp, Homo sapiens
taaaaatcgaggcggggccgagaggctgcggcggctgactaggttttcggaccgcggcgcggcggggaagagagactgcggcgggagggccaggccgtgggagagacgcgggaaagtgcgggtcgcagaggcacttgaccaccccgccctaggccgacccggcggacgcggcgtctggtgtgcgggcgctggggcgggtcccaggtctccccgctgcgctgcttgaggctcggccatggcccagcagagagccctgccccagagcaaggagacgctgctgcagtcctacaacaagcggctgaaggacgacattaagtccatcatggacaacttcaccgagatcatcaagaccgccaagattgaggacgagacgcaggtgtcacgggccactcagggtgaacaggacaattacgagatgcatgtgcgagccgccaacatcgtccgagccggcgagtccctgatgaagctggtgtccgacctcaagcagttcctgatcctcaatgacttcccctccgtgaacgaggccattgaccagcgcaaccagcagctgcgcacactgcaggaggagtgcgaccggaagctcatcacgctgcgagacgagatctccattgacctctacgagctggaggaggagtattactcgtccagctcaagcctttgcgaagctaatgacctgcctctgtgcgaagcttacgggaggctggacctcgacacagactctgctgatggcctctcggcccctctgctggcgtccccggagcccagtgctggccccctacaggtggcagcccctgcccactcccatgctggtggccctggccccactgagcacgcctgagcctccggggccacgcttcgttctcaggaacaaaacctgaggcagccctttggatgccctcacagccttgcttctctcagcctaggttcccatttggggacttcaggaccccagagccactaggacttccttgggaagcccgttagcccagggtgggtcccgccaggacagtagggaaacagttgtttccctagccatttccgaatagcccatcattccgagtcatcatctctgtttgctgccttcctggccagccaggtggaagaaagtttccaagctaggtctggcccgttggggatctcagcagtggggcaggagggtgcctgatttcgggggagtcctgacccgagcctgttgtcagagttgggaggggctctgagcagtgttgggcaggccgggtctcccatcccgaggccagcgttcctgtgcagaggcccatccactggttcttgccctgagccacatatgtctgtgccatgggctgagtgccacgacaggcccgtgtgacagctgctgcccacgcatgtggaagctaggtgggactcattcctaattctgccgttgtaatgagacttgattaaaacaccgccacttttttgcattgctgct

SEQ ID NO: 314533 - DNA, 1221 bp, Homo sapiens
taaaaatcgaggcggggccgagaggctgcggcggctgactaggttttcggaccgcggcgcggcggggaagagagactgcggcgggagggccaggccgtgggagagacgcgggaaagtgcgggtcgcagaggcacttgaccaccccgccctaggccgacccggcggacgcggcgtctggtgtgcgggcgctggggcgggtcccaggtctccccgctgcgctgcttgaggctcggccatggcccagcagagagccctgccccagagcaaggagacgctgctgcagtcctacaacaagcggctgaaggacgacattaagtccatcatggacaacttcaccgagatcatcaagaccgccaagattgaggacgagacgcaggtgtcacgggccactcagggtgaacaggacaattacgagatgcatgtgcgagccgccaacatcgtccgagccggcgagtccctgatgaagctggtgtccgacctcaagcagttcctgatcctcaatgacttcccctccgtgaacgaggccattgaccagcgcaaccagcagctgcgcacactgcaggaggagtgcgaccggaagctcatcacgctgcgagacgagatctccattgacctctacgagctggaggaggagtattactcgtccagctcaagcctttgcgaagctaatgacctgcctctgtgcgaagcttacgggaggctggacctcgacacagactctgctgatggcctctcggcccctctgctggcgtccccggagcccagtgctggccccctacaggtggcagcccctgcccactcccatgctggtggccctggccccactgagcacgcctgagcctccggggccacgcttcgttctcaggaacaaaacctgaggcagccctttggatgccctcacagccttgcttctctcagcctaggttcccatttggggacttcaggaccccagagccactaggacttccttgggaagcccgttagcccagggtgggtcccgccaggacagtagggaaacagttgtttccctagccatttccgaatagcccatccactggttcttgccctgagccacatatgtctgtgccatgggctgagtgccacgacaggcccgtgtgacagctgctgcccacgcatgtggaagctaggtgggactcattcctaattctgccgttgtaatgagacttgattaaaacaccgccacttttttgcattgctgct

SEQ ID NO: 314534 - DNA, 685 bp, Homo sapiens
taaaaatcgaggcggggccgagaggctgcggcggctgactaggttttcggaccgcggcgcggcggggaagagagactgcggcgggagggccaggccgtgggagagacgcgggaaagtgcgggtcgcagaggcacttgaccaccccgccctaggccgacccggcggacgcggcgtctggtgtgcgggcgctggggcgggtcccaggtctccccgctgcgctgcttgaggctcggccatggcccagcagagagccctgccccagagcaaggagacgctgctgcagtcctacaacaagcggctgaaggacgacattaagtccatcatggacaacttcaccgagatcatcaagaccgccaagattgaggacgagacgcaggtgtcacgggccactcagggtgaacaggacaattacgagatgcatgtgcgagccgccaacatcgtccgagccggcgagtccctgatgaagctggtgtccgacctcaagcagttcctgatcctcaatgacttcccctccgtgaacgaggccattgaccagcgcaaccagcagctgcgcacactgcaggaggagtgcgaccggaagctcatcacgctgcgagacgagatctccattgacctctacgagctggaggaggagtattactcgtccagctggcaaaactcaaggctcagaaactgcagggccccc

SEQ ID NO: 314535 - DNA, 1229 bp, Homo sapiens
acagtctgccctcagagagctctttgcagtgtagtgacactggggtttctgcagtcagggaggagggagggtggccaggctgacagctttttgcaagaggagggggaccagcaccagctgggaggcataggctaggacaggcccacgtggaggctgggcaggaagggcctgctgaggtcacacagctgttggtggttgggccagggcggcttcctcctttcagaatgctagggtggctctcaccactggccgcctctccttgccaggcctgccaactcaggggacagatggagcaggagtggagaaagggaaaggcaggtctggggtgtggtcgtgttttcttaactctgcttctgtcttgctctcccctcccctggctttcctctctgcctgctcctgtctctccctggggtttctggtggtggaaaagctcaagcctttgcgaagctaatgacctgcctctgtgcgaagcttacgggaggctggacctcgacacagactctgctgatggcctctcggcccctctgctggcgtccccggagcccagtgctggccccctacaggtggcagcccctgcccactcccatgctggtggccctggccccactgagcacgcctgagcctccggggccacgcttcgttctcaggaacaaaacctgaggcagccctttggatgccctcacagccttgcttctctcagcctaggttcccatttggggacttcaggaccccagagccactaggacttccttgggaagcccgttagcccagggtgggtcccgccaggacagtagggaaacagttgtttccctagccatttccgaatagcccatcattccgagtcatcatctctgtttgctgccttcctggccagccaggtggaagaaagtttccaagctaggtctggcccgttggggatctcagcagtggggcaggagggtgcctgatttcgggggagtcctgacccgagcctgttgtcagagttgggaggggctctgagcagtgttgggcaggccgggtctcccatcccgaggccagcgttcctgtgcagaggcccatccactggttcttgccctgagccacatatgtctgtgccatgggctgagtgccacgacaggcccgtgtgacagctgctgcccacgcatgtggaagctaggtgggactcattcctaattctgccgttgtaatgagacttgattaaaacaccgccacttttttgcattgctgct

SEQ ID NO: 314536 - DNA, 1016 bp, Homo sapiens
gagtagattgctccagtgtactgtccgcaggggagcgctttgctttctctgattatagttctgaggccctagctactcactttgcaaactccaggctccggtcgcgcacgggacgaactgcggggagtgagccgcgcgggccgccgtagtcagctgctaagagcaggaagagtccgagcggcgggcggagtctgcaggatggcaccggacccctggttctccacatacgattctacttgtcaaattgcccaagaaattgctgagaaaattcaacaacgaaatcaatatgaacgaaaaggtgaaaaggcaccaaagcttaccgtgacaatcagagctttgttgcagaacctgaaggaaaagatcgcccttttgaaggacttattgctaagagctgtgtcaacacatcagataacacagcttgaaggggaccgaagacagaacctcttggatgatcttgtaactcgagagagactacttctggcatcctttaagaatgagggtgccgaaccagatctaatcaggtccagcctgatgagtgaagaggctaagcgaggagcacccaacccttggctctttgaggagccagaggagaccagaggcttgggttttgatgaaatccggcaacagcagcagaaaattatccaagaacaggatgcaggccttgatgccctttcctctatcataagtcgccaaaaacaaatggggcaggaaattgggaatgaattggatgaacaaaatgagataattgacgaccttgccaacctagtggagaacacagatgaaaaacttcgcaatgaaaccaggcgggtaaacatggtggacagaaagtcagcctcttgtgggatgatcatggtgattttactgctgcttgtggctatcgtggttgttgcagtctggccgaccaactgatggcagtaaagagaccaccagcagtgacacctggcaatgacagatgcaagcccaacacccttttggtacgcaaaacctgctctcaataaattcccccaaagctctga

SEQ ID NO: 314537 - DNA, 804 bp, Homo sapiens
gagtagattgctccagtgtactgtccgcaggggagcgctttgctttctctgattatagttctgaggccctagctactcactttgcaaactccaggctccggtcgcgcacgggacgaactgcggggagtgagccgcgcgggccgccgtagtcagctgctaagagcaggaagagtccgagcggcgggcggagtctgcaggatggcaccggacccctggttctccacatacgattctacttgtcaaattgcccaagaaattgctgagaaaattcaacaacgaaatcaatatgaacgaaaaggtgaaaaggcaccaaagcttaccgtgacaatcagagctttgttgcagaacctgaaggaaaagatcgcccttttgaaggacttattgctaagagctgtgtcaacacatcagataacacagcttgaaggggaccgaagacagaacctcttggatgatcttgtaactcgagagagactacttctggcatcctttaagaatgagggtgccgaaccagatctaatcaggtccagcctgatgagtgaagaggctaagcgaggagcacccaacccttggctctttgaggagccagaggagaccagaggcttgggttttgatgaaatccggcaacagcagcagaaaattatccaagaacaggatgcaggccttgatgccctttcctctatcataagtcgccaaaaacaaatggggcaggaaattgggaatgaattggatgaacaaaatgagataattgacgacctttgccacctagtggagaacacagatgatcttgtggaattgatcatgtga

SEQ ID NO: 314538 - DNA, 372 bp, Homo sapiens
ttaggaagaactttctaatgattgaaattcatcatggaatcactgcaatggccgcaaacagaggcgtctaagagactgggaaagtggccggcctgagataattgacgaccttgccaacctagtggagaacacagatgaaaaacttcgcaatgaaaccaggcgggtaaacatggtggacagaaagtcagcctcttgtgggatgatcatggtgattttactgctgcttgtggctatcgtggttgttgcagtctggccgaccaactgatggcagtaaagagaccaccagcagtgacacctggcaatgacagatgcaagcccaacacccttttggtacgcaaaacctgctctcaataaattcccccaaagctctga

SEQ ID NO: 314539 - DNA, 1150 bp, Homo sapiens
gagtagattgctccagtgtactgtccgcaggggagcgctttgctttctctgattatagttctgaggccctagctactcactttgcaaactccaggctccggtcgcgcacgggacgaactgcggggagtgagccgcgcgggccgccgtagtcagctgctaagagcaggaagagtccgagcggcgggcggagtctgcaggatggcaccggacccctggttctccacatacgattctacttgtcaaattgcccaagaaattgctgagaaaattcaacaacgaaatcaatatgaacgaaaaggtgaaaaggcaccaaagcttaccgtgacaatcagagctttgttgcagaacctgaaggaaaagatcgcccttttgaaggacttattgctaagagctgtgtcaacacatcagataacacagcttgaaggggaccgaagacagaacctcttggatgatcttgtaactcgagagagactacttctggcatcctttaagaatgagggtgccgaaccagatctaatcaggtccagcctgatgagtgaagaggctaagcgaggagcacccaacccttggctctttgaggagccagaggagaccagaggcttgggttttgatgaaatccggcaacagcagcagaaaattatccaagaacaggatgcaggccttgatgccctttcctctatcataagtcgccaaaaacaaatggggcaggaaattgggaatgaattggatgaacaaaatgagataattgacgaccttgccaacctagtggagaacacagatgaaaaacttcgcaatgaaaccaggcgggtaaacatggtggacagaaagtcagcctcttgtgggatgatcatggtgattttactgctgcttgtggctatcgtggttgttgcagtctggccgaccaactgatggcagtaaagagaccaccagcagtgacacctggcaatgacagatgcaagcccaacacccttttggtacgcaaaacctgctctcaataaattcccccaaagctctgagtctggaaaaaaacaacaacaaacaaaaccgcggggctttgcggggggacaaaggtataagggacgggtatagtggttctgcaccctttgtaaaggggatgcgggcccaagggggataatgaaaacgtactaac

SEQ ID NO: 314540 - DNA, 994 bp, Homo sapiens
gagtagattgctccagtgtactgtccgcaggggagcgctttgctttctctgattatagttctgaggccctagctactcactttgcaaactccaggctccggtcgcgcacgggacgaactgcggggagtgagccgcgcgggccgccgtagtcagctgctaagagcaggaagagtccgagcggcgggcggagtctgcaggatggcaccggacccctggttctccacatacgattctacttgtcaaattgcccaagaaattgctgagaaaattcaacaacgaaatcaatatgaacgaaaaggtgaaaaggcaccaaagcttaccgtgacaatcagagctttgttgcagaacctgaaggaaaagatcgcccttttgaaggacttattgctaagagctgtgtcaacacatcagataacacagcttgaaggggaccgaagacagaacctcttggatgatcttgtaactcgagagagactacttctggcatcctttaagaatgagggtgccgaaccagatctaatcaggtccagcctgatgagtgaagaggctaagcgaggagcacccaacccttggctctttgaggagccagaggagaccagaggcttgggttttgatgaaatccggcaacagcagcagaaaattatccaagaacaggatgcaggccttgatgccctttcctctatcataagtcgccaaaaacaaatggggcaggaaattgggaatgaattggatgaacaaaatgagataattgacgaccttgccaacctagtggagaacacagatgaaaaacttcgcaatgaaaccaggcgggtaaacatggtggacagaaagtcagcctcttgtgggatgatcatggtgattttactgctgcttgtggctatcgtggttgttgcagtctggccgaccaacagcagtgacacctggcaatgacagatgcaagcccaacacccttttggtacgcaaaacctgctctcaataaattcccccaaagctctga

SEQ ID NO: 314541 - DNA, 1255 bp, Homo sapiens
gagtagattgctccagtgtactgtccgcaggggagcgctttgctttctctgattatagttctgaggccctagctactcactttgcaaactccaggctccggtcgcgcacgggacgaactgcggggagtgagccgcgcgggccgccgtagtcagctgctaagagcaggaagagtccgagcggcgggcggagtctgcaggatggcaccggacccctgatggagtctcacagtgtcgccgggctggagtgcaatggtgtgatctcagctcactgcaaccttcgcctcctgggttcaagcgattctcctgcctcagcctcccaagtagctgggattacaggcacccgccaccatgcctggctaattttttgtatttttagttgagacggggtttcactatgttggccaggctggtctcgaacttctgacctcatgatctgcccgcctcggcctcccaaagtgctgggattacaagcgtgagccaccgcatccggtctgcttaagtattttctatatgatagaaagtaaaaatgctctgagagaagcaaaacataaggggctattgggagttcaccgtgaacccttcaaagcctccaacgctgctgaatgacaactagaagcttattaaatgttttgagagaattctggcaagctcagatgtcaggttctccacatacgattctacttgtcaaattgcccaagaaattgctgagaaaattcaacaacgaaatcaatatgaacgaaaaggtgaaaaggcaccaaaggtccagcctgatgagtgaagaggctaagcgaggagcacccaacccttggctctttgaggagccagaggagaccagaggcttgggttttgatgaaatccggcaacagcagcagaaaattatccaagaacaggatgcaggccttgatgccctttcctctatcataagtcgccaaaaacaaatggggcaggaaattgggaatgaattggatgaacaaaatgagataattgacgaccttgccaacctagtggagaacacagatgaaaaacttcgcaatgaaaccaggcgggtaaacatggtggacagaaagtcagcctcttgtgggatgatcatggtgattttactgctgcttgtggctatcgtggttgttgcagtctggccgaccaactgatggcagtaaagagaccaccagcagtgacacctggcaatgacagatgcaagcccaacacccttttggtacgcaaaacctgctctcaataaattcccccaaagctctga

SEQ ID NO: 314542 - DNA, 782 bp, Homo sapiens
gagtagattgctccagtgtactgtccgcaggggagcgctttgctttctctgattatagttctgaggccctagctactcactttgcaaactccaggctccggtcgcgcacgggacgaactgcggggagtgagccgcgcgggccgccgtagtcagctgctaagagcaggaagagtccgagcggcgggcggagtctgcaggatggcaccggacccctggttctccacatacgattctacttgtcaaattgcccaagaaattgctgagaaaattcaacaacgaaatcaatatgaacgaaaaggtgaaaaggcaccaaagcttaccgtgacaatcagagctttgttgcagaacctgaaggaaaagatcgcccttttgaaggacttattgctaagagctgtgtcaacacatcagataacacagcttgaaggggaccgaagacagaacctcttggatgatcttgtaactcgagagagactacttctggcatcctttaagaatgagggtgccgaaccagatctaatcaggtccagcctgatgagtgaagaggctaagcgaggagcacccaacccttggctctttgaggagccagaggagaccagaggcttgggttttgatgaaatccggcaacagcagcagaaaattatccaagaacaggatgcaggccttgatgccctttcctctatcataagtcgccaaaaacaaatggggcaggaaattgggaatgaattggatgaacaaaatggtaagaataagtctgggattgaccagatttgccgttgacataa

SEQ ID NO: 314543 - DNA, 685 bp, Homo sapiens
gagtagattgctccagtgtactgtccgcaggggagcgctttgctttctctgattatagttctgaggccctagctactcactttgcaaactccaggctccggtcgcgcacgggacgaactgcggggagtgagccgcgcgggccgccgtagtcagctgctaagagcaggaagagtccgagcggcgggcggagtctgcaggatggcaccggacccctggttctccacatacgattctacttgtcaaattgcccaagaaattgctgagaaaattcaacaacgaaatcaatatgaacgaaaaggtgaaaaggcaccaaagaacaggatgcaggccttgatgccctttcctctatcataagtcgccaaaaacaaatggggcaggaaattgggaatgaattggatgaacaaaatgagataattgacgaccttgccaacctagtggagaacacagatgaaaaacttcgcaatgaaaccaggcgggtaaacatggtggacagaaagtcagcctcttgtgggatgatcatggtgattttactgctgcttgtggctatcgtggttgttgcagtctggccgaccaactgatggcagtaaagagaccaccagcagtgacacctggcaatgacagatgcaagcccaacacccttttggtacgcaaaacctgctctcaataaattcccccaaagctctga

SEQ ID NO: 314544 - DNA, 626 bp, Homo sapiens
gagtagattgctccagtgtactgtccgcaggggagcgctttgctttctctgattatagttctgaggccctagctactcactttgcaaactccaggctccggtcgcgcacgggacgaactgcggggagtgagccgcgcgggccgccgtagtcagctgctaagagcaggaagagtccgagcggcgggcggagtctgcaggatggcaccggacccctggttctccacatacgattctacttgtcaaattgcccaagaaattgctgagaaaattcaacaacgaaatcaatatgaacgaaaaggtgaaaaggcaccaaagcttaccgtgacaatcagagctttgttgcagaacctgaaggaaaagatcgcccttttgaaggacttattgctaagagctgtgtcaacacatcagataacacagcttgaaggggaccgaagacagaacctcttggatgatcttgtaactcgagagagactacttctggcatcctttaagaatgagggtgccgaaccagatctaatcaggaccagaagtctaggatggttcagaataaggttctagaagaattctgtttaaaaataatgtaagtactgtcaaggagaaatgactcctgtggagtgatttggaga

SEQ ID NO: 314545 - DNA, 391 bp, Homo sapiens
gcttccaggctcacccccatcttagttaaacctgcagaggggatgttaattagcaaagactggcgctcagggagttgggggagctcttagccctctcccttccaagaaagatgaccttttggacccaaaaaggagaattgggctccagttgctctcgttcgaggcactcggagtgcttcccacgtatctcatttatcctcatgacaccccagagagggatgatcatggtgattttactgctgcttgtggctatcgtggttgttgcagtctggccgaccaactgatggcagtaaagagaccaccagcagtgacacctggcaatgacagatgcaagcccaacacccttttggtacgcaaaacctgctctcaataaattcccccaaagctctga

SEQ ID NO: 314546 - DNA, 247 bp, Homo sapiens
aacaaccacagctgtgatactgtgatgtgaaccggggtatttcaggaatagtaatcatgtatgtttcctttctagagataattgacgaccttgccaacctagtggagaacacagatgaaaaacttcgcaatgaaaccaggcgggtaaacatggtggacagaaagtcagcctcttgtggtaagagatagctacgttatggctctgtttctgtcatagcttgtggatttactctgctctgagtttcctg

SEQ ID NO: 314547 - DNA, 453 bp, Homo sapiens
caccttacctcttgataccttgtatgtaaaatggggattcatatgccaagataagaatcgcttggagggccttgcttaaaatactgatcctgaggccctcccctggggattctgattgagtagatctagggtggagttccaagaatgttccattatttaacaagtgtaccaagcagttctgctgcaggtgcttgttctgcagaaattctgatgcagacttttgtgaggtttaaattgtgtattgccggtgcacagtgccttgcccaaaggtacgtgatgataaatgatgggaatagcagtagtaatcacagtaattgtttttgggtgcttcgtctcacaagggtgcaccaagattataaagctgacatatttatgaaaactagaatcacaggccacctgcagtggctcaggagtttgagaccagcctgggcaacatagcaagacctctctgtc

SEQ ID NO: 314548 - DNA, 1058 bp, Homo sapiens
gagtagattgctccagtgtactgtccgcaggggagcgctttgctttctctgattatagttctgaggccctagctactcactttgcaaactccaggctccggtcgcgcacgggacgaactgcggggagtgagccgcgcgggccgccgtagtcagctgctaagagcaggaagagtccgagcggcgggcggagtctgcaggatggcaccggacccctggttctccacatacgattctacttgtcaaattgcccaagaaattgctgagaaaattcaacaacgaaatcaatatgaacgaaaaggtgaaaaggcaccaaagcttaccgtgacaatcagagctttgttgcagaacctgaaggaaaagatcgcccttttgaaggacttattgctaagagctgtgtcaacacatcagataacacagcttgaaggggaccgaagacagaacctcttggatgatcttgtaactcgagagagactacttctggcatcctttaagaatgagggtgccgaaccagatctaatcaggtccagcctgatgagtgaagaggctaagcgaggagcacccaacccttggctctttgaggagccagaggagaccagaggcttgggttttgatgaaatccggcaacagcagcagaaaattatccaagaacaggatgcaggccttgatgccctttcctctatcataagtcgccaaaaacaaatggggcaggaaattgggaatgaattggatgaacaaaatgagataattgacgaccttgccaacctagtggagaacacagatgaaaaacttcgcaatgaaaccaggcgggtaaacatggtggacagaaagtcagcctcttgtgggatgatcatggtgattttactgctgcttgtggctatcgtggttgttgcagtctggccgaccaactgatggcagtaaagagaccaccagcagtgacacctggcaatgacagatgcaagcccaacacccttttggtacgcaaaacctgctctcaataaattcccccaaagctctgaaaaaaaaaagtcgacgcggccgcgaatttagtagtagtagta

SEQ ID NO: 314549 - DNA, 1507 bp, Homo sapiens
gagtagattgctccagtgtactgtccgcaggggagcgctttgctttctctgattatagttctgaggccctagctactcactttgcaaactccaggctccggtcgcgcacgggacgaactgcggggagtgagccgcgcgggccgccgtagtcagctgctaagagcaggaagagtccgagcggcgggcggagtctgcaggatggcaccggacccctggttctccacatacgattctacttgtcaaattgcccaagaaattgctgagaaaattcaacaacgaaatcaatatgaacgaaaaggtgaaaaggcaccaaagcttaccgtgacaatcagagctttgttgcagaacctgaaggaaaagatcgcccttttgaaggacttattgctaagagctgtgtcaacacatcagataacacagcttgaaggggaccgaagacagaacctcttggatgatcttgtaactcgagagagactacttctggcatcctttaagaatgagggtgccgaaccagatctaatcaggtccagcctgatgagtgaagaggctaagcgaggagcacccaacccttggctctttgaggagccagaggagaccagaggcttgggttttgatgaaatccggcaacagcagcagaaaattatccaagaacaggatgcaggccttgatgccctttcctctatcataagtcgccaaaaacaaatggggcaggaaattgggaatgaattggatgaacaaaatgagataattgacgaccttgccaacctagtggagaacacagatgaaaaacttcgcaatgaaaccaggcgggtaaacatggtggacagaaagtcagcctcttgtggtaagagatagctacgttatggctctgtttctgtcatagcttgtggatttactctgctctgagtttcctgtttgtctaattactgtggggatttggttgctcttctgatacaggcagttccatttgatgaagcactgaaattgctaaacaatggttaaatctggtcaaaatgaaatggagttcaaagggcatatcattcattgtttttttgttgttgtttttgtttttaatttaaaagtcctttctgtgtgtttacagagattaatggtttgggaaattgtataacattatactggttggcgggttttaaaggggatctcacttgcttttgtgccgtcttaaaataaccacaagcttaattgagttcaaatcctatgtttagtgatggtatctttgtcaagtcaccttacctcttgataccttgtatgtaaaatggggattcatatgccaagataagaatcgcttggagggccttgcttaaaatactgatcctgaggccctcccctggggattctgattgagtagatctagggtggagttccaagaatgttccattatttaacaagtgtaccaagcagttctgctgcaggtgcttgttctgcagaaattctgatgcagacttttgtgaggtttaaattgtgtattgccggtgcacagtgccttgcc

SEQ ID NO: 314550 - DNA, 1298 bp, Homo sapiens
gagtagattgctccagtgtactgtccgcaggggagcgctttgctttctctgattatagttctgaggccctagctactcactttgcaaactccaggctccggtcgcgcacgggacgaactgcggggagtgagccgcgcgggccgccgtagtcagctgctaagagcaggaagagtccgagcggcgggcggagtctgcaggatggcaccggacccctggttctccacatacgattctacttgtcaaattgcccaagaaattgctgagaaaattcaacaacgaaatcaatatgaacgaaaaggtgaaaaggcaccaaagcttaccgtgacaatcagagctttgttgcagaacctgaaggaaaagatcgcccttttgaaggacttattgctaagagctgtgtcaacacatcagataacacagcttgaaggggaccgaagacagaacctcttggatgatcttgtaactcgagagagactacttctggcatcctttaagaatgagggtgccgaaccagatctaatcaggtccagcctgatgagtgaagaggctaagcgaggagcacccaacccttggctctttgaggagccagaggagaccagaggcttgggttttgatgaaatccggcaacagcagcagaaaattatccaagaacaggatgcaggccttgatgccctttcctctatcataagtcgccaaaaacaaatggggcaggaaattgggaatgaattggatgaacaaaatgagataattgacgaccttgccaacctagtggagaacacagatgaaaaacttcgcaatgaaaccaggcgggtaaacatggtggacagaaagtcagcctcttgtgggatgatcatggtgattttactgctgcttgtggctatcgtggttgttgcagtctggccgaccaactgatggcagtaaagagaccaccagcagtgacacctggcaatgacagatgcaagcccaacacccttttggtacgcaaaacctgctctcaataaattcccccaaagctctgaaaaaaaaaacaaaaaagggcgcgcacaaataccccaggggcaacacaggtaccccattcggtaacaggggccccacaggagcgaaacacacgacgcgccgcagaaaagcacggaaggaaaggacacgacacagagaacaccaccctgggggaaaaagcgcaccaacaaaagcagaaaacgacgacagagaacacactggcgaagtgttaacacaaagaagcaacacacaccgacgaagacaagaagcagacagcagagcatcacaccagcaacatcaaacag

SEQ ID NO: 314551 - DNA, 1824 bp, Homo sapiens
  misc_feature (862)..(862): n is a, c, g, or t
  misc_feature (884)..(884): n is a, c, g, or t
gagtagattgctccagtgtactgtccgcaggggagcgctttgctttctctgattatagttctgaggccctagctactcactttgcaaactccaggctccggtcgcgcacgggacgaactgcggggagtgagccgcgcgggccgccgtagtcagctgctaagagcaggaagagtccgagcggcgggcggagtctgcaggatggcaccggacccctgatggagtctcacagtgtcgccgggctggagtgcaatggtgtgatctcagctcactgcaaccttcgcctcctgggttcaagcgattctcctgcctcagcctcccaagtagctgggattacaggcacccgccaccatgcctggctaattttttgtatttttagttgagacggggtttcactatgttggccaggctggtctcgaacttctgacctcatgatctgcccgcctcggcctcccaaagtgctgggattacaagcgtgagccaccgcatccggtctgcttaagtattttctatatgatagaaagtaaaaatgctctgagagaagcaaaacataaggggctattgggagttcaccgtgaacccttcaaagcctccaacgctgctgaatgacaactagaagcttattaaatgttttgagagaattctggcaagctcagatgtcaggttctccacatacgattctacttgtcaaattgcccaagaaattgctgagaaaattcaacaacgaaatcaatatgaacgaaaaggtgaaaaggcaccaaagcataggcgagccgaagagcttacacgtgacagagtcatggagccttgtgtctgctaagacaccgtcgaaggcgacaaaggatgcgcacctgttgtgatacgngaatcattacttcgccctacangagtcgtcgtagtctagacgagcagtcagactaaacacaagtcgttggaacgaacacagcttgaaggggaccgaagacagaacctcttggatgatcttgtaactcgagagagactacttctggcatcctttaagaatgagggtgccgaaccagatctaatcaggtccagcctgatgagtgaagaggctaagcgaggagcacccaacccttggctctttgaggagccagaggagaccagaggcttgggttttgatgaaatccggcaacagcagcagaaaattatccaagaacaggatgcaggccttgatgccctttcctctatcataagtcgccaaaaacaaatggggcaggaaattgggaatgaattggatgaacaaaatgagataattgacgaccttgccaacctagtggagaacacagatgaaaaacttcgcaatgaaaccaggcgggtaaacatggtggacagaaagtcagcctcttgtgggatgatcatggtgattttactgctgcttgtggctatcgtggttgttgcagtctggccgaccaactgatggcagtaaagagaccaccagcagtgacacctggcaatgacagatgcaagcccaacacccttttggtacgcaaaacctgctctcaataaattcccccaaagctctgaaaaaaaaaacaaaaaagggcgcgcacaaataccccaggggcaacacaggtaccccattcggtaacaggggccccacaggagcgaaacacacgacgcgccgcagaaaagcacggaaggaaaggacacgacacagagaacaccaccctgggggaaaaagcgcaccaacaaaagcagaaaacgacgacagagaacacactggcgaagtgttaacacaaagaagcaacacacaccgacgaagacaagaagcagacagcagagcatcacaccagcaacatcaaacag

SEQ ID NO: 314552 - DNA, 1198 bp, Homo sapiens
gagtagattgctccagtgtactgtccgcaggggagcgctttgctttctctgattatagttctgaggccctagctactcactttgcaaactccaggctccggtcgcgcacgggacgaactgcggggagtgagccgcgcgggccgccgtagtcagctgctaagagcaggaagagtccgagcggcgggcggagtctgcaggatggcaccggacccctgcttaccgtgacaatcagagctttgttgcagaacctgaaggaaaagatcgcccttttgaaggacttattgctaagagctgtgtcaacacatcagataacacagcttgaaggggaccgaagacagaacctcttggatgatcttgtaactcgagagagactacttctggcatcctttaagaatgagggtgccgaaccagatctaatcaggtccagcctgatgagtgaagaggctaagcgaggagcacccaacccttggctctttgaggagccagaggagaccagaggcttgggttttgatgaaatccggcaacagcagcagaaaattatccaagaacaggatgcaggccttgatgccctttcctctatcataagtcgccaaaaacaaatggggcaggaaattgggaatgaattggatgaacaaaatgagataattgacgaccttgccaacctagtggagaacacagatgaaaaacttcgcaatgaaaccaggcgggtaaacatggtggacagaaagtcagcctcttgtgggatgatcatggtgattttactgctgcttgtggctatcgtggttgttgcagtctggccgaccaactgatggcagtaaagagaccaccagcagtgacacctggcaatgacagatgcaagcccaacacccttttggtacgcaaaacctgctctcaataaattcccccaaagctctgaaaaaaaaaacaaaaaagggcgcgcacaaataccccaggggcaacacaggtaccccattcggtaacaggggccccacaggagcgaaacacacgacgcgccgcagaaaagcacggaaggaaaggacacgacacagagaacaccaccctgggggaaaaagcgcaccaacaaaagcagaaaacgacgacagagaacacactggcgaagtgttaacacaaagaagcaacacacaccgacgaagacaagaagcagacagcagagcatcacaccagcaacatcaaacag

SEQ ID NO: 314553 - DNA, 961 bp, Homo sapiens
gagtagattgctccagtgtactgtccgcaggggagcgctttgctttctctgattatagttctgaggccctagctactcactttgcaaactccaggctccggtcgcgcacgggacgaactgcggggagtgagccgcgcgggccgccgtagtcagctgctaagagcaggaagagtccgagcggcgggcggagtctgcaggatggcaccggacccctggttctccacatacgattctacttgtcaaattgcccaagaaattgctgagaaaattcaacaacgaaatcaatatgaacgaaaaggtgaaaaggcaccaaagcttaccgtgacaatcagagctttgttgcagaacctgaaggaaaagatcgcccttttgaaggacttattgctaagagctgtgtcaacacatcagataacacagcttgaaggggaccgaagacagaacctcttggatgatcttgtaactcgagagagactacttctggcatcctttaagaatgagggtgccgaaccagatctaatcaggtccagcctgatgagtgaagaggctaagcgaggagcacccaacccttggctctttgaggagccagaggagaccagaggcttgggttttgatgaaatccggcaacagcagcagaaaattatccaagaacaggatgcaggccttgatgccctttcctctatcataagtcgccaaaaacaaatggggcaggaaattgggaatgaattggatgaacaaaatgagataattgacgaccttgccaacctagtggagaacacagatgaaaaaggatgatcatggtgattttactgctgcttgtggctatcgtggttgttgcagtctggccgaccaactgatggcagtaaagagaccaccagcagtgacacctggcaatgacagatgcaagcccaacacccttttggtacgcaaaacctgctctcaataaattcccccaaagctctga

SEQ ID NO: 314554 - DNA, 753 bp, Homo sapiens
ggctgtcatcacttagacctcaccctgtggagccacaccctagggttggccaatctactcccaggagcagggagggcaggagccagggctgggcataaaagtcagggcagagcatctcttgcttacatttgcttctgacacaactgtgttcactagcaacctcaaacagacaccatggtgcacctgactcctgaggagaagtctgccgttactgccctgtggggcaaggtgaacgtggatgaagttggtggtgaggccctgggcaggctgctggtggtctacccttggacccagaggttctttgagtcctttggggatctgtccactcctgatgctgttatgggcaaccctaaggtgaaggctcatggcaagaaagtgctcggtgcctttagtgatggcctggctcacctggacaacctcaagggcacctttgccacactgagtgagctgcactgtgacaagctgcacgtggatcctgagaacttcaggctcctggggcaacgtgctggtctgtgttgctggcccatcactttgggcaaagaattcaccccaccagtgcaggctgcctattcagaaagtggtggctggtgtggctaatgccctggcccacaagtatcactaagctcgctttcttgctgtccaatttctattaaaggttcctttgttccctaagtccaactactaaactgggggatattatgaagggccttgagcatctggattctgcctaataaaaaacatttattttcattg

SEQ ID NO: 314555 - DNA, 721 bp, Homo sapiens
ggctgtcatcacttagacctcaccctgtggagccacaccctagggttggccaatctactcccaggagcagggagggcaggagccagggctgggcataaaagtcagggcagagcatctcttgcttacatttgcttctgacacaactgtgttcactagcaacctcaaacagacaccatggtgcacctgactcctgaggagaagtctgccgttactgccctgtggggcaaggtgaacgtggatgaagttggtggtgaggccctgggcaggctgctggtggtctacccttggacccagaggttctttgagtcctttggggatctgtccactcctgatgctgttatgggcaaccctaaggtgaaggctcatggcaagaaagtgctcggtgcctttagtgatggcctggctcacctggacaacctcaagggcacctttgccacactgagtgagctgcactgtgacaagctgcacgtggatcctgagaacttcaggctcctggggcaacgtgctggtctgtgttgctggcccatcactttgggcaaagaattcaccccaccagtgcaggctgcctattcagaaagtggtggctggtgtggctaatgccctggaacagtgactgagaagaccaaagagcaagtgacaaacgccgaaggagcagtggcgacgggcgtgacagcagtagcccagaagacagcggagggagcagggggcatcgcagcagcca

SEQ ID NO: 314556 - DNA, 529 bp, Homo sapiens
ggctgtcatcacttagacctcaccctgtggagccacaccctagggttggccaatctactcccaggagcagggagggcaggagccagggctgggcataaaagtcagggcagagcatctcttgcttacatttgcttctgacacaactgtgttcactagcaacctcaaacagacaccatggtgcacctgactcctgaggagaagtctgccgttactgccctgtggggcaaggtgaacgtggatgaagttggtggtgaggccctgggcaggctgctggtggtctacccttggacccagaggttctttgagtcctttggggatctgtccactcctgatgctgttatgggcaaccctaaggtgaaggctcatggcaagaaagtgctcggtgcctttagtgatggcctggctcacctggacaacctcaagggcacctttgccacactgagtgagctgcactgtgacaagctgcacgtggatcctgagaacttcaggctctggcaacgtctgtctggtgctgccatacttcaagata

SEQ ID NO: 314557 - DNA, 604 bp, Homo sapiens
  misc_feature (6)..(6): n is a, c, g, or t
cccggncccggggaattcccgcaccatggtgcacctgactcctgaggagaagtctgccgttactgccctgtggggcaaggtgaacgtggatgaagttggtggtgaggccctgggcaggctgctggtggtctacccttggacccagaggttctttgagtcctttggggatctgtccactcctgatgctgttatgggcaaccctaaggtgaaggctcatggcaagaaagtgctcggtgcctttagtgatggcctggctcacctggacaacctcaagggcacctttgccacactgagtgagctgcactgtgacaagctgcacgtggatcctgagaacttcaggctcctggggcaacgtgctggtctgtgttgctggcccatcactttgggcaaagaattcaccccaccagtgcaggctgcctattcagaaagtggtggctggtgtggctaatgccctggcccacaagtatcactaagctcgctttcttgctgtccaatttctattaaaggttcctttgttccctaagtccaactactaaactgggggatattatgaagggccttgagcatctggattctgcctaataaaaaacatttattttcattg

SEQ ID NO: 314558 - DNA, 760 bp, Homo sapiens
ttttttttgtaaaaaggctttatttgcaggggagcaggaatttaatcaaaaaggccaaatcccatgtcatcatctgactcttcagactcctccttcttctcatctttcttctcctctgctgcagcaggggcagaaccagcagcaggggctgcagagcctggggcagcagagacggctcaccatggtgcacctgactcctgaggagaagtctgccgttactgccctgtggggcaaggtgaacgtggatgaagttggtggtgaggccctgggcaggctgctggtggtctacccttggacccagaggttctttgagtcctttggggatctgtccactcctgatgctgttatgggcaaccctaaggtgaaggctcatggcaagaaagtgctcggtgcctttagtgatggcctggctcacctggacaacctcaagggcacctttgccacactgagtgagctgcactgtgacaagctgcacgtggatcctgagaacttcaggctcctggggcaacgtgctggtctgtgttgctggcccatcactttgggcaaagaattcaccccaccagtgcaggctgcctattcagaaagtggtggctggtgtggctaatgccctggcccacaagtatcactaagctcgctttcttgctgtccaatttctattaaaggttcctttgttccctaagtccaactactaaactgggggatattatgaagggccttgagcatctggattctgcctaataaaaaacatttattttcattg

SEQ ID NO: 314559 - DNA, 885 bp, Homo sapiens
ggctgtcatcacttagacctcaccctgtggagccacaccctagggttggccaatctactcccaggagcagggagggcaggagccagggctgggcataaaagtcagggcagagcatctcttgcttacatttgcttctgacacaactgtgttcactagcaacctcaaacagacaccatggtgcacctgactcctgaggagaagtctgccgttactgccctgtggggcaaggtgaacgtggatgaagttggtggtgaggccctgggcagaggttggtatcaaggttacaagacaggtttaaggagaccaatagaaactgggcatgtggagacagagaagactcttgggtttctgataggcactgactctctctgcctattggtctattttcccacccttaggctgctggtggtctacccttggacccagaggttctttgagtcctttggggatctgtccactcctgatgctgttatgggcaaccctaaggtgaaggctcatggcaagaaagtgctcggtgcctttagtgatggcctggctcacctggacaacctcaagggcacctttgccacactgagtgagctgcactgtgacaagctgcacgtggatcctgagaacttcaggctcctggggcaacgtgctggtctgtgttgctggcccatcactttgggcaaagaattcaccccaccagtgcaggctgcctattcagaaagtggtggctggtgtggctaatgccctggcccacaagtatcactaagctcgctttcttgctgtccaatttctattaaaggttcctttgttccctaagtccaactactaaactgggggatattatgaagggccttgagcatctggattctgcctaataaaaaacatttattttcattg

SEQ ID NO: 314560 - DNA, 717 bp, Homo sapiens
  misc_feature (6)..(6): n is a, c, g, or t
  misc_feature (39)..(39): n is a, c, g, or t
  misc_feature (67)..(67): n is a, c, g, or t
  misc_feature (134)..(134): n is a, c, g, or t
  misc_feature (138)..(138): n is a, c, g, or t
cccggngcaattcagagcatgatcccccctactggcggngtgctgtgtggctcaatgtcaactaccnggctttgggagcactccaccactatgggcatctggagggtcctcaccaggctcgggctgccaaactncacnggagctccgtgccaacgtggtaggcaatgtatggcgccagtaccaggctacaggctttctttgggagcagttggtggtgaggccctgggcaggctgctggtggtctacccttggacccagaggttctttgagtcctttggggatctgtccactcctgatgctgttatgggcaaccctaaggtgaaggctcatggcaagaaagtgctcggtgcctttagtgatggcctggctcacctggacaacctcaagggcacctttgccacactgagtgagctgcactgtgacaagctgcacgtggatcctgagaacttcaggctcctggggcaacgtgctggtctgtgttgctggcccatcactttgggcaaagaattcaccccaccagtgcaggctgcctattcagaaagtggtggctggtgtggctaatgccctggcccacaagtatcactaagctcgctttcttgctgtccaatttctattaaaggttcctttgttccctaagtccaactactaaactgggggatattatgaagggccttgagcatctggattctgcctaataaaaaacatttattttcattg

SEQ ID NO: 314561 - DNA, 548 bp, Homo sapiens
  misc_feature (12)..(12): n is a, c, g, or t
  misc_feature (23)..(23): n is a, c, g, or t
gtaacagtaggnacttcaacctnttcaacaggttttggaggtggtggttctggtactgcaggctgctggtggtctacccttggacccagaggttctttgagtcctttggggatctgtccactcctgatgctgttatgggcaaccctaaggtgaaggctcatggcaagaaagtgctcggtgcctttagtgatggcctggctcacctggacaacctcaagggcacctttgccacactgagtgagctgcactgtgacaagctgcacgtggatcctgagaacttcaggctcctggggcaacgtgctggtctgtgttgctggcccatcactttgggcaaagaattcaccccaccagtgcaggctgcctattcagaaagtggtggctggtgtggctaatgccctggcccacaagtatcactaagctcgctttcttgctgtccaatttctattaaaggttcctttgttccctaagtccaactactaaactgggggatattatgaagggccttgagcatctggattctgcctaataaaaaacatttattttcattg

SEQ ID NO: 314562 - DNA, 726 bp, Homo sapiens
ggctgtcatcacttagacctcaccctgtggagccacaccctagggttggccaatctactcccaggagcagggagggcaggagccagggctgggcataaaagtcagggcagagcatctcttgcttacatttgcttctgacacaactgtgttcactagcaacctcaaacagacaccatggtgcacctgactcctgaggagaagtctgccgttactgccctgtggggcaaggtgaacgtggatgaagttggtggtgaggccctgggcaggaggttctttgagtcctttggggatctgtccactcctgatgctgttatgggcaaccctaaggtgaaggctcatggcaagaaagtgctcggtgcctttagtgatggcctggctcacctggacaacctcaagggcacctttgccacactgagtgagctgcactgtgacaagctgcacgtggatcctgagaacttcaggctcctggggcaacgtgctggtctgtgttgctggcccatcactttgggcaaagaattcaccccaccagtgcaggctgcctattcagaaagtggtggctggtgtggctaatgccctggcccacaagtatcactaagctcgctttcttgctgtccaatttctattaaaggttcctttgttccctaagtccaactactaaactgggggatattatgaagggccttgagcatctggattctgcctaataaaaaacatttattttcattg

SEQ ID NO: 314563 - DNA, 549 bp, Homo sapiens
gacgctctctctgatggggccaagtgtaacgtgtattatcttgaatgtgacggtctgggatgtctgtctgtgagcgtctaaccttcgtggaggttctttgagtcctttggggatctgtccactcctgatgctgttatgggcaaccctaaggtgaaggctcatggcaagaaagtgctcggtgcctttagtgatggcctggctcacctggacaacctcaagggcacctttgccacactgagtgagctgcactgtgacaagctgcacgtggatcctgagaacttcaggctcctggggcaacgtgctggtctgtgttgctggcccatcactttgggcaaagaattcaccccaccagtgcaggctgcctattcagaaagtggtggctggtgtggctaatgccctggcccacaagtatcactaagctcgctttcttgctgtccaatttctattaaaggttcctttgttccctaagtccaactactaaactgggggatattatgaagggccttgagcatctggattctgcctaataaaaaacatttattttcattg

SEQ ID NO: 314564 - DNA, 542 bp, Homo sapiens
ggctgtcatcacttagacctcaccctgtggagccacaccctagggttggccaatctactcccaggagcagggagggcaggagccagggctgggcataaaagtcagggcagagcatctcttgcttacatttgcttctgacacaactgtgttcactagcaacctcaaacagacaccatggtgcacctgactcctgaggagaagtctgccgttactgccctgtggggcaaggtgaacgtggatgaagttggtggtgaggccctgggcaggctgctggtggtctacccttggacccagaggttctttgagtcctttggggatctgtccactcctgatgctgttatgggcaaccctaaggtgaaggctcatggcaagaaagtgctcggtgcctttagtgcccacaagtatcactaagctcgctttcttgctgtccaatttctattaaaggttcctttgttccctaagtccaactactaaactgggggatattatgaagggccttgagcatctggattctgcctaataaaaaacatttattttcattg

SEQ ID NO: 314565 - DNA, 458 bp, Homo sapiens
ggctgtcatcacttagacctcaccctgtggagccacaccctagggttggccaatctactcccaggagcagggagggcaggagccagggctgggcataaaagtcagggcagagcatctcttgcttacatttgcttctgacacaactgtgttcactagcaacctcaaacagacaccatggtgcacctgactcctgaggagaagtctgccgttactgccctgtggggcaaggtgaacgtggatgaagttggtggtgaggccctgggcaggctgctggtggtctacccttggacccagaggttctttgagtcctttggggatctgtccactcctgatgctgttatgggcaaccctaaggtgaaggctcatggcaagaaagtgctcggtgcctttagtgtcaaagcctctgaggaggcgtttttacaggggccgtgtttaggaggcctttcacccatgggaaa

SEQ ID NO: 314566 - DNA, 510 bp, Homo sapiens
ggctgtcatcacttagacctcaccctgtggagccacaccctagggttggccaatctactcccaggagcagggagggcaggagccagggctgggcataaaagtcagggcagagcatctcttgcttacatttgcttctgacacaactgtgttcactagcaacctcaaacagacaccatggtgcacctgactcctgaggagaagtctgccgttactgccctgtggggcaaggtgaacgtggatgaagttggtggtgaggccctgggcaggctgctggtggtctacccttggacccagaggttctttgagtcctttggggatctgtccactcctgatgctgttatgggcaaccctaaggtgaaggctcatggcaagaaagtgctcggtgcctttagtgaagggcacctttgtccacacttagttagctgtcacttttacaagtcttcacgttgtatccttagtaacttagtctccttgtgcaacgtgtctgtttctgtgttctgtgcgcatcac

SEQ ID NO: 314567 - DNA, 633 bp, Homo sapiens
  misc_feature (6)..(6): n is a, c, g, or t
cccggncccggggaattcccgaactgtgttcactagcaacctcaaacagacaccatggtgcacctgactcctgaggagaagtctgccgttactgccctgtggggcaaggtgaacgtggatgaagttggtggtgaggccctgggcaggctgctggtggtctacccttggacccagaggttctttgagtcctttggggatctgtccactcctgatgctgttatgggcaaccctaaggtgaaggctcatggcaagaaagtgctcggtgcctttagtgatggcctggctcacctggacaacctcaagggcacctttgccacactgagtgagctgcactgtgacaagctgcacgtggatcctgagaacttcaggctcctggggcaacgtgctggtctgtgttgctggcccatcactttgggcaaagaattcaccccaccagtgcaggctgcctattcagaaagtggtggctggtgtggctaatgccctggcccacaagtatcactaagctcgctttcttgctgtccaatttctattaaaggttcctttgttccctaagtccaactactaaactgggggatattatgaagggccttgagcatctggattctgcctaataaaaaacatttattttcattg

SEQ ID NO: 314568 - DNA, 911 bp, Homo sapiens
ggctgtcatcacttagacctcaccctgtggagccacaccctagggttggccaatctactcccaggagcagggagggcaggagccagggctgggcataaaagtcagggcagagcatctcttgcttacatttgcttctgacacaactgtgttcactagcaacctcaaacagacaccatggtgcacctgactcctgaggagaagtctgccgttactgccctgtggggcaaggtgaacgtggatgaagttggtggtgaggccctgggcaggctgctggtggtctacccttggacccagaggttctttgagtcctttggggatctgtccactcctgatgctgttatgggcaaccctaaggtgaaggctcatggcaagaaagtgctcggtgcctttagtgatggcctggctcacctggacaacctcaagggcacctttgccacactgagtgagctgcactgtgacaagctgcacgtggatcctgagaacttcaggctcctggggcaacgtgctggtctgtgttgctggcccatcactttgggcaaagaattcaccccaccagtgcaggctgcctattcagaaagtggtggctggtgtggctaatgccctggcccacaagtatcactaagctcgctttcttgctgtccaatttctattaaaggttcctttgttccctaagtccaactactaaactgggggatattatgaagggccttgagcatctggattctgcctaataaaaaacatttattttcattgaaaaaaaaaaaaaaaaaaaaaaaaaaaaaaaaaaaccccacttttttttttgggggccgggggggggggggggggggcacaaaggggggcccaggggccgggggaagggggggggggggggcccgtcccccaagagatgcccacacagggggtggcgg

SEQ ID NO: 314569 - DNA, 784 bp, Homo sapiens
gggtctcgctatgttgcccaggctggtcttgggctcctgacctgaggtggtcctcccactggcctcacaatgttgggattacaggtataagccactgcacacggccttactatgctatcaattccatatatggaaaggtgttttccctttcagagctctttaaagctctgcagaagatttacatgtgtttatagagctaagagaaatcagggcatggaaattgagtgtgtaataaaaattaaactcttcatgttatataatcatgcataacttctatcttcattctctgaagttgcctagagcaccatcacagctaggaagcttccatcatgaattaccttatttccaaaagcaagtactcaaataattgtctcaagagaggaaggacaaaactgttacaagctgaaatatttggggatttgtttgacttgactagggaaccacaagttttcatataatgcctgatttagccctgtgcctaacagtttaaatcttaatgctaatgttaattgcttcccagttggttgaccttataagaaaacactgtgtggtattttaatgtggtaaacatgtgaatgaaggcctgtggctcagttaatcactcccacaactttgagctgtgagttttactggtggaaggaactttaacaggtcttcgctcttgtcattagatatcaaagaactgaaattagttggaattgtaagcagtgaatagatgtgttgttagaatgattccatcacttatacattgtttaaaatgctaataaagtaacttgctttgtaa

SEQ ID NO: 314570 - DNA, 732 bp, Homo sapiens
gggtctcgctatgttgcccaggctggtcttgggctcctgacctgaggtggtcctcccactggcctcacaatgttgggattacaggtataagccactgcacacggccttactatgctatcaattccatatatggaaaggtgttttccctttcagagctctttaaagctctgcagaagatttacatgtgtttatagagctaagagaaatcagggcatggaaattgagtgtgtaataaaaattaaactcttcatgttatataatcatgcataacttctatcttcattctctgaagttgcctagagcaccatcacagctaggaagcttccatcatgaattaccttatttccaaaagcaagtactcaaataattgtctcaagagaggaaggacaaaactgttttcatataatgcctgatttagccctgtgcctaacagtttaaatcttaatgctaatgttaattgcttcccagttggttgaccttataagaaaacactgtgtggtattttaatgtggtaaacatgtgaatgaaggcctgtggctcagttaatcactcccacaactttgagctgtgagttttactggtggaaggaactttaacaggtcttcgctcttgtcattagatatcaaagaactgaaattagttggaattgtaagcagtgaatagatgtgttgttagaatgattccatcacttatacattgtttaaaatgctaataaagtaacttgctttgtaa

SEQ ID NO: 314571 - DNA, 270 bp, Homo sapiens
gcggcccctactactactactgctcgaattcaagcttctaacgatgtacggggacatgtgaatgaaggcctgtggctcagttaatcactcccacaactttgagctgtgagttttactggtggaaggaactttaacaggtcttcgctcttgtcattagatatcaaagaactgaaattagttggaattgtaagcagtgaatagatgtgttgttagaatgattccatcacttatacattgtttaaaatgctaataaagtaacttgctttgtaa

SEQ ID NO: 314572 - DNA, 1791 bp, Homo sapiens
gagtggagtgggacaggtatataaaggaagtacagggcctggggaagaggccctgtctaggtagctggcaccaggagccgtgggcaagggaagaggccacaccctgccctgctctgctgcagccagaatgggtgtgaaggcgtctcaaacaggctttgtggtcctggtgctgctccagtgctgctctgcatacaaactggtctgctactacaccagctggtcccagtaccgggaaggcgatgggagctgcttcccagatgcccttgaccgcttcctctgtacccacatcatctacagctttgccaatataagcaacgatcacatcgacacctgggagtggaatgatgtgacgctctacggcatgctcaacacactcaagaacaggaaccccaacctgaagactctcttgtctgtcggaggatggaactttgggtctcaaagattttccaagatagcctccaacacccagagtcgccggactttcatcaagtcagtaccgccatttctgcgcacccatggctttgatgggctggaccttgcctggctctaccctggacggagagacaaacagcattttaccaccctaatcaaggaaatgaaggccgaatttataaaggaagcccagccagggaaaaagcagctcctgctcagcgcagcactgtctgcggggaaggtcaccattgacagcagctatgacattgccaagatatcccaacacctggatttcattagcatcatgacctacgattttcatggagcctggcgtgggaccacaggccatcacagtcccctgttccgaggtcaggaggatgcaagtcctgacagattcagcaacactgactatgctgtggggtacatgttgaggctgggggctcctgccagtaagctggtgatgggcatccccaccttcgggaggagcttcactctggcttcttctgagactggtgttggagccccaatctcaggaccgggaattccaggccggttcaccaaggaggcagggacccttgcctactatgagatctgtgacttcctccgcggagccacagtccatagaatcctcggccagcaggtcccctatgccaccaagggcaaccagtgggtaggatacgacgaccaggaaagcgtcaaaagcaaggtgcagtacctgaaggacaggcagctggcgggcgccatggtatgggccctggacctggatgacttccagggctccttctgcggccaggatctgcgcttccctctcaccaatgccatcaaggatgcactcgctgcaacgtagccctctgttctgcacacagcacgggggccaaggatgccccgtccccctctggctccagctggccgggagcctgatcacctgccctgctgagtcccaggctgagcctcagtctccctcccttggggcctatgcagaggtccacaacacacagatttgagctcagccctggtgggcagagaggtagggatggggctgtggggatagtgaggcatcgcaatgtaagactcgggattagtacacacttgttgattaatggaaatgtttacagatccccaagcctggcaagggaatttcttcaactccctgccccccagccctccttatcaaaggacaccattttggcaagctctatcaccaaggagccaaacatcctacaagacacagtgaccatactaattataccccctgcaaagcccagcttgaaaccttcacttaggaacgtaatcgtgtcccctatcctacttccccttcctaattccacagctgctcaataaagtacaagagcttaacag

SEQ ID NO: 314573 - DNA, 769 bp, Homo sapiens
gtcgtatcctacccactggttgcccttggtggcataggggaccaggaaagcgtcaaaagcgaggtgcagtacctgaaggacaggcagctggcgggcgccatggtatgggccctggacctggatgacttccagggctccttctgcggccaggatctgcgcttccctctcaccaatgccatcaaggatgcactcgctgcaacgtagccctctgttctgcacacagcacgggggccaaggatgccccgtccccctctggctccagctggccgggagcctgatcacctgccctgctgagtcccaggctgagcctcagtctccctcccttggggcctatgcagaggtccacaacacacagatttgagctcagccctggtgggcagagaggtagggatggggctgtggggatagtgaggcatcgcaatgtaagactcgggattagtacacacttgttgattaatggaaatgtttacagatccccaagcctggcaagggaatttcttcaactccctgccccccagccctccttatcaaaggacaccattttggcaagctctatcaccaaggagccaaacatcctacaagacacagtgaccatactaattataccccctgcaaagcccagcttgaaaccttcacttaggaacgtaatcgtgtcccctatcctacttccccttcctaattccacagctgctcaataaagtacaagagcttaacagacaaaaacaccgccatcaaaaacagcatcaagaccacaaacaaaaaaagaggg

SEQ ID NO: 314574 - DNA, 2383 bp, Homo sapiens
gagtggagtgggacaggtatataaaggaagtacagggcctggggaagaggccctgtctaggtagctggcaccaggagccgtgggcaagggaagaggccacaccctgccctgctctgctgcagccagaatgggtgtgaaggcgtctcaaacaggctttgtggtcctggtgctgctccagtgctgctctgcatacaaactggtctgctactacaccagctggtcccagtaccgggaaggcgatgggagctgcttcccagatgcccttgaccgcttcctctgtacccacatcatctacagctttgccaatataagcaacgatcacatcgacacctgggagtggaatgatgtgacgctctacggcatgctcaacacactcaagaacaggaaccccaacctgaagactctcttgtctgtcggaggatggaactttgggtctcaaagattttccaagatagcctccaacacccagagtcgccggactttcatcaagtcagtaccgccatttctgcgcacccatggctttgatgggctggaccttgcctggctctaccctggacggagagacaaacagcattttaccaccctaatcaaggaaatgaaggccgaatttataaaggaagcccagccagggaaaaagcagctcctgctcagcgcagcactgtctgcggggaaggtcaccattgacagcagctatgacattgccaagatatcccaacacctggatttcattagcatcatgacctacgattttcatggagcctggcgtgggaccacaggccatcacagtcccctgttccgaggtcaggaggatgcaagtcctgacagattcagcaacactgactatgctgtggggtacatgttgaggctgggggctcctgccagtaagctggtgatgggcatccccaccttcgggaggagcttcactctggcttcttctgagactggtgttggagccccaatctcaggaccgggaattccaggccggttcaccaaggaggcagggacccttgcctactatgaggtaatggagttggggagaaggtaggattcccccacaccaccagcagccctggggaaggtgattccccaccacgttcttgctttttctcctttgggaataaagaaaatgtccggttgccccagcatgcctgaggaagtggaagggagaggttaggacatttgttgctgaaaatctccagcaggtacaggcacatgggcctgcaccactaggcacctgggatagccctctggctatggggctgaggtcttccttccagcccaggaaagagcagaggtcaagaggcagattttttgtttcactctagcctctgctactctgtgtggccttgggcctgtcctcagtgtcaaccagcaggcctcacatctctgtttaaatggaagaagctaagcagggccaaggcagccaccatctctgggtcatttgcctctggtttgtataaacttgtgtgatgcatgcagcctgcagaccctgcagagagtgaggctgcaggatggagcaggagctaaaagagatttggagagtggcgtctcctggtgacctgcaaggtctcggcacgactccccacactgccttttccctgttatctgctcagatctgtgacttcctccgcggagccacagtccatagaatcctcggccagcaggtcccctatgccaccaagggcaaccagtgggtaggatacgacgaccaggaaagcgtcaaaagcaaggtgcagtacctgaaggacaggcagctggcgggcgccatggtatgggccctggacctggatgacttccagggctccttctgcggccaggatctgcgcttccctctcaccaatgccatcaaggatgcactcgctgcaacgtagccctctgttctgcacacagcacgggggccaaggatgccccgtccccctctggctccagctggccgggagcctgatcacctgccctgctgagtcccaggctgagcctcagtctccctcccttggggcctatgcagaggtccacaacacacagatttgagctcagccctggtgggcagagaggtagggatggggctgtggggatagtgaggcatcgcaatgtaagactcgggattagtacacacttgttgattaatggaaatgtttacagatccccaagcctggcaagggaatttcttcaactccctgccccccagccctccttatcaaaggacaccattttggcaagctctatcaccaaggagccaaacatcctacaagacacagtgaccatactaattataccccctgcaaagcccagcttgaaaccttcacttaggaacgtaatcgtgtcccctatcctacttccccttcctaattccacagctgctcaataaagtacaagagcttaacag

SEQ ID NO: 314575 - DNA, 1966 bp, Homo sapiens
gagtggagtgggacaggtatataaaggaagtacagggcctggggaagaggccctgtctaggtagctggcaccaggagccgtgggcaagggaagaggccacaccctgccctgctctgctgcagccagaatgggtgtgaaggcgtctcaaacaggctttgtggtcctggtgctgctccagtgctgctctgcatacaaactggtctgctactacaccagctggtcccagtaccgggaaggcgatgggagctgcttcccagatgcccttgaccgcttcctctgtacccacatcatctacagctttgccaatataagcaacgatcacatcgacacctgggagtggaatgatgtgacgctctacggcatgctcaacacactcaagaacaggaaccccaacctgaagactctcttgtctgtcggaggatggaactttgggtctcaaagattttccaagatagcctccaacacccagagtcgccggactttcatcaagtcagtaccgccatttctgcgcacccatggctttgatgggctggaccttgcctggctctaccctggacggagagacaaacagcattttaccaccctaatcaaggaaatgaaggccgaatttataaaggaagcccagccagggaaaaagcagctcctgctcagcgcagcactgtctgcggggaaggtcaccattgacagcagctatgacattgccaagatatcccaacacctggatttcattagcatcatgacctacgattttcatggagcctggcgtgggaccacaggccatcacagtcccctgttccgaggtcaggaggatgcaagtcctgacagattcagcaacactgactatgctgtggggtacatgttgaggctgggggctcctgccagtaagctggtgatgggcatccccaccttcgggaggagcttcactctggcttcttctgagactggtgttggagccccaatctcaggaccgggaattccaggccggttcaccaaggaggcagggacccttgcctactatgagatctgtgacttcctccgcggagccacagtccatagaatcctcggccagcaggtcccctatgccaccaagggcaaccagtgggtaggatacgacgaccaggaaagcgtcaaaagcaaggtaggtttccccaaggccacacctcaggacaaagagaaagaaggaggccccgctcccagcagccagattcctgtcccttgcactgaggtctgggctgggctcacagagcacatgtgccctgtacacactctgggtcagggaacccagccctgctcctctgggcctcccctgccaggtgcagtacctgaaggacaggcagctggcgggcgccatggtatgggccctggacctggatgacttccagggctccttctgcggccaggatctgcgcttccctctcaccaatgccatcaaggatgcactcgctgcaacgtagccctctgttctgcacacagcacgggggccaaggatgccccgtccccctctggctccagctggccgggagcctgatcacctgccctgctgagtcccaggctgagcctcagtctccctcccttggggcctatgcagaggtccacaacacacagatttgagctcagccctggtgggcagagaggtagggatggggctgtggggatagtgaggcatcgcaatgtaagactcgggattagtacacacttgttgattaatggaaatgtttacagatccccaagcctggcaagggaatttcttcaactccctgccccccagccctccttatcaaaggacaccattttggcaagctctatcaccaaggagccaaacatcctacaagacacagtgaccatactaattataccccctgcaaagcccagcttgaaaccttcacttaggaacgtaatcgtgtcccctatcctacttccccttcctaattccacagctgctcaataaagtacaagagcttaacag

SEQ ID NO: 314576 - DNA, 2558 bp, Homo sapiens
gagtggagtgggacaggtatataaaggaagtacagggcctggggaagaggccctgtctaggtagctggcaccaggagccgtgggcaagggaagaggccacaccctgccctgctctgctgcagccagaatgggtgtgaaggcgtctcaaacaggctttgtggtcctggtgctgctccagtgctgctctgcatacaaactggtctgctactacaccagctggtcccagtaccgggaaggcgatgggagctgcttcccagatgcccttgaccgcttcctctgtacccacatcatctacagctttgccaatataagcaacgatcacatcgacacctgggagtggaatgatgtgacgctctacggcatgctcaacacactcaagaacaggaaccccaacctgaagactctcttgtctgtcggaggatggaactttgggtctcaaagattttccaagatagcctccaacacccagagtcgccggactttcatcaagtcagtaccgccatttctgcgcacccatggctttgatgggctggaccttgcctggctctaccctggacggagagacaaacagcattttaccaccctaatcaaggaaatgaaggccgaatttataaaggaagcccagccagggaaaaagcagctcctgctcagcgcagcactgtctgcggggaaggtcaccattgacagcagctatgacattgccaagatatcccaacacctggatttcattagcatcatgacctacgattttcatggagcctggcgtgggaccacaggccatcacagtcccctgttccgaggtcaggaggatgcaagtcctgacagattcagcaacactgactatgctgtggggtacatgttgaggctgggggctcctgccagtaagctggtgatgggcatccccaccttcgggaggagcttcactctggcttcttctgagactggtgttggagccccaatctcaggaccgggaattccaggccggttcaccaaggaggcagggacccttgcctactatgaggtaatggagttggggagaaggtaggattcccccacaccaccagcagccctggggaaggtgattccccaccacgttcttgctttttctcctttgggaataaagaaaatgtccggttgccccagcatgcctgaggaagtggaagggagaggttaggacatttgttgctgaaaatctccagcaggtacaggcacatgggcctgcaccactaggcacctgggatagccctctggctatggggctgaggtcttccttccagcccaggaaagagcagaggtcaagaggcagattttttgtttcactctagcctctgctactctgtgtggccttgggcctgtcctcagtgtcaaccagcaggcctcacatctctgtttaaatggaagaagctaagcagggccaaggcagccaccatctctgggtcatttgcctctggtttgtataaacttgtgtgatgcatgcagcctgcagaccctgcagagagtgaggctgcaggatggagcaggagctaaaagagatttggagagtggcgtctcctggtgacctgcaaggtctcggcacgactccccacactgccttttccctgttatctgctcagatctgtgacttcctccgcggagccacagtccatagaatcctcggccagcaggtcccctatgccaccaagggcaaccagtgggtaggatacgacgaccaggaaagcgtcaaaagcaaggtaggtttccccaaggccacacctcaggacaaagagaaagaaggaggccccgctcccagcagccagattcctgtcccttgcactgaggtctgggctgggctcacagagcacatgtgccctgtacacactctgggtcagggaacccagccctgctcctctgggcctcccctgccaggtgcagtacctgaaggacaggcagctggcgggcgccatggtatgggccctggacctggatgacttccagggctccttctgcggccaggatctgcgcttccctctcaccaatgccatcaaggatgcactcgctgcaacgtagccctctgttctgcacacagcacgggggccaaggatgccccgtccccctctggctccagctggccgggagcctgatcacctgccctgctgagtcccaggctgagcctcagtctccctcccttggggcctatgcagaggtccacaacacacagatttgagctcagccctggtgggcagagaggtagggatggggctgtggggatagtgaggcatcgcaatgtaagactcgggattagtacacacttgttgattaatggaaatgtttacagatccccaagcctggcaagggaatttcttcaactccctgccccccagccctccttatcaaaggacaccattttggcaagctctatcaccaaggagccaaacatcctacaagacacagtgaccatactaattataccccctgcaaagcccagcttgaaaccttcacttaggaacgtaatcgtgtcccctatcctacttccccttcctaattccacagctgctcaataaagtacaagagcttaacag

SEQ ID NO: 314577 - DNA, 1947 bp, Homo sapiens
gagtggagtgggacaggtatataaaggaagtacagggcctggggaagaggccctgtctaggtagctggcaccaggagccgtgggcaagggaagaggccacaccctgccctgctctgctgcagccagaatgggtgtgaaggcgtctcaaacaggctttgtggtcctggtgctgctccagtgctgctctgcatacaaactggtctgctactacaccagctggtcccagtaccgggaaggcgatgggagctgcttcccagatgcccttgaccgcttcctctgtacccacatcatctacagctttgccaatataagcaacgatcacatcgacacctgggagtggaatgatgtgacgctctacggcatgctcaacacactcaagaacaggaaccccaacctgaagactctcttgtctgtcggaggatggaactttgggtctcaaagattttccaagatagcctccaacacccagagtcgccggactttcatcaagtcagtaccgccatttctgcgcacccatggctttgatgggctggaccttgcctggctctaccctggacggagagacaaacagcattttaccaccctaatcaaggaaatgaaggccgaatttataaaggaagcccagccagggaaaaagcagctcctgctcagcgcagcactgtctgcggggaaggtcaccattgacagcagctatgacattgccaagatatcccaacacctggatttcattagcatcatgacctacgattttcatggagcctggcgtgggaccacaggccatcacagtcccctgttccgaggtcaggaggatgcaagtcctgacagattcagcaacactgactatgctgtggggtacatgttgaggctgggggctcctgccagtaagctggtgatgggcatccccaccttcgggaggagcttcactctggcttcttctgagactggtgttggagccccaatctcaggaccgggaattccaggccggttcaccaaggaggcagggacccttgcctactatgagatctgtgacttcctccgcggagccacagtccatagaatcctcggccagcaggtcccctatgccaccaagggcaaccagtgggtaggatacgacgaccaggaaagcgtcaaaagcaaggtgcagtacctgaaggacaggcagctggcgggcgccatggtatgggccctggacctggatgacttccagggctccttctgcggccaggatctgcgcttccctctcaccaatgccatcaaggatgcactcgctgcaacgtagccctctgttctgcacacagcacgggggccaaggatgccccgtccccctctggctccagctggccgggagcctgatcacctgccctgctgagtcccaggctgagcctcagtctccctcccttggggcctatgcagaggtccacaacacacagatttgagctcagccctggtgggcagagaggtagggatggggctgtggggatagtgaggcatcgcaatgtaagactcgggattagtacacacttgttgattaatggaaatgtttacagatccccaagcctggcaagggaatttcttcaactccctgccccccagccctccttatcaaaggacaccattttggcaagctctatcaccaaggagccaaacatcctacaagacacagtgaccatactaattataccccctgcaaagcccagcttgaaaccttcacttaggaacgtaatcgtgtcccctatcctacttccccttcctaattccacagctgctcaataaagtacaagagcttaacagaaaaaaaaaaaaataaaaaaaaaaaaaagggggggggcaaaaaattcccggggggccaattagggtaccggtttttgtaaagggggcccaaaagggggggattaaaagaaggaagggggggggtaaaaggctgggggaaatggagggaatttggag

SEQ ID NO: 314578 - DNA, 1844 bp, Homo sapiens
gagtggagtgggacaggtatataaaggaagtacagggcctggggaagaggccctgtctaggtagctggcaccaggagccgtgggcaagggaagaggccacaccctgccctgctctgctgcagccagaatgggtgtgaaggcgtctcaaacaggctttgtggtcctggtgctgctccagtgctgctctgcatacaaactggtctgctactacaccagctggtcccagtaccgggaaggcgatgggagctgcttcccagatgcccttgaccgcttcctctgtacccacatcatctacagctttgccaatataagcaacgatcacatcgacacctgggagtggaatgatgtgacgctctacggcatgctcaacacactcaagaacaggaaccccaacctgaagactctcttgtctgtcggaggatggaactttgggtctcaaagattttccaagatagcctccaacacccagagtcgccggactttcatcaagtcagtaccgccatttctgcgcacccatggctttgatgggctggaccttgcctggctctaccctggacggagagacaaacagcattttaccaccctaatcaaggaaatgaaggccgaatttataaaggaagcccagccagggaaaaagcagctcctgctcagcgcagcactgtctgcggggaaggtcaccattgacagcagctatgacattgccaagatatcccaacacctggatttcattagcatcatgacctacgattttcatggagcctggcgtgggaccacaggccatcacagtcccctgttccgaggtcaggaggatgcaagtcctgacagattcagcaacactgactatgctgtggggtacatgttgaggctgggggctcctgccagtaagctggtgatgggcatccccaccttcgggaggagcttcactctggcttcttctgagactggtgttggagccccaatctcaggaccgggaattccaggccggttcaccaaggaggcagggacccttgcctactatgagatctgtgacttcctccgcggagccacagtccatagaatcctcggccagcaggtcccctatgccaccaagggcaaccagtgggtaggatacgacgaccaggaaagcgtcaaaagcaaggtgcagtacctgaaggacaggcagctggcgggcgccatggtatgggccctggacctggatgacttccagggctccttctgcggccaggatctgcgcttccctctcaccaatgccatcaaggatgcactcgctgcaacgtagccctctgttctgcacacagcacgggggccaaggatgccccgtccccctctggctccagctggccgggagcctgatcacctgccctgctgagtcccaggctgagcctcagtctccctcccttggggcctatgcagaggtccacaacacacagatttgagctcagccctggtgggcagagaggtagggatggggctgtggggatagtgaggcatcgcaatgtaagactcgggattagtacacacttgttgattaatggaaatgtttacagatccccaagcctggcaagggaatttcttcaactccctgccccccagccctccttatcaaaggacaccattttggcaagctctatcaccaaggagccaaacatcctacaagacacagtgaccatactaattataccccctgcaaagcccagcttgaaaccttcacttaggaacgtaatcgtgtcccctatcctacttccccttcctaattccacagctgctcaataaagtacaagagcttaacagacaaaaacaccgccatcaaaaacagcatcaagaccacaaacaaaaaaagaggg

SEQ ID NO: 314579 - DNA, 1734 bp, Homo sapiens
gagtggagtgggacaggtatataaaggaagtacagggcctggggaagaggccctgtctaggtagctggcaccaggagccgtgggcaagggaagaggccacaccctgccctgctctgctgcagccagaatgggtgtgaaggcgtctcaaacaggctttgtggtcctggtgctgctccagtgctgctctgcatacaaactggtctgctactacaccagctggtcccagtaccgggaaggcgatgggagctgcttcccagatgcccttgaccgcttcctctgtacccacatcatctacagctttgccaatataagcaacgatcacatcgacacctgggagtggaatgatgtgacgctctacggcatgctcaacacactcaagaacagattttccaagatagcctccaacacccagagtcgccggactttcatcaagtcagtaccgccatttctgcgcacccatggctttgatgggctggaccttgcctggctctaccctggacggagagacaaacagcattttaccaccctaatcaaggaaatgaaggccgaatttataaaggaagcccagccagggaaaaagcagctcctgctcagcgcagcactgtctgcggggaaggtcaccattgacagcagctatgacattgccaagatatcccaacacctggatttcattagcatcatgacctacgattttcatggagcctggcgtgggaccacaggccatcacagtcccctgttccgaggtcaggaggatgcaagtcctgacagattcagcaacactgactatgctgtggggtacatgttgaggctgggggctcctgccagtaagctggtgatgggcatccccaccttcgggaggagcttcactctggcttcttctgagactggtgttggagccccaatctcaggaccgggaattccaggccggttcaccaaggaggcagggacccttgcctactatgagatctgtgacttcctccgcggagccacagtccatagaatcctcggccagcaggtcccctatgccaccaagggcaaccagtgggtaggatacgacgaccaggaaagcgtcaaaagcaaggtgcagtacctgaaggacaggcagctggcgggcgccatggtatgggccctggacctggatgacttccagggctccttctgcggccaggatctgcgcttccctctcaccaatgccatcaaggatgcactcgctgcaacgtagccctctgttctgcacacagcacgggggccaaggatgccccgtccccctctggctccagctggccgggagcctgatcacctgccctgctgagtcccaggctgagcctcagtctccctcccttggggcctatgcagaggtccacaacacacagatttgagctcagccctggtgggcagagaggtagggatggggctgtggggatagtgaggcatcgcaatgtaagactcgggattagtacacacttgttgattaatggaaatgtttacagatccccaagcctggcaagggaatttcttcaactccctgccccccagccctccttatcaaaggacaccattttggcaagctctatcaccaaggagccaaacatcctacaagacacagtgaccatactaattataccccctgcaaagcccagcttgaaaccttcacttaggaacgtaatcgtgtcccctatcctacttccccttcctaattccacagctgctcaataaagtacaagagcttaacag

SEQ ID NO: 314580 - DNA, 1608 bp, Homo sapiens
gagtggagtgggacaggtatataaaggaagtacagggcctggggaagaggccctgtctaggtagctggcaccaggagccgtgggcaagggaagaggccacaccctgccctgctctgctgcagccagaatgggtgtgaaggcgtctcaaacaggctttgtggtcctggtgctgctccagtgctgctctgcatacaaactggtctgctactacaccagctggtcccagtaccgggaaggcgatgggagctgcttcccagatgcccttgaccgcttcctctgtacccacatcatctacagctttgccaatataagcaacgatcacatcgacacctgggagtggaatgatgtgacgctctacggcatgctcaacacactcaagaacaggaaccccaacctgaagactctcttgtctgtcggaggatggaactttgggtctcaaagattttccaagatagcctccaacacccagagtcgccggactttcatcaagtcagtaccgccatttctgcgcacccatggctttgatgggctggaccttgcctggctctaccctggacggagagacaaacagcattttaccaccctaatcaaggaaatgaaggccgaatttataaaggaagcccagccagggaaaaagcagctcctgctcagcgcagcactgtctgcggggaaggtcaccattgacagcagctatgacattgccaagatatcccaacacctggatttcattagcatcatgacctacgattttcatggagcctggcgtgggaccacaggccatcacagtcccctgttccgaggtcaggaggatgcaagtcctgacagattcagcaacactatctgtgacttcctccgcggagccacagtccatagaatcctcggccagcaggtcccctatgccaccaagggcaaccagtgggtaggatacgacgaccaggaaagcgtcaaaagcaaggtgcagtacctgaaggacaggcagctggcgggcgccatggtatgggccctggacctggatgacttccagggctccttctgcggccaggatctgcgcttccctctcaccaatgccatcaaggatgcactcgctgcaacgtagccctctgttctgcacacagcacgggggccaaggatgccccgtccccctctggctccagctggccgggagcctgatcacctgccctgctgagtcccaggctgagcctcagtctccctcccttggggcctatgcagaggtccacaacacacagatttgagctcagccctggtgggcagagaggtagggatggggctgtggggatagtgaggcatcgcaatgtaagactcgggattagtacacacttgttgattaatggaaatgtttacagatccccaagcctggcaagggaatttcttcaactccctgccccccagccctccttatcaaaggacaccattttggcaagctctatcaccaaggagccaaacatcctacaagacacagtgaccatactaattataccccctgcaaagcccagcttgaaaccttcacttaggaacgtaatcgtgtcccctatcctacttccccttcctaattccacagctgctcaataaagtacaagagcttaacag

SEQ ID NO: 314581 - DNA, 2910 bp, Homo sapiens
gagtggagtgggacaggtatataaaggaagtacagggcctggggaagaggccctgtctaggtagctggcaccaggagccgtgggcaagggaagaggccacaccctgccctgctctgctgcagccagaatgggtgtgaaggcgtctcaaacaggctttgtggtcctggtgctgctccagtgctgctctgcatacaaactggtctgctactacaccagctggtcccagtaccgggaaggcgatgggagctgcttcccagatgcccttgaccgcttcctctgtacccacatcatctacagctttgccaatataagcaacgatcacatcgacacctgggagtggaatgatgtgacgctctacggcatgctcaacacactcaagaacaggaaccccaacctgaagactctcttgtctgtcggaggatggaactttgggtctcaaagggctgattttggtcctagattttccaagatagcctccaacacccagagtcgccggactttcatcaagtcagtaccgccatttctgcgcacccatggctttgatgggctggaccttgcctggctctaccctggacggagagacaaacagcattttaccaccctaatcaaggaaatgaaggccgaatttataaaggaagcccagccagggaaaaagcagctcctgctcagcgcagcactgtctgcggggaaggtcaccattgacagcagctatgacattgccaagatatcccaacacctggatttcattagcatcatgacctacgattttcatggagcctggcgtgggaccacaggccatcacagtcccctgttccgaggtcaggaggatgcaagtcctgacagattcagcaacactgtgagttcccagaaggagggagggccaggagggggccgcaagacctgccatctgccagtgctcacacaccaatctctctagccctcagtacagtcctgcaagaggggggtcatgaggcccattccacagataaggaaactgaggcccaaagtctgggcatgctgcgttgctctgggaaggtgatctgcagggtaaatggagtgagggcagggggccgaatggggagaggctgggagccgaggaggtaggagtcattgtgccctcagagccaaccacctgatttctgcatctgtcaaatagtaatagccccttcctatgcctcaaaggatttttttcaagaatgaaactgtaaaattcactttaaagtgacatgatccgttcccggagggacaggggaatccccagtgcaccatacaccaataacccctgctaaggcagcagtattaattgctcaaccttccgcacctgtgcactaactgctcacgttgttcccaccctaccccacccaggactatgctgtggggtacatgttgaggctgggggctcctgccagtaagctggtgatgggcatccccaccttcgggaggagcttcactctggcttcttctgagactggtgttggagccccaatctcaggaccgggaattccaggccggttcaccaaggaggcagggacccttgcctactatgaggtaatggagttggggagaaggtaggattcccccacaccaccagcagccctggggaaggtgattccccaccacgttcttgctttttctcctttgggaataaagaaaatgtccggttgccccagcatgcctgaggaagtggaagggagaggttaggacatttgttgctgaaaatctccagcaggtacaggcacatgggcctgcaccactaggcacctgggatagccctctggctatggggctgaggtcttccttccagcccaggaaagagcagaggtcaagaggcagattttttgtttcactctagcctctgctactctgtgtggccttgggcctgtcctcagtgtcaaccagcaggcctcacatctctgtttaaatggaagaagctaagcagggccaaggcagccaccatctctgggtcatttgcctctggtttgtataaacttgtgtgatgcatgcagcctgcagaccctgcagagagtgaggctgcaggatggagcaggagctaaaagagatttggagagtggcgtctcctggtgacctgcaaggtctcggcacgactccccacactgccttttccctgttatctgctcagatctgtgacttcctccgcggagccacagtccatagaatcctcggccagcaggtcccctatgccaccaagggcaaccagtgggtaggatacgacgaccaggaaagcgtcaaaagcaaggtgcagtacctgaaggacaggcagctggcgggcgccatggtatgggccctggacctggatgacttccagggctccttctgcggccaggatctgcgcttccctctcaccaatgccatcaaggatgcactcgctgcaacgtagccctctgttctgcacacagcacgggggccaaggatgccccgtccccctctggctccagctggccgggagcctgatcacctgccctgctgagtcccaggctgagcctcagtctccctcccttggggcctatgcagaggtccacaacacacagatttgagctcagccctggtgggcagagaggtagggatggggctgtggggatagtgaggcatcgcaatgtaagactcgggattagtacacacttgttgattaatggaaatgtttacagatccccaagcctggcaagggaatttcttcaactccctgccccccagccctccttatcaaaggacaccattttggcaagctctatcaccaaggagccaaacatcctacaagacacagtgaccatactaattataccccctgcaaagcccagcttgaaaccttcacttaggaacgtaatcgtgtcccctatcctacttccccttcctaattccacagctgctcaataaagtacaagagcttaacag

SEQ ID NO: 314582 - DNA, 1786 bp, Homo sapiens
gagtggagtgggacaggtatataaaggaagtacagggcctggggaagaggccctgtctaggtagctggcaccaggagccgtgggcaagggaagaggccacaccctgccctgctctgctgcagccagaatgggtgtgaaggcgtctcaaacaggctttgtggtcctggtgctgctccagtgctgctctgcatacaaactggtctgctactacaccagctggtcccagtaccgggaaggcgatgggagctgcttcccagatgcccttgaccgcttcctctgtacccacatcatctacagctttgccaatataagcaacgatcacatcgacacctgggagtggaatgatgtgacgctctacggcatgctcaacacactcaagaacaggaaccccaacctgaagactctcttgtctgtcggaggatggaactttgggtctcaaagattttccaagatagcctccaacacccagagtcgccggactttcatcaagtcagtaccgccatttctgcgcacccatggctttgatgggctggaccttgcctggctctaccctggacggagagacaaacagcattttaccaccctaatcaaggaaatgaaggccgaatttataaaggaagcccagccagggaaaaagcagctcctgctcagcgcagcactgtctgcggggaaggtcaccattgacagcagctatgacattgccaagatatcccaacacctggatttcattagcatcatgacctacgattttcatggagcctggcgtgggaccacaggccatcacagtcccctgttccgaggtcaggaggatgcaagtcctgacagattcagcaacactgactatgctgtggggtacatgttgaggctgggggctcctgccagtaagctggtgatgggcatccccaccttcgggaggagcttcactctggcttcttctgagactggtgttggagccccaatctcaggaccgggaattccaggccggttcaccaaggaggcagggacccttgcctactatgagatctgtgacttcctccgcggagccacagtccatagaatcctcggccagcaggtcccctatgccaccaagggcaaccagtgggtaggatacgacgaccaggaaagcgtcaaaagcaaggtgcagtacctgaaggacaggcagctggcgggcgccatggtatgggccctggacctggatgacttccagggctccttctgcggccaggatctgcgcttccctctcaccaatgccatcaaggatgcactcgctgcaacgtagccctctgttctgcacacagcacgggggccaaggatgccccgtccccctctggctccagctggccgggagcctgatcacctgccctgctgagtcccaggctgagcctcagtctccctcccttggggcctatgcagaggtccacaacacacagatttgagctcagccctggtgggcagagaggtagggatggggctgtggggatagtgaggcatcgcaatgtaagactcgggattagtacacacttgttgattaatggaaatgtttacagatccccaagcctggcaagggaatttcttcaactccctgccccccagccctccttatcaaaggacaccattttggcaagctctatcaccaaggagccaaacattctaaaaccggtgacaataatgaccatgattccggattacgcgctgggttaccaccatcatgtaagcaacgtcgatcgtatacgcggtactcattcgcctccttcatcatcacatctagatgagcaatgatcagaat

SEQ ID NO: 314583 - DNA, 1703 bp, Homo sapiens
gagtggagtgggacaggtatataaaggaagtacagggcctggggaagaggccctgtctaggtagctggcaccaggagccgtgggcaagggaagaggccacaccctgccctgctctgctgcagccagaatgggtgtgaaggcgtctcaaacaggctttgtggtcctggtgctgctccagtgctgctctgcatacaaactggtctgctactacaccagctggtcccagtaccgggaaggcgatgggagctgcttcccagatgcccttgaccgcttcctctgtacccacatcatctacagctttgccaatataagcaacgatcacatcgacacctgggagtggaatgatgtgacgctctacggcatgctcaacacactcaagaacaggaaccccaacctgaagactctcttgtctgtcggaggatggaactttgggtctcaaagattttccaagatagcctccaacacccagagtcgccggactttcatcaagtcagtaccgccatttctgcgcacccatggctttgatgggctggaccttgcctggctctaccctggacggagagacaaacagcattttaccaccctaatcaaggaaatgaaggccgaatttataaaggaagcccagccagggaaaaagcagctcctgctcagcgcagcactgtctgcggggaaggtcaccattgacagcagctatgacattgccaagatatcccaacacctggatttcattagcatcatgacctacgattttcatggagcctggcgtgggaccacaggccatcacagtcccctgttccgaggtcaggaggatgcaagtcctgacagattcagcaacactgactatgctgtggggtacatgttgaggctgggggctcctgccagtaagctggtgatgggcatccccaccttcgggaggagcttcactctggcttcttctgagactggtgttggagccccaatctcaggaccgggaattccaggccggttcaccaaggaggcagggacccttgcctactatgagatctgtgacttcctccgcggagccacagtccatagaatcctcggccagcaggtcccctatgccaccaagggcaaccagtgggtaggatacgacgaccaggaaagcgtcaaaagcaaggtgcagtacctgaaggacaggcagctggcgggcgccatggtatgggccctggacctggatgacttccagggctccttctgcggccaggatctgcgcttccctctcaccaatgccatcaaggatgcactcgctgcaacgtagccctctgttctgcacacagcacgggggccaaggatgccccgtccccctctggctccagctggccgggagcctgatcacctgccctgctgagtcccaggctgagcctcagtctccctcccttggggcctatgcagaggtccacaacacacagatttgagctcagccctggtgggcagagagatccccaagcctggcaagggaatttcttcaactccctgccccccagccctccttatcaaaggacaccattttggcaagctctatcaccaaggagccaaacatcctacaagacacagtgaccatactaattataccccctgcaaagcccagcttgaaaccttcacttaggaacgtaatcgtgtcccctatcctacttccccttcctaattccacagctgctcaataaagtacaagagcttaacag

SEQ ID NO: 314584 - DNA, 1468 bp, Homo sapiens
gagtggagtgggacaggtatataaaggaagtacagggcctggggaagaggccctgtctaggtagctggcaccaggagccgtgggcaagggaagaggccacaccctgccctgctctgctgcagccagaatgggtgtgaaggcgtctcaaacaggctttgtggtcctggtgctgctccagtgctgctctgcatacaaactggtctgctactacaccagctggtcccagtaccgggaaggcgatgggagctgcttcccagatgcccttgaccgcttcctctgtacccacatcatctacagctttgccaatataagcaacgatcacatcgacacctgggagtggaatgatgtgacgctctacggcatgctcaacacactcaagaacaggaaccccaacctgaagactctcttgtctgtcggaggatggaactttgggtctcaaagattttccaagatagcctccaacacccagagtcgccggactttcatcaagtcagtaccgccatttctgcgcacccatggctttgatgggctggaccttgcctggctctaccctggacggagagacaaacagcattttaccaccctaatcaaggaaatgaaggccgaatttataaaggaagcccagccagggaaaaagcagctcctgctcagcgcagcactgtctgcggggaaggtcaccattgacagcagctatgacattgccaagatatcccaacacctggatttcattagcatcatgacctacgattttcatggagcctggcgtgggaccacaggccatcacagtcccctgttccgaggtcaggaggatgcaagtcctgacagattcagcaacactgactatgctgtggggtacatgttgaggctgggggctcctgccagtaagctggtgatgggcatccccaccttcgggaggagcttcactctggcttcttctgagactggtgttggagccccaatctcaggaccgggaattccaggccggttcaccaaggaggcagggacccttgcctactatgagatctgtgacttcctccgcggagccacagtccatagaatcctcggccagcaggtcccctatgccaccaagggcaaccagtgggtaggatacgacgaccaggaaagcgtcaaaagcaaggtgcagtacctgaaggacaggcagctggcgggcgccatggtatgggccctggacctggatgacttccagggctccttctgcggccaggatctgcgcttccctctcaccaatgccatcaaggatgcactcgctgcaacgtagccctctgttctgcacacagcacgggggccaaggatgccccgtccccctctggctccagctggccgggagcctgatcacctgccctgctgagtcccaggctgagcctcagttttcccttcccctttttgggggggccccttatttgcgaaggtttccccaaccccggatttgggttcagccttggtgggg

SEQ ID NO: 314585 - DNA, 415 bp, Homo sapiens
tcattccactcctgccctccccacctccctgtgctccacaggaaccccaacctgaagactctcttgtctgtcggaggatggaactttgggtctcaaaggtaggagcctctccccaggggcaggacggcagaggatgatggcataggagtgaggagcttgggtctcccgcatccactgtatggatgttccaggggctccagactagataggtacaaggcctacctgtttgtcaagggcctgcctgatgtgtagcaaagaaagcagagcccagagagagagcaggacttgccaagagtcacacagcaagttaacagtggatctcccaattccctgccaatgctctatttactacctcacaggcccgaaaatatgggacttctggggctaccaccattagggctggaaagagagagat

SEQ ID NO: 314586 - DNA, 1924 bp, Homo sapiens
  misc_feature (1924)..(1924): n is a, c, g, or t
gagtggagtgggacaggtatataaaggaagtacagggcctggggaagaggccctgtctaggtagctggcaccaggagccgtgggcaagggaagaggccacaccctgccctgctctgctgcagccagaatgggtgtgaaggcgtctcaaacaggctttgtggtcctggtgctgctccagtgctgctctgcatacaaactggtctgctactacaccagctggtcccagtaccgggaaggcgatgggagctgcttcccagatgcccttgaccgcttcctctgtacccacatcatctacagctttgccaatataagcaacgatcacatcgacacctgggagtggaatgatgtgacgctctacggcatgctcaacacactcaagaacaggaaccccaacctgaagactctcttgtctgtcggaggatggaactttgggtctcaaagattttccaagatagcctccaacacccagagtcgccggactttcatcaagtcagtaccgccatttctgcgcacccatggctttgatgggctggaccttgcctggctctaccctggacggagagacaaacagcattttaccaccctaatcaaggaaatgaaggccgaatttataaaggaagcccagccagggaaaaagcagctcctgctcagcgcagcactgtctgcggggaaggtcaccattgacagcagctatgacattgccaagatatcccaacacctggatttcattagcatcatgacctacgattttcatggagcctggcgtgggaccacaggccatcacagtcccctgttccgaggtcaggaggatgcaagtcctgacagattcagcaacactgactatgctgtggggtacatgttgaggctgggggctcctgccagtaagctggtgatgggcatccccaccttcgggaggagcttcactctggcttcttctgagactggtgttggagccccaatctcaggaccgggaattccaggccggttcaccaaggaggcagggacccttgcctactatgagatctgtgacttcctccgcggagccacagtccatagaatcctcggccagcaggtcccctatgccaccaagggcaaccagtgggtaggatacgacgaccaggaaagcgtcaaaagcaaggtgcagtacctgaaggacaggcagctggcgggcgccatggtatgggccctggacctggatgacttccagggctccttctgcggccaggatctgcgcttccctctcaccaatgccatcaaggatgcactcgctgcaacgtagccctctgttctgcacacagcacgggggccaaggatgccccgtccccctctggctccagctggccgggagcctgatcacctgccctgctgagtcccaggctgagcctcagtctccctcccttggggcctatgcagaggtccacaacacacagatttgagctcagccctggtgggcagagaggtagggatggggctgtggggatagtgaggcatcgcaatgtaagactcgggattagtacacacttgttgattaatggaaatgtttacagatccccaagcctggcaagggaatttcttcaactccctgccccccagccctccttatcaaaggacaccattttggcaagctctatcaccaaggagccaaacatcctacaagacacagtgaccatactaattataccccctgcaaagcccagcttgaaaccttcacttaggaacgtaatcgtgtcccctatcctacttccccttcctaattccacagctgctcaataaagtacaagagcttaacaggtgtgttggcgctttgctttggtctatctttgagcgcccactagacccactggactcacctcccccatctcttctgggttccttcctctgagccttgggacccctgagcttgcagagatgaggccgccatgtn

SEQ ID NO: 314587 - DNA, 417 bp, Homo sapiens
cagagagggatccccaaaagcgttgccattcagcagtgaaatgcaagggtttttataagctagctagtggggaggtgaggtgttatcttacctacatagggtgtgaaaaaccccaggtgtgcaatctgcgtagagcattaatttctggcatccccccaccccacccttttattatacaggcaggtcttttgcctgagctactccacgttgctttcctactgtgtatgtgcttcaaagggggaggtggagcctccatggtggacacacctggccccaggtacccctttctgtctgtgcagctgcaagcatactgcaaagcccagcttgaaaccttcacttaggaacgtaatcgtgtcccctatcctacttccccttcctaattccacagctgctcaataaagtacaagagcttaacag

SEQ ID NO: 314588 - DNA, 1808 bp, Homo sapiens
taacatggaatgtacacggtcctgtgctgcaagaggcccttgtcgtaggtagctggcaccagcgagaccctgtgcggtcggctgggaagaggccatatcctgtccctgttctgctgctcccatattgggtgtgaaagcggtcgtctagagactatgagcttatgttggtctctggttgctgcgtacctagttggcgtaggctctgcatacaaactggtctgctactacaccagctggtcccagtaccgggaaggcgatgggagctgcttcccagatgcccttgaccgcttcctctgtacccacatcatctacagctttgccaatataagcaacgatcacatcgacacctgggagtggaatgatgtgacgctctacggcatgctcaacacactcaagaacaggaaccccaacctgaagactctcttgtctgtcggaggatggaactttgggtctcaaagattttccaagatagcctccaacacccagagtcgccggactttcatcaagtcagtaccgccatttctgcgcacccatggctttgatgggctggaccttgcctggctctaccctggacggagagacaaacagcattttaccaccctaatcaaggaaatgaaggccgaatttataaaggaagcccagccagggaaaaagcagctcctgctcagcgcagcactgtctgcggggaaggtcaccattgacagcagctatgacattgccaagatatcccaacacctggatttcattagcatcatgacctacgattttcatggagcctggcgtgggaccacaggccatcacagtcccctgttccgaggtcaggaggatgcaagtcctgacagattcagcaacactgactatgctgtggggtacatgttgaggctgggggctcctgccagtaagctggtgatgggcatccccaccttcgggaggagcttcactctggcttcttctgagactggtgttggagccccaatctcaggaccgggaattccaggccggttcaccaaggaggcagggacccttgcctactatgagatctgtgacttcctccgcggagccacagtccatagaatcctcggccagcaggtcccctatgccaccaagggcaaccagtgggtaggatacgacgaccaggaaagcgtcaaaagcaaggtgcagtacctgaaggacaggcagctggcgggcgccatggtatgggccctggacctggatgacttccagggctccttctgcggccaggatctgcgcttccctctcaccaatgccatcaaggatgcactcgctgcaacgtagccctctgttctgcacacagcacgggggccaaggatgccccgtccccctctggctccagctggccgggagcctgatcacctgccctgctgagtcccaggctgagcctcagtctccctcccttggggcctatgcagaggtccacaacacacagatttgagctcagccctggtgggcagagaggtagggatggggctgtggggatagtgaggcatcgcaatgtaagactcgggattagtacacacttgttgattaatggaaatgtttacagatccccaagcctggcaagggaatttcttcaactccctgccccccagccctccttatcaaaggacaccattttggcaagctctatcaccaaggagccaaacatcctacaagacacagtgaccatactaattataccccctgcaaagcccagcttgaaaccttcacttaggaacgtaatcgtgtcccctatcctacttccccttcctaattccacagctgctcaataaagtacaagagcttaacag

SEQ ID NO: 314589 - DNA, 2892 bp, Homo sapiens
gagtggagtgggacaggtatataaaggaagtacagggcctggggaagaggccctgtctaggtagctggcaccaggagccgtgggcaagggaagaggccacaccctgccctgctctgctgcagccagaatgggtgtgaaggcgtctcaaacaggctttgtggtcctggtgctgctccagtgctgctctgcatacaaactggtctgctactacaccagctggtcccagtaccgggaaggcgatgggagctgcttcccagatgcccttgaccgcttcctctgtacccacatcatctacagctttgccaatataagcaacgatcacatcgacacctgggagtggaatgatgtgacgctctacggcatgctcaacacactcaagaacaggaaccccaacctgaagactctcttgtctgtcggaggatggaactttgggtctcaaagattttccaagatagcctccaacacccagagtcgccggactttcatcaagtcagtaccgccatttctgcgcacccatggctttgatgggctggaccttgcctggctctaccctggacggagagacaaacagcattttaccaccctaatcaaggaaatgaaggccgaatttataaaggaagcccagccagggaaaaagcagctcctgctcagcgcagcactgtctgcggggaaggtcaccattgacagcagctatgacattgccaagatatcccaacacctggatttcattagcatcatgacctacgattttcatggagcctggcgtgggaccacaggccatcacagtcccctgttccgaggtcaggaggatgcaagtcctgacagattcagcaacactgtgagttcccagaaggagggagggccaggagggggccgcaagacctgccatctgccagtgctcacacaccaatctctctagccctcagtacagtcctgcaagaggggggtcatgaggcccattccacagataaggaaactgaggcccaaagtctgggcatgctgcgttgctctgggaaggtgatctgcagggtaaatggagtgagggcagggggccgaatggggagaggctgggagccgaggaggtaggagtcattgtgccctcagagccaaccacctgatttctgcatctgtcaaatagtaatagccccttcctatgcctcaaaggatttttttcaagaatgaaactgtaaaattcactttaaagtgacatgatccgttcccggagggacaggggaatccccagtgcaccatacaccaataacccctgctaaggcagcagtattaattgctcaaccttccgcacctgtgcactaactgctcacgttgttcccaccctaccccacccaggactatgctgtggggtacatgttgaggctgggggctcctgccagtaagctggtgatgggcatccccaccttcgggaggagcttcactctggcttcttctgagactggtgttggagccccaatctcaggaccgggaattccaggccggttcaccaaggaggcagggacccttgcctactatgaggtaatggagttggggagaaggtaggattcccccacaccaccagcagccctggggaaggtgattccccaccacgttcttgctttttctcctttgggaataaagaaaatgtccggttgccccagcatgcctgaggaagtggaagggagaggttaggacatttgttgctgaaaatctccagcaggtacaggcacatgggcctgcaccactaggcacctgggatagccctctggctatggggctgaggtcttccttccagcccaggaaagagcagaggtcaagaggcagattttttgtttcactctagcctctgctactctgtgtggccttgggcctgtcctcagtgtcaaccagcaggcctcacatctctgtttaaatggaagaagctaagcagggccaaggcagccaccatctctgggtcatttgcctctggtttgtataaacttgtgtgatgcatgcagcctgcagaccctgcagagagtgaggctgcaggatggagcaggagctaaaagagatttggagagtggcgtctcctggtgacctgcaaggtctcggcacgactccccacactgccttttccctgttatctgctcagatctgtgacttcctccgcggagccacagtccatagaatcctcggccagcaggtcccctatgccaccaagggcaaccagtgggtaggatacgacgaccaggaaagcgtcaaaagcaaggtgcagtacctgaaggacaggcagctggcgggcgccatggtatgggccctggacctggatgacttccagggctccttctgcggccaggatctgcgcttccctctcaccaatgccatcaaggatgcactcgctgcaacgtagccctctgttctgcacacagcacgggggccaaggatgccccgtccccctctggctccagctggccgggagcctgatcacctgccctgctgagtcccaggctgagcctcagtctccctcccttggggcctatgcagaggtccacaacacacagatttgagctcagccctggtgggcagagaggtagggatggggctgtggggatagtgaggcatcgcaatgtaagactcgggattagtacacacttgttgattaatggaaatgtttacagatccccaagcctggcaagggaatttcttcaactccctgccccccagccctccttatcaaaggacaccattttggcaagctctatcaccaaggagccaaacatcctacaagacacagtgaccatactaattataccccctgcaaagcccagcttgaaaccttcacttaggaacgtaatcgtgtcccctatcctacttccccttcctaattccacagctgctcaataaagtacaagagcttaacag

SEQ ID NO: 314590 - DNA, 1495 bp, Homo sapiens
ggacgcgtggtcgacccacgcgtccgatcgacacctgggagtggaatgatgtgacgctctacggcatgctcaacacactcaagaacaggaaccccaacctgaagactctcttgtctgtcggaggatggaactttgggtctcaaagattttccaagatagcctccaacacccagagtcgccggactttcatcaagtcagtaccgccatttctgcgcacccatggctttgatgggctggaccttgcctggctctaccctggacggagagacaaacagcattttaccaccctaatcaaggaaatgaaggccgaatttataaaggaagcccagccagggaaaaagcagctcctgctcagcgcagcactgtctgcggggaaggtcaccattgacagcagctatgacattgccaagatatcccaacacctggatttcattagcatcatgacctacgattttcatggagcctggcgtgggaccacaggccatcacagtcccctgttccgaggtcaggaggatgcaagtcctgacagattcagcaacactgactatgctgtggggtacatgttgaggctgggggctcctgccagtaagctggtgatgggcatccccaccttcgggaggagcttcactctggcttcttctgagactggtgttggagccccaatctcaggaccgggaattccaggccggttcaccaaggaggcagggacccttgcctactatgagatctgtgacttcctccgcggagccacagtccatagaatcctcggccagcaggtcccctatgccaccaagggcaaccagtgggtaggatacgacgaccaggaaagcgtcaaaagcaaggtgcagtacctgaaggacaggcagctggcgggcgccatggtatgggccctggacctggatgacttccagggctccttctgcggccaggatctgcgcttccctctcaccaatgccatcaaggatgcactcgctgcaacgtagccctctgttctgcacacagcacgggggccaaggatgccccgtccccctctggctccagctggccgggagcctgatcacctgccctgctgagtcccaggctgagcctcagtctccctcccttggggcctatgcagaggtccacaacacacagatttgagctcagccctggtgggcagagaggtagggatggggctgtggggatagtgaggcatcgcaatgtaagactcgggattagtacacacttgttgattaatggaaatgtttacagatccccaagcctggcaagggaatttcttcaactccctgccccccagccctccttatcaaaggacaccattttggcaagctctatcaccaaggagccaaacatcctacaagacacagtgaccatactaattataccccctgcaaagcccagcttgaaaccttcacttaggaacgtaatcgtgtcccctatcctacttccccttcctaattccacagctgctcaataaagtacaagagcttaacag

SEQ ID NO: 314591 - DNA, 2300 bp, Homo sapiens
gagtggagtgggacaggtatataaaggaagtacagggcctggggaagaggccctgtctaggtagctggcaccaggagccgtgggcaagggaagaggccacaccctgccctgctctgctgcagccagaatgggtgtgaaggcgtctcaaacaggctttgtggtcctggtgctgctccagtgctgctctgcatacaaactggtctgctactacaccagctggtcccagtaccgggaaggcgatgggagctgcttcccagatgcccttgaccgcttcctctgtacccacatcatctacagctttgccaatataagcaacgatcacatcgacacctgggagtggaatgatgtgacgctctacggcatgctcaacacactcaagaacaggaaccccaacctgaagactctcttgtctgtcggaggatggaactttgggtctcaaagattttccaagatagcctccaacacccagagtcgccggactttcatcaagtcagtaccgccatttctgcgcacccatggctttgatgggctggaccttgcctggctctaccctggacggagagacaaacagcattttaccaccctaatcaaggaaatgaaggccgaatttataaaggaagcccagccagggaaaaagcagctcctgctcagcgcagcactgtctgcggggaaggtcaccattgacagcagctatgacattgccaagatatcccaacacctggatttcattagcatcatgacctacgattttcatggagcctggcgtgggaccacaggccatcacagtcccctgttccgaggtcaggaggatgcaagtcctgacagattcagcaacactgtgagttcccagaaggagggagggccaggagggggccgcaagacctgccatctgccagtgctcacacaccaatctctctagccctcagtacagtcctgcaagaggggggtcatgaggcccattccacagataaggaaactgaggcccaaagtctgggcatgctgcgttgctctgggaaggtgatctgcagggtaaatggagtgagggcagggggccgaatggggagaggctgggagccgaggaggtaggagtcattgtgccctcagagccaaccacctgatttctgcatctgtcaaatagtaatagccccttcctatgcctcaaaggatttttttcaagaatgaaactgtaaaattcactttaaagtgacatgatccgttcccggagggacaggggaatccccagtgcaccatacaccaataacccctgctaaggcagcagtattaattgctcaaccttccgcacctgtgcactaactgctcacgttgttcccaccctaccccacccaggactatgctgtggggtacatgttgaggctgggggctcctgccagtaagctggtgatgggcatccccaccttcgggaggagcttcactctggcttcttctgagactggtgttggagccccaatctcaggaccgggaattccaggccggttcaccaaggaggcagggacccttgcctactatgagatctgtgacttcctccgcggagccacagtccatagaatcctcggccagcaggtcccctatgccaccaagggcaaccagtgggtaggatacgacgaccaggaaagcgtcaaaagcaaggtgcagtacctgaaggacaggcagctggcgggcgccatggtatgggccctggacctggatgacttccagggctccttctgcggccaggatctgcgcttccctctcaccaatgccatcaaggatgcactcgctgcaacgtagccctctgttctgcacacagcacgggggccaaggatgccccgtccccctctggctccagctggccgggagcctgatcacctgccctgctgagtcccaggctgagcctcagtctccctcccttggggcctatgcagaggtccacaacacacagatttgagctcagccctggtgggcagagaggtagggatggggctgtggggatagtgaggcatcgcaatgtaagactcgggattagtacacacttgttgattaatggaaatgtttacagatccccaagcctggcaagggaatttcttcaactccctgccccccagccctccttatcaaaggacaccattttggcaagctctatcaccaaggagccaaacatcctacaagacacagtgaccatactaattataccccctgcaaagcccagcttgaaaccttcacttaggaacgtaatcgtgtcccctatcctacttccccttcctaattccacagctgctcaataaagtacaagagcttaacag

SEQ ID NO: 314592 - DNA, 1321 bp, Homo sapiens
cctgcctcagcctcccgagtagctgggattacaggtgcctgccaccatgcctggctaattttcgtagttagagtagagacggggtttcaccatcttggccaggctggtcttgaactcctcacctcatgatccacctgcctcggcctcccaaagtgctgggattccaggtatgagccaccacgcccggcctaaagcttttctattaataatttcctgcctcaccctccatccccttcctcctcagacacctggatttcattagcatcatgacctacgattttcatggagcctggcgtgggaccacaggccatcacagtcccctgttccgaggtcaggaggatgcaagtcctgacagattcagcaacactgactatgctgtggggtacatgttgaggctgggggctcctgccagtaagctggtgatgggcatccccaccttcgggaggagcttcactctggcttcttctgagactggtgttggagccccaatctcaggaccgggaattccaggccggttcaccaaggaggcagggacccttgcctactatgagatctgtgacttcctccgcggagccacagtccatagaatcctcggccagcaggtcccctatgccaccaagggcaaccagtgggtaggatacgacgaccaggaaagcgtcaaaagcaaggtgcagtacctgaaggacaggcagctggcgggcgccatggtatgggccctggacctggatgacttccagggctccttctgcggccaggatctgcgcttccctctcaccaatgccatcaaggatgcactcgctgcaacgtagccctctgttctgcacacagcacgggggccaaggatgccccgtccccctctggctccagctggccgggagcctgatcacctgccctgctgagtcccaggctgagcctcagtctccctcccttggggcctatgcagaggtccacaacacacagatttgagctcagccctggtgggcagagaggtagggatggggctgtggggatagtgaggcatcgcaatgtaagactcgggattagtacacacttgttgattaatggaaatgtttacagatccccaagcctggcaagggaatttcttcaactccctgccccccagccctccttatcaaaggacaccattttggcaagctctatcaccaaggagccaaacatcctacaagacacagtgaccatactaattataccccctgcaaagcccagcttgaaaccttcacttaggaacgtaatcgtgtcccctatcctacttccccttcctaattccacagctgctcaataaagtacaagagcttaacag

SEQ ID NO: 314593 - DNA, 1755 bp, Homo sapiens
gagtggagtgggacaggtatataaaggaagtacagggcctggggaagaggccctgtctaggtagctggcaccaggagccgtgggcaagggaagaggccacaccctgccctgctctgctgcagccagaatgggtgtgaaggcgtctcaaacaggctttgtggtcctggtgctgctccagtgctgctctgcatacaaactggtctgctactacaccagctggtcccagtaccgggaaggcgatgggagctgcttcccagatgcccttgaccgcttcctctgtacccacatcatctacagctttgccaatataagcaacgatcacatcgacacctgggagtggaatgatgtgacgctctacggcatgctcaacacactcaagaacaggaaccccaacctgaagactctcttgtctgtcggaggatggaactttgggtctcaaagattttccaagatagcctccaacacccagagtcgccggactttcatcaagtcagtaccgccatttctgcgcacccatggctttgatgggctggaccttgcctggctctaccctggacggagagacaaacagcattttaccaccctaatcaaggaaatgaaggccgaatttataaaggaagcccagccagggaaaaagcagctcctgctcagcgcagcactgtctgcggggaaggtcaccattgacagcagctatgacattgccaagatatcccaacacctggatttcattagcatcatgacctacgattttcatggagcctggcgtgggaccacaggccatcacagtcccctgttccgaggtcaggaggatgcaagtcctgacagattcagcaacactgactatgctgtggggtacatgttgaggctgggggctcctgccagtaagctggtgatgggcatccccaccttcgggaggagcttcactctggcttcttctgagactggtgttggagccccaatctcaggaccgggaattccaggccggttcaccaaggaggcagggacccttgcctactatgagatctgtgacttcctccgcggagccacagtccatagaatcctcggccagcaggtcccctatgccaccaagggcaaccagtgggtaggatacgacgaccaggaaagcgtcaaaagcaaggtgcagtacctgaaggacaggcagctggcgggcgccatggtatgggccctggacctggatgacttccagggctccttctgcggccaggatctgcgcttccctctcaccaatgccatcaaggatgcactcgctgcaacgtagccctctgttctgcacacagcacgggggccaaggcctgatcacctgccctgctgagtcccaggctgagcctcagtctccctcccttggggcctatgcagaggtccacaacacacagatttgagctcagccctggtgggcagagaggtagggatggggctgtggggatagtgaggcatcgcaatgtaagactcgggattagtacacacttgttgattaatggaaatgtttacagatccccaagcctggcaagggaatttcttcaactccctgccccccagccctccttatcaaaggacaccattttggcaagctctatcaccaaggagccaaacatcctacaagacacagtgaccatactaattataccccctgcaaagcccagcttgaaaccttcacttaggaacgtaatcgtgtcccctatcctacttccccttcctaattccacagctgctcaataaagtacaagagcttaacag

SEQ ID NO: 314594 - DNA, 1732 bp, Homo sapiens
agcggccgcccgcgatctagaactatgtaaaattcactttaaagtgacatgatccgttcccggagggacaggggaatccccagtgcaccatacaccaataacccctgctaaggcagcagtattaattgctcaaccttccgcacctgtgcactaactgctcacgttgttcccaccctaccccacccaggactatgctgtggggtacatgttgaggctgggggctcctgccagtaagctggtgatgggcatccccaccttcgggaggagcttcactctggcttcttctgagactggtgttggagccccaatctcaggaccgggaattccaggccggttcaccaaggaggcagggacccttgcctactatgaggtaatggagttggggagaaggtaggattcccccacaccaccagcagccctggggaaggtgattccccaccacgttcttgctttttctcctttgggaataaagaaaatgtccggttgccccagcatgcctgaggaagtggaagggagaggttaggacatttgttgctgaaaatctccagcaggtacaggcacatgggcctgcaccactaggcacctgggatagccctctggctatggggctgaggtcttccttccagcccaggaaagagcagaggtcaagaggcagattttttgtttcactctagcctctgctactctgtgtggccttgggcctgtcctcagtgtcaaccagcaggcctcacatctctgtttaaatggaagaagctaagcagggccaaggcagccaccatctctgggtcatttgcctctggtttgtataaacttgtgtgatgcatgcagcctgcagaccctgcagagagtgaggctgcaggatggagcaggagctaaaagagatttggagagtggcgtctcctggtgacctgcaaggtctcggcacgactccccacactgccttttccctgttatctgctcagatctgtgacttcctccgcggagccacagtccatagaatcctcggccagcaggtcccctatgccaccaagggcaaccagtgggtaggatacgacgaccaggaaagcgtcaaaagcaaggtgcagtacctgaaggacaggcagctggcgggcgccatggtatgggccctggacctggatgacttccagggctccttctgcggccaggatctgcgcttccctctcaccaatgccatcaaggatgcactcgctgcaacgtagccctctgttctgcacacagcacgggggccaaggatgccccgtccccctctggctccagctggccgggagcctgatcacctgccctgctgagtcccaggctgagcctcagtctccctcccttggggcctatgcagaggtccacaacacacagatttgagctcagccctggtgggcagagaggtagggatggggctgtggggatagtgaggcatcgcaatgtaagactcgggattagtacacacttgttgattaatggaaatgtttacagatccccaagcctggcaagggaatttcttcaactccctgccccccagccctccttatcaaaggacaccattttggcaagctctatcaccaaggagccaaacatcctacaagacacagtgaccatactaattataccccctgcaaagcccagcttgaaaccttcacttaggaacgtaatcgtgtcccctatcctacttccccttcctaattccacagctgctcaataaagtacaagagcttaacag

SEQ ID NO: 314595 - DNA, 1529 bp, Homo sapiens
gagtggagtgggacaggtatataaaggaagtacagggcctggggaagaggccctgtctaggtagctggcaccaggagccgtgggcaagggaagaggccacaccctgccctgctctgctgcagccagaatgggtgtgaaggcgtctcaaacaggctttgtggtcctggtgctgctccagtgctgctctgcatacaaactggtctgctactacaccagctggtcccagtaccgggaaggcgatgggagctgcttcccagatgcccttgaccgcttcctctgtacccacatcatctacagctttgccaatataagcaacgatcacatcgacacctgggagtggaatgatgtgacgctctacggcatgctcaacacactcaagaacaggaaccccaacctgaagactctcttgtctgtcggaggatggaactttgggtctcaaagattttccaagatagcctccaacacccagagtcgccggactttcatcaagtcagtaccgccatttctgcgcacccatggctttgatgggctggaccttgcctggctctaccctggacggagagacaaacagcattttaccaccctaatcaaggaaatgaaggccgaatttataaaggaagcccagccagggaaaaagcagctcctgctcagcgcagcactgtctgcggggaaggtcaccattgacagcagctatgacattgccaagatatcccaacacctggatttcattagcatcatgacctacgattttcatggagcctggcgtgggaccacaggccatcacagtcccctgttccgaggtcaggaggatgcaagtcctgacagattcagcaacactgactatgctgtggggtacatgttgaggctgggggctcctgccagtaagctggtgatgggcatccccaccttcgggaggagcttcactctggcttcttctgagactggtgttggagccccaatctcaggaccgggaattccaggccggttcaccaaggaggcagggacccttgcctactatgagatctgtgacttcctccgcggagccacagtccatagaatcctcggccagcaggtcccctatgccaccaagggcaaccagtgggtaggatacgacgaccaggaaagcgtcaaaagcaagatgccccgtccccctctggctccagctggccgggagcctgatcacctgccctgctgagtcccaggctgagcctcagtctccctcccttggggcctatgcagaggtccacaacacacagatttgagctcagccctggtgggcagagagatccccaagcctggcaagggaatttcttcaactccctgccccccagccctccttatcaaaggacaccattttggcaagctctatcaccaaggagccaaacatcctacaagacacagtgaccatactaattataccccctgcaaagcccagcttgaaaccttcacttaggaacgtaatcgtgtcccctatcctacttccccttcctaattccacagctgctcaataaagtacaagagcttaacag

SEQ ID NO: 314596 - DNA, 950 bp, Homo sapiens
tccctggctcgcagtgcctgccgggagccacgtctccgaagaccgatagctgcttcgggattggcgtccgggcggctatctaggggctgctgggaagatggcggactcggtggctagccgatgaggaggccgcggggggaacccggcccccgggccccgagaccgactgagggagcgacctgcgcagggcccggggagtcatgtaggggtggcgcctgcggggagggctgcgggagggcagcgggagctggtgttagcggcagcggccacggtctcctggcgtccctgggccggggtgggtgttggggcccccgacttcgccgactccgcgccatcgcaaagcggtgcactcgggctccacgcgcgccctgcgaggtgggcgctgcgttttcatttcacgggtgaggagacttagagagacgaagccacttgtccaaggtcacgccgctggtgagtgggagcgcccagcatggaacccagcaccgtccagccgcggagcccgcgttccaccctctgtgccgccgccgcctcctgtgggagagggaggtggtcgggagagtgcacgccggtgccgcctgggctccagactgggcgcgaccactaacccggttaatgacctcgggcttaacttaaccccttcgctgctctgggcctgcgtttctccaccggtgaaatgaggtaatgccagccctgcctactcttcatgggcgtgtaaggagcatcagagatggtgcatgtggaattgctttgcaagtagtgctgcgctgagcgcactgaggattatgattgctgtttcaaaggcgtggaaggaggcagaggggcggggtggggaagaggcccagagcagtcacaaaggcttgctctgaccacaggccccctaaatgaggagtgaggtaagcagtaggtagcaggtctttctcccctttggagaaaacctcaccccctttttt

SEQ ID NO: 314597 - DNA, 1871 bp, Homo sapiens
tccctggctcgcagtgcctgccgggagccacgtctccgaagaccgatagctgcttcgggattggcgtccgggcggctatctaggggctgctgggaagatggcggactcggtggctagccgatgaggaggccgcggggggaacccggcccccgggccccgagaccgactgagggagcgacctgcgcagggcccggggagtcatggtctccatcacccaactccatgcttcgagtcctgctctctgctcagacctcccctgctcggctgtctggcctgctgctgatccctccagtacagccctgctgtttggggcccagcaaatggggggaccggcctgttggaggaggccccagtgcaggtcctgtgcaaggactgcagcggcttctggaacaggcgaagagccctggggagctgctgcgctggctgggccagaaccccagcaaggtgcgcgcccaccactactcggtggcgcttcgtcgtctgggccagctcttggggtctcggccacggccccctcctgtggagcaggtcacactgcaggacttgagtcagctcatcatccgaaactgcccctcctttgacattcacaccatccacgtgtgtctgcaccttgcagtcttacttggctttccatctgatggtcccctggtgtgtgccctggaacaggagcgaaggctccgcctccctccgaagccacctccccctttgcagccccttctccgaggtgggcaagggttggaagctgctctaagctgcccccgttttctgcggtatccacggcagcatctgatcagcagcctggcagaggcaaggccagaggaactgactccccacgtgatggtgctcctggcccagcacctggcccggcaccggttgcgggagccccagcttctggaagccattgcccacttcctggtggttcaggaaacgcaactcagcagcaaggtggtacagaagttggtcctgccctttgggcgactgaactacctgcccctggaacagcagtttatgccctgccttgagaggatcctggctcgggaagcaggggtggcacccctggctacagtcaacatcttgatgtcactgtgccaactgcggtgcctgcccttcagagccctgcactttgttttttcccctggcttcatcaactacatcagtggcacccctcatgctctgattgtgcgtcgctacctctccctgctggacacggccgtggagctggagctcccaggataccggggtccccgccttccccgaaggcagcaagtgcccatctttccccagcctctcatcaccgaccgtgcccgctgcaagtacagtcacaaggacatagtagctgaggggttgcgccagctgctgggggaggagaaataccgccaggacctgactgtgcctccaggctactgcacagacttcctgctgtgcgccagcagctctggtgctgtgcttcccgtgaggacccaggaccccttcctgccatacccaccaaggtcctgcccacagggccaggctgcctctagcgccactactcgagaccctgcccagagggtggtgctggtgttgcgggaacgctggcatttctgccgggacggccgggtgctgctgggctcgagggccctgagggagcggcacctaggcctgatgggctaccagctcctgccgctacccttcgaggaactggagtcccagagaggcctgccccagctcaagagctacctgaggcagaagctccaggccctgggcctgcgctgggggcctgaagggggctgaggggatgatgtggggttcaggatggcccccccatggggggtggatgatttgcactttggttccctgtgttttgatttctcattaaagttcctttccttccc

SEQ ID NO: 314598 - DNA, 1700 bp, Homo sapiens
tccctggctcgcagtgcctgccgggagccacgtctccgaagaccgatagctgcttcgggattggcgtccgggcggctatctaggggctgctgggaagatggcggactcggtggctagccgatgaggaggccgcggggggaacccggcccccgggccccgagaccgactgagggagcgacctgcgcagggcccggggagtcatggtctccatcacccaactccatgcttcgagtcctgctctctgctcagacctcccctgctcggctgtctggcctgctgctgatccctccagtacagccctgctgtttggggcccagcaaatggggggaccggcctgttggaggaggccccagtgcaggtcctgtgcaaggactgcagcggcttctggaacaggcgaagagccctggggagctgctgcgctggctgggccagaaccccagcaaggtgcgcgcccaccactactcggtggcgcttcgtcgtctgggccagctcttggggtctcggccacggccccctcctgtggagcaggtcacactgcaggacttgagtcagctcatcatccgaaactgcccctcctttgacattcacaccatccacgtgtgtctgcaccttgcagtcttacttggctttccatctgatggtcccctggtgtgtgccctggaacaggagcgaaggctccgcctccctccgaagccacctccccctttgcagccccttctccgaggtgggcaagggttggaagctgctctaagctgcccccgttttctgcggtatccacggcagcatctgatcagcagcctggcagaggcaaggccagaggaactgactccccacgtgatggtgctcctggcccagcacctggcccggcaccggttgcgggagccccagcttctggaagccattgcccacttcctggtggttcaggaaacgcaactcagcagcaaggtggtacagaagttggtcctgccctttgggcgactgaactacctgcccctggaacagcagtttatgccctgccttgagaggatcctggctcgggaagcaggggtggcacccctggctacagtcaacatcttgatgtcactgtgccaactgcggtgcctgcccttcagagccctgcactttgttttttcccctggcttcatcaactacatcagtggcacccctcatgctctgattgtgcgtcgctacctctccctgctggacacggccgtggagctggagctcccaggataccggggtccccgccttccccgaaggcagcaagtgcccatctttccccagcctctcatcaccgaccgtgcccgctgcaagtacagtcacaaggacatagtagctgaggggttgcgccagctgctgggggaggagaaataccgccaggacctgactgtgcctccaggctactgcacagacttcctgctgtgcgccagcagctctggtgctgtgcttcccgtgaggacccaggaccccttcctgccatacccaccaaggtcctgccccagctcaagagctacctgaggcagaagctccaggccctgggcctgcgctgggggcctgaagggggctgaggggatgatgtggggttcaggatggcccccccatggggggtggatgatttgcactttggttccctgtgttttgatttctcattaaagttcctttccttccccgttgtgaatctcagttttgggacggggagc

SEQ ID NO: 314599 - DNA, 2426 bp, Homo sapiens
  misc_feature (1885)..(1885): n is a, c, g, or t
tccctggctcgcagtgcctgccgggagccacgtctccgaagaccgatagctgcttcgggattggcgtccgggcggctatctaggggctgctgggaagatggcggactcggtggctagccgatgaggaggccgcggggggaacccggcccccgggccccgagaccgactgagggagcgacctgcgcagggcccggggagtcatggtctccatcacccaactccatgcttcgagtcctgctctctgctcagacctcccctgctcggctgtctggcctgctgctgatccctccagtacagccctgctgtttggggcccagcaaatggggggaccggcctgttggaggaggccccagtgcaggtcctgtgcaaggactgcagcggcttctggaacaggcgaagagccctggggagctgctgcgctggctgggccagaaccccagcaaggtgcgcgcccaccactactcggtggcgcttcgtcgtctgggccagctcttggggtctcggccacggccccctcctgtggagcaggtcacactgcaggacttgagtcagctcatcatccgaaactgcccctcctttgacattcacaccatccacgtgtgtctgcaccttgcagtcttacttggctttccatctgatggtcccctggtgtgtgccctggaacaggagcgaaggctccgcctccctccgaagccacctccccctttgcagccccttctccgaggtgggcaagggttggaagctgctctaagctgcccccgttttctgcggtatccacggcagcatctgatcagcagcctggcagaggcaaggccagaggaactgactccccacgtgatggtgctcctggcccagcacctggcccggcaccggttgcgggagccccagcttctggaagccattgcccacttcctggtggttcaggaaacgcaactcagcagcaaggtggtacagaagttggtcctgccctttgggcgactgaactacctgcccctggaacagcagtttatgccctgccttgagaggatcctggctcgggaagcaggggtggcacccctggctacagtcaacatcttgatgtcactgtgccaactgcggtgcctgcccttcagagccctgcactttgttttttcccctggcttcatcaactacatcagtggcacccctcatgctctgattgtgcgtcgctacctctccctgctggacacggccgtggagctggagctcccaggataccggggtccccgccttccccgaaggcagcaagtgcccatctttccccagcctctcatcaccgaccgtgcccgctgcaagtacagtcacaaggacatagtagctgaggggttgcgccagctgctgggggaggagaaataccgccaggacctgactgtgcctccaggctactgcacagacttcctgctgtgcgccagcagctctggtgctgtgcttcccgtgaggacccaggaccccttcctgccatacccaccaaggtcctgcccacagggccaggctgcctctagcgccactactcgagaccctgcccagagggtggtgctggtgttgcgggaacgctggcatttctgccgggacggccgggtgctgctgggctcgagggccctgagggagcggcacctaggcctgatgggctaccagctcctgccgctacccttcgaggaactggagtcccagagaggcctgccccagctcaagagctacctgaggcagaagctccaggccctgggcctgcgctgggggcctgaagggggctgaggggatgatgtggggttcaggatggcccccccatggggggtggatgatttgcactttggttccctgtgttttgatttctcattaaagttcctttccttcccaaaaaaaaaaaaanaaaaaaaaaaaaaaaaaaaaaaaaaaaaaaaaaaaaaaaaaaaaaaaaaaaaaaaaaaaaaacaacaaaaagagagagggggggcggcgcacagcaaaactctctccccgcagggaggcggcagcagtacgagacgcgcccccgcgcggtttatgggagaagaagggcgggccgccacaagagggggggcgggtatataaaaacgaggcgagcgagggggggggtgttataacaagaatgcgcgagagagagggggagaaaaaggagcggaatagggggagtaattatgtgtggaagagagcaaacatatatatttgtggggggggggtggagaaaaatgtgtgggggaacaataaccaacgaaggagaagtatattaagaagggtcagtaggggggagggaaatatacaatagaattaggaagcggaggttggaggagggggggaaaaaaaaagtgtaattatattgtagttagggatgtgaaaagaagaatgtgtgaaatgaggagggtatgatttataagaaagagaaaatttttggg

SEQ ID NO: 314600 - DNA, 2090 bp, Homo sapiens
tccctggctcgcagtgcctgccgggagccacgtctccgaagaccgatagctgcttcgggattggcgtccgggcggctatctaggggctgctgggaagatggcggactcggtggctagccgatgaggaggccgcggggggaacccggcccccgggccccgagaccgactgagggagcgacctgcgcagggcccggggagtcatggtctccatcacccaactccatgcttcgagtcctgctctctgctcagacctcccctgctcggctgtctggcctgctgctgatccctccagtacagccctgctgtttggggcccagcaaatggggggaccggcctgttggaggaggccccagtgcaggtcctgtgcaaggactgcagcggcttctggaacaggcgaagagccctggggagctgctgcgctggctgggccagaaccccagcaaggtgcgcgcccaccactactcggtggcgcttcgtcgtctgggccagctcttggggtctcggccacggccccctcctgtggagcaggtcacactgcaggacttgagtcagctcatcatccgaaactgcccctcctttgacattcacaccatccacgtgtgtctgcaccttgcagtcttacttggctttccatctgatggtcccctggtgtgtgccctggaacaggagcgaaggctccgcctccctccgaagccacctccccctttgcagccccttctccgaggtgggcaagggttggaagctgctctaagctgcccccgttttctgcggtatccacggcagcatctgatcagcagcctggcagaggcaaggccagaggaactgactccccacgtgatggtgctcctggcccagcacctggcccggcaccggttgcgggagccccagcttctggaagccattgcccacttcctggtggttcaggaaacgcaactcagcagcaaggtggtacagaagttggtcctgccctttgggcgactgaactacctgcccctggaacagcagtttatgccctgccttgagaggatcctggctcgggaagcaggggtggcacccctggctacagtcaacatcttgatgtcactgtgccaactgcggtgcctgcccttcagagccctgcactttgttttttcccctggcttcatcaactacatcagtggcacccctcatgctctgattgtgcgtcgctacctctccctgctggacacggccgtggagctggagctcccaggataccggggtccccgccttccccgaaggcagcaagtgcccatctttccccagcctctcatcaccgaccgtgcccgctgcaagtacaggtggatggggcagcctggggcaaggggaggggccagcctgggaccagcagagtggaaaagccagagggaccatgaagcgccaaagctaaggagctctcggccaccataaaactgggccctgaagcagcagagggctttgcccagggtggtggcactagactgggacagattaggatgaggtgccgggcccttcctgctactggtgtcctttctcctcagtcacaaggacatagtagctgaggggttgcgccagctgctgggggaggagaaataccgccaggacctgactgtgcctccaggctactgcacagacttcctgctgtgcgccagcagctctggtgctgtgcttcccgtgaggacccaggaccccttcctgccatacccaccaaggtcctgcccacagggccaggctgcctctagcgccactactcgagaccctgcccagagggtggtgctggtgttgcgggaacgctggcatttctgccgggacggccgggtgctgctgggctcgagggccctgagggagcggcacctaggcctgatgggctaccagctcctgccgctacccttcgaggaactggagtcccagagaggcctgccccagctcaagagctacctgaggcagaagctccaggccctgggcctgcgctgggggcctgaagggggctgaggggatgatgtggggttcaggatggcccccccatggggggtggatgatttgcactttggttccctgtgttttgatttctcattaaagttcctttccttccc

SEQ ID NO: 314601 - DNA, 2163 bp, Homo sapiens
tccctggctcgcagtgcctgccgggagccacgtctccgaagaccgatagctgcttcgggattggcgtccgggcggctatctaggggctgctgggaagatggcggactcggtggctagccgatgaggaggccgcggggggaacccggcccccgggccccgagaccgactgagggagcgacctgcgcagggcccggggagtcatggtctccatcacccaactccatgcttcgagtcctgctctctgctcagacctcccctgctcggctgtctggcctgctgctgatccctccagtacagccctgctgtttggggcccagcaaatggggggaccggcctgttggaggaggccccagtgcaggtcctgtgcaaggactgcagcggcttctggaacaggcgaagagccctggggagctgctgcgctggctgggccagaaccccagcaaggtgcgcgcccaccactactcggtggcgcttcgtcgtctgggccagctcttggggtctcggccacggccccctcctgtggagcaggtcacactgcaggacttgagtcagctcatcatccgaaactgcccctcctttgacattcacaccatccacgtgtgtctgcaccttgcagtcttacttggctttccatctgatggtcccctggtgtgtgccctggaacaggagcgaaggctccgcctccctccgaagccacctccccctttgcagccccttctccgaggtgggcaagggttggaagctgctctaagctgcccccgttttctgcggtatccacggcagcatctgatcagcagcctggcagaggcaaggccagaggaactgactccccacgtgatggtgctcctggcccagcacctggcccggcaccggttgcgggagccccagcttctggaagccattgcccacttcctggtggttcaggaaacgcaactcagcagcaaggtggtacagaagttggtcctgccctttgggcgactgaactacctgcccctggaacagcagtttatgccctgccttgagaggatcctggctcgggaagcaggggtggcacccctggctacagtcaacatcttgatgtcactgtgccaactgcggtgcctgcccttcagagccctgcactttgttttttcccctggcttcatcaactacatcagtggcacccctcatgctctgattgtgcgtcgctacctctccctgctggacacggccgtggagctggagctcccaggataccggggtccccgccttccccgaaggcagcaagtgcccatctttccccagcctctcatcaccgaccgtgcccgctgcaagtacaggtggatggggcagcctggggcaaggggaggggccagcctgggaccagcagagtggaaaagccagagggaccatgaagcgccaaagctaaggagctctcggccaccataaaactgggccctgaagcagcagagggctttgcccagggtggtggcactagactgggacagattaggatgaggtgccgggcccttcctgctactggtgtcctttctcctcagtcacaaggacatagtagctgaggggttgcgccagctgctgggggaggagaaataccgccaggacctgactgtgcctccaggctactgcacaggtgagcaaggggcaggcggcaggcccggggagacggagccctggctaaggccgccggccctgctcccctccagacttcctgctgtgcgccagcagctctggtgctgtgcttcccgtgaggacccaggaccccttcctgccatacccaccaaggtcctgcccacagggccaggctgcctctagcgccactactcgagaccctgcccagagggtggtgctggtgttgcgggaacgctggcatttctgccgggacggccgggtgctgctgggctcgagggccctgagggagcggcacctaggcctgatgggctaccagctcctgccgctacccttcgaggaactggagtcccagagaggcctgccccagctcaagagctacctgaggcagaagctccaggccctgggcctgcgctgggggcctgaagggggctgaggggatgatgtggggttcaggatggcccccccatggggggtggatgatttgcactttggttccctgtgttttgatttctcattaaagttcctttccttccc

SEQ ID NO: 314602 - DNA, 1944 bp, Homo sapiens
tccctggctcgcagtgcctgccgggagccacgtctccgaagaccgatagctgcttcgggattggcgtccgggcggctatctaggggctgctgggaagatggcggactcggtggctagccgatgaggaggccgcggggggaacccggcccccgggccccgagaccgactgagggagcgacctgcgcagggcccggggagtcatggtctccatcacccaactccatgcttcgagtcctgctctctgctcagacctcccctgctcggctgtctggcctgctgctgatccctccagtacagccctgctgtttggggcccagcaaatggggggaccggcctgttggaggaggccccagtgcaggtcctgtgcaaggactgcagcggcttctggaacaggcgaagagccctggggagctgctgcgctggctgggccagaaccccagcaaggtgcgcgcccaccactactcggtggcgcttcgtcgtctgggccagctcttggggtctcggccacggccccctcctgtggagcaggtcacactgcaggacttgagtcagctcatcatccgaaactgcccctcctttgacattcacaccatccacgtgtgtctgcaccttgcagtcttacttggctttccatctgatggtcccctggtgtgtgccctggaacaggagcgaaggctccgcctccctccgaagccacctccccctttgcagccccttctccgaggtgggcaagggttggaagctgctctaagctgcccccgttttctgcggtatccacggcagcatctgatcagcagcctggcagaggcaaggccagaggaactgactccccacgtgatggtgctcctggcccagcacctggcccggcaccggttgcgggagccccagcttctggaagccattgcccacttcctggtggttcaggaaacgcaactcagcagcaaggtggtacagaagttggtcctgccctttgggcgactgaactacctgcccctggaacagcagtttatgccctgccttgagaggatcctggctcgggaagcaggggtggcacccctggctacagtcaacatcttgatgtcactgtgccaactgcggtgcctgcccttcagagccctgcactttgttttttcccctggcttcatcaactacatcagtggcacccctcatgctctgattgtgcgtcgctacctctccctgctggacacggccgtggagctggagctcccaggataccggggtccccgccttccccgaaggcagcaagtgcccatctttccccagcctctcatcaccgaccgtgcccgctgcaagtacagtcacaaggacatagtagctgaggggttgcgccagctgctgggggaggagaaataccgccaggacctgactgtgcctccaggctactgcacagacttcctgctgtgcgccagcagctctggtgctgtgcttcccgtgaggacccaggaccccttcctgccatacccaccaaggtcctgcccacagggccaggctgcctctagcgccactactcgagaccctgcccagaggtaaaggaggcagggtgggggagccctggccaccttgcccgccatgccctgagccacgtccctccccctgcagggtggtgctggtgttgcgggaacgctggcatttctgccgggacggccgggtgctgctgggctcgagggccctgagggagcggcacctaggcctgatgggctaccagctcctgccgctacccttcgaggaactggagtcccagagaggcctgccccagctcaagagctacctgaggcagaagctccaggccctgggcctgcgctgggggcctgaagggggctgaggggatgatgtggggttcaggatggcccccccatggggggtggatgatttgcactttggttccctgtgttttgatttctcattaaagttcctttccttccc

SEQ ID NO: 314603 - DNA, 2236 bp, Homo sapiens
tccctggctcgcagtgcctgccgggagccacgtctccgaagaccgatagctgcttcgggattggcgtccgggcggctatctaggggctgctgggaagatggcggactcggtggctagccgatgaggaggccgcggggggaacccggcccccgggccccgagaccgactgagggagcgacctgcgcagggcccggggagtcatggtctccatcacccaactccatgcttcgagtcctgctctctgctcagacctcccctgctcggctgtctggcctgctgctgatccctccagtacagccctgctgtttggggcccagcaaatggggggaccggcctgttggaggaggccccagtgcaggtcctgtgcaaggactgcagcggcttctggaacaggcgaagagccctggggagctgctgcgctggctgggccagaaccccagcaaggtgcgcgcccaccactactcggtggcgcttcgtcgtctgggccagctcttggggtctcggccacggccccctcctgtggagcaggtcacactgcaggacttgagtcagctcatcatccgaaactgcccctcctttgacattcacaccatccacgtgtgtctgcaccttgcagtcttacttggctttccatctgatggtcccctggtgtgtgccctggaacaggagcgaaggctccgcctccctccgaagccacctccccctttgcagccccttctccgaggtgggcaagggttggaagctgctctaagctgcccccgttttctgcggtatccacggcagcatctgatcagcagcctggcagaggcaaggccagaggaactgactccccacgtgatggtgctcctggcccagcacctggcccggcaccggttgcgggagccccagcttctggaagccattgcccacttcctggtggttcaggaaacgcaactcagcagcaaggtggtacagaagttggtcctgccctttgggcgactgaactacctgcccctggaacagcagtttatgccctgccttgagaggatcctggctcgggaagcaggggtggcacccctggctacagtcaacatcttgatgtcactgtgccaactgcggtgcctgcccttcagagccctgcactttgttttttcccctggcttcatcaactacatcagtggcacccctcatgctctgattgtgcgtcgctacctctccctgctggacacggccgtggagctggagctcccaggataccggggtccccgccttccccgaaggcagcaagtgcccatctttccccagcctctcatcaccgaccgtgcccgctgcaagtacaggtggatggggcagcctggggcaaggggaggggccagcctgggaccagcagagtggaaaagccagagggaccatgaagcgccaaagctaaggagctctcggccaccataaaactgggccctgaagcagcagagggctttgcccagggtggtggcactagactgggacagattaggatgaggtgccgggcccttcctgctactggtgtcctttctcctcagtcacaaggacatagtagctgaggggttgcgccagctgctgggggaggagaaataccgccaggacctgactgtgcctccaggctactgcacaggtgagcaaggggcaggcggcaggcccggggagacggagccctggctaaggccgccggccctgctcccctccagacttcctgctgtgcgccagcagctctggtgctgtgcttcccgtgaggacccaggaccccttcctgccatacccaccaaggtcctgcccacagggccaggctgcctctagcgccactactcgagaccctgcccagaggtaaaggaggcagggtgggggagccctggccaccttgcccgccatgccctgagccacgtccctccccctgcagggtggtgctggtgttgcgggaacgctggcatttctgccgggacggccgggtgctgctgggctcgagggccctgagggagcggcacctaggcctgatgggctaccagctcctgccgctacccttcgaggaactggagtcccagagaggcctgccccagctcaagagctacctgaggcagaagctccaggccctgggcctgcgctgggggcctgaagggggctgaggggatgatgtggggttcaggatggcccccccatggggggtggatgatttgcactttggttccctgtgttttgatttctcattaaagttcctttccttccc

SEQ ID NO: 314604 - DNA, 2024 bp, Homo sapiens
tccctggctcgcagtgcctgccgggagccacgtctccgaagaccgatagctgcttcgggattggcgtccgggcggctatctaggggctgctgggaagatggcggactcggtggctagccgatgaggaggccgcggggggaacccggcccccgggccccgagaccgactgagggagcgacctgcgcagggcccggggagtcatggtctccatcacccaactccatgcttcgagtcctgctctctgctcagacctcccctgctcggctgtctggcctgctgctgatccctccagtacagccctgctgtttggggcccagcaaatggggggaccggcctgttggaggaggccccagtgcaggtcctgtgcaaggactgcagcggcttctggaacaggcgaagagccctggggagctgctgcgctggctgggccagaaccccagcaaggtgcgcgcccaccactactcggtggcgcttcgtcgtctgggccagctcttggggtctcggccacggccccctcctgtggagcaggtcacactgcaggacttgagtcagctcatcatccgaaactgcccctcctttgacattcacaccatccacgtgtgtctgcaccttgcagtcttacttggctttccatctgatggtcccctggtgtgtgccctggaacaggagcgaaggctccgcctccctccgaagccacctccccctttgcagccccttctccgaggtgggcaagggttggaagctgctctaagctgcccccgttttctgcggtatccacggcagcatctgatcagcagcctggcagaggcaaggccagaggaactgactccccacgtgatggtgctcctggcccagcacctggcccggcaccggttgcgggagccccagcttctggaagccattgcccacttcctggtggttcaggaaacgcaactcagcagcaaggtggtacagaagttggtcctgccctttgggcgactgaactacctgcccctggaacagcagtttatgccctgccttgagaggatcctggctcgggaagcaggggtggcacccctggctacagtcaacatcttgatgtcactgtgccaactgcggtgcctgcccttcagagccctgcactttgttttttcccctggcttcatcaactacatcagtggcacccctcatgctctgattgtgcgtcgctacctctccctgctggacacggccgtggagctggagctcccaggataccggggtccccgccttccccgaaggcagcaagtgcccatctttccccagcctctcatcaccgaccgtgcccgctgcaagtacagtcacaaggacatagtagctgaggggttgcgccagctgctgggggaggagaaataccgccaggacctgactgtgcctccaggctactgcacagacttcctgctgtgcgccagcagctctggtgctgtgcttcccgtgaggacccaggaccccttcctgccatacccaccaaggtcctgcccacagggccaggctgcctctagcgccactactcgagaccctgcccagaggtaaaggaggcagggtgggggagccctggccaccttgcccgccatgccctgagccacgtccctccccctgcagggtggtgctggtgttgcgggaacgctggcatttctgccgggacggccgggtgctgctgggctcgagggccctgagggagcggcacctaggcctgatgggctaccagctcctgccggtgagtggccctggcctggcccgtggcgcatcctcactcccagcctgcgggtaacctgccgccctctcctctccccacagctacccttcgaggaactggagtcccagagaggcctgccccagctcaagagctacctgaggcagaagctccaggccctgggcctgcgctgggggcctgaagggggctgaggggatgatgtggggttcaggatggcccccccatggggggtggatgatttgcactttggttccctgtgttttgatttctcattaaagttcctttccttccc

SEQ ID NO: 314605 - DNA, 1669 bp, Homo sapiens
tccctggctcgcagtgcctgccgggagccacgtctccgaagaccgatagctgcttcgggattggcgtccgggcggctatctaggggctgctgggaagatggcggactcggtggctagccgatgaggaggccgcggggggaacccggcccccgggccccgagaccgactgagggagcgacctgcgcagggcccggggagtcatggtctccatcacccaactccatgcttcgagtcctgctctctgctcagacctcccctgctcggctgtctggcctgctgctgatccctccagtacagccctgctgtttggggcccagcaaatggggggaccggcctgttggaggaggccccagtgcaggtcctgtgcaaggactgcagcggcttctggaacaggcgaagagccctggggagctgctgcgctggctgggccagaaccccagcaaggtgcgcgcccaccactactcggtggcgcttcgtcgtctgggccagctcttggggtctcggccacggccccctcctgtggagcaggtcacactgcaggacttgagtcagctcatcatccgaaactgcccctcctttgacattcacaccatccacgtgtgtctgcaccttgcagtcttacttggctttccatctgatggtcccctggtgtgtgccctggaacaggagcgaaggctccgcctccctccgaagccacctccccctttgcagccccttctccgaggtgggcaagggttggaagctgctctaagctgcccccgttttctgcggtatccacggcagcatctgatcagcagcctggcagaggcaaggccagaggaactgactccccacgtgatggtgctcctggcccagcacctggcccggcaccggttgcgggagccccagcttctggaagccattgcccacttcctggtggttcaggaaacgcaactcagcagcaaggtggtacagaagttggtcctgccctttgggcgactgaactacctgcccctggaacagcagtttatgccctgccttgagaggatcctggctcgggaagcaggggtggcacccctggctacagtcaacatcttgatgtcactgtgccaactgcggtgcctgcccttcagagccctgcactttgttttttcccctggcttcatcaactacatcagtggcacccctcatgctctgattgtgcgtcgctacctctccctgctggacacggccgtggagctggagctcccaggataccggggtccccgccttccccgaaggcagcaagtgcccatctttccccagcctctcatcaccgaccgtgcccgctgcaagtacagtcacaaggacatagtagctgaggggttgcgccagctgctgggggaggagaaataccgccaggacctgactgtgcctccaggctactgcacagacttcctgctgtgcgccagcagctctggtgctgtgcttcccgtgaggacccaggaccccttcctgccatacccaccaaggtcctgccccagctcaagagctacctgaggcagaagctccaggccctgggcctgcgctgggggcctgaagggggctgaggggatgatgtggggttcaggatggcccccccatggggggtggatgatttgcactttggttccctgtgttttgatttctcattaaagttcctttccttccc

SEQ ID NO: 314606 - DNA, 2119 bp, Homo sapiens
tccctggctcgcagtgcctgccgggagccacgtctccgaagaccgatagctgcttcgggattggcgtccgggcggctatctaggggctgctgggaagatggcggactcggtggctagccgatgaggaggccgcggggggaacccggcccccgggccccgagaccgactgagggagcgacctgcgcagggcccggggagtcatgtaggggtggcgcctgcggggagggctgcgggagggcagcgggagctggtgttagcggcagcggccacggtctcctggcgtccctgggccggggtgggtgttggggcccccgacttcgccgactccgcgccatcgcaaagcggtgcactcgggctccacgcgcgccctgcgaggtgggcgctgcgttttcatttcacgggtgaggagacttagagagacgaagccacttgtccaaggtcacgccgctgggtctccatcacccaactccatgcttcgagtcctgctctctgctcagacctcccctgctcggctgtctggcctgctgctgatccctccagtacagccctgctgtttggggcccagcaaatggggggaccggcctgttggaggaggccccagtgcaggtcctgtgcaaggactgcagcggcttctggaacaggcgaagagccctggggagctgctgcgctggctgggccagaaccccagcaaggtgcgcgcccaccactactcggtggcgcttcgtcgtctgggccagctcttggggtctcggccacggccccctcctgtggagcaggtcacactgcaggacttgagtcagctcatcatccgaaactgcccctcctttgacattcacaccatccacgtgtgtctgcaccttgcagtcttacttggctttccatctgatggtcccctggtgtgtgccctggaacaggagcgaaggctccgcctccctccgaagccacctccccctttgcagccccttctccgaggtgggcaagggttggaagctgctctaagctgcccccgttttctgcggtatccacggcagcatctgatcagcagcctggcagaggcaaggccagaggaactgactccccacgtgatggtgctcctggcccagcacctggcccggcaccggttgcgggagccccagcttctggaagccattgcccacttcctggtggttcaggaaacgcaactcagcagcaaggtggtacagaagttggtcctgccctttgggcgactgaactacctgcccctggaacagcagtttatgccctgccttgagaggatcctggctcgggaagcaggggtggcacccctggctacagtcaacatcttgatgtcactgtgccaactgcggtgcctgcccttcagagccctgcactttgttttttcccctggcttcatcaactacatcagtggcacccctcatgctctgattgtgcgtcgctacctctccctgctggacacggccgtggagctggagctcccaggataccggggtccccgccttccccgaaggcagcaagtgcccatctttccccagcctctcatcaccgaccgtgcccgctgcaagtacagtcacaaggacatagtagctgaggggttgcgccagctgctgggggaggagaaataccgccaggacctgactgtgcctccaggctactgcacagacttcctgctgtgcgccagcagctctggtgctgtgcttcccgtgaggacccaggaccccttcctgccatacccaccaaggtcctgcccacagggccaggctgcctctagcgccactactcgagaccctgcccagagggtggtgctggtgttgcgggaacgctggcatttctgccgggacggccgggtgctgctgggctcgagggccctgagggagcggcacctaggcctgatgggctaccagctcctgccgctacccttcgaggaactggagtcccagagaggcctgccccagctcaagagctacctgaggcagaagctccaggccctgggcctgcgctgggggcctgaagggggctgaggggatgatgtggggttcaggatggcccccccatggggggtggatgatttgcactttggttccctgtgttttgatttctcattaaagttcctttccttccc

SEQ ID NO: 314607 - DNA, 1790 bp, Homo sapiens
tccctggctcgcagtgcctgccgggagccacgtctccgaagaccgatagctgcttcgggattggcgtccgggcggctatctaggggctgctgggaagatggcggactcggtggctagccgatgaggaggccgcggggggaacccggcccccgggccccgagaccgactgagggagcgacctgcgcagggcccggggagtcatggtctccatcacccaactccatgcttcgagtcctgctctctgctcagacctcccctgctcggctgtctggcctgctgctgatccctccagtacagccctgctgtttggggcccagcaaatggggggaccggcctgttggaggaggccccagtgcaggtcctgtgcaaggactgcagcggcttctggaacaggcgaagagccctggggagctgctgcgctggctgggccagaaccccagcaaggtgcgcgcccaccactactcggtggcgcttcgtcgtctgggccagctcttggggtctcggccacggccccctcctgtggagcaggtcacactgcaggacttgagtcagctcatcatccgaaactgcccctcctttgacattcacaccatccacgtgtgtctgcaccttgcagtcttacttggctttccatctgatggtcccctggtgtgtgccctggaacaggagcgaaggctccgcctccctccgaagccacctccccctttgcagccccttctccgagaggcaaggccagaggaactgactccccacgtgatggtgctcctggcccagcacctggcccggcaccggttgcgggagccccagcttctggaagccattgcccacttcctggtggttcaggaaacgcaactcagcagcaaggtggtacagaagttggtcctgccctttgggcgactgaactacctgcccctggaacagcagtttatgccctgccttgagaggatcctggctcgggaagcaggggtggcacccctggctacagtcaacatcttgatgtcactgtgccaactgcggtgcctgcccttcagagccctgcactttgttttttcccctggcttcatcaactacatcagtggcacccctcatgctctgattgtgcgtcgctacctctccctgctggacacggccgtggagctggagctcccaggataccggggtccccgccttccccgaaggcagcaagtgcccatctttccccagcctctcatcaccgaccgtgcccgctgcaagtacagtcacaaggacatagtagctgaggggttgcgccagctgctgggggaggagaaataccgccaggacctgactgtgcctccaggctactgcacagacttcctgctgtgcgccagcagctctggtgctgtgcttcccgtgaggacccaggaccccttcctgccatacccaccaaggtcctgcccacagggccaggctgcctctagcgccactactcgagaccctgcccagagggtggtgctggtgttgcgggaacgctggcatttctgccgggacggccgggtgctgctgggctcgagggccctgagggagcggcacctaggcctgatgggctaccagctcctgccgctacccttcgaggaactggagtcccagagaggcctgccccagctcaagagctacctgaggcagaagctccaggccctgggcctgcgctgggggcctgaagggggctgaggggatgatgtggggttcaggatggcccccccatggggggtggatgatttgcactttggttccctgtgttttgatttctcattaaagttcctttccttccc

SEQ ID NO: 314608 - DNA, 2597 bp, Homo sapiens
tccctggctcgcagtgcctgccgggagccacgtctccgaagaccgatagctgcttcgggattggcgtccgggcggctatctaggggctgctgggaagatggcggactcggtggctagccgatgaggaggccgcggggggaacccggcccccgggccccgagaccgactgagggagcgacctgcgcagggcccggggagtcatgtaggggtggcgcctgcggggagggctgcgggagggcagcgggagctggtgttagcggcagcggccacggtctcctggcgtccctgggccggggtgggtgttggggcccccgacttcgccgactccgcgccatcgcaaagcggtgcactcgggctccacgcgcgccctgcgaggtgggcgctgcgttttcatttcacgggtgaggagacttagagagacgaagccacttgtccaaggtcacgccgctgggtctccatcacccaactccatgcttcgagtcctgctctctgctcagacctcccctgctcggctgtctggcctgctgctgatccctccagtacagccctgctgtttggggcccagcaaatggggggaccggcctgttggaggaggccccagtgcaggtcctgtgcaaggactgcagcggcttctggaacaggcgaagagccctggggagctgctgcgctggctgggccagaaccccagcaaggtgcgcgcccaccactactcggtggcgcttcgtcgtctgggccagctcttggggtctcggccacggccccctcctgtggagcaggtcacactgcaggacttgagtcagctcatcatccgaaactgcccctcctttgacattcacaccatccacgtgtgtctgcaccttgcagtcttacttggtgaggaggggcttgaggtgggcgcctggggggctaggtgttaatgaagaatagggagaacagtagaggaccacggacagagacccagcctctcaggcgtttgcccaggaacgcttgctcctgctcccgtcctatgtctgcggcagacatcatgagtcgaacgcactccttccggcctcgctagggtgccaccccagattcctgctaatagagtgccctaggaagccaccataatttgtcacaattggtatgagatgaaagcctatttgccatctttgtatgtactccctacaaaccgtttcgatacctcatagccacatgatactttacatgtctctagtgtttgcacttaaactctagcacaccttcccgctcaggaaacgggagaggagaaaggtggagaattcaccaagtaaccccatgataagaacagcagcacagctctgttaccaggctgccttttacctctccccctcaggctttccatctgatggtcccctggtgtgtgccctggaacaggagcgaaggctccgcctccctccgaagccacctccccctttgcagccccttctccgaggtgggcaagggttggaagctgctctaagctgcccccgttttctgcggtatccacggcagcatctgatcagcagcctggcagaggcaaggccagaggaactgactccccacgtgatggtgctcctggcccagcacctggcccggcaccggttgcgggagccccagcttctggaagccattgcccacttcctggtggttcaggaaacgcaactcagcagcaaggtggtacagaagttggtcctgccctttgggcgactgaactacctgcccctggaacagcagtttatgccctgccttgagaggatcctggctcgggaagcaggggtggcacccctggctacagtcaacatcttgatgtcactgtgccaactgcggtgcctgcccttcagagccctgcactttgttttttcccctggcttcatcaactacatcagtggcacccctcatgctctgattgtgcgtcgctacctctccctgctggacacggccgtggagctggagctcccaggataccggggtccccgccttccccgaaggcagcaagtgcccatctttccccagcctctcatcaccgaccgtgcccgctgcaagtacagtcacaaggacatagtagctgaggggttgcgccagctgctgggggaggagaaataccgccaggacctgactgtgcctccaggctactgcacagacttcctgctgtgcgccagcagctctggtgctgtgcttcccgtgaggacccaggaccccttcctgccatacccaccaaggtcctgcccacagggccaggctgcctctagcgccactactcgagaccctgcccagagggtggtgctggtgttgcgggaacgctggcatttctgccgggacggccgggtgctgctgggctcgagggccctgagggagcggcacctaggcctgatgggctaccagctcctgccgctacccttcgaggaactggagtcccagagaggcctgccccagctcaagagctacctgaggcagaagctccaggccctgggcctgcgctgggggcctgaagggggctgaggggatgatgtggggttcaggatggcccccccatggggggtggatgatttgcactttggttccctgtgttttgatttctcattaaagttcctttccttccc

SEQ ID NO: 314609 - DNA, 1882 bp, Homo sapiens
tccctggctcgcagtgcctgccgggagccacgtctccgaagaccgatagctgcttcgggattggcgtccgggcggctatctaggggctgctgggaagatggcggactcggtggctagccgatgaggaggccgcggggggaacccggcccccgggccccgagaccgactgagggagcgacctgcgcagggcccggggagtcatggtctccatcacccaactccatgcttcgagtcctgctctctgctcagacctcccctgctcggctgtctggcctgctgctgatccctccagtacagccctgctgtttggggcccagcaaatggggggaccggcctgttggaggaggccccagtgcaggtcctgtgcaaggactgcagcggcttctggaacaggcgaagagccctggggagctgctgcgctggctgggccagaaccccagcaaggtgcgcgcccaccactactcggtggcgcttcgtcgtctgggccagctcttggggtctcggccacggccccctcctgtggagcaggtcacactgcaggacttgagtcagctcatcatccgaaactgcccctcctttgtagattttcaccaatactaccatggttttttctgctatgcttgctgtcttgacttggctttccatctgatggtcccctggtgtgtgccctggaacaggagcgaaggctccgcctccctccgaagccacctccccctttgcagccccttctccgaggtgggcaagggttggaagctgctctaagctgcccccgttttctgcggtatccacggcagcatctgatcagcagcctggcagaggcaaggccagaggaactgactccccacgtgatggtgctcctggcccagcacctggcccggcaccggttgcgggagccccagcttctggaagccattgcccacttcctggtggttcaggaaacgcaactcagcagcaaggtggtacagaagttggtcctgccctttgggcgactgaactacctgcccctggaacagcagtttatgccctgccttgagaggatcctggctcgggaagcaggggtggcacccctggctacagtcaacatcttgatgtcactgtgccaactgcggtgcctgcccttcagagccctgcactttgttttttcccctggcttcatcaactacatcagtggcacccctcatgctctgattgtgcgtcgctacctctccctgctggacacggccgtggagctggagctcccaggataccggggtccccgccttccccgaaggcagcaagtgcccatctttccccagcctctcatcaccgaccgtgcccgctgcaagtacagtcacaaggacatagtagctgaggggttgcgccagctgctgggggaggagaaataccgccaggacctgactgtgcctccaggctactgcacagacttcctgctgtgcgccagcagctctggtgctgtgcttcccgtgaggacccaggaccccttcctgccatacccaccaaggtcctgcccacagggccaggctgcctctagcgccactactcgagaccctgcccagagggtggtgctggtgttgcgggaacgctggcatttctgccgggacggccgggtgctgctgggctcgagggccctgagggagcggcacctaggcctgatgggctaccagctcctgccgctacccttcgaggaactggagtcccagagaggcctgccccagctcaagagctacctgaggcagaagctccaggccctgggcctgcgctgggggcctgaagggggctgaggggatgatgtggggttcaggatggcccccccatggggggtggatgatttgcactttggttccctgtgttttgatttctcattaaagttcctttccttccc

SEQ ID NO: 314610 - DNA, 1599 bp, Homo sapiens
tccctggctcgcagtgcctgccgggagccacgtctccgaagaccgatagctgcttcgggattggcgtccgggcggctatctaggggctgctgggaagatggcggactcggtggctagccgatgaggaggccgcggggggaacccggcccccgggccccgagaccgactgagggagcgacctgcgcagggcccggggagtcatgcgaagagccctggggagctgctgcgctggctgggccagaaccccagcaaggtgcgcgcccaccactactcggtggcgcttcgtcgtctgggccagctcttggggtctcggccacggccccctcctgtggagcaggtcacactgcaggacttgagtcagctcatcatccgaaactgcccctcctttgacattcacaccatccacgtgtgtctgcaccttgcagtcttacttggctttccatctgatggtcccctggtgtgtgccctggaacaggagcgaaggctccgcctccctccgaagccacctccccctttgcagccccttctccgagaggcaaggccagaggaactgactccccacgtgatggtgctcctggcccagcacctggcccggcaccggttgcgggagccccagcttctggaagccattgcccacttcctggtggttcaggaaacgcaactcagcagcaaggtggtacagaagttggtcctgccctttgggcgactgaactacctgcccctggaacagcagtttatgccctgccttgagaggatcctggctcgggaagcaggggtggcacccctggctacagtcaacatcttgatgtcactgtgccaactgcggtgcctgcccttcagagccctgcactttgttttttcccctggcttcatcaactacatcagtggcacccctcatgctctgattgtgcgtcgctacctctccctgctggacacggccgtggagctggagctcccaggataccggggtccccgccttccccgaaggcagcaagtgcccatctttccccagcctctcatcaccgaccgtgcccgctgcaagtacagtcacaaggacatagtagctgaggggttgcgccagctgctgggggaggagaaataccgccaggacctgactgtgcctccaggctactgcacagacttcctgctgtgcgccagcagctctggtgctgtgcttcccgtgaggacccaggaccccttcctgccatacccaccaaggtcctgcccacagggccaggctgcctctagcgccactactcgagaccctgcccagagggtggtgctggtgttgcgggaacgctggcatttctgccgggacggccgggtgctgctgggctcgagggccctgagggagcggcacctaggcctgatgggctaccagctcctgccgctacccttcgaggaactggagtcccagagaggcctgccccagctcaagagctacctgaggcagaagctccaggccctgggcctgcgctgggggcctgaagggggctgaggggatgatgtggggttcaggatggcccccccatggggggtggatgatttgcactttggttccctgtgttttgatttctcattaaagttcctttccttccc

SEQ ID NO: 314611 - DNA, 1851 bp, Homo sapiens
  misc_feature (1494)..(1494): n is a, c, g, or t
tccctggctcgcagtgcctgccgggagccacgtctccgaagaccgatagctgcttcgggattggcgtccgggcggctatctaggggctgctgggaagatggcggactcggtggctagccgatgaggaggccgcggggggaacccggcccccgggccccgagaccgactgagggagcgacctgcgcagggcccggggagtcatggtctccatcacccaactccatgcttcgagtcctgctctctgctcagacctcccctgctcggctgtctggcctgctgctgatccctccagtacagccctgctgtttggggcccagcaaatggggggaccggcctgttggaggaggccccagtgcaggtcctgtgcaaggactgcagcggcttctggaacaggcgaagagccctggggagctgctgcgctggctgggccagaaccccagcaaggtgcgcgcccaccactactcggtggcgcttcgtcgtctgggccagctcttggggtctcggccacggccccctcctgtggagcaggtcacactgcaggacttgagtcagctcatcatccgaaactgcccctcctttgacattcacaccatccacgtgtgtctgcaccttgcagtcttacttggctttccatctgatggtcccctggtgtgtgccctggaacaggagcgaaggctccgcctccctccgaagccacctccccctttgcagccccttctccgaggtgggcaagggttggaagctgctctaagctgcccccgttttctgcggtatccacggcagcatctgatcagcagcctggcagaggcaaggccagaggaactgactccccacgtgatggtgctcctggcccagcacctggcccggcaccggttgcgggagccccagcccagcctctcatcaccgaccgtgcccgctgcaagtacagtcacaaggacatagtagctgaggggttgcgccagctgctgggggaggagaaataccgccaggacctgactgtgcctccaggctactgcacagacttcctgctgtgcgccagcagctctggtgctgtgcttcccgtgaggacccaggaccccttcctgccatacccaccaaggtcctgcccacagggccaggctgcctctagcgccactactcgagaccctgcccagagggtggtgctggtgttgcgggaacgctggcatttctgccgggacggccgggtgctgctgggctcgagggccctgagggagcggcacctaggcctgatgggctaccagctcctgccgctacccttcgaggaactggagtcccagagaggcctgccccagctcaagagctacctgaggcagaagctccaggccctgggcctgcgctgggggcctgaagggggctgaggggatgatgtggggttcaggatggcccccccatggggggtggatgatttgcactttggttccctgtgttttgatttctcattaaagttcctttccttcccaaaaaaaaaaaaanaaaaaaaaaaaaaaaaaaaggggggggagacaaaaaagattatctcccgagagggggcccaaagttaacggggatacccacagtttttgtgtggacaagggggccccaaaaggagggacccagtattataaacgcaaaaggaacagtgggccacggcagtattaaaacaagacgtccagaagaggtggggaaaaactgtttgtaaacgataggggaaaaatcatgtgagataaagaggagaggacataaatttcggggggggtacaaccaattttggggacaaaaatatacttataagaaagtatttaaagcgtctaaagggaaaaatattaaaattttaaagggtataaaactggg

SEQ ID NO: 314612 - DNA, 1551 bp, Homo sapiens
tccctggctcgcagtgcctgccgggagccacgtctccgaagaccgatagctgcttcgggattggcgtccgggcggctatctaggggctgctgggaagatggcggactcggtggctagccgatgaggaggccgcggggggaacccggcccccgggccccgagaccgactgagggagcgacctgcgcagggcccggggagtcatggtctccatcacccaactccatgcttcgagtcctgctctctgctcagacctcccctgctcggctgtctggcctgctgctgatccctccagtacagccctgctgtttggggcccagcaaatggggggaccggcctgttggaggaggccccagtgcaggtcctgtgcaaggactgcagcggcttctggaacaggcgaagagccctggggagctgctgcgctggctgggccagaaccccagcaaggtgcgcgcccaccactactcggtggcgcttcgtcgtctgggccagctcttggggtctcggccacggccccctcctgtggagcaggtcacactgcaggacttgagtcagctcatcatccgaaactgcccctcctttgacattcacaccatccacgtgtgtctgcaccttgcagtcttacttggtggtacagaagttggtcctgccctttgggcgactgaactacctgcccctggaacagcagtttatgccctgccttgagaggatcctggctcgggaagcaggggtggcacccctggctacagtcaacatcttgatgtcactgtgccaactgcggtgcctgcccttcagagccctgcactttgttttttcccctggcttcatcaactacatcagtggcacccctcatgctctgattgtgcgtcgctacctctccctgctggacacggccgtggagctggagctcccaggataccggggtccccgccttccccgaaggcagcaagtgcccatctttccccagcctctcatcaccgaccgtgcccgctgcaagtacagtcacaaggacatagtagctgaggggttgcgccagctgctgggggaggagaaataccgccaggacctgactgtgcctccaggctactgcacagacttcctgctgtgcgccagcagctctggtgctgtgcttcccgtgaggacccaggaccccttcctgccatacccaccaaggtcctgcccacagggccaggctgcctctagcgccactactcgagaccctgcccagagggtggtgctggtgttgcgggaacgctggcatttctgccgggacggccgggtgctgctgggctcgagggccctgagggagcggcacctaggcctgatgggctaccagctcctgccgctacccttcgaggaactggagtcccagagaggcctgccccagctcaagagctacctgaggcagaagctccaggccctgggcctgcgctgggggcctgaagggggctgaggggatgatgtggggttcaggatggcccccccatggggggtggatgatttgcactttggttccctgtgttttgatttctcattaaagttcctttccttccc

SEQ ID NO: 314613 - DNA, 2614 bp, Homo sapiens
tccctggctcgcagtgcctgccgggagccacgtctccgaagaccgatagctgcttcgggattggcgtccgggcggctatctaggggctgctgggaagatggcggactcggtggctagccgatgaggaggccgcggggggaacccggcccccgggccccgagaccgactgagggagcgacctgcgcagggcccggggagtcatgtaggggtggcgcctgcggggagggctgcgggagggcagcgggagctggtgttagcggcagcggccacggtctcctggcgtccctgggccggggtgggtgttggggcccccgacttcgccgactccgcgccatcgcaaagcggtgcactcgggctccacgcgcgccctgcgaggtgggcgctgcgttttcatttcacgggtgaggagacttagagagacgaagccacttgtccaaggtcacgccgctgggtctccatcacccaactccatgcttcgagtcctgctctctgctcagacctcccctgctcggctgtctggcctgctgctgatccctccagtacagccctgctgtttggggcccagcaaatggggggaccggcctgttggaggaggccccagtgcaggtcctgtgcaaggactgcagcggcttctggaacaggcgaagagccctggggagctgctgcgctggctgggccagaaccccagcaaggtgcgcgcccaccactactcggtggcgcttcgtcgtctgggccagctcttggggtctcggccacggccccctcctgtggagcaggtcacactgcaggacttgagtcagctcatcatccgaaactgcccctcctttgacattcacaccatccacgtgtgtctgcaccttgcagtcttacttggtgaggaggggcttgaggtgggcgcctggggggctaggtgttaatgaagaatagggagaacagtagaggaccacggacagagacccagcctctcaggcgtttgcccaggaacgcttgctcctgctcccgtcctatgtctgcggcagacatcatgagtcgaacgcactccttccggcctcgctagggtgccaccccagattcctgctaatagagtgccctaggaagccaccataatttgtcacaattggtatgagatgaaagcctatttgccatctttgtatgtactccctacaaaccgtttcgatacctcatagccacatgatactttacatgtctctagtgtttgcacttaaactctagcacaccttcccgctcaggaaacgggagaggagaaaggtggagaattcaccaagtaaccccatgataagaacagcagcacagctctgttaccaggctgccttttacctctccccctcaggctttccatctgatggtcccctggtgtgtgccctggaacaggagcgaaggctccgcctccctccgaagccacctccccctttgcagccccttctccgagaggcaaggccagaggaactgactccccacgtgatggtgctcctggcccagcacctggcccggcaccggttgcgggagccccagcttctggaagccattgcccacttcctggtggttcaggaaacgcaactcagcagcaaggtggtacagaagttggtcctgccctttgggcgactgaactacctgcccctggaacagcagtttatgccctgccttgagaggatcctggctcgggaagcaggggtggcacccctggctacagtcaacatcttgatgtcactgtgccaactgcggtgcctgcccttcagagccctgcactttgttttttcccctggcttcatcaactacatcagtggtacgcagccaggatggctggctgggcccctgagggctggagaggcaggggagcagggtggcctgcagcccagagccccagtccccgcctccccacaggcacccctcatgctctgattgtgcgtcgctacctctccctgctggacacggccgtggagctggagctcccaggataccggggtccccgccttccccgaaggcagcaagtgcccatctttccccagcctctcatcaccgaccgtgcccgctgcaagtacagtcacaaggacatagtagctgaggggttgcgccagctgctgggggaggagaaataccgccaggacctgactgtgcctccaggctactgcacagacttcctgctgtgcgccagcagctctggtgctgtgcttcccgtgaggacccaggaccccttcctgccatacccaccaaggtcctgcccacagggccaggctgcctctagcgccactactcgagaccctgcccagagggtggtgctggtgttgcgggaacgctggcatttctgccgggacggccgggtgctgctgggctcgagggccctgagggagcggcacctaggcctgatgggctaccagctcctgccgctacccttcgaggaactggagtcccagagaggcctgccccagctcaagagctacctgaggcagaagctccaggccctgggcctgcgctgggggcctgaagggggctgaggggatgatgtggggttcaggatggcccccccatggggggtggatgatttgcactttggttccctgtgttttgatttctcattaaagttcctttccttccc

SEQ ID NO: 314614 - DNA, 1465 bp, Homo sapiens
tccctggctcgcagtgcctgccgggagccacgtctccgaagaccgatagctgcttcgggattggcgtccgggcggctatctaggggctgctgggaagatggcggactcggtggctagccgatgaggaggccgcggggggaacccggcccccgggccccgagaccgactgagggagcgacctgcgcagggcccggggagtcatgctttccatctgatggtcccctggtgtgtgccctggaacaggagcgaaggctccgcctccctccgaagccacctccccctttgcagccccttctccgagaggcaaggccagaggaactgactccccacgtgatggtgctcctggcccagcacctggcccggcaccggttgcgggagccccagcttctggaagccattgcccacttcctggtggttcaggaaacgcaactcagcagcaaggtggtacagaagttggtcctgccctttgggcgactgaactacctgcccctggaacagcagtttatgccctgccttgagaggatcctggctcgggaagcaggggtggcacccctggctacagtcaacatcttgatgtcactgtgccaactgcggtgcctgcccttcagagccctgcactttgttttttcccctggcttcatcaactacatcagtggtacgcagccaggatggctggctgggcccctgagggctggagaggcaggggagcagggtggcctgcagcccagagccccagtccccgcctccccacaggcacccctcatgctctgattgtgcgtcgctacctctccctgctggacacggccgtggagctggagctcccaggataccggggtccccgccttccccgaaggcagcaagtgcccatctttccccagcctctcatcaccgaccgtgcccgctgcaagtacagtcacaaggacatagtagctgaggggttgcgccagctgctgggggaggagaaataccgccaggacctgactgtgcctccaggctactgcacagacttcctgctgtgcgccagcagctctggtgctgtgcttcccgtgaggacccaggaccccttcctgccatacccaccaaggtcctgcccacagggccaggctgcctctagcgccactactcgagaccctgcccagagggtggtgctggtgttgcgggaacgctggcatttctgccgggacggccgggtgctgctgggctcgagggccctgagggagcggcacctaggcctgatgggctaccagctcctgccgctacccttcgaggaactggagtcccagagaggcctgccccagctcaagagctacctgaggcagaagctccaggccctgggcctgcgctgggggcctgaagggggctgaggggatgatgtggggttcaggatggcccccccatggggggtggatgatttgcactttggttccctgtgttttgatttctcattaaagttcctttccttccc

SEQ ID NO: 314615 - DNA, 2601 bp, Homo sapiens
tccctggctcgcagtgcctgccgggagccacgtctccgaagaccgatagctgcttcgggattggcgtccgggcggctatctaggggctgctgggaagatggcggactcggtggctagccgatgaggaggccgcggggggaacccggcccccgggccccgagaccgactgagggagcgacctgcgcagggcccggggagtcatgtaggggtggcgcctgcggggagggctgcgggagggcagcgggagctggtgttagcggcagcggccacggtctcctggcgtccctgggccggggtgggtgttggggcccccgacttcgccgactccgcgccatcgcaaagcggtgcactcgggctccacgcgcgccctgcgaggtgggcgctgcgttttcatttcacgggtgaggagacttagagagacgaagccacttgtccaaggtcacgccgctggtgagtgggagcgcccagcatggaacccagcaccgtccagccgcggagcccgcgttccaccctctgtgccgccgccgcctcctgtgggagagggaggtggtcgggagagtgcacgccggtgccgcctgggctccagactgggcgcgaccactaacccggttaatgacctcgggcttaacttaaccccttcgctgctctgggcctgcgtttctccaccggtgaaatgagggtctccatcacccaactccatgcttcgagtcctgctctctgctcagacctcccctgctcggctgtctggcctgctgctgatccctccagtacagccctgctgtttggggcccagcaaatggggggaccggcctgttggaggaggccccagtgcaggtcctgtgcaaggactgcagcggcttctggaacaggcgaagagccctggggagctgctgcgctggctgggccagaaccccagcaaggtgcgcgcccaccactactcggtggcgcttcgtcgtctgggccagctcttggggtctcggccacggccccctcctgtggagcaggtcacactgcaggacttgagtcagctcatcatccgaaactgcccctcctttgacattcacaccatccacgtgtgtctgcaccttgcagtcttacttggtggtacagaagttggtcctgccctttgggcgactgaactacctgcccctggaacagcagtttatgccctgccttgagaggatcctggctcgggaagcaggggtggcacccctggctacagtcaacatcttgatgtcactgtgccaactgcggtgcctgcccttcagagccctgcactttgttttttcccctggcttcatcaactacatcagtggtacgcagccaggatggctggctgggcccctgagggctggagaggcaggggagcagggtggcctgcagcccagagccccagtccccgcctccccacaggcacccctcatgctctgattgtgcgtcgctacctctccctgctggacacggccgtggagctggagctcccaggataccggggtccccgccttccccgaaggcagcaagtgcccatctttccccagcctctcatcaccgaccgtgcccgctgcaagtacaggtggatggggcagcctggggcaaggggaggggccagcctgggaccagcagagtggaaaagccagagggaccatgaagcgccaaagctaaggagctctcggccaccataaaactgggccctgaagcagcagagggctttgcccagggtggtggcactagactgggacagattaggatgaggtgccgggcccttcctgctactggtgtcctttctcctcagtcacaaggacatagtagctgaggggttgcgccagctgctgggggaggagaaataccgccaggacctgactgtgcctccaggctactgcacaggtgagcaaggggcaggcggcaggcccggggagacggagccctggctaaggccgccggccctgctcccctccagacttcctgctgtgcgccagcagctctggtgctgtgcttcccgtgaggacccaggaccccttcctgccatacccaccaaggtcctgcccacagggccaggctgcctctagcgccactactcgagaccctgcccagaggtaaaggaggcagggtgggggagccctggccaccttgcccgccatgccctgagccacgtccctccccctgcagggtggtgctggtgttgcgggaacgctggcatttctgccgggacggccgggtgctgctgggctcgagggccctgagggagcggcacctaggcctgatgggctaccagctcctgccggtgagtggccctggcctggcccgtggcgcatcctcactcccagcctgcgggtaacctgccgccctctcctctccccacagctacccttcgaggaactggagtcccagagaggcctgccccagctcaagagctacctgaggcagaagctccaggccctgggcctgcgctgggggcctgaagggggctgaggggatgatgtggggttcaggatggcccccccatggggggtggatgatttgcactttggttccctgtgttttgatttctcattaaagttcctttccttccccgttgtgaatctcagttttgggacggggagc

SEQ ID NO: 314616 - DNA, 308 bp, Homo sapiens
caggaaacgggagaggagaaaggtggagaattcaccaagtaaccccatgataagaacagcagcacagctctgttaccaggctgccttttacctctccccctcaggctttccatctgatggtcccctggtgtgtgccctggaacaggagcgaaggctccgcctccctccgaagccacctccccctttgcagccccttctccgaggtgggcaagggttggaagctgctctaagctgcccccgttttctgcggtatccacggcagcatctgatcagcagcctggcaggtgctggagggggttaaaatcaga

SEQ ID NO: 314617 - DNA, 1969 bp, Homo sapiens
tccctggctcgcagtgcctgccgggagccacgtctccgaagaccgatagctgcttcgggattggcgtccgggcggctatctaggggctgctgggaagatggcggactcggtggctagccgatgaggaggccgcggggggaacccggcccccgggccccgagaccgactgagggagcgacctgcgcagggcccggggagtcatggtctccatcacccaactccatgcttcgagtcctgctctctgctcagacctcccctgctcggctgtctggcctgctgctgatccctccagtacagccctgctgtttggggcccagcaaatggggggaccggcctgttggaggaggccccagtgcaggtcctgtgcaaggactgcagcggcttctggaacaggcgaagagccctggggagctgctgcgctggctgggccagaaccccagcaaggtgcgcgcccaccactactcggtggcgcttcgtcgtctgggccagctcttggggtctcggccacggccccctcctgtggagcaggtcacactgcaggacttgagtcagctcatcatccgaaactgcccctcctttgacattcacaccatccacgtgtgtctgcaccttgcagtcttacttggctttccatctgatggtcccctggtgtgtgccctggaacaggagcgaaggctccgcctccctccgaagccacctccccctttgcagccccttctccgaggtgggcaagggttggaagctgctctaagctgcccccgttttctgcggtatccacggcagcatctgatcagcagcctggcagaggcaaggccagaggaactgactccccacgtgatggtgctcctggcccagcacctggcccggcaccggttgcgggagccccagcttctggaagccattgcccacttcctggtggttcaggaaacgcaactcagcagcaaggtggtacagaagttggtcctgccctttgggcgactgaactacctgcccctggaacagcagtttatgccctgccttgagaggatcctggctcgggaagcaggggtggcacccctggctacagtcaacatcttgatgtcactgtgccaactgcggtgcctgcccttcagagccctgcactttgttttttcccctggcttcatcaactacatcagtggtacgcagccaggatggctggctgggcccctgagggctggagaggcaggggagcagggtggcctgcagcccagagccccagtccccgcctccccacaggcacccctcatgctctgattgtgcgtcgctacctctccctgctggacacggccgtggagctggagctcccaggataccggggtccccgccttccccgaaggcagcaagtgcccatctttccccagcctctcatcaccgaccgtgcccgctgcaagtacagtcacaaggacatagtagctgaggggttgcgccagctgctgggggaggagaaataccgccaggacctgactgtgcctccaggctactgcacagacttcctgctgtgcgccagcagctctggtgctgtgcttcccgtgaggacccaggaccccttcctgccatacccaccaaggtcctgcccacagggccaggctgcctctagcgccactactcgagaccctgcccagagggtggtgctggtgttgcgggaacgctggcatttctgccgggacggccgggtgctgctgggctcgagggccctgagggagcggcacctaggcctgatgggctaccagctcctgccgctacccttcgaggaactggagtcccagagaggcctgccccagctcaagagctacctgaggcagaagctccaggccctgggcctgcgctgggggcctgaagggggctgaggggatgatgtggggttcaggatggcccccccatggggggtggatgatttgcactttggttccctgtgttttgatttctcattaaagttcctttccttccc

SEQ ID NO: 314618 - DNA, 2242 bp, Homo sapiens
  misc_feature (1885)..(1885): n is a, c, g, or t
tccctggctcgcagtgcctgccgggagccacgtctccgaagaccgatagctgcttcgggattggcgtccgggcggctatctaggggctgctgggaagatggcggactcggtggctagccgatgaggaggccgcggggggaacccggcccccgggccccgagaccgactgagggagcgacctgcgcagggcccggggagtcatggtctccatcacccaactccatgcttcgagtcctgctctctgctcagacctcccctgctcggctgtctggcctgctgctgatccctccagtacagccctgctgtttggggcccagcaaatggggggaccggcctgttggaggaggccccagtgcaggtcctgtgcaaggactgcagcggcttctggaacaggcgaagagccctggggagctgctgcgctggctgggccagaaccccagcaaggtgcgcgcccaccactactcggtggcgcttcgtcgtctgggccagctcttggggtctcggccacggccccctcctgtggagcaggtcacactgcaggacttgagtcagctcatcatccgaaactgcccctcctttgacattcacaccatccacgtgtgtctgcaccttgcagtcttacttggctttccatctgatggtcccctggtgtgtgccctggaacaggagcgaaggctccgcctccctccgaagccacctccccctttgcagccccttctccgaggtgggcaagggttggaagctgctctaagctgcccccgttttctgcggtatccacggcagcatctgatcagcagcctggcagaggcaaggccagaggaactgactccccacgtgatggtgctcctggcccagcacctggcccggcaccggttgcgggagccccagcttctggaagccattgcccacttcctggtggttcaggaaacgcaactcagcagcaaggtggtacagaagttggtcctgccctttgggcgactgaactacctgcccctggaacagcagtttatgccctgccttgagaggatcctggctcgggaagcaggggtggcacccctggctacagtcaacatcttgatgtcactgtgccaactgcggtgcctgcccttcagagccctgcactttgttttttcccctggcttcatcaactacatcagtggcacccctcatgctctgattgtgcgtcgctacctctccctgctggacacggccgtggagctggagctcccaggataccggggtccccgccttccccgaaggcagcaagtgcccatctttccccagcctctcatcaccgaccgtgcccgctgcaagtacagtcacaaggacatagtagctgaggggttgcgccagctgctgggggaggagaaataccgccaggacctgactgtgcctccaggctactgcacagacttcctgctgtgcgccagcagctctggtgctgtgcttcccgtgaggacccaggaccccttcctgccatacccaccaaggtcctgcccacagggccaggctgcctctagcgccactactcgagaccctgcccagagggtggtgctggtgttgcgggaacgctggcatttctgccgggacggccgggtgctgctgggctcgagggccctgagggagcggcacctaggcctgatgggctaccagctcctgccgctacccttcgaggaactggagtcccagagaggcctgccccagctcaagagctacctgaggcagaagctccaggccctgggcctgcgctgggggcctgaagggggctgaggggatgatgtggggttcaggatggcccccccatggggggtggatgatttgcactttggttccctgtgttttgatttctcattaaagttcctttccttcccaaaaaaaaaaaaanaaaaaaaaaaaaaaaaaaaggggggggagacaaaaaagattatctcccgagagggggcccaaagttaacggggatacccacagtttttgtgtggacaagggggccccaaaaggagggacccagtattataaacgcaaaaggaacagtgggccacggcagtattaaaacaagacgtccagaagaggtggggaaaaactgtttgtaaacgataggggaaaaatcatgtgagataaagaggagaggacataaatttcggggggggtacaaccaattttggggacaaaaatatacttataagaaagtatttaaagcgtctaaagggaaaaatattaaaattttaaagggtataaaactggg

SEQ ID NO: 314619 - DNA, 1944 bp, Homo sapiens
tccctggctcgcagtgcctgccgggagccacgtctccgaagaccgatagctgcttcgggattggcgtccgggcggctatctaggggctgctgggaagatggcggactcggtggctagccgatgaggaggccgcggggggaacccggcccccgggccccgagaccgactgagggagcgacctgcgcagggcccggggagtcatggtctccatcacccaactccatgcttcgagtcctgctctctgctcagacctcccctgctcggctgtctggcctgctgctgatccctccagtacagccctgctgtttggggcccagcaaatggggggaccggcctgttggaggaggccccagtgcaggtcctgtgcaaggactgcagcggcttctggaacaggcgaagagccctggggagctgctgcgctggctgggccagaaccccagcaaggtgcgcgcccaccactactcggtggcgcttcgtcgtctgggccagctcttggggtctcggccacggccccctcctgtggagcaggtcacactgcaggacttgagtcagctcatcatccgaaactgcccctcctttgacattcacaccatccacgtgtgtctgcaccttgcagtcttacttggctttccatctgatggtcccctggtgtgtgccctggaacaggagcgaaggctccgcctccctccgaagccacctccccctttgcagccccttctccgaggtgggcaagggttggaagctgctctaagctgcccccgttttctgcggtatccacggcagcatctgatcagcagcctggcagaggcaaggccagaggaactgactccccacgtgatggtgctcctggcccagcacctggcccggcaccggttgcgggagccccagcttctggaagccattgcccacttcctggtggttcaggaaacgcaactcagcagcaaggtggtacagaagttggtcctgccctttgggcgactgaactacctgcccctggaacagcagtttatgccctgccttgagaggatcctggctcgggaagcaggggtggcacccctggctacagtcaacatcttgatgtcactgtgccaactgcggtgcctgcccttcagagccctgcactttgttttttcccctggcttcatcaactacatcagtggcacccctcatgctctgattgtgcgtcgctacctctccctgctggacacggccgtggagctggagctcccaggataccggggtccccgccttccccgaaggcagcaagtgcccatctttccccagcctctcatcaccgaccgtgcccgctgcaagtacagtcacaaggacatagtagctgaggggttgcgccagctgctgggggaggagaaataccgccaggacctgactgtgcctccaggctactgcacaggtgagcaaggggcaggcggcaggcccggggagacggagccctggctaaggccgccggccctgctcccctccagacttcctgctgtgcgccagcagctctggtgctgtgcttcccgtgaggacccaggaccccttcctgccatacccaccaaggtcctgcccacagggccaggctgcctctagcgccactactcgagaccctgcccagagggtggtgctggtgttgcgggaacgctggcatttctgccgggacggccgggtgctgctgggctcgagggccctgagggagcggcacctaggcctgatgggctaccagctcctgccgctacccttcgaggaactggagtcccagagaggcctgccccagctcaagagctacctgaggcagaagctccaggccctgggcctgcgctgggggcctgaagggggctgaggggatgatgtggggttcaggatggcccccccatggggggtggatgatttgcactttggttccctgtgttttgatttctcattaaagttcctttccttccc

SEQ ID NO: 314620 - DNA, 1951 bp, Homo sapiens
tccctggctcgcagtgcctgccgggagccacgtctccgaagaccgatagctgcttcgggattggcgtccgggcggctatctaggggctgctgggaagatggcggactcggtggctagccgatgaggaggccgcggggggaacccggcccccgggccccgagaccgactgagggagcgacctgcgcagggcccggggagtcatggtctccatcacccaactccatgcttcgagtcctgctctctgctcagacctcccctgctcggctgtctggcctgctgctgatccctccagtacagccctgctgtttggggcccagcaaatggggggaccggcctgttggaggaggccccagtgcaggtcctgtgcaaggactgcagcggcttctggaacaggcgaagagccctggggagctgctgcgctggctgggccagaaccccagcaaggtgcgcgcccaccactactcggtggcgcttcgtcgtctgggccagctcttggggtctcggccacggccccctcctgtggagcaggtcacactgcaggacttgagtcagctcatcatccgaaactgcccctcctttgacattcacaccatccacgtgtgtctgcaccttgcagtcttacttggctttccatctgatggtcccctggtgtgtgccctggaacaggagcgaaggctccgcctccctccgaagccacctccccctttgcagccccttctccgaggtgggcaagggttggaagctgctctaagctgcccccgttttctgcggtatccacggcagcatctgatcagcagcctggcagaggcaaggccagaggaactgactccccacgtgatggtgctcctggcccagcacctggcccggcaccggttgcgggagccccagcttctggaagccattgcccacttcctggtggttcaggaaacgcaactcagcagcaaggtggtacagaagttggtcctgccctttgggcgactgaactacctgcccctggaacagcagtttatgccctgccttgagaggatcctggctcgggaagcaggggtggcacccctggctacagtcaacatcttgatgtcactgtgccaactgcggtgcctgcccttcagagccctgcactttgttttttcccctggcttcatcaactacatcagtggcacccctcatgctctgattgtgcgtcgctacctctccctgctggacacggccgtggagctggagctcccaggataccggggtccccgccttccccgaaggcagcaagtgcccatctttccccagcctctcatcaccgaccgtgcccgctgcaagtacagtcacaaggacatagtagctgaggggttgcgccagctgctgggggaggagaaataccgccaggacctgactgtgcctccaggctactgcacagacttcctgctgtgcgccagcagctctggtgctgtgcttcccgtgaggacccaggaccccttcctgccatacccaccaaggtcctgcccacagggccaggctgcctctagcgccactactcgagaccctgcccagagggtggtgctggtgttgcgggaacgctggcatttctgccgggacggccgggtgctgctgggctcgagggccctgagggagcggcacctaggcctgatgggctaccagctcctgccggtgagtggccctggcctggcccgtggcgcatcctcactcccagcctgcgggtaacctgccgccctctcctctccccacagctacccttcgaggaactggagtcccagagaggcctgccccagctcaagagctacctgaggcagaagctccaggccctgggcctgcgctgggggcctgaagggggctgaggggatgatgtggggttcaggatggcccccccatggggggtggatgatttgcactttggttccctgtgttttgatttctcattaaagttcctttccttccc

SEQ ID NO: 314621 - DNA, 2017 bp, Homo sapiens
tccctggctcgcagtgcctgccgggagccacgtctccgaagaccgatagctgcttcgggattggcgtccgggcggctatctaggggctgctgggaagatggcggactcggtggctagccgatgaggaggccgcggggggaacccggcccccgggccccgagaccgactgagggagcgacctgcgcagggcccggggagtcatggtctccatcacccaactccatgcttcgagtcctgctctctgctcagacctcccctgctcggctgtctggcctgctgctgatccctccagtacagccctgctgtttggggcccagcaaatggggggaccggcctgttggaggaggccccagtgcaggtcctgtgcaaggactgcagcggcttctggaacaggcgaagagccctggggagctgctgcgctggctgggccagaaccccagcaaggtgcgcgcccaccactactcggtggcgcttcgtcgtctgggccagctcttggggtctcggccacggccccctcctgtggagcaggtcacactgcaggacttgagtcagctcatcatccgaaactgcccctcctttgacattcacaccatccacgtgtgtctgcaccttgcagtcttacttggctttccatctgatggtcccctggtgtgtgccctggaacaggagcgaaggctccgcctccctccgaagccacctccccctttgcagccccttctccgaggtgggcaagggttggaagctgctctaagctgcccccgttttctgcggtatccacggcagcatctgatcagcagcctggcagaggcaaggccagaggaactgactccccacgtgatggtgctcctggcccagcacctggcccggcaccggttgcgggagccccagcttctggaagccattgcccacttcctggtggttcaggaaacgcaactcagcagcaaggtggtacagaagttggtcctgccctttgggcgactgaactacctgcccctggaacagcagtttatgccctgccttgagaggatcctggctcgggaagcaggggtggcacccctggctacagtcaacatcttgatgtcactgtgccaactgcggtgcctgcccttcagagccctgcactttgttttttcccctggcttcatcaactacatcagtggcacccctcatgctctgattgtgcgtcgctacctctccctgctggacacggccgtggagctggagctcccaggataccggggtccccgccttccccgaaggcagcaagtgcccatctttccccagcctctcatcaccgaccgtgcccgctgcaagtacagtcacaaggacatagtagctgaggggttgcgccagctgctgggggaggagaaataccgccaggacctgactgtgcctccaggctactgcacaggtgagcaaggggcaggcggcaggcccggggagacggagccctggctaaggccgccggccctgctcccctccagacttcctgctgtgcgccagcagctctggtgctgtgcttcccgtgaggacccaggaccccttcctgccatacccaccaaggtcctgcccacagggccaggctgcctctagcgccactactcgagaccctgcccagaggtaaaggaggcagggtgggggagccctggccaccttgcccgccatgccctgagccacgtccctccccctgcagggtggtgctggtgttgcgggaacgctggcatttctgccgggacggccgggtgctgctgggctcgagggccctgagggagcggcacctaggcctgatgggctaccagctcctgccgctacccttcgaggaactggagtcccagagaggcctgccccagctcaagagctacctgaggcagaagctccaggccctgggcctgcgctgggggcctgaagggggctgaggggatgatgtggggttcaggatggcccccccatggggggtggatgatttgcactttggttccctgtgttttgatttctcattaaagttcctttccttccc

SEQ ID NO: 314622 - DNA, 1756 bp, Homo sapiens
tccctggctcgcagtgcctgccgggagccacgtctccgaagaccgatagctgcttcgggattggcgtccgggcggctatctaggggctgctgggaagatggcggactcggtggctagccgatgaggaggccgcggggggaacccggcccccgggccccgagaccgactgagggagcgacctgcgcagggcccggggagtcatggtctccatcacccaactccatgcttcgagtcctgctctctgctcagacctcccctgctcggctgtctggcctgctgctgatccctccagtacagccctgctgtttggggcccagcaaatggggggaccggcctgttggaggaggccccagtgcaggtcctgtgcaaggactgcagcggcttctggaacaggcgaagagccctggggagctgctgcgctggctgggccagaaccccagcaaggtgcgcgcccaccactactcggtggcgcttcgtcgtctgggccagctcttggggtctcggccacggccccctcctgtggagcaggtcacactgcaggacttgagtcagctcatcatccgaaactgcccctcctttgacattcacaccatccacgtgtgtctgcaccttgcagtcttacttggctttccatctgatggtcccctggtgtgtgccctggaacaggagcgaaggctccgcctccctccgaagccacctccccctttgcagccccttctccgaggtgggcaagggttggaagctgctctaagctgcccccgttttctgcggtatccacggcagcatctgatcagcagcctggcagaggcaaggccagaggaactgactccccacgtgatggtgctcctggcccagcacctggcccggcaccggttgcgggagccccagcttctggaagccattgcccacttcctggtggttcaggaaacgcaactcagcagcaaggtggtacagaagttggtcctgccctttgggcgactgaactacctgcccctggaacagcagtttatgccctgccttgagaggatcctggctcgggaagcaggggtggcacccctggctacagtcaacatcttgatgtcactgtgccaactgcggtgcctgcccttcagagccctgcactttgttttttcccctggcttcatcaactacatcagtggcacccctcatgctctgattgtgcgtcgctacctctccctgctggacacggccgtggagctggagctcccaggataccggggtccccgccttccccgaaggcagcaagtgcccatctttccccagcctctcatcaccgaccgtgcccgctgcaagtacagtcacaaggacatagtagctgaggggttgcgccagctgctgggggaggagaaataccgccaggacctgactgtgcctccaggctactgcacagacttcctgctgtgcgccagcagctctggtgctgtgcttcccgtgaggacccaggaccccttcctgccatacccaccaaggtcctgcccacagggccaggctgcctctagcgccactactcgagaccctgcccagagctacccttcgaggaactggagtcccagagaggcctgccccagctcaagagctacctgaggcagaagctccaggccctgggcctgcgctgggggcctgaagggggctgaggggatgatgtggggttcaggatggcccccccatggggggtggatgatttgcactttggttccctgtgttttgatttctcattaaagttcctttccttccc

SEQ ID NO: 314623 - DNA, 1620 bp, Homo sapiens
tccctggctcgcagtgcctgccgggagccacgtctccgaagaccgatagctgcttcgggattggcgtccgggcggctatctaggggctgctgggaagatggcggactcggtggctagccgatgaggaggccgcggggggaacccggcccccgggccccgagaccgactgagggagcgacctgcgcagggcccggggagtcatggtctccatcacccaactccatgcttcgagtcctgctctctgctcagacctcccctgctcggctgtctggcctgctgctgatccctccagtacagccctgctgtttggggcccagcaaatggggggaccggcctgttggaggaggccccagtgcaggtcctgtgcaaggactgcagcggcttctggaacaggcgaagagccctggggagctgctgcgctggctgggccagaaccccagcaaggtgcgcgcccaccactactcggtggcgcttcgtcgtctgggccagctcttggggtctcggccacggccccctcctgtggagcaggtcacactgcaggacttgagtcagctcatcatccgaaactgcccctcctttgacattcacaccatccacgtgtgtctgcaccttgcagtcttacttggctttccatctgatggtcccctggtgtgtgccctggaacaggagcgaaggctccgcctccctccgaagccacctccccctttgcagccccttctccgaggtgggcaagggttggaagctgctctaagctgcccccgttttctgcggtatccacggcagcatctgatcagcagcctggcagaggcaaggccagaggaactgactccccacgtgatggtgctcctggcccagcacctggcccggcaccggttgcgggagccccagcttctggaagccattgcccacttcctggtggttcaggaaacgcaactcagcagcaaggtggtacagaagttggtcctgccctttgggcgactgaactacctgcccctggaacagcagtttatgccctgccttgagaggatcctggctcgggaagcaggggtggcacccctggctacagtcaacatcttgatgtcactgtgccaactgcggtgcctgcccttcagagccctgcactttgttttttcccctggcttcatcaactacatcagtggcacccctcatgctctgattgtgcgtcgctacctctccctgctggacacggccgtggagctggagctcccaggataccggggtccccgccttccccgaaggcagcaagtgcccatctttccccagcctctcatcaccgaccgtgcccgctgcaagtacagtcacaaggacatagtagctgaggggttgcgccagctgctgggggaggagaaataccgccaggacctgactgtgcctccaggctactgcacagctacccttcgaggaactggagtcccagagaggcctgccccagctcaagagctacctgaggcagaagctccaggccctgggcctgcgctgggggcctgaagggggctgaggggatgatgtggggttcaggatggcccccccatggggggtggatgatttgcactttggttccctgtgttttgatttctcattaaagttcctttccttccc

SEQ ID NO: 314624 - DNA, 2347 bp, Homo sapiens
tccctggctcgcagtgcctgccgggagccacgtctccgaagaccgatagctgcttcgggattggcgtccgggcggctatctaggggctgctgggaagatggcggactcggtggctagccgatgaggaggccgcggggggaacccggcccccgggccccgagaccgactgagggagcgacctgcgcagggcccggggagtcatgtaggggtggcgcctgcggggagggctgcgggagggcagcgggagctggtgttagcggcagcggccacggtctcctggcgtccctgggccggggtgggtgttggggcccccgacttcgccgactccgcgccatcgcaaagcggtgcactcgggctccacgcgcgccctgcgaggtgggcgctgcgttttcatttcacgggtgaggagacttagagagacgaagccacttgtccaaggtcacgccgctggtgagtgggagcgcccagcatggaacccagcaccgtccagccgcggagcccgcgttccaccctctgtgccgccgccgcctcctgtgggagagggaggtggtcgggagagtgcacgccggtgccgcctgggctccagactgggcgcgaccactaacccggttaatgacctcgggcttaacttaaccccttcgctgctctgggcctgcgtttctccaccggtgaaatgagggtctccatcacccaactccatgcttcgagtcctgctctctgctcagacctcccctgctcggctgtctggcctgctgctgatccctccagtacagccctgctgtttggggcccagcaaatggggggaccggcctgttggaggaggccccagtgcaggtcctgtgcaaggactgcagcggcttctggaacaggcgaagagccctggggagctgctgcgctggctgggccagaaccccagcaaggtgcgcgcccaccactactcggtggcgcttcgtcgtctgggccagctcttggggtctcggccacggccccctcctgtggagcaggtcacactgcaggacttgagtcagctcatcatccgaaactgcccctcctttgacattcacaccatccacgtgtgtctgcaccttgcagtcttacttggctttccatctgatggtcccctggtgtgtgccctggaacaggagcgaaggctccgcctccctccgaagccacctccccctttgcagccccttctccgaggtgggcaagggttggaagctgctctaagctgcccccgttttctgcggtatccacggcagcatctgatcagcagcctggcagaggcaaggccagaggaactgactccccacgtgatggtgctcctggcccagcacctggcccggcaccggttgcgggagccccagcttctggaagccattgcccacttcctggtggttcaggaaacgcaactcagcagcaaggtggtacagaagttggtcctgccctttgggcgactgaactacctgcccctggaacagcagtttatgccctgccttgagaggatcctggctcgggaagcaggggtggcacccctggctacagtcaacatcttgatgtcactgtgccaactgcggtgcctgcccttcagagccctgcactttgttttttcccctggcttcatcaactacatcagtggcacccctcatgctctgattgtgcgtcgctacctctccctgctggacacggccgtggagctggagctcccaggataccggggtccccgccttccccgaaggcagcaagtgcccatctttccccagcctctcatcaccgaccgtgcccgctgcaagtacagtcacaaggacatagtagctgaggggttgcgccagctgctgggggaggagaaataccgccaggacctgactgtgcctccaggctactgcacagacttcctgctgtgcgccagcagctctggtgctgtgcttcccgtgaggacccaggaccccttcctgccatacccaccaaggtcctgcccacagggccaggctgcctctagcgccactactcgagaccctgcccagagggtggtgctggtgttgcgggaacgctggcatttctgccgggacggccgggtgctgctgggctcgagggccctgagggagcggcacctaggcctgatgggctaccagctcctgccgctacccttcgaggaactggagtcccagagaggcctgccccagctcaagagctacctgaggcagaagctccaggccctgggcctgcgctgggggcctgaagggggctgaggggatgatgtggggttcaggatggcccccccatggggggtggatgatttgcactttggttccctgtgttttgatttctcattaaagttcctttccttccc

SEQ ID NO: 314625 - DNA, 1843 bp, Homo sapiens
tccctggctcgcagtgcctgccgggagccacgtctccgaagaccgatagctgcttcgggattggcgtccgggcggctatctaggggctgctgggaagatggcggactcggtggctagccgatgaggaggccgcggggggaacccggcccccgggccccgagaccgactgagggagcgacctgcgcagggcccggggagtcatgtaggggtggcgcctgcggggagggctgcgggagggcagcgggagctggtgttagcggcagcggccacggtctcctggcgtccctgggccggggtgggtgttggggcccccgacttcgccgactccgcgccatcgcaaagcggtgcactcgggctccacgcgcgccctgcgaggtgggcgctgcgttttcatttcacgggtgaggagacttagagagacgaagccacttgtccaaggtcacgccgctggtgagtgggagcgcccagcatggaacccagcaccgtccagccgcggagcccgcgttccaccctctgtgccgccgccgcctcctgtgggagagggaggtggtcgggagagtgcacgccggtgccgcctgggctccagactgggcgcgaccactaacccggttaatgacctcgggcttaacttaaccccttcgctgctctgggcctgcgtttctccaccggtgaaatgaggctttccatctgatggtcccctggtgtgtgccctggaacaggagcgaaggctccgcctccctccgaagccacctccccctttgcagccccttctccgagaggcaaggccagaggaactgactccccacgtgatggtgctcctggcccagcacctggcccggcaccggttgcgggagccccagcttctggaagccattgcccacttcctggtggttcaggaaacgcaactcagcagcaaggtggtacagaagttggtcctgccctttgggcgactgaactacctgcccctggaacagcagtttatgccctgccttgagaggatcctggctcgggaagcaggggtggcacccctggctacagtcaacatcttgatgtcactgtgccaactgcggtgcctgcccttcagagccctgcactttgttttttcccctggcttcatcaactacatcagtggcacccctcatgctctgattgtgcgtcgctacctctccctgctggacacggccgtggagctggagctcccaggataccggggtccccgccttccccgaaggcagcaagtgcccatctttccccagcctctcatcaccgaccgtgcccgctgcaagtacagtcacaaggacatagtagctgaggggttgcgccagctgctgggggaggagaaataccgccaggacctgactgtgcctccaggctactgcacagacttcctgctgtgcgccagcagctctggtgctgtgcttcccgtgaggacccaggaccccttcctgccatacccaccaaggtcctgcccacagggccaggctgcctctagcgccactactcgagaccctgcccagagggtggtgctggtgttgcgggaacgctggcatttctgccgggacggccgggtgctgctgggctcgagggccctgagggagcggcacctaggcctgatgggctaccagctcctgccgctacccttcgaggaactggagtcccagagaggcctgccccagctcaagagctacctgaggcagaagctccaggccctgggcctgcgctgggggcctgaagggggctgaggggatgatgtggggttcaggatggcccccccatggggggtggatgatttgcactttggttccctgtgttttgatttctcattaaagttcctttccttccc

SEQ ID NO: 314626 - DNA, 1448 bp, Homo sapiens
tccctggctcgcagtgcctgccgggagccacgtctccgaagaccgatagctgcttcgggattggcgtccgggcggctatctaggggctgctgggaagatggcggactcggtggctagccgatgaggaggccgcggggggaacccggcccccgggccccgagaccgactgagggagcgacctgcgcagggcccggggagtcatgctttccatctgatggtcccctggtgtgtgccctggaacaggagcgaaggctccgcctccctccgaagccacctccccctttgcagccccttctccgaggtgggcaagggttggaagctgctctaagctgcccccgttttctgcggtatccacggcagcatctgatcagcagcctggcagaggcaaggccagaggaactgactccccacgtgatggtgctcctggcccagcacctggcccggcaccggttgcgggagccccagcttctggaagccattgcccacttcctggtggttcaggaaacgcaactcagcagcaaggtggtacagaagttggtcctgccctttgggcgactgaactacctgcccctggaacagcagtttatgccctgccttgagaggatcctggctcgggaagcaggggtggcacccctggctacagtcaacatcttgatgtcactgtgccaactgcggtgcctgcccttcagagccctgcactttgttttttcccctggcttcatcaactacatcagtggcacccctcatgctctgattgtgcgtcgctacctctccctgctggacacggccgtggagctggagctcccaggataccggggtccccgccttccccgaaggcagcaagtgcccatctttccccagcctctcatcaccgaccgtgcccgctgcaagtacagtcacaaggacatagtagctgaggggttgcgccagctgctgggggaggagaaataccgccaggacctgactgtgcctccaggctactgcacagacttcctgctgtgcgccagcagctctggtgctgtgcttcccgtgaggacccaggaccccttcctgccatacccaccaaggtcctgcccacagggccaggctgcctctagcgccactactcgagaccctgcccagagggtggtgctggtgttgcgggaacgctggcatttctgccgggacggccgggtgctgctgggctcgagggccctgagggagcggcacctaggcctgatgggctaccagctcctgccgctacccttcgaggaactggagtcccagagaggcctgccccagctcaagagctacctgaggcagaagctccaggccctgggcctgcgctgggggcctgaagggggctgaggggatgatgtggggttcaggatggcccccccatggggggtggatgatttgcactttggttccctgtgttttgatttctcattaaagttcctttccttccc

SEQ ID NO: 314627 - DNA, 1378 bp, Homo sapiens
tccctggctcgcagtgcctgccgggagccacgtctccgaagaccgatagctgcttcgggattggcgtccgggcggctatctaggggctgctgggaagatggcggactcggtggctagccgatgaggaggccgcggggggaacccggcccccgggccccgagaccgactgagggagcgacctgcgcagggcccggggagtcatggtctccatcacccaactccatgcttcgagtcctgctctctgctcagacctcccctgctcggctgtctggcctgctgctgatccctccagtacagccctgctgtttggggcccagcaaatggggggaccggcctgttggaggaggccccagtgcaggtcctgtgcaaggactgcagcggcttctggaacaggcgaagagccctggggagctgctgcgctggctgggccagaaccccagcaaggtgcgcgcccaccactactcggtggcgcttcgtcgtctgggccagctcttggggtctcggccacggccccctcctgtggagcaggtcacactgcaggacttgagtcagctcatcatccgaaactgcccctcctttgacattcacaccatccacgtgtgtctgcaccttgcagtcttacttggctttccatctgatggtcccctggtgtgtgccctggaacaggagcgaaggctccgcctccctccgaagccacctccccctttgcagccccttctccgaggtgggcaagggttggaagctgctctaagctgcccccgttttctgcggtatccacggcagcatcccagcctctcatcaccgaccgtgcccgctgcaagtacagtcacaaggacatagtagctgaggggttgcgccagctgctgggggaggagaaataccgccaggacctgactgtgcctccaggctactgcacagacttcctgctgtgcgccagcagctctggtgctgtgcttcccgtgaggacccaggaccccttcctgccatacccaccaaggtcctgcccacagggccaggctgcctctagcgccactactcgagaccctgcccagagggtggtgctggtgttgcgggaacgctggcatttctgccgggacggccgggtgctgctgggctcgagggccctgagggagcggcacctaggcctgatgggctaccagctcctgccgctacccttcgaggaactggagtcccagagaggcctgccccagctcaagagctacctgaggcagaagctccaggccctgggcctgcgctgggggcctgaagggggctgaggggatgatgtggggttcaggatggcccccccatggggggtggatgatttgcactttggttccctgtgttttgatttctcattaaagttcctttccttccc

SEQ ID NO: 314628 - DNA, 2027 bp, Homo sapiens
tccctggctcgcagtgcctgccgggagccacgtctccgaagaccgatagctgcttcgggattggcgtccgggcggctatctaggggctgctgggaagatggcggactcggtggctagccgatgaggaggccgcggggggaacccggcccccgggccccgagaccgactgagggagcgacctgcgcagggcccggggagtcatgtaggggtggcgcctgcggggagggctgcgggagggcagcgggagctggtgttagcggcagcggccacggtctcctggcgtccctgggccggggtgggtgttggggcccccgacttcgccgactccgcgccatcgcaaagcggtgcactcgggctccacgcgcgccctgcgaggtgggcgctgcgttttcatttcacgggtgaggagacttagagagacgaagccacttgtccaaggtcacgccgctggtgagtgggagcgcccagcatggaacccagcaccgtccagccgcggagcccgcgttccaccctctgtgccgccgccgcctcctgtgggagagggaggtggtcgggagagtgcacgccggtgccgcctgggctccagactgggcgcgaccactaacccggttaatgacctcgggcttaacttaaccccttcgctgctctgggcctgcgtttctccaccggtgaaatgagggtctccatcacccaactccatgcttcgagtcctgctctctgctcagacctcccctgctcggctgtctggcctgctgctgatccctccagtacagccctgctgtttggggcccagcaaatggggggaccggcctgttggaggaggccccagtgcaggtcctgtgcaaggactgcagcggcttctggaacaggcgaagagccctggggagctgctgcgctggctgggccagaaccccagcaaggtgcgcgcccaccactactcggtggcgcttcgtcgtctgggccagctcttggggtctcggccacggccccctcctgtggagcaggtcacactgcaggacttgagtcagctcatcatccgaaactgcccctcctttgacattcacaccatccacgtgtgtctgcaccttgcagtcttacttggtggtacagaagttggtcctgccctttgggcgactgaactacctgcccctggaacagcagtttatgccctgccttgagaggatcctggctcgggaagcaggggtggcacccctggctacagtcaacatcttgatgtcactgtgccaactgcggtgcctgcccttcagagccctgcactttgttttttcccctggcttcatcaactacatcagtggcacccctcatgctctgattgtgcgtcgctacctctccctgctggacacggccgtggagctggagctcccaggataccggggtccccgccttccccgaaggcagcaagtgcccatctttccccagcctctcatcaccgaccgtgcccgctgcaagtacagtcacaaggacatagtagctgaggggttgcgccagctgctgggggaggagaaataccgccaggacctgactgtgcctccaggctactgcacagacttcctgctgtgcgccagcagctctggtgctgtgcttcccgtgaggacccaggaccccttcctgccatacccaccaaggtcctgcccacagggccaggctgcctctagcgccactactcgagaccctgcccagagggtggtgctggtgttgcgggaacgctggcatttctgccgggacggccgggtgctgctgggctcgagggccctgagggagcggcacctaggcctgatgggctaccagctcctgccgctacccttcgaggaactggagtcccagagaggcctgccccagctcaagagctacctgaggcagaagctccaggccctgggcctgcgctgggggcctgaagggggctgaggggatgatgtggggttcaggatggcccccccatggggggtggatgatttgcactttggttccctgtgttttgatttctcattaaagttcctttccttccc

SEQ ID NO: 314629 - DNA, 1399 bp, Homo sapiens
tccctggctcgcagtgcctgccgggagccacgtctccgaagaccgatagctgcttcgggattggcgtccgggcggctatctaggggctgctgggaagatggcggactcggtggctagccgatgaggaggccgcggggggaacccggcccccgggccccgagaccgactgagggagcgacctgcgcagggcccggggagtcatggtctccatcacccaactccatgcttcgagtcctgctctctgctcagacctcccctgctcggctgtctggcctgctgctgatccctccagtacagccctgctgtttggggcccagcaaatggggggaccggcctgttggaggaggccccagtgcaggtcctgtgcaaggactgcagcggcttctggaacaggcgaagagccctggggagctgctgcgctggctgggccagaaccccagcaaggtgcgcgcccaccactactcggtggcgcttcgtcgtctgggccagctcttggggtctcggccacggccccctcctgtggagcaggtcacactgcaggacttgagtcagctcatcatccgaaactgcccctcctttgacattcacaccatccacgtgtgtctgcaccttgcagtcttacttggctttccatctgatggtcccctggtgtgtgccctggaacaggagcgaaggctccgcctccctccgaagccacctccccctttgcagccccttctccgagaggcaaggccagaggaactgactccccacgtgatggtgctcctggcccagcacctggcccggcaccggttgcgggagccccagcccagcctctcatcaccgaccgtgcccgctgcaagtacagtcacaaggacatagtagctgaggggttgcgccagctgctgggggaggagaaataccgccaggacctgactgtgcctccaggctactgcacagacttcctgctgtgcgccagcagctctggtgctgtgcttcccgtgaggacccaggaccccttcctgccatacccaccaaggtcctgcccacagggccaggctgcctctagcgccactactcgagaccctgcccagagggtggtgctggtgttgcgggaacgctggcatttctgccgggacggccgggtgctgctgggctcgagggccctgagggagcggcacctaggcctgatgggctaccagctcctgccgctacccttcgaggaactggagtcccagagaggcctgccccagctcaagagctacctgaggcagaagctccaggccctgggcctgcgctgggggcctgaagggggctgaggggatgatgtggggttcaggatggcccccccatggggggtggatgatttgcactttggttccctgtgttttgatttctcattaaagttcctttccttccc

SEQ ID NO: 314630 - DNA, 2570 bp, Homo sapiens
tccctggctcgcagtgcctgccgggagccacgtctccgaagaccgatagctgcttcgggattggcgtccgggcggctatctaggggctgctgggaagatggcggactcggtggctagccgatgaggaggccgcggggggaacccggcccccgggccccgagaccgactgagggagcgacctgcgcagggcccggggagtcatgtaggggtggcgcctgcggggagggctgcgggagggcagcgggagctggtgttagcggcagcggccacggtctcctggcgtccctgggccggggtgggtgttggggcccccgacttcgccgactccgcgccatcgcaaagcggtgcactcgggctccacgcgcgccctgcgaggtgggcgctgcgttttcatttcacgggtgaggagacttagagagacgaagccacttgtccaaggtcacgccgctggtgagtgggagcgcccagcatggaacccagcaccgtccagccgcggagcccgcgttccaccctctgtgccgccgccgcctcctgtgggagagggaggtggtcgggagagtgcacgccggtgccgcctgggctccagactgggcgcgaccactaacccggttaatgacctcgggcttaacttaaccccttcgctgctctgggcctgcgtttctccaccggtgaaatgagggtctccatcacccaactccatgcttcgagtcctgctctctgctcagacctcccctgctcggctgtctggcctgctgctgatccctccagtacagccctgctgtttggggcccagcaaatggggggaccggcctgttggaggaggccccagtgcaggtcctgtgcaaggactgcagcggcttctggaacaggcgaagagccctggggagctgctgcgctggctgggccagaaccccagcaaggtgcgcgcccaccactactcggtggcgcttcgtcgtctgggccagctcttggggtctcggccacggccccctcctgtggagcaggtcacactgcaggacttgagtcagctcatcatccgaaactgcccctcctttgacattcacaccatccacgtgtgtctgcaccttgcagtcttacttggtggtacagaagttggtcctgccctttgggcgactgaactacctgcccctggaacagcagtttatgccctgccttgagaggatcctggctcgggaagcaggggtggcacccctggctacagtcaacatcttgatgtcactgtgccaactgcggtgcctgcccttcagagccctgcactttgttttttcccctggcttcatcaactacatcagtggtacgcagccaggatggctggctgggcccctgagggctggagaggcaggggagcagggtggcctgcagcccagagccccagtccccgcctccccacaggcacccctcatgctctgattgtgcgtcgctacctctccctgctggacacggccgtggagctggagctcccaggataccggggtccccgccttccccgaaggcagcaagtgcccatctttccccagcctctcatcaccgaccgtgcccgctgcaagtacaggtggatggggcagcctggggcaaggggaggggccagcctgggaccagcagagtggaaaagccagagggaccatgaagcgccaaagctaaggagctctcggccaccataaaactgggccctgaagcagcagagggctttgcccagggtggtggcactagactgggacagattaggatgaggtgccgggcccttcctgctactggtgtcctttctcctcagtcacaaggacatagtagctgaggggttgcgccagctgctgggggaggagaaataccgccaggacctgactgtgcctccaggctactgcacaggtgagcaaggggcaggcggcaggcccggggagacggagccctggctaaggccgccggccctgctcccctccagacttcctgctgtgcgccagcagctctggtgctgtgcttcccgtgaggacccaggaccccttcctgccatacccaccaaggtcctgcccacagggccaggctgcctctagcgccactactcgagaccctgcccagaggtaaaggaggcagggtgggggagccctggccaccttgcccgccatgccctgagccacgtccctccccctgcagggtggtgctggtgttgcgggaacgctggcatttctgccgggacggccgggtgctgctgggctcgagggccctgagggagcggcacctaggcctgatgggctaccagctcctgccggtgagtggccctggcctggcccgtggcgcatcctcactcccagcctgcgggtaacctgccgccctctcctctccccacagctacccttcgaggaactggagtcccagagaggcctgccccagctcaagagctacctgaggcagaagctccaggccctgggcctgcgctgggggcctgaagggggctgaggggatgatgtggggttcaggatggcccccccatggggggtggatgatttgcactttggttccctgtgttttgatttctcattaaagttcctttccttccc

SEQ ID NO: 314631 - DNA, 5952 bp, Homo sapiens
gactggctgcagccgcagtcttggtggaggaggtggtgaccaccaccgctcctccacctgcatccggctgcgggactgcggcggccgcgtttgccctgcagaccctgcaccccgggacgcggctcatctgtcattagcaccggcactaagctcccaccgctcagcgacttggtccgccgcaagctccgccgcaggctttgtccgctagcgctcggctgagtctgggcgggcgggaaacctgggctagggcgaggcggggcccctggacatgcctttctccacgtccgcctcctcgaccctattgtaagcggagaaacttagtgtgcgaggcaggcaggggacgtccccattttgatgtcccgtaccctccacccccttcggatcgaggtagtaaagaggctcctgtaggaaactgactgcctctatgattgcggcctcttgggggattttgcgtttagcccgaaagttggctttgccaaaagacgcacgggtaggaagggcgaaaaggaaaccctgtattccgtcgcgctgggctctccgagtccgtgcgcaaagcggcctacgagtcctggctccgcacctgcagaggacaagagccaatgcctaaaaaagaacagcggaggaaccggctggcgcggccagctggaacgctggatcgcagtgcgcccagggaaggccgggggcgcccgccggccctagccctcagtggtcctctcccacgccggcccgcgcgtgcctctgcctacaagacctggggcgtcctggccagatctggatggcaggtccctccgccacccccggcccggttccgggggcgtggcttggcgcgggggcgggtttaagtcaccgcgggtgtctgaccactctgacaggtctccaaatttctcccagtcgcctggcgcccgcggtgcgtttcagagctccagggtggcacgcggcggcgcttccctagatccagaggcgtctctgtcgacttccacgcggcctcgggcctcccttctcctccaaaccttcgcctcatccgccaagcttcggttctcagcctcagatatccgcaccggcggcttctcttcgttctcggagctcttggctttggagccctcaccactttttccttcccccgcctctcctgatcctcctagctccgagccaaatggactccaaagaacgaaataaaggggatgagaactgtgtgctgcgacccttcgaaagcacagctgaaagcgttgacctcgtcttatagatcaggctgggaccctggggcgagagtccccacaccccctccgggagggatgcttctggccagagccagcgctgcgctgtcagtccttgctcccgaactaggaaagagcctaggagggagcctcagcataccccttcctccaaattaactatttggtgaattgttagcgccgaggctaccacctctccaaccctgtcgcggggcgcgccgccacctcaccgtgaccccctcctcctccttctttgccaccgcccccagctccgcccctgctccccatcccggcgcaatggagttctccgaagggcgatgattccagccacatctgctaacttcgcacccatcgctgccgccggtcaccgccggccaggccccctgcagccgcggagcagtgggcgtccaaagcccagtgcagcagccaggacccgcccgacgcgcagcagaagcacggcgcccaggcgcttaggcgtctcttggagagcaaaggctgcgccaaaacgctgagcctagaatcaaccaaggagcctgagcccaggaaggggctgcgtggctcacagcgctgcggctcctgaggacaaatagccactgccgctgcgtacccaagctgcgccggctggcgggagagcagcacgcaaggacgccgaggtccgccgcgatcttccaggtgccctttgcccctgggcacagtatgacccgacctacagggagccctagcgcagggctcctgcaacgggtcagcctaggataaaaaggatccttgccaagctcctaccaggccgcctttgagtctttaggaacccctcctccggctgcctccccaaggttctgggcctccttccctgcggcccagagccatggagctctccgatgtgcgctgccttacaggcagcgaggaactctacaccatccacccgacgcccccggccggcgacggcaggagcgcctcccggccgcagcggctgctgtggcagacggcggtgcgacacatcacggagcagcgcttcattcacgggcaccggggaggcagcggcagcgggagtggaggctcgggcaaagcctcggaccctgcgggcggcggccccaaccaccacgcgccgcagctgtcaggcgactcggcgctgcccctctactcgctgggcccgggagagcgagcgcacagcacctgcggcaccaaagtcttcccggaacgcagcgggagcggcagtgccagcggcagcggaggcgggggcgacctgggcttcctgcaccttgactgtgcccctagcaactcggatttctttcttaatgggggctatagctaccgaggggtcattttccccaccctgcgcaactccttcaaatctcgggatttggaacgcctctaccagcgctatttcttgggccaaaggcgcaaatcggaagtggtgatgaacgtgctggacgtgctgaccaaactcactctcttggtcctacacttgagcctggcctcggcccccatggacccgctcaagggcatcctgctgggcttcttcaccggcattgaggtagtgatctgcgccctggtggtggtcaggaaggacaccacctcccacacgtacctgcagtacagcggcgtggtcacctgggtggccatgaccacccagatcctggcagcaggcctcggctacgggctcctgggcgacggcataggctacgtgctcttcacgctcttcgccacctacagtatgctgccgctgccgctcacctgggccatcctggccggcctgggcacctcgctgctgcaggtcatcctccaagtggtcataccccggctggcggtcatttccatcaaccaggttgtggcccaggcagtgctattcatgtgtatgaacacagctggaatcttcatcagttacctgtcagaccgggcccagcgccaagctttcctggagactcggaggtgtgtggaggccaggctgcgcctggagacagagaaccaaagacaggagcggctcgtgctttctgtgctcccccggtttgttgtcctggaaatgatcaacgacatgaccaatgtggaagatgagcacctgcagcaccagttccatcggatctacatccatcgctatgagaacgtcagtattctttttgcagatgttaaaggatttaccaacctctccacgaccttgtctgctcaggagctggtcaggatgctcaacgagctctttgccagatttgatcgactggcccatgagcatcactgccttcgtattaaaatcctgggggactgctactactgcgtgtctggacttcctgagccccgccaggaccatgcccactgctgtgttgaaatgggtctcagcatgatcaaaaccatcaggtatgtgcggtcaaggacaaaacacgatgttgacatgaggattggaatccactccggctcggtgctgtgcggtgttttgggactacggaagtggcagtttgatgtctggtcttgggatgtggatattgcaaacaaactcgaatctggaggaatccccgggaggattcacatttccaaagccacgctggactgtctcaacggtgactataacgtggaagagggccatggtaaagagaggaatgaattcctgaggaagcataatatcgaaacttacttaattaagcagcctgaggacagtctgctgtccttgcctgaagatatcgtcaaggagtcagtgagctcctcagaccggagaaacagtggggccacattcactgaaggatcctggagccctgaactgccctttgataatatcgtggggaaacagaatactctggctgccctaacaagaaattcaataaatctgcttccaaaccatcttgcacaagctttgcatgtccagtctgggcctgaggaaattaacaagagaatagaacataccatcgacttgcggagtggcgataaattgagaagagagcatatcaagccattctcactgatgtttaaagactccagcctggagcacaagtattctcaaatgagggatgaagtgttcaagtcaaacttggtctgtgcatttatcgttcttctatttatcacggcaatacaaagtttgcttccttcttcaagagtgatgccaatgaccatccagttctccattctgattatgctgcactcggctctggtcctcatcaccacagcagaggattataaatgtttgcccctcatcctccggaaaacttgctgttggattaatgagacctatttggcccggaacgtcatcatctttgcatccattttgattaatttcctgggtgccatcttaaatatcctgtggtgtgattttgacaagtcgatacccttgaagaacctgactttcaattcctcagctgtgtttacagatatctgctcctacccagagtactttgtcttcacgggggtgttggccatggtgacctgtgcagttttcctccggctgaactccgtcctgaagctggcagtgctgctgatcatgattgccatctatgccctgctcactgagaccgtctacgcaggcctctttctgcgttatgacaacctcaaccacagtggagaagatttcctggggaccaaggaggtatcactgctactgatggccatgttcctcctggctgtgttctaccatggacagcagctggagtacacagcccgcctggacttcctttggcgagtacaggccaaagaggagatcaatgagatgaaggagctgagggaacacaatgagaacatgctccggaatatcttacccagccatgtggcccgccatttcctagagaaggaccgagacaatgaggagctgtattctcaatcctatgatgctgttggggtgatgtttgcctccatcccaggatttgcggacttttactctcagactgaaatgaataaccagggagtggaatgcctgcgcttgctcaatgagatcattgctgacttcgatgagttgcttggtgaagaccgatttcaagacattgaaaagattaagaccattggcagcacctacatggccgtgtcaggcctgtcacctgaaaaacagcaatgtgaagacaagtggggacatttgtgtgctctggctgacttctcactcgccctgacagaaagcatacaggagatcaacaagcattcattcaacaattttgaactccggattggcatcagccacggctcagtggtagctggcgttatcggcgctaagaaaccacagtatgacatttggggcaaaactgtgaacctggcaagccgaatggacagcacgggggttagtggccggatccaagtcccagaggagacctatctcatcctgaaggaccagggctttgcctttgattaccgaggggagatctatgtgaagggtatcagtgaacaggaaggaaaaatcaaaacgtactttcttctgggaagagtccaacccaacccattcatcttgcccccaagaagactgcctgggcagtactccctggccgcggttgtcctgggacttgtccagtccctcaataggcaaaggcagaagcagctactcaatgagaacaacaacacaggaatcatcaagggtcattacaaccggcggactttgttgtcacccagcggcacagagcctggagcccaggctgaaggcaccgacaaatctgatttgccataaaagcattttctttctgtttttttttttttttgtatttcttttatatataaaataaatatactaataaaaaggtttaattttttttagaacaaaaaaaaaaaa

SEQ ID NO: 314632 - DNA, 2875 bp, Homo sapiens
ctggtgaaggggagacagataaggttgtggcccaggcagtgctattcatgtgtatgaacacagctggaatcttcatcagttacctgtcagaccgggcccagcgccaagctttcctggagactcggaggagcggctcgtgctttctgtgctcccccggtttgttgtcctggaaatgatcaacgacatgaccaatgtggaagatgagcacctgcagcaccagttccatcggatctacatccatcgctatgagaacgtcagtattctttttgcagatgttaaaggatttaccaacctctccacgaccttgtctgctcaggagctggtcaggatgctcaacgagctctttgccagatttgatcgactggcccatgagcatcactgccttcgtattaaaatcctgggggactgctactactgcgtgtctggacttcctgagccccgccaggaccatgcccactgctgtgttgaaatgggtctcagcatgatcaaaaccatcaggtatgtgcggtcaaggacaaaacacgatgttgacatgaggattggaatccactccggctcggtgctgtgcggtgttttgggactacggaagtggcagtttgatgtctggtcttgggatgtggatattgcaaacaaactcgaatctggaggaatccccgggaggattcacatttccaaagccacgctggactgtctcaacggtgactataacgtggaagagggccatggtaaagagaggaatgaattcctgaggaagcataatatcgaaacttacttaattaagcagcctgaggacagtctgctgtccttgcctgaagatatcgtcaaggagtcagtgagctcctcagaccggagaaacagtggggccacattcactgaaggatcctggagccctgaactgccctttgataatatcgtggggaaacagaatactctggctgccctaacaagaaattcaataaatctgcttccaaaccatcttgcacaagctttgcatgtccagtctgggcctgaggaaattaacaagagaatagaacataccatcgacttgcggagtggcgataaattgagaagagagcatatcaagccattctcactgatgtttaaagactccagcctggagcacaagtattctcaaatgagggatgaagtgttcaagtcaaacttggtctgtgcatttatcgttcttctatttatcacggcaatacaaagtttgcttccttcttcaagagtgatgccaatgaccatccagttctccattctgattatgctgcactcggctctggtcctcatcaccacagcagaggattataaatgtttgcccctcatcctccggaaaacttgctgttggattaatgagacctatttggcccggaacgtcatcatctttgcatccattttgattaatttcctgggtgccatcttaaatatcctgtggtgtgattttgacaagtcgatacccttgaagaacctgactttcaattcctcagctgtgtttacagatatctgctcctacccagagtactttgtcttcacgggggtgttggccatggtgacctgtgcagttttcctccggctgaactccgtcctgaagctggcagtgctgctgatcatgattgccatctatgccctgctcactgagaccgtctacgcaggcctctttctgcgttatgacaacctcaaccacagtggagaagatttcctggggaccaaggaggtatcactgctactgatggccatgttcctcctggctgtgttctaccatggacagcagctggagtacacagcccgcctggacttcctttggcgagtacaggccaaagaggagatcaatgagatgaaggagctgagggaacacaatgagaacatgctccggaatatcttacccagccatgtggcccgccatttcctagagaaggaccgagacaatgaggagctgtattctcaatcctatgatgctgttggggtgatgtttgcctccatcccaggatttgcggacttttactctcagactgaaatgaataaccagggagtggaatgcctgcgcttgctcaatgagatcattgctgacttcgatgagttgcttggtgaagaccgatttcaagacattgaaaagattaagaccattggcagcacctacatggccgtgtcaggcctgtcacctgaaaaacagcaatgtgaagacaagtggggacatttgtgtgctctggctgacttctcactcgccctgacagaaagcatacaggagatcaacaagcattcattcaacaattttgaactccggattggcatcagccacggctcagtggtagctggcgttatcggcgctaagaaaccacagtatgacatttggggcaaaactgtgaacctggcaagccgaatggacagcacgggggttagtggccggatccaagtcccagaggagacctatctcatcctgaaggaccagggctttgcctttgattaccgaggggagatctatgtgaagggtatcagtgaacaggaaggaaaaatcaaaacgtactttcttctgggaagagtccaacccaacccattcatcttgcccccaagaagactgcctgggcagtactccctggccgcggttgtcctgggacttgtccagtccctcaataggcaaaggcagaagcagctactcaatgagaacaacaacacaggaatcatcaagggtcattacaaccggcggactttgttgtcacccagcggcacagagcctggagcccaggctgaaggcaccgacaaatctgatttgccataaaagcattttctttctgtttttttttttttttgtatttcttttatatataaaataaatatactaataaaaaggtttaattttttttagaacaaaaaaaaaaaa

SEQ ID NO: 314633 - DNA, 2300 bp, Homo sapiens
ctggtgaaggggagacagataaggttgtggcccaggcagtgctattcatgtgtatgaacacagctggaatcttcatcagttacctgtcagaccgggcccagcgccaagctttcctggagactcggaggagcggctcgtgctttctgtgctcccccggtttgttgtcctggaaatgatcaacgacatgaccaatgtggaagatgagcacctgcagcaccagttccatcggatctacatccatcgctatgagaacgtcagtattctttttgcagatgttaaaggatttaccaacctctccacgaccttgtctgctcaggagctggtcaggatgctcaacgagctctttgccagatttgatcgactggcccatgagcatcactgccttcgtattaaaatcctgggggactgctactactgcgtgtctggacttcctgagccccgccaggaccatgcccactgctgtgttgaaatgggtctcagcatgatcaaaaccatcaggtatgtgcggtcaaggacaaaacacgatgttgacatgaggattggaatccactccggctcggtgctgtgcggtgttttgggactacggaagtggcagtttgatgtctggtcttgggatgtggatattgcaaacaaactcgaatctggaggaatccccgggaggattcacatttccaaagccacgctggactgtctcaacggtgactataacgtggaagagggccatggtaaagagaggaatgaattcctgaggaagcataatatcgaaacttacttaattaagcagcctgaggacagtctgctgtccttgcctgaagatatcgtcaaggagtcagtgagctcctcagaccggagaaacagtggggccacattcactgaaggatcctggagccctgaactgccctttgataatatcgtggggaaacagaatactctggctgccctaacaagaaattcaataaatctgcttccaaaccatcttgcacaagctttgcatgtccagtctgggcctgaggaaattaacaagagaatagaacataccatcgacttgcggagtggcgataaattgagaagagagcatatcaagccattctcactgatgtttaaagactccagcctggagcacaagtattctcaaatgagggatgaagtgttcaagtcaaacttggtctgtgcatttatcgttcttctatttatcacggcaatacaaagtttgcttccttcttcaagagtgatgccaatgaccatccagttctccattctgattatgctgcactcggctctggtcctcatcaccacagcagaggattataaatgtttgcccctcatcctccggaaaacttgctgttggattaatgagacctatttggcccggaacgtcatcatctttgcatccattttgattaatttcctgggtgccatcttaaatatcctgtggtgtgattttgacaagtcgatacccttgaagaacctgactttcaattcctcagctgtgtttacagatatctgctcctacccagagtactttgtcttcacgggggtgttggccatggtgacctgtgcagttttcctccggctgaactccgtcctgaagctggcagtgctgctgatcatgattgccatctatgccctgctcactgagaccgtctacgcaggcctctttctgcgttatgacaacctcaaccacagtggagaagatttcctggggaccaaggaggtatcactgctactgatggccatgttcctcctggctgtgttctaccatggacagcagctggagtacacagcccgcctggacttcctttggcgagtacaggccaaagaggagatcaatgagatgaaggagctgagggaacacaatgagaacatgctccggaatatcttacccagccatgtggcccgccatttcctagagaaggaccgagacaatgaggagctgtattctcaatcctatgatgctgttggggtgatgtttgcctccatcccaggatttgcggacttttactctcagatactccctggccgcggttgtcctgggacttgtccagtccctcaataggcaaaggcagaagcagctactcaatgagaacaacaacacaggaatcatcaagggtcattacaaccggcggactttgttgtcacccagcggcacagagcctggagcccaggctgaaggcaccgacaaatctgatttgccataaaagcattttctttctgtttttttttttttttgtatttcttttatatataaaataaatatactaataaaaaggtttaattttttttagaacaaaaaaaaaaaa

SEQ ID NO: 314634 - DNA, 3157 bp, Homo sapiens
gactggctgcagccgcagtcttggtggaggaggtggtgaccaccaccgctcctccacctgcatccggctgcgggactgcggcggccgcgtttgccctgcagaccctgcaccccgggacgcggctcatctgtcattagcaccggcactaagctcccaccgctcagcgacttggtccgccgcaagctccgccgcaggctttgtccgctagcgctcggctgagtctgggcgggcgggaaacctgggctagggcgaggcggggcccctggacatgcctttctccacgtccgcctcctcgaccctattgtaagcggagaaacttagtgtgcgaggcaggcaggggacgtccccattttgatgtcccgtaccctccacccccttcggatcgaggtagtaaagaggctcctgtaggaaactgactgcctctatgattgcggcctcttgggggattttgcgtttagcccgaaagttggctttgccaaaagacgcacgggtaggaagggcgaaaaggaaaccctgtattccgtcgcgctgggctctccgagtccgtgcgcaaagcggcctacgagtcctggctccgcacctgcagaggacaagagccaatgcctaaaaaagaacagcggaggaaccggctggcgcggccagctggaacgctggatcgcagtgcgcccagggaaggccgggggcgcccgccggccctagccctcagtggtcctctcccacgccggcccgcgcgtgcctctgcctacaagacctggggcgtcctggccagatctggatggcaggtccctccgccacccccggcccggttccgggggcgtggcttggcgcgggggcgggtttaagtcaccgcgggtgtctgaccactctgacaggtctccaaatttctcccagtcgcctggcgcccgcggtgcgtttcagagctccagggtggcacgcggcggcgcttccctagatccagaggcgtctctgtcgacttccacgcggcctcgggcctcccttctcctccaaaccttcgcctcatccgccaagcttcggttctcagcctcagatatccgcaccggcggcttctcttcgttctcggagctcttggctttggagccctcaccactttttccttcccccgcctctcctgatcctcctagctccgagccaaatggactccaaagaacgaaataaaggggatgagaactgtgtgctgcgacccttcgaaagcacagctgaaagcgttgacctcgtcttatagatcaggctgggaccctggggcgagagtccccacaccccctccgggagggatgcttctggccagagccagcgctgcgctgtcagtccttgctcccgaactaggaaagagcctaggagggagcctcagcataccccttcctccaaattaactatttggtgaattgttagcgccgaggctaccacctctccaaccctgtcgcggggcgcgccgccacctcaccgtgaccccctcctcctccttctttgccaccgcccccagctccgcccctgctccccatcccggcgcaatggagttctccgaagggcgatgattccagccacatctgctaacttcgcacccatcgctgccgccggtcaccgccggccaggccccctgcagccgcggagcagtgggcgtccaaagcccagtgcagcagccaggacccgcccgacgcgcagcagaagcacggcgcccaggcgcttaggcgtctcttggagagcaaaggctgcgccaaaacgctgagcctagaatcaaccaaggagcctgagcccaggaaggggctgcgtggctcacagcgctgcggctcctgaggacaaatagccactgccgctgcgtacccaagctgcgccggctggcgggagagcagcacgcaaggacgccgaggtccgccgcgatcttccaggtgccctttgcccctgggcacagtatgacccgacctacagggagccctagcgcagggctcctgcaacgggtcagcctaggataaaaaggatccttgccaagctcctaccaggccgcctttgagtctttaggaacccctcctccggctgcctccccaaggttctgggcctccttccctgcggcccagagccatggagctctccgatgtgcgctgccttacaggcagcgaggaactctacaccatccacccgacgcccccggccggcgacggcaggagcgcctcccggccgcagcggctgctgtggcagacggcggtgcgacacatcacggagcagcgcttcattcacgggcaccggggaggcagcggcagcgggagtggaggctcgggcaaagcctcggaccctgcgggcggcggccccaaccaccacgcgccgcagctgtcaggcgactcggcgctgcccctctactcgctgggcccgggagagcgagcgcacagcacctgcggcaccaaagtcttcccggaacgcagcgggagcggcagtgccagcggcagcggaggcgggggcgacctgggcttcctgcaccttgactgtgcccctagcaactcggatttctttcttaatgggggctatagctaccgaggggtcattttccccaccctgcgcaactccttcaaatctcgggatttggaacgcctctaccagcgctatttcttgggccaaaggcgcaaatcggaagtggtgatgaacgtgctggacgtgctgaccaaactcactctcttggtcctacacttgagcctggcctcggcccccatggacccgctcaagggcatcctgctgggcttcttcaccggcattgaggtagtgatctgcgccctggtggtggtcaggaaggacaccacctcccacacgtacctgcagtacagcggcgtggtcacctgggtggccatgaccacccagatcctggcagcaggcctcggctacgggctcctgggcgacggcataggctacgtgctcttcacgctcttcgccacctacagtatgctgccgctgccgctcacctgggccatcctggccggcctgggcacctcgctgctgcaggtcatcctccaagtggtcataccccggctggcggtcatttccatcaaccaggtaactcctgcctgccttgcatttgtttcccctctaacttccccgggttattgatcatatagcttccagagagccagggttgcctcactctctttaagtctcc

SEQ ID NO: 314635 - DNA, 2606 bp, Homo sapiens
ctggtgaaggggagacagataaggttgtggcccaggcagtgctattcatgtgtatgaacacagctggaatcttcatcagttacctgtcagaccgggcccagcgccaagctttcctggagactcggaggagcggctcgtgctttctgtgctcccccggtttgttgtcctggaaatgatcaacgacatgaccaatgtggaagatgagcacctgcagcaccagttccatcggatctacatccatcgctatgagaacgtcagtattctttttgcagatgttaaaggatttaccaacctctccacgaccttgtctgctcaggagctggtcaggatgctcaacgagctctttgccagatttgatcgactggcccatgagcatcactgccttcgtattaaaatcctgggggactgctactactgcgtgtctggacttcctgagccccgccaggaccatgcccactgctgtgttgaaatgggtctcagcatgatcaaaaccatcaggtatgtgcggtcaaggacaaaacacgatgttgacatgaggattggaatccactccggctcggtgctgtgcggtgttttgggactacggaagtggcagtttgatgtctggtcttgggatgtggatattgcaaacaaactcgaatctggaggaatccccgggaggattcacatttccaaagccacgctggactgtctcaacggtgactataacgtggaagagggccatggtaaagagaggaatgaattcctgaggaagcataatatcgaaacttacttaattaagcagcctgaggacagtctgctgtccttgcctgaagatatcgtcaaggagtcagtgagctcctcagaccggagaaacagtggggccacattcactgaaggatcctggagccctgaactgccctttgataatatcgtggggaaacagaatactctggctgccctaacaagaaattcaataaatctgcttccaaaccatcttgcacaagctttgcatgtccagtctgggcctgaggaaattaacaagagaatagaacataccatcgacttgcggagtggcgataaattgagaagagagcatatcaagccattctcactgatgtttaaagactccagcctggagcacaagtattctcaaatgagggatgaagtgttcaagtcaaacttggtctgtgcatttatcgttcttctatttatcacggcaatacaaagtttgcttccttcttcaagagtgatgccaatgaccatccagttctccattctgattatgctgcactcggctctggtcctcatcaccacagcagaggattataaatgtttgcccctcatcctccggaaaacttgctgttggattaatgagacctatttggcccggaacgtcatcatctttgcatccattttgattaatttcctgggtgccatcttaaatatcctgtggtgtgattttgacaagtcgatacccttgaagaacctgactttcaattcctcagctgtgtttacagatatctgctcctacccagagtactttgtcttcacgggggtgttggccatggtgacctgtgcagttttcctccggctgaactccgtcctgaagctggcagtgctgctgatcatgattgccatctatgccctgctcactgagaccgtctacgcaggcctctttctgcgttatgacaacctcaaccacagtggagaagatttcctggggaccaaggaggtatcactgctactgatggccatgttcctcctggctgtgttctaccatggacagcagctggagtacacagcccgcctggacttcctttggcgagtacaggccaaagaggagatcaatgagatgaaggagctgagggaacacaatgagaacatgctccggaatatcttacccagccatgtggcccgccatttcctagagaaggaccgagacaatgaggagctgtattctcaatcctatgatgctgacagaaagcatacaggagatcaacaagcattcattcaacaattttgaactccggattggcatcagccacggctcagtggtagctggcgttatcggcgctaagaaaccacagtatgacatttggggcaaaactgtgaacctggcaagccgaatggacagcacgggggttagtggccggatccaagtcccagaggagacctatctcatcctgaaggaccagggctttgcctttgattaccgaggggagatctatgtgaagggtatcagtgaacaggaaggaaaaatcaaaacgtactttcttctgggaagagtccaacccaacccattcatcttgcccccaagaagactgcctgggcagtactccctggccgcggttgtcctgggacttgtccagtccctcaataggcaaaggcagaagcagctactcaatgagaacaacaacacaggaatcatcaagggtcattacaaccggcggactttgttgtcacccagcggcacagagcctggagcccaggctgaaggcaccgacaaatctgatttgccataaaagcattttctttctgtttttttttttttttgtatttcttttatatataaaataaatatactaataaaaaggtttaattttttttagaacaaaaaaaaaaaa

SEQ ID NO: 314636 - DNA, 662 bp, Homo sapiens
agatcttacggaagcattaaccctaccggagatattaatgcattcattcaacaattttgaactccgtgattggcatcagccacggctcagtggtagctggcgttatcggcgctaagaaaccacagtatgacatttggggcaaaactgtgaacctggcaagccgaatggacagcacgggggttagtggccggatccaagtcccagaggagacctatctcatcctgaaggaccagggctttgcctttgattaccgaggggagatctatgtgaagggtatcagtgaacaggaaggaaaaatcaaaacgtactttcttctgggaagagtccaacccaacccattcatcttgcccccaagaagactgcctgggcagtactccctggccgcggttgtcctgggacttgtccagtccctcaataggcaaaggcagaagcagctactcaatgagaacaacaacacaggaatcatcaagggtcattacaaccggcggactttgttgtcacccagcggcacagagcctggagcccaggctgaaggcaccgacaaatctgatttgccataaaagcattttctttctgtttttttttttttttgtatttcttttatatataaaataaatatactaataaaaaggtttaattttttttagaacaaaaaaaaaaaa

SEQ ID NO: 314637 - DNA, 2028 bp, Homo sapiens
  misc_feature (392)..(392): n is a, c, g, or t
  misc_feature (1793)..(1793): n is a, c, g, or t
attatatttgtcatcacttgtttgatagtatcatctttaatgtactctgtctttaatttcttcattatagaatagcacatgtggatatcattttctttccagattgggagcagtgcatgaaaatggtattcctgaattcccttggttggttcttgttcagactctgtatatctttggtccctacagagatcgattggcaaaatgctttctgtgtttagatcatgttaatttactatatattggctttgcttttatgttgacctttatcttgtaagttactttttctttatcctaacagatggctttgtagagttacaggcaaggttcctgcctataattccatttccctcctctcttctctgcatctgtttagttctatatccttttctctnttctttctccttttctttttttttctccctccatttcctctccctccctccttccttttttcccttcctccctccccccttccttccttcttttttattttaattttagcttagttcattaattctatttttaggtcggatgatgagcagagctctgcggataaagagagacttgccaggtaggagaacagtgtcttttagcatgatgaagcagatgatgctgctttttctatcctttttcttactctttcttttcttcccctttctctttgtatttttccttatctgtggcaagagaggacaagattttttagaagtttgagtgtaacaggaactttggcttcccccatcagaaagtgggtgagttgagggaactttgcttagggatttaagaaattgctattagttttaagtttttttttctttttctctttatgtcagtactaagtttcacagaacaaaaagctcttagaaggaatgcaaccgtgccagttggtgctttaacagggaaatactctttttatcagaaaaccaataaatatatctgtatttgtgattagttcccagtatttaggcctcagcatttactccacacctctaggaaactcacacctattttcctatgaagactcacagcctagattattctcacaacagaactagtgttgctttggtgaccgaatcctttcttgcggtagttttctagaaaagttttagtttccttgatgtggctatttaaaagaccaggtttctgtacttacgtgtcagaaatctgtcagatactaggaagatgagtgctttatgtttgagaatagaattttatgtcttaggcaaagtgtaactaaatatgggcctatgtggtgagaccctttttgccatttagaaaggagactctagaattctcttgggagactgttgtttgtaatgtagaaatgctgcagaagaaatatgcatagacttttctgttttctagtatctgtgatttgggggtgacttaggaaatagatcattgatgccaatacccatttttactatattcccccttttttctactatttcctctttaatctgggtcacaaactcattttgctgccagtttaactcgagcttcttactaaccctttcactgttcagaaaatggatttggcatgatgtggtggagaaaacattgtattgggaagagagcagcctggggaaagtcacttacctacttgacctccctttgctcttctcagaaaaaagagatttatgttagatttttaattttcttactttcttttttttttggacaaagaacttttgttcaagtagaattcttaagtggtaacagaaataaataaaagagataaagcaggccgggcgcagtggctcatgcttgtaaccctagcactttgggaggcngaggcaggcagatcacgaggtcaagagatggagaatatcctggccaacttggtgaaaccgcgtctctactaaaaataaaaaaaaaaaaaactgggcgtggtggtgtgcgcctgtagtcccagctacctgggaggctgagatagcagaattgcttgaacccagaaggcggaggttgcagtgagccgagatcccgccactgtactccagcctgggtgacagagcaagactccatctc

SEQ ID NO: 314638 - DNA, 4869 bp, Homo sapiens
aggggctgggatgctgggggctgctgaagccgccatcttggattccgcggtagcggaggcggcggtcaggcgccgcttctggggagtggcctttcttttcccctccctcccggttcggtggcggcggctcctcccactggggggggggtggcgcggcggcggtggcatctgcggccatggcggcgactactgccaaccccgaaatgacatcagatgtaccatcactgggtccagccattgcctctggaaactctggacctggaattcaaggtggaggagccattgtccagagggctattaagcggcgaccagggctggattttgatgatgatggagaagggaacagtaaatttttgaggtgtgatgatgatcagatgtctaacgataaggagcggtttgccaggtcggatgatgagcagagctctgcggataaagagagacttgccagggaaaatcacagtgaaattgaacggcggcgacggaacaagatgacagcctacatcacagaactgtcagatatggtacccacctgtagtgccctggctcgaaaaccagacaagctaaccatcttacgcatggcagtttctcacatgaagtccttgcggggaactggcaacacatccactgatggctcctataagccgtctttcctcactgatcaggaactgaaacatttgatcttggaggcagcagatggctttctgtttattgtctcatgtgagacaggcagggtggtgtatgtgtctgactccgtgactcctgttttgaaccagccacagtctgaatggtttggcagcacactctatgatcaggtgcacccagatgatgtggataaacttcgtgagcagctttccacttcagaaaatgccctgacagggcgtatcctggatctaaagactggaacagtgaaaaaggaaggtcagcagtcttccatgagaatgtgtatgggctcaaggagatcgtttatttgccgaatgaggtgtggcagtagctctgtggacccagtttctgtgaataggctgagctttgtgaggaacagatgcaggaatggacttggctctgtaaaggatggggaacctcacttcgtggtggtccactgcacaggctacatcaaggcctggcccccagcaggtgtttccctcccagatgatgacccagaggctggccagggaagcaagttttgcctagtggccattggcagattgcaggtaactagttctcccaactgtacagacatgagtaatgtttgtcaaccaacagagttcatctcccgacacaacattgagggtatcttcacttttgtggatcaccgctgtgtggctactgttggctaccagccacaggaactcttaggaaagaatattgtagaattctgtcatcctgaagaccagcagcttctaagagacagcttccaacaggtagtgaaattaaaaggccaagtgctgtctgtcatgttccggttccggtctaagaaccaagaatggctctggatgagaaccagctcctttactttccagaacccttactcagatgaaattgagtacatcatctgtaccaacaccaatgtgaagaactctagccaagaaccacggcctacactctccaacacaatccagaggccacaactaggtcccacagctaatttacccctggagatgggctcaggacagctggcacccaggcagcagcaacagcaaacagaattggacatggtaccaggaagagatggactggccagctacaatcattcccaggtggttcagcctgtgacaaccacaggaccagaacacagcaagccccttgagaagtcagatggtttatttgcccaggatagagatccaagattttcagaaatctatcacaacatcaatgcggatcagagtaaaggcatctcctccagcactgtccctgccacccaacagctattctcccagggcaacacattccctcctaccccccggccggcagagaatttcaggaatagtggcctagcccctcctgtaaccattgtccagccatcagcttctgcaggacagatgttggcccagatttcccgccactccaaccccacccaaggagcaaccccaacttggacccctactacccgctcaggcttttctgcccagcaggtggctacccaggctactgctaagactcgtacttcccagtttggtgtgggcagctttcagactccatcctccttcagctccatgtccctccctggtgccccaactgcatcgcctggtgctgctgcctaccctagtctcaccaatcgtggatctaactttgctcctgagactggacagactgcaggacaattccagacacggacagcagagggtgtgggtgtctggccacagtggcagggccagcagcctcatcatcgttcaagttctagtgagcaacatgttcaacaaccgccagcacagcaacctggccagcctgaggtcttccaggagatgctgtccatgctgggagatcagagcaacagctacaacaatgaagaattccctgatctaactatgtttccccccttttcagaatagaactattggggtgaggataaggggtgggggagaaaaaatcactgtttgtttttaaaaagcaaatctttctgtaaacagaataaaagttcctctcccttcccttccctcacccctgacatgtaccccctttcccttctggctgttcccctgctctgttgcctctctaaggtaacatttatagaagaaatggaatgaatctccaaggcttttaggactgtctgaaaatttgaggctgggtgaagttaaaacacctttccttatgtctcctgacctgaaattgtatagtgttgatttgtgctgagatcaagaggcaggttagaagaacctgacatccactgtttgccttggatagtatggcttgtttttggaaagaaattctgaagagagtggaggagaggagaaatgtcctcatatttgaggaccatgaaacattgtaggtatatatggggctttagcaagtttgagcataggctctttttgctgcctgtgagcagtccctctggaaagaaacatgtgagtaagtgagagagagtgtgtgtgtatgtgtgtgtgtgtgtgtgtgtgtgcgcacacatgcttctgtatttcactctttctccctattagggagttatgcaaaatttgtccccgattttacctttgtctttctgtgtacttttcaaagagtcctaaggagttaaatcttccaggtattttccacttagtattgcagccaaagaatatttaaataaacgtctttgctgcgcttgcatccatgcccagccaatatacaactgtaaagcaaatatagaaagtcggctgttgatacgattgtctgttatcgaacacattcagtgataaagctgggttactgctgcttttggtgctctcaccttatctggaagatctgcaaacattacctaaataggctggcaagataaacactttctggaacccgagacttggccataaagataatgctgcatttttctgtcagaatcacatatgatgtgtgttctgtagaggttatttctgcatggaaactcaacttcttggattagccgtcccagtgaaaatcctcattgttggagtgtaaaccaaatacgaagccctcttgcaaagtagcctctttcatcccatactcaaaatacccagtttagcaagcaactgagatttaagtctctctggccctaagaggtttttcctctttgctccctccaatcttgagattgggttttgctttagagtgcaagtatcataattccgtatgatagatggggcctggacacccatctcaacagggtcacttggtaattaacaatagccatataaatgcggatacaggttactaccctcaccctttaccttcctcaggtaacagtcgtagataccagcttttttttttttttttttaaattggctttggccagtagctaaagtgcaagactgaattaatgagaagatatattaaatgtagtcataggggactgaggagcaagggtggccttgaagaggccaaaggaatgtccatttgctgagtttcccttccttatgtctccagtctggtgccaggtagtggagtaaaaaaggagacagtttatttttttattctatgtgcacacttacagtatacatatatatttatatcacaatttacgaaaccaaaaagttgagtttccaatggaacccttgttttttaataatcgactttttaaatgtgatcaggactataatattgtacagttattatagggcttttggggaaggggaggatagcgagaagatgctctgggggttttgtttttgcttttccttcagggttttatttttgactgttttgttttcttgttggccatttctgtattgctggcatctgtgctaagctttacagtggcaaaaataatgacatgtagcaaagattttcaaacaaaatattttttccttttgtaaaatttcttgtgttgtgtgatcttgattgcggctttatcattcctttccagttcataaacaacaggcacccacaaccagaggaatctatagtttaagctccagacatacaaacataaggcacattgtgtctttaatttcaggaatcagaaatcatagggttctgatcacattgcacgcctcccccctcacttgtcctcctgatcctgacacattctgagtaacatcagcaggaatgctctgaccatgaggtgggggttttggggtgggcgttgcctgggttcttgggagagaggggaagagtcgggacttgaaaaccactagggcacatctggatgccttcccccagtatgtccttttctggattaaaatgagtgaaatttaaactgttcaagtc

SEQ ID NO: 314639 - DNA, 4783 bp, Homo sapiens
aggggctgggatgctgggggctgctgaagccgccatcttggattccgcggtagcggaggcggcggtcaggcgccgcttctggggagtggcctttcttttcccctccctcccggttcggtggcggcggctcctcccactggggggggggtggcgcggcggcggtggcatctgcggccatggcggcgactactgccaaccccgaaatgacatcagatgtaccatcactgggtccagccattgcctctggaaactctggacctggaattcaaggtggaggagccattgtccagagggctattaagcggcgaccagggctggattttgatgatgatggagaagggaacagtaaatttttgaggtgtgatgatgatcagatgtctaacgataaggagcggtttgccaggtcggatgatgagcagagctctgcggataaagagagacttgccagggaaaatcacagtgaaattgaacggcggcgacggaacaagatgacagcctacatcacagaactgtcagatatggtacccacctgtagtgccctggctcgaaaaccagacaagctaaccatcttacgcatggcagtttctcacatgaagtccttgcggggaactggcaacacatccactgatggctcctataagccgtctttcctcactgatcaggaactgaaacatttgatcttggaggcagcagatggctttctgtttattgtctcatgtgagacaggcagggtggtgtatgtgtctgactccgtgactcctgttttgaaccagccacagtctgaatggtttggcagcacactctatgatcaggtgcacccagatgatgtggataaacttcgtgagcagctttccacttcagaaaatgccctgacagggcgtatcctggatctaaagactggaacagtgaaaaaggaaggtcagcagtcttccatgagaatgtgtatgggctcaaggagatcgtttatttgccgaatgaggtgtggcagtagctctgtggacccagtttctgtgaataggctgagctttgtgaggaacagatgcaggaatggacttggctctgtaaaggatggggaacctcacttcgtggtggtccactgcacaggctacatcaaggcctggcccccagcaggtgtttccctcccagatgatgacccagaggctggccagggaagcaagttttgcctagtggccattggcagattgcaggtaactagttctcccaactgtacagacatgagtaatgtttgtcaaccaacagagttcatctcccgacacaacattgagggtatcttcacttttgtggatcaccgctgtgtggctactgttggctaccagccacaggaactcttaggaaagaatattgtagaattctgtcatcctgaagaccagcagcttctaagagacagcttccaacaggtagtgaaattaaaaggccaagtgctgtctgtcatgttccggttccggtctaagaaccaagaatggctctggatgagaaccagctcctttactttccagaacccttactcagatgaaattgagtacatcatctgtaccaacaccaatgtgaagaactctagccaagaaccacggcctacactctccaacacaatccagaggccacaactaggtcccacagctaatttacccctggagatgggctcaggacagctggcacccaggcagcagcaacagcaaacagaattggacatggtaccaggaagagatggactggccagctacaatcattcccaggtggttcagcctgtgacaaccacaggaccagaacacagcaagccccttgagaagtcagatggtttatttgcccaggatagagatccaagattttcagaaatctatcacaacatcaatgcggatcagagtaaaggcatctcctccagcactgtccctgccacccaacagctattctcccagggcaacacattccctcctaccccccggccggcagagaatttcaggaatagtggcctagcccctcctgtaaccattgtccagccatcagcttctgcaggacagatgttggcccagatttcccgccactccaaccccacccaaggagcaaccccaacttggacccctactacccgctcaggcttttctgcccagcaggtggctacccaggctactgctaagactcgtacttcccagtttggtgtgggcagctttcagactccatcctccttcagctccatgtccctccctggtgccccaactgcatcgcctggtgctgctgcctaccctagtctcaccaatcgtggatctaactttgctcctgagactggacagactgcaggacaattccagacacggacagcagagggtgtgggtgtctggccacagtggcagggccagcagcctcatcatcgttcaagttctagtgagcaacatgttcaacaaccgccagcacagcaacctggccagcctgaggtcttccaggagatgctgtccatgctgggagatcagagcaacagctacaacaatgaagaattccctgatctaactatgtttccccccttttcagaatagaactattggggtgaggataaggggtgggggagaaaaaatcactgtttgtttttaaaaagcaaatctttctgtaaacagaataaaagttcctctcccttcccttccctcacccctgacatgtaccccctttcccttctggctgttcccctgctctgttgcctctctaaggtaacatttatagaagaaatggaatgaatctccaaggcttttaggactgtctgaaaatttgaggctgggtgaagttaaaacacctttccttatgtctcctgacctgaaattgtatagtgttgatttgtgctgagatcaagaggcaggttagaagaacctgacatccactgtttgccttggatagtatggcttgtttttggaaagaaattctgaagagagtggaggagaggagaaatgtcctcatatttgaggaccatgaaacattgtaggtatatatggggctttagcaagtttgagcataggctctttttgctgcctgtgagcagtccctctggaaagaaacatgtgagtaagtgagagagagtgtgtgtgtatgtgtgtgtgtgtgtgtgtgtgtgcgcacacatgcttctgtatttcactctttctccctattagggagttatgcaaaatttgtccccgattttacctttgtctttctgtgtacttttcaaagagtcctaaggagttaaatcttccaggtattttccacttagtattgcagccaaagaatatttaaataaacgtctttgctgcgcttgcatccatgcccagccaatatacaactgtaaagcaaatatagaaagtcggctgttgatacgattgtctgttatcgaacacattcagtgataaagctgggttactgctgcttttggtgctctcaccttatctggaagatctgcaaacattacctaaataggctggcaagataaacactttctggaacccgagacttggccataaagataatgctgcatttttctgtcagaatcacatatgatgtgtgttctgtagaggttatttctgcatggaaactcaacttcttggattagccgtcccagtgaaaatcctcattgttggagtgtaaaccaaatacgaagccctcttgcaaagtagcctctttcatcccatactcaaaatacccagtttagcaagcaactgagatttaagtctctctggccctaagaggtttttcctctttgctccctccaatcttgagattgggttttgctttagagtgcaagtatcataattccgtatgatagatggggcctggacacccatctcaacagggtcacttggtaattaacaatagccatataaatgcggatacaggttactaccctcaccctttaccttcctcaggtaacagtcgtagataccagcttttttttttttttttttaaattggctttggccagtagctaaagtgcaagactgaattaatgagaagatatattaaatgtagtcataggggactgaggagcaagggtggccttgaagaggccaaaggaatgtccatttgctgagtttcccttccttatgtctccagtctggtgccaggtagtggagtaaaaaaggagacagtttatttttttattctatgtgcacacttacagtatacatatatatttatatcacaatttacgaaaccaaaaagttgagtttccaatggaacccttgttttttaataatcgactttttaaatgtgatcaggactataatattgtacagttattatagggcttttggggaaggggaggatagcgagaagatgctctgggggttttgtttttgcttttccttcagggttttatttttgactgttttgttttcttgttggccatttctgtattgctggcatctgtgctaagctttacagtggcaaaaataatgacatgtagcaaagattttcaaacaaaatattttttccttttgtaaaaaaaaaaaaaaaaaaaaaaacaaaaaaaaaaaaaaaaaagggggggggggccaaaagaaacccagagggggccaaagtacagggacaccgttgcgtgtgacacagggggcccaataagaggcccccaatttaacgtcaacatgcccgcccgtatcacacacgctgtaagctggacaaccgctcaacggggggaaaatttgagaaaagacccctatatacgggcggggcacaacctatggggaacatcccctaagaacttttataacccgagcgaaacaataacatttcaagcgttaagatgggtacg

SEQ ID NO: 314640 - DNA, 4942 bp, Homo sapiens
tccacctcccagattcaagtgattctcctgtctcagcctcccaagtagctgggattacagatgcatgccactgtgccctgctaatttttgtatttttagtagagacaggatttcaccatgttggccaggccggtctcaaactcctggcctcaagtaatccacctgcctccatctcccaaagtgctgggattacaggcatgagccaccatgcctgacctgtcgtttcttaaaacagcttttgttctgagggagtggtaatttacaaaggatgtgaagtttccaggaaatagggggaagggaattacattatcttcttgttctctgtctgccttattagttctgtttcatgcttgctttgcatgagaaggttggcaaaccttattttaactgctgagacttaagcatcactaaatctgaataccacattcttcagcagcacacttggtatccatatcactctccctgctaccaaatgaccagatgtgaccacctggatggggcttctctttctttccatgcagggaaaatcacagtgaaattgaacggcggcgacggaacaagatgacagcctacatcacagaactgtcagatatggtacccacctgtagtgccctggctcgaaaaccagacaagctaaccatcttacgcatggcagtttctcacatgaagtccttgcggggaactggcaacacatccactgatggctcctataagccgtctttcctcactgatcaggaactgaaacatttgatcttggaggcagcagatggctttctgtttattgtctcatgtgagacaggcagggtggtgtatgtgtctgactccgtgactcctgttttgaaccagccacagtctgaatggtttggcagcacactctatgatcaggtgcacccagatgatgtggataaacttcgtgagcagctttccacttcagaaaatgccctgacagggcgtatcctggatctaaagactggaacagtgaaaaaggaaggtcagcagtcttccatgagaatgtgtatgggctcaaggagatcgtttatttgccgaatgaggtgtggcagtagctctgtggacccagtttctgtgaataggctgagctttgtgaggaacagatgcaggaatggacttggctctgtaaaggatggggaacctcacttcgtggtggtccactgcacaggctacatcaaggcctggcccccagcaggtgtttccctcccagatgatgacccagaggctggccagggaagcaagttttgcctagtggccattggcagattgcaggtaactagttctcccaactgtacagacatgagtaatgtttgtcaaccaacagagttcatctcccgacacaacattgagggtatcttcacttttgtggatcaccgctgtgtggctactgttggctaccagccacaggaactcttaggaaagaatattgtagaattctgtcatcctgaagaccagcagcttctaagagacagcttccaacaggtagtgaaattaaaaggccaagtgctgtctgtcatgttccggttccggtctaagaaccaagaatggctctggatgagaaccagctcctttactttccagaacccttactcagatgaaattgagtacatcatctgtaccaacaccaatgtgaagaactctagccaagaaccacggcctacactctccaacacaatccagaggccacaactaggtcccacagctaatttacccctggagatgggctcaggacagctggcacccaggcagcagcaacagcaaacagaattggacatggtaccaggaagagatggactggccagctacaatcattcccaggtggttcagcctgtgacaaccacaggaccagaacacagcaagccccttgagaagtcagatggtttatttgcccaggatagagatccaagattttcagaaatctatcacaacatcaatgcggatcagagtaaaggcatctcctccagcactgtccctgccacccaacagctattctcccagggcaacacattccctcctaccccccggccggcagagaatttcaggaatagtggcctagcccctcctgtaaccattgtccagccatcagcttctgcaggacagatgttggcccagatttcccgccactccaaccccacccaaggagcaaccccaacttggacccctactacccgctcaggcttttctgcccagcaggtggctacccaggctactgctaagactcgtacttcccagtttggtgtgggcagctttcagactccatcctccttcagctccatgtccctccctggtgccccaactgcatcgcctggtgctgctgcctaccctagtctcaccaatcgtggatctaactttgctcctgagactggacagactgcaggacaattccagacacggacagcagagggtgtgggtgtctggccacagtggcagggccagcagcctcatcatcgttcaagttctagtgagcaacatgttcaacaaccgccagcacagcaacctggccagcctgaggtcttccaggagatgctgtccatgctgggagatcagagcaacagctacaacaatgaagaattccctgatctaactatgtttccccccttttcagaatagaactattggggtgaggataaggggtgggggagaaaaaatcactgtttgtttttaaaaagcaaatctttctgtaaacagaataaaagttcctctcccttcccttccctcacccctgacatgtaccccctttcccttctggctgttcccctgctctgttgcctctctaaggtaacatttatagaagaaatggaatgaatctccaaggcttttaggactgtctgaaaatttgaggctgggtgaagttaaaacacctttccttatgtctcctgacctgaaattgtatagtgttgatttgtgctgagatcaagaggcaggttagaagaacctgacatccactgtttgccttggatagtatggcttgtttttggaaagaaattctgaagagagtggaggagaggagaaatgtcctcatatttgaggaccatgaaacattgtaggtatatatggggctttagcaagtttgagcataggctctttttgctgcctgtgagcagtccctctggaaagaaacatgtgagtaagtgagagagagtgtgtgtgtatgtgtgtgtgtgtgtgtgtgtgtgcgcacacatgcttctgtatttcactctttctccctattagggagttatgcaaaatttgtccccgattttacctttgtctttctgtgtacttttcaaagagtcctaaggagttaaatcttccaggtattttccacttagtattgcagccaaagaatatttaaataaacgtctttgctgcgcttgcatccatgcccagccaatatacaactgtaaagcaaatatagaaagtcggctgttgatacgattgtctgttatcgaacacattcagtgataaagctgggttactgctgcttttggtgctctcaccttatctggaagatctgcaaacattacctaaataggctggcaagataaacactttctggaacccgagacttggccataaagataatgctgcatttttctgtcagaatcacatatgatgtgtgttctgtagaggttatttctgcatggaaactcaacttcttggattagccgtcccagtgaaaatcctcattgttggagtgtaaaccaaatacgaagccctcttgcaaagtagcctctttcatcccatactcaaaatacccagtttagcaagcaactgagatttaagtctctctggccctaagaggtttttcctctttgctccctccaatcttgagattgggttttgctttagagtgcaagtatcataattccgtatgatagatggggcctggacacccatctcaacagggtcacttggtaattaacaatagccatataaatgcggatacaggttactaccctcaccctttaccttcctcaggtaacagtcgtagataccagcttttttttttttttttttaaattggctttggccagtagctaaagtgcaagactgaattaatgagaagatatattaaatgtagtcataggggactgaggagcaagggtggccttgaagaggccaaaggaatgtccatttgctgagtttcccttccttatgtctccagtctggtgccaggtagtggagtaaaaaaggagacagtttatttttttattctatgtgcacacttacagtatacatatatatttatatcacaatttacgaaaccaaaaagttgagtttccaatggaacccttgttttttaataatcgactttttaaatgtgatcaggactataatattgtacagttattatagggcttttggggaaggggaggatagcgagaagatgctctgggggttttgtttttgcttttccttcagggttttatttttgactgttttgttttcttgttggccatttctgtattgctggcatctgtgctaagctttacagtggcaaaaataatgacatgtagcaaagattttcaaacaaaatattttttccttttgtaaaatttcttgtgttgtgtgatcttgattgcggctttatcattcctttccagttcataaacaacaggcacccacaaccagaggaatctatagtttaagctccagacatacaaacataaggcacattgtgtctttaatttcaggaatcagaaatcatagggttctgatcacattgcacgcctcccccctcacttgtcctcctgatcctgacacattctgagtaacatcagcaggaatgctctgaccatgaggtgggggttttggggtgggcgttgcctgggttcttgggagagaggggaagagtcgggacttgaaaaccactagggcacatctggatgccttcccccagtatgtccttttctggattaaaatgagtgaaatttaaactgttcaagtc

SEQ ID NO: 314641 - DNA, 4824 bp, Homo sapiens
aggggctgggatgctgggggctgctgaagccgccatcttggattccgcggtagcggaggcggcggtcaggcgccgcttctggggagtggcctttcttttcccctccctcccggttcggtggcggcggctcctcccactggggggggggtggcgcggcggcggtggcatctgcggccatggcggcgactactgccaaccccgaaatgacatcagatgtaccatcactgggtccagccattgcctctggaaactctggacctggaattcaaggtggaggagccattgtccagagggctattaagcggcgaccagggctggattttgatgatgatggagaagggaacagtaaatttttgaggtgtgatgatgatcagatgtctaacgataaggagcggtttgccagggaaaatcacagtgaaattgaacggcggcgacggaacaagatgacagcctacatcacagaactgtcagatatggtacccacctgtagtgccctggctcgaaaaccagacaagctaaccatcttacgcatggcagtttctcacatgaagtccttgcggggaactggcaacacatccactgatggctcctataagccgtctttcctcactgatcaggaactgaaacatttgatcttggaggcagcagatggctttctgtttattgtctcatgtgagacaggcagggtggtgtatgtgtctgactccgtgactcctgttttgaaccagccacagtctgaatggtttggcagcacactctatgatcaggtgcacccagatgatgtggataaacttcgtgagcagctttccacttcagaaaatgccctgacagggcgtatcctggatctaaagactggaacagtgaaaaaggaaggtcagcagtcttccatgagaatgtgtatgggctcaaggagatcgtttatttgccgaatgaggtgtggcagtagctctgtggacccagtttctgtgaataggctgagctttgtgaggaacagatgcaggaatggacttggctctgtaaaggatggggaacctcacttcgtggtggtccactgcacaggctacatcaaggcctggcccccagcaggtgtttccctcccagatgatgacccagaggctggccagggaagcaagttttgcctagtggccattggcagattgcaggtaactagttctcccaactgtacagacatgagtaatgtttgtcaaccaacagagttcatctcccgacacaacattgagggtatcttcacttttgtggatcaccgctgtgtggctactgttggctaccagccacaggaactcttaggaaagaatattgtagaattctgtcatcctgaagaccagcagcttctaagagacagcttccaacaggtagtgaaattaaaaggccaagtgctgtctgtcatgttccggttccggtctaagaaccaagaatggctctggatgagaaccagctcctttactttccagaacccttactcagatgaaattgagtacatcatctgtaccaacaccaatgtgaagaactctagccaagaaccacggcctacactctccaacacaatccagaggccacaactaggtcccacagctaatttacccctggagatgggctcaggacagctggcacccaggcagcagcaacagcaaacagaattggacatggtaccaggaagagatggactggccagctacaatcattcccaggtggttcagcctgtgacaaccacaggaccagaacacagcaagccccttgagaagtcagatggtttatttgcccaggatagagatccaagattttcagaaatctatcacaacatcaatgcggatcagagtaaaggcatctcctccagcactgtccctgccacccaacagctattctcccagggcaacacattccctcctaccccccggccggcagagaatttcaggaatagtggcctagcccctcctgtaaccattgtccagccatcagcttctgcaggacagatgttggcccagatttcccgccactccaaccccacccaaggagcaaccccaacttggacccctactacccgctcaggcttttctgcccagcaggtggctacccaggctactgctaagactcgtacttcccagtttggtgtgggcagctttcagactccatcctccttcagctccatgtccctccctggtgccccaactgcatcgcctggtgctgctgcctaccctagtctcaccaatcgtggatctaactttgctcctgagactggacagactgcaggacaattccagacacggacagcagagggtgtgggtgtctggccacagtggcagggccagcagcctcatcatcgttcaagttctagtgagcaacatgttcaacaaccgccagcacagcaacctggccagcctgaggtcttccaggagatgctgtccatgctgggagatcagagcaacagctacaacaatgaagaattccctgatctaactatgtttccccccttttcagaatagaactattggggtgaggataaggggtgggggagaaaaaatcactgtttgtttttaaaaagcaaatctttctgtaaacagaataaaagttcctctcccttcccttccctcacccctgacatgtaccccctttcccttctggctgttcccctgctctgttgcctctctaaggtaacatttatagaagaaatggaatgaatctccaaggcttttaggactgtctgaaaatttgaggctgggtgaagttaaaacacctttccttatgtctcctgacctgaaattgtatagtgttgatttgtgctgagatcaagaggcaggttagaagaacctgacatccactgtttgccttggatagtatggcttgtttttggaaagaaattctgaagagagtggaggagaggagaaatgtcctcatatttgaggaccatgaaacattgtaggtatatatggggctttagcaagtttgagcataggctctttttgctgcctgtgagcagtccctctggaaagaaacatgtgagtaagtgagagagagtgtgtgtgtatgtgtgtgtgtgtgtgtgtgtgtgcgcacacatgcttctgtatttcactctttctccctattagggagttatgcaaaatttgtccccgattttacctttgtctttctgtgtacttttcaaagagtcctaaggagttaaatcttccaggtattttccacttagtattgcagccaaagaatatttaaataaacgtctttgctgcgcttgcatccatgcccagccaatatacaactgtaaagcaaatatagaaagtcggctgttgatacgattgtctgttatcgaacacattcagtgataaagctgggttactgctgcttttggtgctctcaccttatctggaagatctgcaaacattacctaaataggctggcaagataaacactttctggaacccgagacttggccataaagataatgctgcatttttctgtcagaatcacatatgatgtgtgttctgtagaggttatttctgcatggaaactcaacttcttggattagccgtcccagtgaaaatcctcattgttggagtgtaaaccaaatacgaagccctcttgcaaagtagcctctttcatcccatactcaaaatacccagtttagcaagcaactgagatttaagtctctctggccctaagaggtttttcctctttgctccctccaatcttgagattgggttttgctttagagtgcaagtatcataattccgtatgatagatggggcctggacacccatctcaacagggtcacttggtaattaacaatagccatataaatgcggatacaggttactaccctcaccctttaccttcctcaggtaacagtcgtagataccagcttttttttttttttttttaaattggctttggccagtagctaaagtgcaagactgaattaatgagaagatatattaaatgtagtcataggggactgaggagcaagggtggccttgaagaggccaaaggaatgtccatttgctgagtttcccttccttatgtctccagtctggtgccaggtagtggagtaaaaaaggagacagtttatttttttattctatgtgcacacttacagtatacatatatatttatatcacaatttacgaaaccaaaaagttgagtttccaatggaacccttgttttttaataatcgactttttaaatgtgatcaggactataatattgtacagttattatagggcttttggggaaggggaggatagcgagaagatgctctgggggttttgtttttgcttttccttcagggttttatttttgactgttttgttttcttgttggccatttctgtattgctggcatctgtgctaagctttacagtggcaaaaataatgacatgtagcaaagattttcaaacaaaatattttttccttttgtaaaatttcttgtgttgtgtgatcttgattgcggctttatcattcctttccagttcataaacaacaggcacccacaaccagaggaatctatagtttaagctccagacatacaaacataaggcacattgtgtctttaatttcaggaatcagaaatcatagggttctgatcacattgcacgcctcccccctcacttgtcctcctgatcctgacacattctgagtaacatcagcaggaatgctctgaccatgaggtgggggttttggggtgggcgttgcctgggttcttgggagagaggggaagagtcgggacttgaaaaccactagggcacatctggatgccttcccccagtatgtccttttctggattaaaatgagtgaaatttaaactgttcaagtc

SEQ ID NO: 314642 - DNA, 3389 bp, Homo sapiens
tcccgctggggagtacggaatagagagcatccttggaggctgacctgtccaagttgctcatcccatttaaagggtttggagaacaatggcagatgcatcctaagtttttctatcctggtaaatgagagaagctaagtcaaggtatattgaattagaagcagggaaataaagaattttacaaggctgtcatctgtcccagctgcagcagcaacagcaaacagaattggacatggtaccaggaagagatggactggccagctacaatcattcccaggtggttcagcctgtgacaaccacaggaccagaacacagcaagccccttgagaagtcagatggtttatttgcccaggatagagatccaagattttcagaaatctatcacaacatcaatgcggatcagagtaaaggcatctcctccagcactgtccctgccacccaacagctattctcccagggcaacacattccctcctaccccccggccggcagagaatttcaggaatagtggcctagcccctcctgtaaccattgtccagccatcagcttctgcaggacagatgttggcccagatttcccgccactccaaccccacccaaggagcaaccccaacttggacccctactacccgctcaggcttttctgcccagcaggtggctacccaggctactgctaagactcgtacttcccagtttggtgtgggcagctttcagactccatcctccttcagctccatgtccctccctggtgccccaactgcatcgcctggtgctgctgcctaccctagtctcaccaatcgtggatctaactttgctcctgagactggacagactgcaggacaattccagacacggacagcagagggtgtgggtgtctggccacagtggcagggccagcagcctcatcatcgttcaagttctagtgagcaacatgttcaacaaccgccagcacagcaacctggccagcctgaggtcttccaggagatgctgtccatgctgggagatcagagcaacagctacaacaatgaagaattccctgatctaactatgtttccccccttttcagaatagaactattggggtgaggataaggggtgggggagaaaaaatcactgtttgtttttaaaaagcaaatctttctgtaaacagaataaaagttcctctcccttcccttccctcacccctgacatgtaccccctttcccttctggctgttcccctgctctgttgcctctctaaggtaacatttatagaagaaatggaatgaatctccaaggcttttaggactgtctgaaaatttgaggctgggtgaagttaaaacacctttccttatgtctcctgacctgaaattgtatagtgttgatttgtgctgagatcaagaggcaggttagaagaacctgacatccactgtttgccttggatagtatggcttgtttttggaaagaaattctgaagagagtggaggagaggagaaatgtcctcatatttgaggaccatgaaacattgtaggtatatatggggctttagcaagtttgagcataggctctttttgctgcctgtgagcagtccctctggaaagaaacatgtgagtaagtgagagagagtgtgtgtgtatgtgtgtgtgtgtgtgtgtgtgtgcgcacacatgcttctgtatttcactctttctccctattagggagttatgcaaaatttgtccccgattttacctttgtctttctgtgtacttttcaaagagtcctaaggagttaaatcttccaggtattttccacttagtattgcagccaaagaatatttaaataaacgtctttgctgcgcttgcatccatgcccagccaatatacaactgtaaagcaaatatagaaagtcggctgttgatacgattgtctgttatcgaacacattcagtgataaagctgggttactgctgcttttggtgctctcaccttatctggaagatctgcaaacattacctaaataggctggcaagataaacactttctggaacccgagacttggccataaagataatgctgcatttttctgtcagaatcacatatgatgtgtgttctgtagaggttatttctgcatggaaactcaacttcttggattagccgtcccagtgaaaatcctcattgttggagtgtaaaccaaatacgaagccctcttgcaaagtagcctctttcatcccatactcaaaatacccagtttagcaagcaactgagatttaagtctctctggccctaagaggtttttcctctttgctccctccaatcttgagattgggttttgctttagagtgcaagtatcataattccgtatgatagatggggcctggacacccatctcaacagggtcacttggtaattaacaatagccatataaatgcggatacaggttactaccctcaccctttaccttcctcaggtaacagtcgtagataccagcttttttttttttttttttaaattggctttggccagtagctaaagtgcaagactgaattaatgagaagatatattaaatgtagtcataggggactgaggagcaagggtggccttgaagaggccaaaggaatgtccatttgctgagtttcccttccttatgtctccagtctggtgccaggtagtggagtaaaaaaggagacagtttatttttttattctatgtgcacacttacagtatacatatatatttatatcacaatttacgaaaccaaaaagttgagtttccaatggaacccttgttttttaataatcgactttttaaatgtgatcaggactataatattgtacagttattatagggcttttggggaaggggaggatagcgagaagatgctctgggggttttgtttttgcttttccttcagggttttatttttgactgttttgttttcttgttggccatttctgtattgctggcatctgtgctaagctttacagtggcaaaaataatgacatgtagcaaagattttcaaacaaaatattttttccttttgtaaaatttcttgtgttgtgtgatcttgattgcggctttatcattcctttccagttcataaacaacaggcacccacaaccagaggaatctatagtttaagctccagacatacaaacataaggcacattgtgtctttaatttcaggaatcagaaatcatagggttctgatcacattgcacgcctcccccctcacttgtcctcctgatcctgacacattctgagtaacatcagcaggaatgctctgaccatgaggtgggggttttggggtgggcgttgcctgggttcttgggagagaggggaagagtcgggacttgaaaaccactagggcacatctggatgccttcccccagtatgtccttttctggattaaaatgagtgaaatttaaactgttcaagtc

SEQ ID NO: 314643 - DNA, 3191 bp, Homo sapiens
ccagagtcaagatccaagatgcacaccggctgcaccatgtcagcagcctggactggccagctacaatcattcccaggtggttcagcctgtgacaaccacaggaccagaacacagcaagccccttgagaagtcagatggtttatttgcccaggatagagatccaagattttcagaaatctatcacaacatcaatgcggatcagagtaaaggcatctcctccagcactgtccctgccacccaacagctattctcccagggcaacacattccctcctaccccccggccggcagagaatttcaggaatagtggcctagcccctcctgtaaccattgtccagccatcagcttctgcaggacagatgttggcccagatttcccgccactccaaccccacccaaggagcaaccccaacttggacccctactacccgctcaggcttttctgcccagcaggtggctacccaggctactgctaagactcgtacttcccagtttggtgtgggcagctttcagactccatcctccttcagctccatgtccctccctggtgccccaactgcatcgcctggtgctgctgcctaccctagtctcaccaatcgtggatctaactttgctcctgagactggacagactgcaggacaattccagacacggacagcagagggtgtgggtgtctggccacagtggcagggccagcagcctcatcatcgttcaagttctagtgagcaacatgttcaacaaccgccagcacagcaacctggccagcctgaggtcttccaggagatgctgtccatgctgggagatcagagcaacagctacaacaatgaagaattccctgatctaactatgtttccccccttttcagaatagaactattggggtgaggataaggggtgggggagaaaaaatcactgtttgtttttaaaaagcaaatctttctgtaaacagaataaaagttcctctcccttcccttccctcacccctgacatgtaccccctttcccttctggctgttcccctgctctgttgcctctctaaggtaacatttatagaagaaatggaatgaatctccaaggcttttaggactgtctgaaaatttgaggctgggtgaagttaaaacacctttccttatgtctcctgacctgaaattgtatagtgttgatttgtgctgagatcaagaggcaggttagaagaacctgacatccactgtttgccttggatagtatggcttgtttttggaaagaaattctgaagagagtggaggagaggagaaatgtcctcatatttgaggaccatgaaacattgtaggtatatatggggctttagcaagtttgagcataggctctttttgctgcctgtgagcagtccctctggaaagaaacatgtgagtaagtgagagagagtgtgtgtgtatgtgtgtgtgtgtgtgtgtgtgtgcgcacacatgcttctgtatttcactctttctccctattagggagttatgcaaaatttgtccccgattttacctttgtctttctgtgtacttttcaaagagtcctaaggagttaaatcttccaggtattttccacttagtattgcagccaaagaatatttaaataaacgtctttgctgcgcttgcatccatgcccagccaatatacaactgtaaagcaaatatagaaagtcggctgttgatacgattgtctgttatcgaacacattcagtgataaagctgggttactgctgcttttggtgctctcaccttatctggaagatctgcaaacattacctaaataggctggcaagataaacactttctggaacccgagacttggccataaagataatgctgcatttttctgtcagaatcacatatgatgtgtgttctgtagaggttatttctgcatggaaactcaacttcttggattagccgtcccagtgaaaatcctcattgttggagtgtaaaccaaatacgaagccctcttgcaaagtagcctctttcatcccatactcaaaatacccagtttagcaagcaactgagatttaagtctctctggccctaagaggtttttcctctttgctccctccaatcttgagattgggttttgctttagagtgcaagtatcataattccgtatgatagatggggcctggacacccatctcaacagggtcacttggtaattaacaatagccatataaatgcggatacaggttactaccctcaccctttaccttcctcaggtaacagtcgtagataccagcttttttttttttttttttaaattggctttggccagtagctaaagtgcaagactgaattaatgagaagatatattaaatgtagtcataggggactgaggagcaagggtggccttgaagaggccaaaggaatgtccatttgctgagtttcccttccttatgtctccagtctggtgccaggtagtggagtaaaaaaggagacagtttatttttttattctatgtgcacacttacagtatacatatatatttatatcacaatttacgaaaccaaaaagttgagtttccaatggaacccttgttttttaataatcgactttttaaatgtgatcaggactataatattgtacagttattatagggcttttggggaaggggaggatagcgagaagatgctctgggggttttgtttttgcttttccttcagggttttatttttgactgttttgttttcttgttggccatttctgtattgctggcatctgtgctaagctttacagtggcaaaaataatgacatgtagcaaagattttcaaacaaaatattttttccttttgtaaaatttcttgtgttgtgtgatcttgattgcggctttatcattcctttccagttcataaacaacaggcacccacaaccagaggaatctatagtttaagctccagacatacaaacataaggcacattgtgtctttaatttcaggaatcagaaatcatagggttctgatcacattgcacgcctcccccctcacttgtcctcctgatcctgacacattctgagtaacatcagcaggaatgctctgaccatgaggtgggggttttggggtgggcgttgcctgggttcttgggagagaggggaagagtcgggacttgaaaaccactagggcacatctggatgccttcccccagtatgtccttttctggattaaaatgagtgaaatttaaactgttcaagtc

SEQ ID NO: 314644 - DNA, 1817 bp, Homo sapiens
  misc_feature (1759)..(1759): n is a, c, g, or t
aggggctgggatgctgggggctgctgaagccgccatcttggattccgcggtagcggaggcggcggtcaggcgccgcttctggggagtggcctttcttttcccctccctcccggttcggtggcggcggctcctcccactggggggggggtggcgcggcggcggtggcatctgcggccatggcggcgactactgccaaccccgaaatgacatcagatgtaccatcactgggtccagccattgcctctggaaactctggacctggaattcaaggtggaggagccattgtccagagggctattaagcggcgaccagggctggattttgatgatgatggagaagggaacagtaaatttttgaggtgtgatgatgatcagatgtctaacgataaggagcggtttgccaggtcggatgatgagcagagctctgcggataaagagagacttgccagggaaaatcacagtgaaattgaacggcggcgacggaacaagatgacagcctacatcacagaactgtcagatatggtacccacctgtagtgccctggctcgaaaaccagacaagctaaccatcttacgcatggcagtttctcacatgaagtccttgcggggaactggcaacacatccactgatggctcctataagccgtctttcctcactgatcaggaactgaaacatttgatcttggaggcagcagatggctttctgtttattgtctcatgtgagacaggcagggtggtgtatgtgtctgactccgtgactcctgttttgaaccagccacagtctgaatggtttggcagcacactctatgatcaggtgcacccagatgatgtggataaacttcgtgagcagctttccacttcagaaaatgccctgacagggcgtatcctggatctaaagactggaacagtgaaaaaggaaggtcagcagtcttccatgagaatgtgtatgggctcaaggagatcgtttatttgccgaatgaggtgtggcagtagctctgtggacccagtttctgtgaataggctgagctttgtgaggaacagatgcaggaatggacttggctctgtaaaggatggggaacctcacttcgtggtggtccactgcacaggctacatcaaggcctggcccccagcaggtgtttccctcccagatgatgacccagaggctggccagggaagcaagttttgcctagtggccattggcagattgcaggtaactagttctcccaactgtacagacatgagtaatgtttgtcaaccaacagagttcatctcccgacacaacattgagggtatcttcacttttgtggatcaccgctgtgtggctactgttggctaccagccacaggaactcttaggaaagaatattgtagaattctgtcatcctgaagaccagcagcttctaagagacagcttccaacaggtagtgaaattaaaaggccaagtgctgtctgtcatgttccggttccggtctaagaaccaagaatggctctggatgagaaccagctcctttactttccagaacccttactcagatgaaattgagtacatcatctgtaccaacaccaatgtgaagaactctagccaagaaccacggcctacactctccaacacaatccagaggccacaactaggtcccacagctaatttacccctggagatgggctcaggacagctggcacccaggcagcagcaacagcaaacagaattggacatggtaccaggaagagatggactggccagctacaatcattcccaggtggntcagcctgtgacaaccacagcgactgcctcacagctaatcactagtgaatttgcggcc

SEQ ID NO: 314645 - DNA, 1161 bp, Homo sapiens
aggggctgggatgctgggggctgctgaagccgccatcttggattccgcggtagcggaggcggcggtcaggcgccgcttctggggagtggcctttcttttcccctccctcccggttcggtggcggcggctcctcccactggggggggggtggcgcggcggcggtggcatctgcggccatggcggcgactactgccaaccccgaaatgacatcagatgtaccatcactgggtccagccattgcctctggaaactctggacctggaattcaaggtggaggagccattgtccagagggctattaagcggcgaccagggctggattttgatgatgatggagaagggaacagtaaatttttgaggtgtgatgatgatcagatgtctaacgataaggagcggtttgccaggtcggatgatgagcagagctctgcggataaagagagacttgccagggaaaatcacagtgaaattgaacggcggcgacggaacaagatgacagcctacatcacagaactgtcagatatggtacccacctgtagtgccctggctcgaaaaccagacaagctaaccatcttacgcatggcagtttctcacatgaagtccttgcggggaactggcaacacatccactgatggctcctataagccgtctttcctcactgatcaggaactgaaacatttgatcttggaggcagcagatggctttctgtttattgtctcatgtgagacaggcagggtggtgtatgtgtctgactccgtgactcctgttttgaaccagccacagtctgaatggtttggcagcacactctatgatcaggtgcacccagatgatgtggataaacttcgtgagcagctttccacttcagaaaatgccctgacagggcgtatcctggatctaaagactggaacagtgaaaaaggaaggtcagcagtcttccatgagaatgtgtatgggctcaaggagatcgtttatttgccgaatgaggtgtggcagtagctctgtggacccagtttctgtgaataggctgagctttgtgaggaacagatgcaggaatggacttggctctgtaaaggatggggaacctcacttcgtggtggtccactgcacaggctacatcaaggcctggcccccagcagtaagaaagtgaaatagtaaatatttcccct

SEQ ID NO: 314646 - DNA, 578 bp, Homo sapiens
cggtgcctggcccataaataggtctattttgaatctttacttgtctgagttttgaaggcatttgagttggaggtccccgttaaaccttttaacgtcacgtttctgaaggtgtttccctcccagatgatgacccagaggctggccagggaagcaagttttgcctagtggccattggcagattgcaggcaagtatgaattttccacatctatattcccgttcaattagagcagatcttcaggactcattcctgttaattttcttttactttctgaatacaaatgaagaattccataaaactctcaaaatttgaaggaatatggcatttatagtgaccattgctattcttggatttaagtaaagttgaaaagtatgagaggagggagatctttttccccttgtcttaattttagctttactatgcttaattttctatttccagttaatttcctttgcccctatacaaaagaagaaagatccttttcattgtatcattacctgactaacaatagaaaagtggaattattttgattttttcataagtatagataagtttcttggttacttgtaccatatcaac

SEQ ID NO: 314647 - DNA, 1192 bp, Homo sapiens
tccacctcccagattcaagtgattctcctgtctcagcctcccaagtagctgggattacagatgcatgccactgtgccctgctaatttttgtatttttagtagagacaggatttcaccatgttggccaggccggtctcaaactcctggcctcaagtaatccacctgcctccatctcccaaagtgctgggattacaggcatgagccaccatgcctgacctgtcgtttcttaaaacagcttttgttctgagggagtggtaatttacaaaggatgtgaagtttccaggaaatagggggaagggaattacattatcttcttgttctctgtctgccttattagttctgtttcatgcttgctttgcatgagaaggttggcaaaccttattttaactgctgagacttaagcatcactaaatctgaataccacattcttcagcagcacacttggtatccatatcactctccctgctaccaaatgaccagatgtgaccacctggatggggcttctctttctttccatgcagggaaaatcacagtgaaattgaacggcggcgacggaacaagatgacagcctacatcacagaactgtcagatatggtacccacctgtagtgccctggctcgaaaaccagacaagctaaccatcttacgcatggcagtttctcacatgaagtccttgcggggaactggcaacacatccactgatggctcctataagccgtctttcctcactgatcaggtctctgggacttatagttctgagagagtctggaatctgggtgaatctcttgaaagttttcgttttttggacaagaattcagcttttcaggaagaagtcagacaatgggaaaacgaatttcaatccttggctataacattaattagccattgggacaatgagaagtagagaagagttgaaaactatttaataagctaataagtattaatatttgagaacttgactcatgaatatagcatataggatggaagaagaacagtggaatcacagaggaaatgactatgtccatggaaccaattttctttcttgcctttagggttatagaagatggaagaaatctatttcttatccctgaagcagcttctagttttagtaatagaatgaatctgtccccctttggtgatagaagaactgagagtctaattgttgcttagggatgtgctctgttacatgtgat

SEQ ID NO: 314648 - DNA, 4829 bp, Homo sapiens
aggggctgggatgctgggggctgctgaagccgccatcttggattccgcggtagcggaggcggcggtcaggcgccgcttctggggagtggcctttcttttcccctccctcccggttcggtggcggcggctcctcccactggggggggggtggcgcggcggcggtggcatctgcggccatggcggcgactactgccaaccccgaaatgacatcagatgtaccatcactgggtccagccattgcctctggaaactctggacctggaattcaaggtggaggagccattgtccagagggctattaagcggcgaccagggctggattttgatgatgatggagaagggaacagtaaatttttgaggtgtgatgatgatcagatgtctaacgataaggagcggtttgccaggtcggatgatgagcagagctctgcggataaagagagacttgccagggaaaatcacagtgaaattgaacggcggcgacggaacaagatgacagcctacatcacagaactgtcagatatggtacccacctgtagtgccctggctcgaaaaccagacaagctaaccatcttacgcatggcagtttctcacatgaagtccttgcggggaactggcaacacatccactgatggctcctataagccgtctttcctcactgatcaggaactgaaacatttgatcttggaggcagcagatggctttctgtttattgtctcatgtgagacaggcagggtggtgtatgtgtctgactccgtgactcctgttttgaaccagccacagtctgaatggtttggcagcacactctatgatcaggtgcacccagatgatgtggataaacttcgtgagcagctttccacttcagaaaatgccctgacagggcgtatcctggatctaaagactggaacagtgaaaaaggaaggtcagcagtcttccatgagaatgtgtatgggctcaaggagatcgtttatttgccgaatgaggtgtggcagtagctctgtggacccagtttctgtgaataggctgagctttgtgaggaacagatgcaggaatggacttggctctgtaaaggatggggaacctcacttcgtggtggtccactgcacaggctacatcaaggcctggcccccagcaggtgtttccctcccagatgatgacccagaggctggccagggaagcaagttttgcctagtggccattggcagattgcaggtaactagttctcccaactgtacagacatgagtaatgtttgtcaaccaacagagttcatctcccgacacaacattgagggtatcttcacttttgtggatcaccgctgtgtggctactgttggctaccagccacaggaactcttaggaaagaatattgtagaattctgtcatcctgaagaccagcagcttctaagagacagcttccaacaggtagtgaaattaaaaggccaagtgctgtctgtcatgttccggttccggtctaagaaccaagaatggctctggatgagaaccagctcctttactttccagaacccttactcagatgaaattgagtacatcatctgtaccaacaccaatgtgaagaactctagccaagaaccacggcctacactctccaacacaatccagaggccacaactaggtcccacagctaatttacccctggagatgggctcaggacagctggcacccaggcagcagcaacagcaaacagaattggacatggtaccaggaagagatggactggccagctacaatcattcccaggtggttcagcctgtgacaaccacaggaccagaacacagcaagccccttgagaagtcagatggtttatttgcccaggatagagatccaagattttcagaaatctatcacaacatcaatgcggatcagagtaaaggcatctcctccagcactgtccctgccacccaacagctattctcccagggcaacacattccctcctaccccccggccggcagagaatttcaggaatagtggcctagcccctcctgtaaccattgtccagccatcagcttctgcaggacagatgttggcccagatttcccgccactccaaccccacccaaggagcaaccccaacttggacccctactacccgctcaggcttttctgcccagcaggtggctacccaggctactgctaagactcgtacttcccagtttggtgtgggcagctttcagactccatcctccttcagctccatgtccctccctggtgccccaactgcatcgcctggtgctgctgcctaccctagtctcaccaatcgtggatctaactttgctcctgagactggacagactgcaggacaattccagacacggacagcagagggtgtgggtgtctggccacagtggcagggccagcagcctcatcatcgttcaagttctagtgagcaacatgttcaacaaccgccagcacagcaacctggccagcctgaggtcttccaggagatgctgtccatgctgggagatcagagcaacagctacaacaatgaagaattccctgatctaactatgtttccccccttttcagaatagaactattggggtgaggataaggggtgggggagaaaaaatcactgtttgtttttaaaaagcaaatctttctgtaaacagaataaaagttcctctcccttcccttccctcacccctgacatgtaccccctttcccttctggctgttcccctgctctgttgcctctctaaggtaacatttatagaagaaatggaatgaatctccaaggcttttaggactgtctgaaaatttgaggctgggtgaagttaaaacacctttccttatgtctcctgacctgaaattgtatagtgttgatttgtgctgagatcaagaggcaggttagaagaacctgacatccactgtttgccttggatagtatggcttgtttttggaaagaaattctgaagagagtggaggagaggagaaatgtcctcatatttgaggaccatgaaacattgtaggtatatatggggctttagcaagtttgagcataggctctttttgctgcctgtgagcagtccctctggaaagaaacatgtgagtaagtgagagagagtgtgtgtgtatgtgtgtgtgtgtgtgtgtgtgtgcgcacacatgcttctgtatttcactctttctccctattagggagttatgcaaaatttgtccccgattttacctttgtctttctgtgtacttttcaaagagtcctaaggagttaaatcttccaggtattttccacttagtattgcagccaaagaatatttaaataaacgtctttgctgcgcttgcatccatgcccagccaatatacaatctgttatcgaacacattcagtgataaagctgggttactgctgcttttggtgctctcaccttatctggaagatctgcaaacattacctaaataggctggcaagataaacactttctggaacccgagacttggccataaagataatgctgcatttttctgtcagaatcacatatgatgtgtgttctgtagaggttatttctgcatggaaactcaacttcttggattagccgtcccagtgaaaatcctcattgttggagtgtaaaccaaatacgaagccctcttgcaaagtagcctctttcatcccatactcaaaatacccagtttagcaagcaactgagatttaagtctctctggccctaagaggtttttcctctttgctccctccaatcttgagattgggttttgctttagagtgcaagtatcataattccgtatgatagatggggcctggacacccatctcaacagggtcacttggtaattaacaatagccatataaatgcggatacaggttactaccctcaccctttaccttcctcaggtaacagtcgtagataccagcttttttttttttttttttaaattggctttggccagtagctaaagtgcaagactgaattaatgagaagatatattaaatgtagtcataggggactgaggagcaagggtggccttgaagaggccaaaggaatgtccatttgctgagtttcccttccttatgtctccagtctggtgccaggtagtggagtaaaaaaggagacagtttatttttttattctatgtgcacacttacagtatacatatatatttatatcacaatttacgaaaccaaaaagttgagtttccaatggaacccttgttttttaataatcgactttttaaatgtgatcaggactataatattgtacagttattatagggcttttggggaaggggaggatagcgagaagatgctctgggggttttgtttttgcttttccttcagggttttatttttgactgttttgttttcttgttggccatttctgtattgctggcatctgtgctaagctttacagtggcaaaaataatgacatgtagcaaagattttcaaacaaaatattttttccttttgtaaaatttcttgtgttgtgtgatcttgattgcggctttatcattcctttccagttcataaacaacaggcacccacaaccagaggaatctatagtttaagctccagacatacaaacataaggcacattgtgtctttaatttcaggaatcagaaatcatagggttctgatcacattgcacgcctcccccctcacttgtcctcctgatcctgacacattctgagtaacatcagcaggaatgctctgaccatgaggtgggggttttggggtgggcgttgcctgggttcttgggagagaggggaagagtcgggacttgaaaaccactagggcacatctggatgccttcccccagtatgtccttttctggattaaaatgagtgaaatttaaactgttcaagtc

SEQ ID NO: 314649 - DNA, 3584 bp, Homo sapiens
aggggctgggatgctgggggctgctgaagccgccatcttggattccgcggtagcggaggcggcggtcaggcgccgcttctggggagtggcctttcttttcccctccctcccggttcggtggcggcggctcctcccactggggggggggtggcgcggcggcggtggcatctgcggccatggcggcgactactgccaaccccgaaatgacatcagatgtaccatcactgggtccagccattgcctctggaaactctggacctggaattcaaggtggaggagccattgtccagagggctattaagcggcgaccagggctggattttgatgatgatggagaagggaacagtaaatttttgaggtgtgatgatgatcagatgtctaacgataaggagcggtttgccaggtcggatgatgagcagagctctgcggataaagagagacttgccagggaaaatcacagtgaaattgaacggcggcgacggaacaagatgacagcctacatcacagaactgtcagatatggtacccacctgtagtgccctggctcgaaaaccagacaagctaaccatcttacgcatggcagtttctcacatgaagtccttgcggggaactggcaacacatccactgatggctcctataagccgtctttcctcactgatcaggaactgaaacatttgatcttggaggcagcagatggctttctgtttattgtctcatgtgagacaggcagggtggtgtatgtgtctgactccgtgactcctgttttgaaccagccacagtctgaatggtttggcagcacactctatgatcaggtgcacccagatgatgtggataaacttcgtgagcagctttccacttcagaaaatgccctgacagggcgtatcctggatctaaagactggaacagtgaaaaaggaaggtcagcagtcttccatgagaatgtgtatgggctcaaggagatcgtttatttgccgaatgaggtgtggcagtagctctgtggacccagtttctgtgaataggctgagctttgtgaggaacagatgcaggaatggacttggctctgtaaaggatggggaacctcacttcgtggtggtccactgcacaggctacatcaaggcctggcccccagcaggtttccctcccagatgatgacccagcctgaggtcttccaggagatgctgtccatgctgggagatcagagcaacagctacaacaatgaagaattccctgatctaactatgtttccccccttttcagaatagaactattggggtgaggataaggggtgggggagaaaaaatcactgtttgtttttaaaaagcaaatctttctgtaaacagaataaaagttcctctcccttcccttccctcacccctgacatgtaccccctttcccttctggctgttcccctgctctgttgcctctctaaggtaacatttatagaagaaatggaatgaatctccaaggcttttaggactgtctgaaaatttgaggctgggtgaagttaaaacacctttccttatgtctcctgacctgaaattgtatagtgttgatttgtgctgagatcaagaggcaggttagaagaacctgacatccactgtttgccttggatagtatggcttgtttttggaaagaaattctgaagagagtggaggagaggagaaatgtcctcatatttgaggaccatgaaacattgtaggtatatatggggctttagcaagtttgagcataggctctttttgctgcctgtgagcagtccctctggaaagaaacatgtgagtaagtgagagagagtgtgtgtgtatgtgtgtgtgtgtgtgtgtgtgtgcgcacacatgcttctgtatttcactctttctccctattagggagttatgcaaaatttgtccccgattttacctttgtctttctgtgtacttttcaaagagtcctaaggagttaaatcttccaggtattttccacttagtattgcagccaaagaatatttaaataaacgtctttgctgcgcttgcatccatgcccagccaatatacaactgtaaagcaaatatagaaagtcggctgttgatacgattgtctgttatcgaacacattcagtgataaagctgggttactgctgcttttggtgctctcaccttatctggaagatctgcaaacattacctaaataggctggcaagataaacactttctggaacccgagacttggccataaagataatgctgcatttttctgtcagaatcacatatgatgtgtgttctgtagaggttatttctgcatggaaactcaacttcttggattagccgtcccagtgaaaatcctcattgttggagtgtaaaccaaatacgaagccctcttgcaaagtagcctctttcatcccatactcaaaatacccagtttagcaagcaactgagatttaagtctctctggccctaagaggtttttcctctttgctccctccaatcttgagattgggttttgctttagagtgcaagtatcataattccgtatgatagatggggcctggacacccatctcaacagggtcacttggtaattaacaatagccatataaatgcggatacaggttactaccctcaccctttaccttcctcaggtaacagtcgtagataccagcttttttttttttttttttaaattggctttggccagtagctaaagtgcaagactgaattaatgagaagatatattaaatgtagtcataggggactgaggagcaagggtggccttgaagaggccaaaggaatgtccatttgctgagtttcccttccttatgtctccagtctggtgccaggtagtggagtaaaaaaggagacagtttatttttttattctatgtgcacacttacagtatacatatatatttatatcacaatttacgaaaccaaaaagttgagtttccaatggaacccttgttttttaataatcgactttttaaatgtgatcaggactataatattgtacagttattatagggcttttggggaaggggaggatagcgagaagatgctctgggggttttgtttttgcttttccttcagggttttatttttgactgttttgttttcttgttggccatttctgtattgctggcatctgtgctaagctttacagtggcaaaaataatgacatgtagcaaagattttcaaacaaaatattttttccttttgtaaaatttcttgtgttgtgtgatcttgattgcggctttatcattcctttccagttcataaacaacaggcacccacaaccagaggaatctatagtttaagctccagacatacaaacataaggcacattgtgtctttaatttcaggaatcagaaatcatagggttctgatcacattgcacgcctcccccctcacttgtcctcctgatcctgacacattctgagtaacatcagcaggaatgctctgaccatgaggtgggggttttggggtgggcgttgcctgggttcttgggagagaggggaagagtcgggacttgaaaaccactagggcacatctggatgccttcccccagtatgtccttttctggattaaaatgagtgaaatttaaactgttcaagtc

SEQ ID NO: 314650 - DNA, 4925 bp, Homo sapiens
aggggctgggatgctgggggctgctgaagccgccatcttggattccgcggtagcggaggcggcggtcaggcgccgcttctggggagtggcctttcttttcccctccctcccggttcggtggcggcggctcctcccactggggggggggtggcgcggcggcggtggcatctgcggccatggcggcgactactgccaaccccgcctgatcttggactcaagattctcctgcctcagaccccgagtagctgggactacagaaatgacatcagatgtaccatcactgggtccagccattgcctctggaaactctggacctggaattcaaggtggaggagccattgtccagagggctattaagcggcgaccagggctggattttgatgatgatggagaagggaacagtaaatttttgaggtgtgatgatgatcagatgtctaacgataaggagcggtttgccaggtcggatgatgagcagagctctgcggataaagagagacttgccagggaaaatcacagtgaaattgaacggcggcgacggaacaagatgacagcctacatcacagaactgtcagatatggtacccacctgtagtgccctggctcgaaaaccagacaagctaaccatcttacgcatggcagtttctcacatgaagtccttgcggggaactggcaacacatccactgatggctcctataagccgtctttcctcactgatcaggaactgaaacatttgatcttggaggcagcagatggctttctgtttattgtctcatgtgagacaggcagggtggtgtatgtgtctgactccgtgactcctgttttgaaccagccacagtctgaatggtttggcagcacactctatgatcaggtgcacccagatgatgtggataaacttcgtgagcagctttccacttcagaaaatgccctgacagggcgtatcctggatctaaagactggaacagtgaaaaaggaaggtcagcagtcttccatgagaatgtgtatgggctcaaggagatcgtttatttgccgaatgaggtgtggcagtagctctgtggacccagtttctgtgaataggctgagctttgtgaggaacagatgcaggaatggacttggctctgtaaaggatggggaacctcacttcgtggtggtccactgcacaggctacatcaaggcctggcccccagcaggtgtttccctcccagatgatgacccagaggctggccagggaagcaagttttgcctagtggccattggcagattgcaggtaactagttctcccaactgtacagacatgagtaatgtttgtcaaccaacagagttcatctcccgacacaacattgagggtatcttcacttttgtggatcaccgctgtgtggctactgttggctaccagccacaggaactcttaggaaagaatattgtagaattctgtcatcctgaagaccagcagcttctaagagacagcttccaacaggtagtgaaattaaaaggccaagtgctgtctgtcatgttccggttccggtctaagaaccaagaatggctctggatgagaaccagctcctttactttccagaacccttactcagatgaaattgagtacatcatctgtaccaacaccaatgtgaagaactctagccaagaaccacggcctacactctccaacacaatccagaggccacaactaggtcccacagctaatttacccctggagatgggctcaggacagctggcacccaggcagcagcaacagcaaacagaattggacatggtaccaggaagagatggactggccagctacaatcattcccaggtggttcagcctgtgacaaccacaggaccagaacacagcaagccccttgagaagtcagatggtttatttgcccaggatagagatccaagattttcagaaatctatcacaacatcaatgcggatcagagtaaaggcatctcctccagcactgtccctgccacccaacagctattctcccagggcaacacattccctcctaccccccggccggcagagaatttcaggaatagtggcctagcccctcctgtaaccattgtccagccatcagcttctgcaggacagatgttggcccagatttcccgccactccaaccccacccaaggagcaaccccaacttggacccctactacccgctcaggcttttctgcccagcaggtggctacccaggctactgctaagactcgtacttcccagtttggtgtgggcagctttcagactccatcctccttcagctccatgtccctccctggtgccccaactgcatcgcctggtgctgctgcctaccctagtctcaccaatcgtggatctaactttgctcctgagactggacagactgcaggacaattccagacacggacagcagagggtgtgggtgtctggccacagtggcagggccagcagcctcatcatcgttcaagttctagtgagcaacatgttcaacaaccgccagcacagcaacctggccagcctgaggtcttccaggagatgctgtccatgctgggagatcagagcaacagctacaacaatgaagaattccctgatctaactatgtttccccccttttcagaatagaactattggggtgaggataaggggtgggggagaaaaaatcactgtttgtttttaaaaagcaaatctttctgtaaacagaataaaagttcctctcccttcccttccctcacccctgacatgtaccccctttcccttctggctgttcccctgctctgttgcctctctaaggtaacatttatagaagaaatggaatgaatctccaaggcttttaggactgtctgaaaatttgaggctgggtgaagttaaaacacctttccttatgtctcctgacctgaaattgtatagtgttgatttgtgctgagatcaagaggcaggttagaagaacctgacatccactgtttgccttggatagtatggcttgtttttggaaagaaattctgaagagagtggaggagaggagaaatgtcctcatatttgaggaccatgaaacattgtaggtatatatggggctttagcaagtttgagcataggctctttttgctgcctgtgagcagtccctctggaaagaaacatgtgagtaagtgagagagagtgtgtgtgtatgtgtgtgtgtgtgtgtgtgtgtgcgcacacatgcttctgtatttcactctttctccctattagggagttatgcaaaatttgtccccgattttacctttgtctttctgtgtacttttcaaagagtcctaaggagttaaatcttccaggtattttccacttagtattgcagccaaagaatatttaaataaacgtctttgctgcgcttgcatccatgcccagccaatatacaactgtaaagcaaatatagaaagtcggctgttgatacgattgtctgttatcgaacacattcagtgataaagctgggttactgctgcttttggtgctctcaccttatctggaagatctgcaaacattacctaaataggctggcaagataaacactttctggaacccgagacttggccataaagataatgctgcatttttctgtcagaatcacatatgatgtgtgttctgtagaggttatttctgcatggaaactcaacttcttggattagccgtcccagtgaaaatcctcattgttggagtgtaaaccaaatacgaagccctcttgcaaagtagcctctttcatcccatactcaaaatacccagtttagcaagcaactgagatttaagtctctctggccctaagaggtttttcctctttgctccctccaatcttgagattgggttttgctttagagtgcaagtatcataattccgtatgatagatggggcctggacacccatctcaacagggtcacttggtaattaacaatagccatataaatgcggatacaggttactaccctcaccctttaccttcctcaggtaacagtcgtagataccagcttttttttttttttttttaaattggctttggccagtagctaaagtgcaagactgaattaatgagaagatatattaaatgtagtcataggggactgaggagcaagggtggccttgaagaggccaaaggaatgtccatttgctgagtttcccttccttatgtctccagtctggtgccaggtagtggagtaaaaaaggagacagtttatttttttattctatgtgcacacttacagtatacatatatatttatatcacaatttacgaaaccaaaaagttgagtttccaatggaacccttgttttttaataatcgactttttaaatgtgatcaggactataatattgtacagttattatagggcttttggggaaggggaggatagcgagaagatgctctgggggttttgtttttgcttttccttcagggttttatttttgactgttttgttttcttgttggccatttctgtattgctggcatctgtgctaagctttacagtggcaaaaataatgacatgtagcaaagattttcaaacaaaatattttttccttttgtaaaatttcttgtgttgtgtgatcttgattgcggctttatcattcctttccagttcataaacaacaggcacccacaaccagaggaatctatagtttaagctccagacatacaaacataaggcacattgtgtctttaatttcaggaatcagaaatcatagggttctgatcacattgcacgcctcccccctcacttgtcctcctgatcctgacacattctgagtaacatcagcaggaatgctctgaccatgaggtgggggttttggggtgggcgttgcctgggttcttgggagagaggggaagagtcgggacttgaaaaccactagggcacatctggatgccttcccccagtatgtccttttctggattaaaatgagtgaaatttaaactgttcaagtc

SEQ ID NO: 314651 - DNA, 2832 bp, Homo sapiens
  misc_feature (1)..(1): n is a, c, g, or t
  misc_feature (13)..(13): n is a, c, g, or t
nacaaagctaggnagagcctgggtccaaccccacccaaggagcaaccccaacttggacccctactacccgctcaggcttttctgcccagcaggtggctacccaggctactgctaagactcgtacttcccagtttggtgtgggcagctttcagactccatcctccttcagctccatgtccctccctggtgccccaactgcatcgcctggtgctgctgcctaccctagtctcaccaatcgtggatctaactttgctcctgagactggacagactgcaggacaattccagacacggacagcagagggtgtgggtgtctggccacagtggcagggccagcagcctcatcatcgttcaagttctagtgagcaacatgttcaacaaccgccagcacagcaacctggccagcctgaggtcttccaggagatgctgtccatgctgggagatcagagcaacagctacaacaatgaagaattccctgatctaactatgtttccccccttttcagaatagaactattggggtgaggataaggggtgggggagaaaaaatcactgtttgtttttaaaaagcaaatctttctgtaaacagaataaaagttcctctcccttcccttccctcacccctgacatgtaccccctttcccttctggctgttcccctgctctgttgcctctctaaggtaacatttatagaagaaatggaatgaatctccaaggcttttaggactgtctgaaaatttgaggctgggtgaagttaaaacacctttccttatgtctcctgacctgaaattgtatagtgttgatttgtgctgagatcaagaggcaggttagaagaacctgacatccactgtttgccttggatagtatggcttgtttttggaaagaaattctgaagagagtggaggagaggagaaatgtcctcatatttgaggaccatgaaacattgtaggtatatatggggctttagcaagtttgagcataggctctttttgctgcctgtgagcagtccctctggaaagaaacatgtgagtaagtgagagagagtgtgtgtgtatgtgtgtgtgtgtgtgtgtgtgtgcgcacacatgcttctgtatttcactctttctccctattagggagttatgcaaaatttgtccccgattttacctttgtctttctgtgtacttttcaaagagtcctaaggagttaaatcttccaggtattttccacttagtattgcagccaaagaatatttaaataaacgtctttgctgcgcttgcatccatgcccagccaatatacaactgtaaagcaaatatagaaagtcggctgttgatacgattgtctgttatcgaacacattcagtgataaagctgggttactgctgcttttggtgctctcaccttatctggaagatctgcaaacattacctaaataggctggcaagataaacactttctggaacccgagacttggccataaagataatgctgcatttttctgtcagaatcacatatgatgtgtgttctgtagaggttatttctgcatggaaactcaacttcttggattagccgtcccagtgaaaatcctcattgttggagtgtaaaccaaatacgaagccctcttgcaaagtagcctctttcatcccatactcaaaatacccagtttagcaagcaactgagatttaagtctctctggccctaagaggtttttcctctttgctccctccaatcttgagattgggttttgctttagagtgcaagtatcataattccgtatgatagatggggcctggacacccatctcaacagggtcacttggtaattaacaatagccatataaatgcggatacaggttactaccctcaccctttaccttcctcaggtaacagtcgtagataccagcttttttttttttttttttaaattggctttggccagtagctaaagtgcaagactgaattaatgagaagatatattaaatgtagtcataggggactgaggagcaagggtggccttgaagaggccaaaggaatgtccatttgctgagtttcccttccttatgtctccagtctggtgccaggtagtggagtaaaaaaggagacagtttatttttttattctatgtgcacacttacagtatacatatatatttatatcacaatttacgaaaccaaaaagttgagtttccaatggaacccttgttttttaataatcgactttttaaatgtgatcaggactataatattgtacagttattatagggcttttggggaaggggaggatagcgagaagatgctctgggggttttgtttttgcttttccttcagggttttatttttgactgttttgttttcttgttggccatttctgtattgctggcatctgtgctaagctttacagtggcaaaaataatgacatgtagcaaagattttcaaacaaaatattttttccttttgtaaaatttcttgtgttgtgtgatcttgattgcggctttatcattcctttccagttcataaacaacaggcacccacaaccagaggaatctatagtttaagctccagacatacaaacataaggcacattgtgtctttaatttcaggaatcagaaatcatagggttctgatcacattgcacgcctcccccctcacttgtcctcctgatcctgacacattctgagtaacatcagcaggaatgctctgaccatgaggtgggggttttggggtgggcgttgcctgggttcttgggagagaggggaagagtcgggacttgaaaaccactagggcacatctggatgccttcccccagtatgtccttttctggattaaaatgagtgaaatttaaactgttcaagtc

SEQ ID NO: 314652 - DNA, 3138 bp, Homo sapiens
aggggctgggatgctgggggctgctgaagccgccatcttggattccgcggtagcggaggcggcggtcaggcgccgcttctggggagtggcctttcttttcccctccctcccggttcggtggcggcggctcctcccactggggggggggtggcgcggcggcggtggcatctgcggccatggcggcgactactgccaaccccgaaatgacatcagatgtaccatcactgggtccagccattgcctctggaaactctggacctggaattcaaggtggaggagccattgtccagagggctattaagcggcgaccagggctggattttgatgatgatggagaagggaacagtaaatttttgaggtgtgatgatgatcagatgtctaacgataaggagcggtttgccaggtcggatgatgagcagagctctgcggataaagagagacttgccagggaaaatcacagtgaaattgaacggcggcgacggaacaagatgacagcctacatcacagaactgtcagatatggtacccacctgtagtgccctggctcgaaaaccagacaagctaaccatcttacgcatggcagtttctcacatgaagtccttgcggggaactggcaacacatccactgatggctcctataagccgtctttcctcactgatcaggaactgaaacatttgatcttggaggcagcagatggctttctgtttattgtctcatgtgagacaggcagggtggtgtatgtgtctgactccgtgactcctgttttgaaccagccacagtctgaatggtttggcagcacactctatgatcaggtgcacccagatgatgtggataaacttcgtgagcagctttccacttcagaaaatgccctgacagggcgtatcctggatctaaagactggaacagtgaaaaaggaaggtcagcagtcttccatgagaatgtgtatgggctcaaggagatcgtttatttgccgaatgaggtgtggcagtagctctgtggacccagtttctgtgaataggctgagctttgtgaggaacagatgcaggaatggacttggctctgtaaaggatggggaacctcacttcgtggtggtccactgcacaggctacatcaaggcctggcccccagcaggtgtttccctcccagatgatgacccagaggctggccagggaagcaagttttgcctagtggccattggcagattgcaggtaactagttctcccaactgtacagacatgagtaatgtttgtcaaccaacagagttcatctcccgacacaacattgagggtatcttcacttttgtggatcaccgctgtgtggctactgttggctaccagccacaggaactcttaggaaagaatattgtagaattctgtcatcctgaagaccagcagcttctaagagacagcttccaacaggtagtgaaattaaaaggccaagtgctgtctgtcatgttccggttccggtctaagaaccaagaatggctctggatgagaaccagctcctttactttccagaacccttactcagatgaaattgagtacatcatctgtaccaacaccaatgtgaagaactctagccaagaaccacggcctacactctccaacacaatccagaggccacaactaggtcccacagctaatttacccctggagatgggctcaggacagctggcacccaggcagcagcaacagcaaacagaattggacatggtaccaggaagagatggactggccagctacaatcattcccaggtggttcagcctgtgacaaccacaggaccagaacacagcaagccccttgagaagtcagatggtttatttgcccaggatagagatccaagattttcagaaatctatcacaacatcaatgcggatcagagtaaaggcatctcctccagcactgtccctgccacccaacagctattctcccagggcaacacattccctcctaccccccggccggcagagaatttcaggaatagtggcctagcccctcctgtaaccattgtccagccatcagcttctgcaggacagatgttggcccagatttcccgccactccaaccccacccaaggagcaaccccaacttggacccctactacccgctcaggcttttctgcccagcaggtggctacccaggctactgctaagactcgtacttcccagtttggtgtgggcagctttcagactccatcctccttcagctccatgtccctccctggtgccccaactgcatcgcctggtgctgctgcctaccctagtctcaccaatcgtggatctaactttgctcctgagactggacagactgcaggacaattccagacacggacagcagagggtgtgggtgtctggccacagtggcagggccagcagcctcatcatcgttcaagttctagtgagcaacatgttcaacaaccgccagcacagcaacctggccagcctgaggtcttccaggagatgctgtccatgctgggagatcagagcaacagctacaacaatgaagaattccctgatctaactatgtttccccccttttcagaatagaactattggggtgaggataaggggtgggggagaaaaaatcactgtttgtttttgcttttccttcagggttttatttttgactgttttgttttcttgttggccatttctgtattgctggcatctgtgctaagctttacagtggcaaaaataatgacatgtagcaaagattttcaaacaaaatattttttccttttgtaaaatttcttgtgttgtgtgatcttgattgcggctttatcattcctttccagttcataaacaacaggcacccacaaccagaggaatctatagtttaagctccagacatacaaacataaggcacattgtgtctttaatttcaggaatcagaaatcatagggttctgatcacattgcacgcctcccccctcacttgtcctcctgatcctgacacattctgagtaacatcagcaggaatgctctgaccatgaggtgggggttttggggtgggcgttgcctgggttcttgggagagaggggaagagtcgggacttgaaaaccactagggcacatctggatgccttcccccagtatgtccttttctggattaaaatgagtgaaatttaaactgttcaagtc

SEQ ID NO: 314653 - DNA, 2168 bp, Homo sapiens
cggcccagtgatcttgaaccccaaaggccagaactggagcctcagtccagagaattctgagaaaattaaagcagagaggaggggagagatcactgggaccaggccgtgatctctatgcccgagtctcaaccctcaactgtcaccccaaggcacttgggacgtcctggacagaccgagtcccgggaagccccagcactgccgctgccacactgccctgagcccaaatgggggagtgagaggccatagctgtctggcatgggcctctccaccgtgcctgacctgctgctgccactggtgctcctggagctgttggtgggaatatacccctcaggggttattggactggtccctcacctaggggacagggagaagagagatagtgtgtgtccccaaggaaaatatatccaccctcaaaataattcgatttgctgtaccaagtgccacaaaggaacctacttgtacaatgactgtccaggcccggggcaggatacggactgcagggagtgtgagagcggctccttcaccgcttcagaaaaccacctcagacactgcctcagctgctccaaatgccgaaaggaaatgggtcaggtggagatctcttcttgcacagtggaccgggacaccgtgtgtggctgcaggaagaaccagtaccggcattattggagtgaaaaccttttccagtgcttcaattgcagcctctgcctcaatgggaccgtgcacctctcctgccaggagaaacagaacaccgtgtgcacctgccatgcaggtttctttctaagagaaaacgagtgtgtctcctgtagtaactgtaagaaaagcctggagtgcacgaagttgtgcctaccccagattgagaatgttaagggcactgaggactcaggcaccacagtgctgttgcccctggtcattttctttggtctttgccttttatccctcctcttcattggtttaatgtatcgctaccaacggtggaagtccaagctctactccattgtttgtgggaaatcgacacctgaaaaagagggggagcttgaaggaactactactaagcccctggccccaaacccaagcttcagtcccactccaggcttcacccccaccctgggcttcagtcccgtgcccagttccaccttcacctccagctccacctatacccccggtgactgtcccaactttgcggctccccgcagagaggtggcaccaccctatcagggggctgaccccatccttgcgacagccctcgcctccgaccccatccccaacccccttcagaagtgggaggacagcgcccacaagccacagagcctagacactgatgaccccgcgacgctgtacgccgtggtggagaacgtgcccccgttgcgctggaaggaattcgtgcggcgcctagggctgagcgaccacgagatcgatcggctggagctgcagaacgggcgctgcctgcgcgaggcgcaatacagcatgctggcgacctggaggcggcgcacgccgcggcgcgaggccacgctggagctgctgggacgcgtgctccgcgacatggacctgctgggctgcctggaggacatcgaggaggcgctttgcggccccgccgccctcccgcccgcgcccagtcttctcagatgaggctgcgcccctgcgggcagctctaaggaccgtcctgcgagatcgccttccaaccccacttttttctggaaaggaggggtcctgcaggggcaagcaggagctagcagccgcctacttggtgctaacccctcgatgtacatagcttttctcagctgcctgcgcgccgccgacagtcagcgctgtgcgcgcggagagaggtgcgccgtgggctcaagagcctgagtgggtggtttgcgaggatgagggacgctatgcctcatgcccgttttgggtgtcctcaccagcaaggctgctcgggggcccctggttcgtccctgagcctttttcacagtgcataagcagttttttttgtttttgttttgttttgttttgtttttaaatcaatcatgttacactaatagaaacttggcactcctgtgccctctgcctggacaagcacatagcaagctgaactgtcctaaggcaggggcgagcacggaacaatggggccttcagctggagctgtggacttttgtacatacactaaaattctgaagttaaagctc

SEQ ID NO: 314654 - DNA, 2027 bp, Homo sapiens
gctgttgcaacactgcctcactcttcccctcccaccttctctcccctcctctctgctttaattttctcagaattctctggactgaggctccagttctggcctttggggttcaagatcactgggaccaggccgtgatctctatgcccgagtctcaaccctcaactgtcaccccaaggcacttgggacgtcctggacagaccgagtcccgggaagccccagcactgccgctgccacactgccctgagcccaaatgggggagtgagaggccatagctgtctggcatgggcctctccaccgtgcctgacctgctgctgccactggtgctcctggagctgttggtgggaatatacccctcaggggttattggactggtccctcacctaggggacagggagaagagagatagtgtgtgtccccaaggaaaatatatccaccctcaaaataattcgatttgctgtaccaagtgccacaaaggaacctacttgtacaatgactgtccaggcccggggcaggatacggactgcagggagtgtgagagcggctccttcaccgcttcagaaaaccacctcagacactgcctcagctgctccaaatgccgaaaggaaatgggtcaggtggagatctcttcttgcacagtggaccgggacaccgtgtgtggctgcaggaagaaccagtaccggcattattggagtgaaaaccttttccagtgcttcaattgcagcctctgcctcaatgggaccgtgcacctctcctgccaggagaaacagaacaccgtgtgcacctgccatgcaggtttctttctaagagaaaacgagtgtgtctcctgtagtaactgtaagaaaagcctggagtgcacgaagttgtgcctaccccagattgagaatgttaagggcactgaggactcaggcaccacagtgctgttgcccctggtcattttctttggtctttgccttttatccctcctcttcattggtttaatgtatcgctaccaacggtggaagtccaagctctactccattgtttgtgggaaatcgacacctgaaaaagagagaggtggcaccaccctatcagggggctgaccccatccttgcgacagccctcgcctccgaccccatccccaacccccttcagaagtgggaggacagcgcccacaagccacagagcctagacactgatgaccccgcgacgctgtacgccgtggtggagaacgtgcccccgttgcgctggaaggaattcgtgcggcgcctagggctgagcgaccacgagatcgatcggctggagctgcagaacgggcgctgcctgcgcgaggcgcaatacagcatgctggcgacctggaggcggcgcacgccgcggcgcgaggccacgctggagctgctgggacgcgtgctccgcgacatggacctgctgggctgcctggaggacatcgaggaggcgctttgcggccccgccgccctcccgcccgcgcccagtcttctcagatgaggctgcgcccctgcgggcagctctaaggaccgtcctgcgagatcgccttccaaccccacttttttctggaaaggaggggtcctgcaggggcaagcaggagctagcagccgcctacttggtgctaacccctcgatgtacatagcttttctcagctgcctgcgcgccgccgacagtcagcgctgtgcgcgcggagagaggtgcgccgtgggctcaagagcctgagtgggtggtttgcgaggatgagggacgctatgcctcatgcccgttttgggtgtcctcaccagcaaggctgctcgggggcccctggttcgtccctgagcctttttcacagtgcataagcagttttttttgtttttgttttgttttgttttgtttttaaatcaatcatgttacactaatagaaacttggcactcctgtgccctctgcctggacaagcacatagcaagctgaactgtcctaaggcaggggcgagcacggaacaatggggccttcagctggagctgtggacttttgtacatacactaaaattctgaagttaaagctc

SEQ ID NO: 314655 - DNA, 2239 bp, Homo sapiens
gctgttgcaacactgcctcactcttcccctcccaccttctctcccctcctctctgctttaattttctcagaattctctggactgaggctccagttctggcctttggggttcaagatcactgggaccaggccgtgatctctatgcccgagtctcaaccctcaactgtcaccccaaggcacttgggacgtcctggacagaccgagtcccgggaagccccagcactgccgctgccacactgccctgagcccaaatgggggagtgagaggccatagctgtctggcatgggcctctccaccgtgcctgacctgctgctgccactggtgctcctggagctgttggtgggaatatacccctcaggggttattggactggtccctcacctaggggacagggagaagagagatagtgtgtgtccccaaggaaaatatatccaccctcaaaataattcgatttgctgtaccaagtgccacaaaggaacctacttgtacaatgactgtccaggcccggggcaggatacggactgcagggagtgtgagagcggctccttcaccgcttcagaaaaccacctcagacactgcctcagctgctccaaatgccgaaaggaaatgggtcaggtggagatctcttcttgcacagtggaccgggacaccgtgtgtggctgcaggaagaaccagtaccggcattattggagtgaaaaccttttccagtgcttcaattgcagcctctgcctcaatgggaccgtgcacctctcctgccaggagaaacagaacaccgtgtgcacctgccatgcaggtttctttctaagagaaaacgagtgtgtctcctgtagtaaagtcctgctctgtcgcccaggctggaatgcagtggcgcgatctcggctcactgcaacctctgcctcccagattcaagcaattctcctgcttcagcctcccaagtagctgggattacagggcaccacagtgctgttgcccctggtcattttctttggtctttgccttttatccctcctcttcattggtttaatgtatcgctaccaacggtggaagtccaagctctactccattgtttgtgggaaatcgacacctgaaaaagagggggagcttgaaggaactactactaagcccctggccccaaacccaagcttcagtcccactccaggcttcacccccaccctgggcttcagtcccgtgcccagttccaccttcacctccagctccacctatacccccggtgactgtcccaactttgcggctccccgcagagaggtggcaccaccctatcagggggctgaccccatccttgcgacagccctcgcctccgaccccatccccaacccccttcagaagtgggaggacagcgcccacaagccacagagcctagacactgatgaccccgcgacgctgtacgccgtggtggagaacgtgcccccgttgcgctggaaggaattcgtgcggcgcctagggctgagcgaccacgagatcgatcggctggagctgcagaacgggcgctgcctgcgcgaggcgcaatacagcatgctggcgacctggaggcggcgcacgccgcggcgcgaggccacgctggagctgctgggacgcgtgctccgcgacatggacctgctgggctgcctggaggacatcgaggaggcgctttgcggccccgccgccctcccgcccgcgcccagtcttctcagatgaggctgcgcccctgcgggcagctctaaggaccgtcctgcgagatcgccttccaaccccacttttttctggaaaggaggggtcctgcaggggcaagcaggagctagcagccgcctacttggtgctaacccctcgatgtacatagcttttctcagctgcctgcgcgccgccgacagtcagcgctgtgcgcgcggagagaggtgcgccgtgggctcaagagcctgagtgggtggtttgcgaggatgagggacgctatgcctcatgcccgttttgggtgtcctcaccagcaaggctgctcgggggcccctggttcgtccctgagcctttttcacagtgcataagcagttttttttgtttttgttttgttttgttttgtttttaaatcaatcatgttacactaatagaaacttggcactcctgtgccctctgcctggacaagcacatagcaagctgaactgtcctaaggcaggggcgagcacggaacaatggggccttcagctggagctgtggacttttgtacatacactaaaattctgaagttaaagctc

SEQ ID NO: 314656 - DNA, 3113 bp, Homo sapiens
gctgttgcaacactgcctcactcttcccctcccaccttctctcccctcctctctgctttaattttctcagaattctctggactgaggctccagttctggcctttggggttcaagatcactgggaccaggccgtgatctctatgcccgagtctcaaccctcaactgtcaccccaaggcacttgggacgtcctggacagaccgagtcccgggaagccccagcactgccgctgccacactgccctgagcccaaatgggggagtgagaggccatagctgtctggcatgggcctctccaccgtgcctgacctgctgctgccactggtgctcctggagctgttggtgggaatatacccctcaggggttattggactggtccctcacctaggggacagggagaagagagatagtgtgtgtccccaaggaaaatatatccaccctcaaaataattcgatttgctgtaccaagtgccacaaaggaacctacttgtacaatgactgtccaggcccggggcaggatacggactgcagggagtgtgagagcggctccttcaccgcttcagaaaaccacctcagacactgcctcagctgctccaaatgccgaaaggaaatgggtcaggtggagatctcttcttgcacagtggaccgggacaccgtgtgtggctgcaggaagaaccagtaccggcattattggagtgaaaaccttttccagtgcttcaattgcagcctctgcctcaatgggaccgtgcacctctcctgccaggagaaacagaacaccgtgtgcacctgccatgcaggtttctttctaagagaaaacgagtgtgtctcctgtagtaactgtaagaaaagcctggagtgcacgaagttgtgcctaccccagattgagaatgttaagggcactgaggactcaggcaccacagtgctgttgcccctggtcattttctttggtctttgccttttatccctcctcttcattggtttaatgtatcgctaccaacggtggaagtccaagctctactccattgtttgtgggaaatcgacacctgaaaaagagggggagcttgaaggaactactactaagcccctggccccaaacccaagcttcagtcccactccaggcttcacccccaccctgggcttcagtcccgtgcccagttccaccttcacctccagctccacctatacccccggtgactgtcccaactttgcggctccccgcagagaggtggcaccaccctatcagggggctgaccccatccttgcgacagccctcgcctccgaccccatccccaacccccttcagaagtgggaggacagcgcccacaagccacagagcctagacactgatgaccccgcgacgctgtacgccgtggtggagaacgtgcccccgttgcgctggaaggaattcgtgcggcgcctagggctgagcgaccacgagatcgatcggctggagctgcagaacgggcgctgcctgcgcgaggcgcaatacagcatgctggcgacctggaggcggcgcacgccgcggcgcgaggccacgctggagctgctgggacgcgtgctccgcgacatggacctgctgggctgcctggaggacatcgaggaggcgctttgcggccccgccgccctcccgcccgcgcccagtcttctcagatgaggctgcgcccctgcgggcagctctaaggaccgtcctgcgagatcgccttccaaccccacttttttctggaaaggaggggtcctgcaggggcaagcaggagctagcagccgcctacttggtgctaacccctcgatgtacatagcttttctcagctgcctgcgcgccgccgacagtcagcgctgtgcgcgcggagagaggtgcgccgtgggctcaagagcctgagtgggtggtttgcgaggatgagggacgctatgcctcatgcccgttttgggtgtcctcaccagcaaggctgctcgggggcccctggttcgtccctgagcctttttcacagtgcataagcagttttttttgtttttgttttgttttgttttgtttttaaatcaatcatgttacactaatagaaacttggcactcctgtgccctctgcctggacaagcacatagcaagctgaactgtcctaaggcaggggcgagcacggaacaatggggccttcagctggagctgtggacttttgtacatacactaaaattctgaagttaaagctcaaaaacacaagagaaaaaaaaacatacaaaacagaacagagagaaacaaaataacaaaaataacagaacacgagacgaaaagagacacacagagaacgaggaacccatgataagaacgacagaaaagaacggaaagcagcagaactgatgagaccagagcggatggacacgctgcagaggggacggcggctgagcagtgaccgggcaccagatgtgccatgttggaggaagtgcagagaggaccggagagacaggcctggtgacccacagagccatgtgaaggcataccatggaagcgtaatcagaataatccatagatctccaaatagctgcatagatcaaccccattatacttatgggaaggcataaatggcctgatcactgcagagacggtgtagaggacaaagaactctgagacatttacatgtgaaagggccccagacccttgatgaacaaaagcgcagctcggtgcacagaaaatgggaagaaacacgaggtacgggcgggactccaggatgggatggaaaccggtggatcatatcccagttagcaaagaagccttcacaaggttcgaaatcttaacttgggagattccaggatccgtatagcaaagtggttcaagtctaaaaaacaagacgcatatggcctaggaggcccatggaacacaaaggaagaccacttgagtcgcattaagagacgcctcggtgccccccataagggagaaaaccaattttaagagggtttgaacagcgtggccctaaggcgacccatggggaacaattcgaattccaaggcaacattaagacagtttcacaaggcccatgcgaacttggcctacactgggaacattgggagaccaaaaagtgcgataacaagagtaaggaaaataggaccaatatgaacacagaaaacccccctg

SEQ ID NO: 314657 - DNA, 2229 bp, Homo sapiens
gctgttgcaacactgcctcactcttcccctcccaccttctctcccctcctctctgctttaattttctcagaattctctggactgaggctccagttctggcctttggggttcaagatcactgggaccaggccgtgatctctatgcccgagtctcaaccctcaactgtcaccccaaggcacttgggacgtcctggacagaccgagtcccgggaagccccagcactgccgctgccacactgccctgagcccaaatgggggagtgagaggccatagctgtctggcatgggcctctccaccgtgcctgacctgctgctgccactggtgctcctggagctgttggtgggaatatacccctcaggggttattggactggtccctcacctaggggacagggagaagagagatagtgtgtgtccccaaggaaaatatatccaccctcaaaataattcgatttgctgtaccaagtgccacaaaggaacctacttgtacaatgactgtccaggcccggggcaggatacggactgcagggagtgtgagagcggctccttcaccgcttcagaaaaccacctcagacactgcctcagctgctccaaatgccgaaaggaaatgggtcaggtggagatctcttcttgcacagtggaccgggacaccgtgtgtggctgcaggaagaaccagtaccggcattattggagtgaaaaccttttccagtgcttcaattgcagcctctgcctcaatgggaccgtgcacctctcctgccaggagaaacagaacaccgtgtgcacctgccatgcaggtttctttctaagagaaaacgagtgtgtctcctgtagtaactgtaagaaaagcctggagtgcacgaagttgtgcctaccccagattgagaatgttaagggcactgaggactcaggcaccacagtgctgttgcccctggtcattttctttggtctttgccttttatccctcctcttcattggtttaatgtatcgctaccaacggtggaagtccaagctctactccattgtttgtgggaaatcgacacctgaaaaagagggggagcttgaaggaactactactaagcccctggccccaaacccaagcttcagtcccactccaggcttcacccccaccctgggcttcagtcccgtgcccagttccaccttcacctccagctccacctatacccccggtgactgtcccaactttgcggctccccgcagagaggtggcaccaccctatcagggggctgaccccatccttgcgacagccctcgcctccgaccccatccccaacccccttcagaagtgggaggacagcgcccacaagccacagagcctagacactgatgaccccgcgacgctgtacgccgtggtggagaacgtgcccccgttgcgctggaaggaattcgtgcggcgcctagggctgagcgaccacgagatcgatcggctggagctgcagaacgggcgctgcctgcgcgaggcgcaatacagcatgctggcgacctggaggcggcgcacgccgcggcgcgaggccacgctggagctgctgggacgcgtgctccgcgacatggacctgctgggctgcctggaggacatcgaggaggcgctttgcggccccgccgccctcccgcccgcgcccagtcttctcagatgaggctgcgcccctgcgggcagctctaaggaccgtcctgcgagatcgccttccaaccccacttttttctggaaaggaggggtcctgcaggggcaagcaggagctagcagccgcctacttggtgctaacccctcgatgtacatagcttttctcagctgcctgcgcgccgccgacagtcagcgctgtgcgcgcggagagaggtgcgccgtgggctcaagagcctgagtgggtggtttgcgaggatgagggacgctatgcctcatgcccgttttgggtgtcctcaccagcaaggctgctcgggggcccctggttcgtccctgagcctttttcacagtgcataagcagttttttttgtttttgttttgttttgttttgtttttaaatcaatcatgttacactaatagaaacttggcactcctgtgccctctgcctggacaagcacatagcaagctgaactgtcctaaggcaggggcgagcacggaacaatggggccttcagctggagctgtggacttttgtacatacactaaaattctgaagttaaagctcaaacaacacacaaacaaaaaaaaaaaaaaaacaaa

SEQ ID NO: 314658 - DNA, 2317 bp, Homo sapiens
gctgttgcaacactgcctcactcttcccctcccaccttctctcccctcctctctgctttaattttctcagaattctctggactgaggctccagttctggcctttggggttcaagatcactgggaccaggccgtgatctctatgcccgagtctcaaccctcaactgtcaccccaaggcacttgggacgtcctggacagaccgagtcccgggaagccccagcactgccgctgccacactgccctgagcccaaatgggggagtgagaggccatagctgtctggcatgggcctctccaccgtgcctgacctgctgctgccactggtgctcctggagctgttggtgggaatatacccctcaggggttattggactggtccctcacctaggggacagggagaagagagatagtgtgtgtccccaaggaaaatatatccaccctcaaaataattcgatttgctgtaccaagtgccacaaaggaacctacttgtacaatgactgtccaggcccggggcaggatacggactgcagggagtgtgagagcggctccttcaccgcttcagaaaaccacctcagacactgcctcagctgctccaaatgccgaaaggaaatgggtcaggtggagatctcttcttgcacagtggaccgggacaccgtgtgtggctgcaggaagaaccagtaccggcattattggagtgaaaaccttttccagtgcttcaattgcagcctctgcctcaatgggaccgtgcacctctcctgccaggagaaacagaacaccgtgtgcacctgccatgcaggtttctttctaagagaaaacgagtgtgtctcctgtagtaactgtaagaaaagcctggagtgcacgaagttgtgcctaccccagattgagaatgttaagggcactgaggactcaggcaccacagtgctgttgcccctggtcattttctttggtctttgccttttatccctcctcttcattggtttaatgtatcgctaccaacggtggaagtccaagctctactccattgtttgtgggaaatcgacacctgaaaaagagggggagcttgaaggaactactactaagcccctggccccaaacccaagcttcagtcccactccaggcttcacccccaccctgggcttcagtcccgtgcccagttccaccttcacctccagctccacctatacccccggtgactgtcccaactttgcggctccccgcagagaggtggcaccaccctatcagggggctgaccccatccttgcgacagccctcgcctccgaccccatccccaacccccttcagaagtgggaggacagcgcccacaagccacagagcctagacactgatgaccccgcgacgctgtacgccgtggtggagaacgtgcccccgttgcgctggaaggaattcgtgcggcgcctagggctgagcgaccacgagatcgatcggctggagctgcagaacgggcgctgcctgcgcgaggcgcaatacagcatgctggcgacctggaggcggcgcacgccgcggcgcgaggccacgctggagctgctgggacgcgtgctccgcgacatggacctgctgggctgcctggaggacatcgaggaggcgctttgcggccccgccgccctcccgcccgcgcccagtcttctcagatgaggctgcgcccctgcgggcagctctaaggaccgtcctgcgagatcgccttccaaccccacttttttctggaaaggaggggtcctgcaggggcaagcaggagctagcagccgcctacttggtgctaacccctcgatgtacatagcttttctcagctgcctgcgcgccgccgacagtcagcgctgtgcgcgcggagagaggtgcgccgtgggctcaagagcctgagtgggtggtttgcgaggatgagggacgctatgcctcatgcccgttttgggtgtcctcaccagcaaggctgctcgggggcccctggttcgtccctgagcctttttcacagtgcataagcagttttttttgtttttgttttgttttgttttgtttttaaatcaatcatgttacactaatagaaacttggcactcctgtgccctctgcctggacaagcacatagcaagctgaactgtcctaaggcaggggcgagcacggaacaatggggccttcagctggagctgtggacttttgtacatacactaaaattctgaagttaaagctcaaaaaaaaaaaaaaaagatatgcggccgcctatcttttttttttttttttttttttttttttttcccccccggaattttcccttcttattattttgcttttttaaagggggtttttttcaggg

SEQ ID NO: 314659 - DNA, 2106 bp, Homo sapiens
gctgttgcaacactgcctcactcttcccctcccaccttctctcccctcctctctgctttaattttctcagaattctctggactgaggctccagttctggcctttggggttcaagatcactgggaccaggccgtgatctctatgcccgagtctcaaccctcaactgtcaccccaaggcacttgggacgtcctggacagaccgagtcccgggaagccccagcactgccgctgccacactgccctgagcccaaatgggggagtgagaggccatagctgtctggcatgggcctctccaccgtgcctgacctgctgctgccactggtgctcctggagctgttggtgggaatatacccctcaggggttattggactggtccctcacctaggggacagggagaagagagatagtgtgtgtccccaaggaaaatatatccaccctcaaaataattcgatttgctgtaccaagtgccacaaaggaacctacttgtacaatgactgtccaggcccggggcaggatacggactgcagggagtgtgagagcggctccttcaccgcttcagaaaaccacctcagacactgcctcagctgctccaaatgccgaaaggaaatgggtcaggtggagatctcttcttgcacagtggaccgggacaccgtgtgtggctgcaggaagaaccagtaccggcattattggagtgaaaaccttttccagtgcttcaattgcagcctctgcctcaatgggaccgtgcacctctcctgccaggagaaacagaacaccgtgtgcacctgccatgcaggtttctttctaagagaaaacgagtgtgtctcctgtagtaactgtaagaaaagcctggagtgcacgaagttgtgcctaccccagattgagaatgttaagggcactgaggactcaggcaccacagtgctgttgcccctggtcattttctttggtctttgccttttatccctcctcttcattggtttaatgtatcgctaccaacggtggaagtccaagctctactccattgtttgtgggaaatcgacacctgaaaaagagggggagcttgaaggaactactactaagcccctggccccaaacccaagcttcagtcccactccaggcttcacccccaccctgggcttcagtcccgtgcccagttccaccttcacctccagctccacctatacccccggtgactgtcccaactttgcggctccccgcagagaggtggcaccaccctatcagggggctgaccccatccttgcgacagccctcgcctccgaccccatccccaacccccttcagaagtgggaggacagcgcccacaagccacagagcctagacactgatgaccccgcgacgctgtacgccgtggtggagaacgtgcccccgttgcgctggaaggaattcgtgcggcgcctagggctgagcgaccacgagatcgatcggctggagctgcagaacgggcgctgcctgcgcgaggcgcaatacagcatgctggcgacctggaggcggcgcacgccgcggcgcgaggccacgctggagctgctgggacgcgtgctccgcgacatggacctgctgggctgcctggaggacatcgaggaggcgctttgcggccccgccgccctcccgcccgcgcccagtcttctcagatgaggctgcgcccctgcgggcagctctaaggaccgtcctgcgagatcgccttccaaccccacttttttctggaaaggaggggtcctgcaggggcaagcaggagctagcagccgcctacttggtgctaacccctcgatgtacatagcttttctcagctgcctgcgcgccgccgacagtcagcgctgtgcgcgcggagagaggtgcgccgtgggctcaagagcctgagtgggtggtttgcgaggatgagggacgctatgcctcatgcccgttttgggtgtcctcaccagcaaggctgctcgggggcccctggttcgtccctgagcctttttcacagtgcataagcagttttttttgtttttgttttgttttgttttgtttttaaatcaatcatggaacaatggggccttcagctggagctgtggacttttgtacatacactaaaattctgaagttaaagctc

SEQ ID NO: 314660 - DNA, 1828 bp, Homo sapiens
  misc_feature (1759)..(1759): n is a, c, g, or t
  misc_feature (1782)..(1782): n is a, c, g, or t
  misc_feature (1823)..(1823): n is a, c, g, or t
gctgttgcaacactgcctcactcttcccctcccaccttctctcccctcctctctgctttaattttctcagaattctctggactgaggctccagttctggcctttggggttcaagatcactgggaccaggccgtgatctctatgcccgagtctcaaccctcaactgtcaccccaaggcacttgggacgtcctggacagaccgagtcccgggaagccccagcactgccgctgccacactgccctgagcccaaatgggggagtgagaggccatagctgtctggcatgggcctctccaccgtgcctgacctgctgctgccactggtgctcctggagctgttggtgggaatatacccctcaggggttattggactggtccctcacctaggggacagggagaagagagatagtgtgtgtccccaaggaaaatatatccaccctcaaaataattcgatttgctgtaccaagtgccacaaaggaacctacttgtacaatgactgtccaggcccggggcaggatacggactgcagggagtgtgagagcggctccttcaccgcttcagaaaaccacctcagacactgcctcagctgctccaaatgccgaaaggaaatgggtcaggtggagatctcttcttgcacagtggaccgggacaccgtgtgtggctgcaggaagaaccagtaccggcattattggagtgaaaaccttttccagtgcttcaattgcagcctctgcctcaatgggaccgtgcacctctcctgccaggagaaacagaacaccgtgtgcacctgccatgcaggtttctttctaagagaaaacgagtgtgtctcctgtagtaactgtaagaaaagcctggagtgcacgaagttgtgcctaccccagattgagaatgttaagggcactgaggactcaggcaccacagtgctgttgcccctggtcattttctttggtctttgccttttatccctcctcttcattggtttaatgtatcgctaccaacggtggaagtccaagctctactccattgtttgtgggaaatcgacacctgaaaaagagggggagcttgaaggaactactactaagcccctggccccaaacccaagcttcagtcccactccaggcttcacccccaccctgggcttcagtcccgtgcccagttccaccttcacctccagctccacctatacccccggtgactgtcccaactttgcggctccccgcagagaggtggcaccaccctatcagggggctgaccccatccttgcgacagccctcgcctccgaccccatccccaacccccttcagaagtgggaggacagcgcccacaagccacagagcctagacactgatgaccccgcgacgctgtacgccgtggtggagaacgtgcccccgttgcgctggaaggaattcgtgcggcgcctagggctgagcgaccacgagatcgatcggctggagctgcagaacgggcgctgcctgcgcgaggcgcaatacagcatgctggcgacctggaggcggcgcacgccgcggcgcgaggccacgctggagctgctgggacgcgtgctccgcgacatggacctgctgggctgcctggaggacatcgaggaggcgctttgcggccccgccgccctcccgcccgcgcccagtcttctcagatgaggctgcgcccctgcgggcagctctaaggaccgtcctgcgagatcgccttccaaccccacttttttctggggaaaagggaaggggttccttggcaagggggccaaagccanggaaaccttagccaagccccggnccttaactttgggggggccttaaacccccctttggaatggnaccca

SEQ ID NO: 314661 - DNA, 1338 bp, Homo sapiens
gctgttgcaacactgcctcactcttcccctcccaccttctctcccctcctctctgctttaattttctcagaattctctggactgaggctccagttctggcctttggggttcaagatcactgggaccaggccgtgatctctatgcccgagtctcaaccctcaactgtcaccccaaggcacttgggacgtcctggacagaccgagtcccgggaagccccagcactgccgctgccacactgccctgagcccaaatgggggagtgagaggccatagctgtctggcatgggcctctccaccgtgccttcacctccagctccacctatacccccggtgactgtcccaactttgcggctccccgcagagaggtggcaccaccctatcagggggctgaccccatccttgcgacagccctcgcctccgaccccatccccaacccccttcagaagtgggaggacagcgcccacaagccacagagcctagacactgatgaccccgcgacgctgtacgccgtggtggagaacgtgcccccgttgcgctggaaggaattcgtgcggcgcctagggctgagcgaccacgagatcgatcggctggagctgcagaacgggcgctgcctgcgcgaggcgcaatacagcatgctggcgacctggaggcggcgcacgccgcggcgcgaggccacgctggagctgctgggacgcgtgctccgcgacatggacctgctgggctgcctggaggacatcgaggaggcgctttgcggccccgccgccctcccgcccgcgcccagtcttctcagatgaggctgcgcccctgcgggcagctctaaggaccgtcctgcgagatcgccttccaaccccacttttttctggaaaggaggggtcctgcaggggcaagcaggagctagcagccgcctacttggtgctaacccctcgatgtacatagcttttctcagctgcctgcgcgccgccgacagtcagcgctgtgcgcgcggagagaggtgcgccgtgggctcaagagcctgagtgggtggtttgcgaggatgagggacgctatgcctcatgcccgttttgggtgtcctcaccagcaaggctgctcgggggcccctggttcgtccctgagcctttttcacagtgcataagcagttttttttgtttttgttttgttttgttttgtttttaaatcaatcatgttacactaatagaaacttggcactcctgtgccctctgcctggacaagcacatagcaagctgaactgtcctaaggcaggggcgagcacggaacaatggggccttcagctggagctgtggacttttgtacatacactaaaattctgaagttaaagctc

SEQ ID NO: 314662 - DNA, 1175 bp, Homo sapiens
gctgttgcaacactgcctcactcttcccctcccaccttctctcccctcctctctgctttaattttctcagaattctctggactgaggctccagttctggcctttggggttcaagatcactgggaccaggccgtgatctctatgcccgagtctcaaccctcaactgtcaccccaaggcacttgggacgtcctggacagaccgagtcccgggaagccccagcactgccgctgccacactgccctgagcccaaatgggggagtgagaggccatagctgtctggcatgggcctctccaccgtgcctgacctgctgctgccactggtgctcctggagctgttggtgggaatatacccctcaggggttattggactggtccctcacctaggggacagggagaagagagatagtgtgtgtccccaaggaaaatatatccaccctcaaaataattcgatttgctgtaccaagtgccacaaaggaacctacttgtacaatgactgtccaggcccggggcaggatacggactgcagggagtgtgagagcggctccttcaccgcttcagaaaaccacctcagacactgcctcagctgctccaaatgccgaaaggaaatgggtcaggtggagatctcttcttgcacagtggaccgggacaccgtgtgtggctgcaggaagaaccagtaccggcattattggagtgaaaaccttttccagtgcttcaattgcagcctctgcctcaatgggaccgtgcacctctcctgccaggagaaacagaacaccgtgtgcacctgccatgcaggtttctttctaagagaaaacgagtgtgtctcctgtagtaactgtaagaaaagcctggagtgcacgaagttgtgcctaccccagattgagaatgttaagggcactgaggactcaggcaccacagtgctgttgcccctggtcattttctttggtctttgcctttttcacagtgcataagcagttttttttgtttttgttttgttttgttttgtttttaaatcaatcatgttacactaatagaaacttggcactcctgtgccctctgcctggacaagcacatagcaagctgaactgtcctaaggcaggggcgagcacggaacaatggggccttcagctggagctgtggacttttgtacatacactaaaattctgaagttaaagctc

SEQ ID NO: 314663 - DNA, 2094 bp, Homo sapiens
gctgttgcaacactgcctcactcttcccctcccaccttctctcccctcctctctgctttaattttctcagaattctctggactgaggctccagttctggcctttggggttcaagatcactgggaccaggccgtgatctctatgcccgagtctcaaccctcaactgtcaccccaaggcacttgggacgtcctggacagaccgagtcccgggaagccccagcactgccgctgccacactgccctgagcccaaatgggggagtgagaggccatagctgtctggcatgggcctctccaccgtgcctgacctgctgctgccactggtgctcctggagctgttggtgggaatatacccctcaggggttattggactggtccctcacctaggggacagggagaagagagatagtgtgtgtccccaaggaaaatatatccaccctcaaaataattcgatttgctgtaccaagtgccacaaaggaacctacttgtacaatgactgtccaggcccggggcaggatacggactgcagggagtgtgagagcggctccttcaccgcttcagaaaaccacctcagacactgcctcagctgctccaaatgccgaaaggaaatgggtcaggtggagatctcttcttgcacagtggaccgggacaccgtgtgtggctgcaggaagaaccagtaccggcattattggagtgaaaaccttttccagtgcttcaattgcagcctctgcctcaatgggaccgtgcacctctcctgccaggagaaacagaacaccgtgtgcacctgccatgcaggtttctttctaagagaaaacgagtgtgtctcctgtagtaactgtaagaaaagcctggagtgcacgaagttgtgcctaccccagattgagaatgttaagggcactgaggactcaggcaccacagtgctgttgcccctggtcattttctttggtctttgcctttttcacagtgcataagcagttttttttgtttttgttttgttttgttttgtttttaaatcaatcatgttacactaatagaaacttggcactcctgtgccctctgcctggacaagcacatagcaagctgaactgtcctaaggcaggggcgagcacggaacaatggggccttcagctggagctgtggacttttgtacatacactaaaattctgaagttaaagctcaaaaacacaagagaaaaaaaaacatacaaaacagaacagagagaaacaaaataacaaaaataacagaacacgagacgaaaagagacacacagagaacgaggaacccatgataagaacgacagaaaagaacggaaagcagcagaactgatgagaccagagcggatggacacgctgcagaggggacggcggctgagcagtgaccgggcaccagatgtgccatgttggaggaagtgcagagaggaccggagagacaggcctggtgacccacagagccatgtgaaggcataccatggaagcgtaatcagaataatccatagatctccaaatagctgcatagatcaaccccattatacttatgggaaggcataaatggcctgatcactgcagagacggtgtagaggacaaagaactctgagacatttacatgtgaaagggccccagacccttgatgaacaaaagcgcagctcggtgcacagaaaatgggaagaaacacgaggtacgggcgggactccaggatgggatggaaaccggtggatcatatcccagttagcaaagaagccttcacaaggttcgaaatcttaacttgggagattccaggatccgtatagcaaagtggttcaagtctaaaaaacaagacgcatatggcctaggaggcccatggaacacaaaggaagaccacttgagtcgcattaagagacgcctcggtgccccccataagggagaaaaccaattttaagagggtttgaacagcgtggccctaaggcgacccatggggaacaattcgaattccaaggcaacattaagacagtttcacaaggcccatgcgaacttggcctacactgggaacattgggagaccaaaaagtgcgataacaagagtaaggaaaataggaccaatatgaacacagaaaacccccctg

SEQ ID NO: 314664 - DNA, 175 bp, Homo sapiens
attggagtgaaaaccttttccagtgcttcaattgcagcctctgcctcaatgggaccgtgcacctctcctgtgagcgcagctctcctgaggccaagccctctccccaccccaggggttggccccttccccatgcggtggcacttcctttccttccccctcctgtattctgtgggtc

SEQ ID NO: 314665 - DNA, 371 bp, Homo sapiens
cattttctacacagccttttcaagatccctgccaattctaaaattaaatgattctatgattaactgtgtttcattcttctgcatcagttcccaaaacaaattatatcaagagacagcaaaaatatttgtaaagaaaggatgtccaacaatctgtgtggttgtttttctgtgttcctccaatggtagggcctctgttcaccagtgccgtctcttcttttagctgtaagaaaagcctggagtgcacgaagttgtgcctaccccagattgagaatgttaagggcactgaggactcaggtgaggagaagtgacctggtgcccatgctcacctgccctctccctcttcttgcccccacccgtccatccatcccacc

SEQ ID NO: 314666 - DNA, 2194 bp, Homo sapiens
gctgttgcaacactgcctcactcttcccctcccaccttctctcccctcctctctgctttaattttctcagaattctctggactgaggctccagttctggcctttggggttcaagatcactgggaccaggccgtgatctctatgcccgagtctcaaccctcaactgtcaccccaaggcacttgggacgtcctggacagaccgagtcccgggaagccccagcactgccgctgccacactgccctgagcccaaatgggggagtgagaggccatagctgtctggcatgggcctctccaccgtgcctgacctgctgctgccactggtgctcctggagctgttggtgggaatatacccctcaggggttattggactggtccctcacctaggggacagggagaagagagatagtgtgtgtccccaaggaaaatatatccaccctcaaaataattcgatttgctgtaccaagtgccacaaaggaacctacttgtacaatgactgtccaggcccggggcaggatacggactgcagggagtgtgagagcggctccttcaccgcttcagaaaaccacctcagacactgcctcagctgctccaaatgccgaaaggaaatgggtcaggtggagatctcttcttgcacagtggaccgggacaccgtgtgtggctgcaggaagaaccagtaccggcattattggagtgaaaaccttttccagtgcttcaattgcagcctctgcctcaatgggaccgtgcacctctcctgccaggagaaacagaacaccgtgtgcacctgccatgcaggtttctttctaagagaaaacgagtgtgtctcctgtagtaactgtaagaaaagcctggagtgcacgaagttgtgcctaccccagattgagaatgttaagggcactgaggactcaggcaccacagtgctgttgcccctggtcattttctttggtctttgccttttatccctcctcttcattggtttaatgtatcgctaccaacggtggaagtccaagctctactccattgtttgtgggaaatcgacacctgaaaaagagggggagcttgaaggaactactactaagcccctggccccaaacccaagcttcagtcccactccaggcttcacccccaccctgggcttcagtcccgtgcccagttccaccttcacctccagctccacctatacccccggtgactgtcccaactttgcggctccccgcagagaggtggcaccaccctatcagggggctgaccccatccttgcgacagccctcgcctccgaccccatccccaacccccttcagaagtgggaggacagcgcccacaagccacagagcctagacactgatgaccccgcgacgctgtacgccgtggtggagaacgtgcccccgttgcgctggaaggaattcgtgcggcgcctagggctgagcgaccacgagatcgatcggctggagctgcagaacgggcgctgcctgcgcgaggcgcaatacagcatgctggcgacctggaggcggcgcacgccgcggcgcgaggccacgctggagctgctgggacgcgtgctccgcgacatggacctgctgggctgcctggaggacatcgaggaggcgctttgcggccccgccgccctcccgcccgcgcccagtcttctcagatgaggctgcgcccctgcgggcagctctaaggaccgtcctgcgagatcgccttccaaccccacttttttctggaaaggaggggtcctgcaggggcaagcaggagctagcagccgcctacttggtgctaacccctcgatgtacatagcttttctcagctgcctgcgcgccgccgacagtcagcgctgtgcgcgcggagagaggtgcgccgtgggctcaagagcctgagtgggtggtttgcgaggatgagggacgctatgcctcatgcccgttttgggtgtcctcaccagcaaggctgctcgggggcccctggttcgtccctgagcctttttcacagtgcataagcagttttttttgtttttgttttgttttgttttgtttttaaatcaatcatgttacactaatagaaacttggcactcctgtgccctctgcctggacaagcacatagcaagctgaactgtcctaaggcaggggcgagcacggaacaatggggccttcagctggagctgtggacttttgtacatacactaaaattctgaagttaaagctc

SEQ ID NO: 314667 - DNA, 2331 bp, Homo sapiens
ctggcaggggagataccatgatcacgaaggtggttttcccagggcgaggcttatccattgcactccggatgtgctgacccctgcgatttccccaaatgtgggaaactcgactgcataatttgtggtagtgggggactgcgttcgcgctttcccctgactcttcccctcccaccttctctcccctcctctctgctttaattttctcagaattctctggactgaggctccagttctggcctttggggttcaagatcactgggaccaggccgtgatctctatgcccgagtctcaaccctcaactgtcaccccaaggcacttgggacgtcctggacagaccgagtcccgggaagccccagcactgccgctgccacactgccctgagcccaaatgggggagtgagaggccatagctgtctggcatgggcctctccaccgtgcctgacctgctgctgccactggtgctcctggagctgttggtgggaatatacccctcaggggttattggactggtccctcacctaggggacagggagaagagagatagtgtgtgtccccaaggaaaatatatccaccctcaaaataattcgatttgctgtaccaagtgccacaaaggaacctacttgtacaatgactgtccaggcccggggcaggatacggactgcagggagtgtgagagcggctccttcaccgcttcagaaaaccacctcagacactgcctcagctgctccaaatgccgaaaggaaatgggtcaggtggagatctcttcttgcacagtggaccgggacaccgtgtgtggctgcaggaagaaccagtaccggcattattggagtgaaaaccttttccagtgcttcaattgcagcctctgcctcaatgggaccgtgcacctctcctgccaggagaaacagaacaccgtgtgcacctgccatgcaggtttctttctaagagaaaacgagtgtgtctcctgtagtaactgtaagaaaagcctggagtgcacgaagttgtgcctaccccagattgagaatgttaagggcactgaggactcaggcaccacagtgctgttgcccctggtcattttctttggtctttgccttttatccctcctcttcattggtttaatgtatcgctaccaacggtggaagtccaagctctactccattgtttgtgggaaatcgacacctgaaaaagagggggagcttgaaggaactactactaagcccctggccccaaacccaagcttcagtcccactccaggcttcacccccaccctgggcttcagtcccgtgcccagttccaccttcacctccagctccacctatacccccggtgactgtcccaactttgcggctccccgcagagaggtggcaccaccctatcagggggctgaccccatccttgcgacagccctcgcctccgaccccatccccaacccccttcagaagtgggaggacagcgcccacaagccacagagcctagacactgatgaccccgcgacgctgtacgccgtggtggagaacgtgcccccgttgcgctggaaggaattcgtgcggcgcctagggctgagcgaccacgagatcgatcggctggagctgcagaacgggcgctgcctgcgcgaggcgcaatacagcatgctggcgacctggaggcggcgcacgccgcggcgcgaggccacgctggagctgctgggacgcgtgctccgcgacatggacctgctgggctgcctggaggacatcgaggaggcgctttgcggccccgccgccctcccgcccgcgcccagtcttctcagatgaggctgcgcccctgcgggcagctctaaggaccgtcctgcgagatcgccttccaaccccacttttttctggaaaggaggggtcctgcaggggcaagcaggagctagcagccgcctacttggtgctaacccctcgatgtacatagcttttctcagctgcctgcgcgccgccgacagtcagcgctgtgcgcgcggagagaggtgcgccgtgggctcaagagcctgagtgggtggtttgcgaggatgagggacgctatgcctcatgcccgttttgggtgtcctcaccagcaaggctgctcgggggcccctggttcgtccctgagcctttttcacagtgcataagcagttttttttgtttttgttttgttttgttttgtttttaaatcaatcatgttacactaatagaaacttggcactcctgtgccctctgcctggacaagcacatagcaagctgaactgtcctaaggcaggggcgagcacggaacaatggggccttcagctggagctgtggacttttgtacatacactaaaattctgaagttaaagctc

SEQ ID NO: 314668 - DNA, 2174 bp, Homo sapiens
  misc_feature (3)..(3): n is a, c, g, or t
aantaaaaaaaatttgtaaaaaaagaggtggtacggtccggaattcccgggatgacctggactgaggctccagttctggcctttggggttcaagatcactgggaccaggccgtgatctctatgcccgagtctcaaccctcaactgtcaccccaaggcacttgggacgtcctggacagaccgagtcccgggaagccccagcactgccgctgccacactgccctgagcccaaatgggggagtgagaggccatagctgtctggcatgggcctctccaccgtgcctgacctgctgctgccactggtgctcctggagctgttggtgggaatatacccctcaggggttattggactggtccctcacctaggggacagggagaagagagatagtgtgtgtccccaaggaaaatatatccaccctcaaaataattcgatttgctgtaccaagtgccacaaaggaacctacttgtacaatgactgtccaggcccggggcaggatacggactgcagggagtgtgagagcggctccttcaccgcttcagaaaaccacctcagacactgcctcagctgctccaaatgccgaaaggaaatgggtcaggtggagatctcttcttgcacagtggaccgggacaccgtgtgtggctgcaggaagaaccagtaccggcattattggagtgaaaaccttttccagtgcttcaattgcagcctctgcctcaatgggaccgtgcacctctcctgccaggagaaacagaacaccgtgtgcacctgccatgcaggtttctttctaagagaaaacgagtgtgtctcctgtagtaactgtaagaaaagcctggagtgcacgaagttgtgcctaccccagattgagaatgttaagggcactgaggactcaggcaccacagtgctgttgcccctggtcattttctttggtctttgccttttatccctcctcttcattggtttaatgtatcgctaccaacggtggaagtccaagctctactccattgtttgtgggaaatcgacacctgaaaaagagggggagcttgaaggaactactactaagcccctggccccaaacccaagcttcagtcccactccaggcttcacccccaccctgggcttcagtcccgtgcccagttccaccttcacctccagctccacctatacccccggtgactgtcccaactttgcggctccccgcagagaggtggcaccaccctatcagggggctgaccccatccttgcgacagccctcgcctccgaccccatccccaacccccttcagaagtgggaggacagcgcccacaagccacagagcctagacactgatgaccccgcgacgctgtacgccgtggtggagaacgtgcccccgttgcgctggaaggaattcgtgcggcgcctagggctgagcgaccacgagatcgatcggctggagctgcagaacgggcgctgcctgcgcgaggcgcaatacagcatgctggcgacctggaggcggcgcacgccgcggcgcgaggccacgctggagctgctgggacgcgtgctccgcgacatggacctgctgggctgcctggaggacatcgaggaggcgctttgcggccccgccgccctcccgcccgcgcccagtcttctcagatgaggctgcgcccctgcgggcagctctaaggaccgtcctgcgagatcgccttccaaccccacttttttctggaaaggaggggtcctgcaggggcaagcaggagctagcagccgcctacttggtgctaacccctcgatgtacatagcttttctcagctgcctgcgcgccgccgacagtcagcgctgtgcgcgcggagagaggtgcgccgtgggctcaagagcctgagtgggtggtttgcgaggatgagggacgctatgcctcatgcccgttttgggtgtcctcaccagcaaggctgctcgggggcccctggttcgtccctgagcctttttcacagtgcataagcagttttttttgtttttgttttgttttgttttgtttttaaatcaatcatgttacactaatagaaacttggcactcctgtgccctctgcctggacaagcacatagcaagctgaactgtcctaaggcaggggcgagcacggaacaatggggccttcagctggagctgtggacttttgtacatacactaaaattctgaagttaaagctc

SEQ ID NO: 314669 - DNA, 2313 bp, Homo sapiens
gctgttgcaacactgcctcactcttcccctcccaccttctctcccctcctctctgctttaattttctcagaattctctggactgaggctccagttctggcctttggggttcaagatcactgggaccaggccgtgatctctatgcccgagtctcaaccctcaactgtcaccccaaggcacttgggacgtcctggacagaccgagtcccgggaagccccagcactgccgctgccacactgccctgagcccaaatgggggagtgagaggccatagctgtctggcatgggcctctccaccgtgcctgacctgctgctgccactggtgctcctggagctgttggtgggaatatacccctcaggggttattggactggtccctcacctaggggacagggagaagagagatagtgtgtgtccccaaggaaaatatatccaccctcaaaataattcgatttgctgtaccaagtgccacaaaggaacctacttgtacaatgactgtccaggcccggggcaggatacggactgcagggagtgtgagagcggctccttcaccgcttcagaaaaccacctcagacactgcctcagctgctccaaatgccgaaaggaaatgggtcaggtggagatctcttcttgcacagtggaccgggacaccgtgtgtggctgcaggaagaaccagtaccggcattattggagtgaaaaccttttccagtgcttcaattgcagcctctgcctcaatgggaccgtgcacctctcctgccaggagaaacagaacaccgtgtgcacctgccatgcaggtttctttctaagagaaaacgagtgtgtctcctgtagtaaagtcctgctctgtcgcccaggctggaatgcagtggcgcgatctcggctcactgcaacctctgcctcccagattcaagcaattctcctgcttcagcctcccaagtagctgggattacaggctgtaagaaaagcctggagtgcacgaagttgtgcctaccccagattgagaatgttaagggcactgaggactcaggcaccacagtgctgttgcccctggtcattttctttggtctttgccttttatccctcctcttcattggtttaatgtatcgctaccaacggtggaagtccaagctctactccattgtttgtgggaaatcgacacctgaaaaagagggggagcttgaaggaactactactaagcccctggccccaaacccaagcttcagtcccactccaggcttcacccccaccctgggcttcagtcccgtgcccagttccaccttcacctccagctccacctatacccccggtgactgtcccaactttgcggctccccgcagagaggtggcaccaccctatcagggggctgaccccatccttgcgacagccctcgcctccgaccccatccccaacccccttcagaagtgggaggacagcgcccacaagccacagagcctagacactgatgaccccgcgacgctgtacgccgtggtggagaacgtgcccccgttgcgctggaaggaattcgtgcggcgcctagggctgagcgaccacgagatcgatcggctggagctgcagaacgggcgctgcctgcgcgaggcgcaatacagcatgctggcgacctggaggcggcgcacgccgcggcgcgaggccacgctggagctgctgggacgcgtgctccgcgacatggacctgctgggctgcctggaggacatcgaggaggcgctttgcggccccgccgccctcccgcccgcgcccagtcttctcagatgaggctgcgcccctgcgggcagctctaaggaccgtcctgcgagatcgccttccaaccccacttttttctggaaaggaggggtcctgcaggggcaagcaggagctagcagccgcctacttggtgctaacccctcgatgtacatagcttttctcagctgcctgcgcgccgccgacagtcagcgctgtgcgcgcggagagaggtgcgccgtgggctcaagagcctgagtgggtggtttgcgaggatgagggacgctatgcctcatgcccgttttgggtgtcctcaccagcaaggctgctcgggggcccctggttcgtccctgagcctttttcacagtgcataagcagttttttttgtttttgttttgttttgttttgtttttaaatcaatcatgttacactaatagaaacttggcactcctgtgccctctgcctggacaagcacatagcaagctgaactgtcctaaggcaggggcgagcacggaacaatggggccttcagctggagctgtggacttttgtacatacactaaaattctgaagttaaagctc

SEQ ID NO: 314670 - DNA, 2227 bp, Homo sapiens
acgccattctcctgcttcagcctcccgagtagctgggactacaggtgaccgccaccacgcctggctaatttttttgtatttttagtagagacggggtttcactgtgttagccaggatggtctcaatctcctgacctggtgatccatcagcctcggcctcccaaagtgctgggactacaggcatgagccaccgtgcccagaatgggaactcggtcagaggtgcacactctgaccgagtcccgggaagccccagcactgccgctgccacactgccctgagcccaaatgggggagtgagaggccatagctgtctggcatgggcctctccaccgtgcctgacctgctgctgccactggtgctcctggagctgttggtgggaatatacccctcaggggttattggactggtccctcacctaggggacagggagaagagagatagtgtgtgtccccaaggaaaatatatccaccctcaaaataattcgatttgctgtaccaagtgccacaaaggaacctacttgtacaatgactgtccaggcccggggcaggatacggactgcagggagtgtgagagcggctccttcaccgcttcagaaaaccacctcagacactgcctcagctgctccaaatgccgaaaggaaatgggtcaggtggagatctcttcttgcacagtggaccgggacaccgtgtgtggctgcaggaagaaccagtaccggcattattggagtgaaaaccttttccagtgcttcaattgcagcctctgcctcaatgggaccgtgcacctctcctgccaggagaaacagaacaccgtgtgcacctgccatgcaggtttctttctaagagaaaacgagtgtgtctcctgtagtaactgtaagaaaagcctggagtgcacgaagttgtgcctaccccagattgagaatgttaagggcactgaggactcaggcaccacagtgctgttgcccctggtcattttctttggtctttgccttttatccctcctcttcattggtttaatgtatcgctaccaacggtggaagtccaagctctactccattgtttgtgggaaatcgacacctgaaaaagagggggagcttgaaggaactactactaagcccctggccccaaacccaagcttcagtcccactccaggcttcacccccaccctgggcttcagtcccgtgcccagttccaccttcacctccagctccacctatacccccggtgactgtcccaactttgcggctccccgcagagaggtggcaccaccctatcagggggctgaccccatccttgcgacagccctcgcctccgaccccatccccaacccccttcagaagtgggaggacagcgcccacaagccacagagcctagacactgatgaccccgcgacgctgtacgccgtggtggagaacgtgcccccgttgcgctggaaggaattcgtgcggcgcctagggctgagcgaccacgagatcgatcggctggagctgcagaacgggcgctgcctgcgcgaggcgcaatacagcatgctggcgacctggaggcggcgcacgccgcggcgcgaggccacgctggagctgctgggacgcgtgctccgcgacatggacctgctgggctgcctggaggacatcgaggaggcgctttgcggccccgccgccctcccgcccgcgcccagtcttctcagatgaggctgcgcccctgcgggcagctctaaggaccgtcctgcgagatcgccttccaaccccacttttttctggaaaggaggggtcctgcaggggcaagcaggagctagcagccgcctacttggtgctaacccctcgatgtacatagcttttctcagctgcctgcgcgccgccgacagtcagcgctgtgcgcgcggagagaggtgcgccgtgggctcaagagcctgagtgggtggtttgcgaggatgagggacgctatgcctcatgcccgttttgggtgtcctcaccagcaaggctgctcgggggcccctggttcgtccctgagcctttttcacagtgcataagcagttttttttgtttttgttttgttttgttttgtttttaaatcaatcatgttacactaatagaaacttggcactcctgtgccctctgcctggacaagcacatagcaagctgaactgtcctaaggcaggggcgagcacggaacaatggggccttcagctggagctgtggacttttgtacatacactaaaattctgaagttaaagctc

SEQ ID NO: 314671 - DNA, 2859 bp, Homo sapiens
gctgttgcaacactgcctcactcttcccctcccaccttctctcccctcctctctgctttaattttctcagaattctctggactgaggctccagttctggcctttggggttcaagatcactgggaccaggccgtgatctctatgcccgagtctcaaccctcaactgtcaccccaaggcacttgggacgtcctggacagaccgagtcccgggaagccccagcactgccgctgccacactgccctgagcccaaatgggggagtgagaggccatagctgtctggcatgggcctctccaccgtgcctgacctgctgctgccactggtgctcctggagctgttggtgggaatatacccctcaggggttattggactggtccctcacctaggggacagggagaagagagatagtgtgtgtccccaaggaaaatatatccaccctcaaaataattcgatttgctgtaccaagtgccacaaaggaacctacttgtacaatgactgtccaggcccggggcaggatacggactgcagggagtgtgagagcggctccttcaccgcttcagaaaaccacctcagacactgcctcagctgctccaaatgccgaaaggaaatgggtcaggtggagatctcttcttgcacagtggaccgggacaccgtgtgtggctgcaggaagaaccagtaccggcattattggagtgaaaaccttttccagtgcttcaattgcagcctctgcctcaatgggaccgtgcacctctcctgccaggagaaacagaacaccgtgtgcacctgccatgcaggtttctttctaagagaaaacgagtgtgtctcctgtagtaactgtaagaaaagcctggagtgcacgaagttgtgcctaccccagattgagaatgttaagggcactgaggactcaggcaccacagtgctgttgcccctggtcattttctttggtctttgccttttatccctcctcttcattggtttaatgtatcgctaccaacggtggaagtccaagctctactccattgtttgtgggaaatcgacacctgaaaaagagggggagcttgaaggaactactactaagcccctggccccaaacccaagcttcagtcccactccaggcttcacccccaccctgggcttcagtcccgtgcccagttccaccttcacctccagctccacctatacccccggtgactgtcccaactttgcggctccccgcagagaggtggcaccaccctatcagggggctgaccccatccttgcgacagccctcgcctccgaccccatccccaacccccttcagaagtgggaggacagcgcccacaagccacagagcctagacactgatgaccccgcgacgctgtacgccgtggtggagaacgtgcccccgttgcgctggaaggaattcgtgcggcgcctagggctgagcgaccacgagatcgatcggctggagctgcagaacgggcgctgcctgcgcgaggcgcaatacagcatgctggcgacctggaggcggcgcacgccgcggcgcgaggccacgctggagctgctgggacgcgtgctccgcgacatggacctgctgggctgcctggaggacatcgaggaggcgctttgcggccccgccgccctcccgcccgcgcccagtcttctcagatgaggctgcgcccctgcgggcagctctaaggaccgtcctgcgagatcgccttccaaccccacttttttctggaaaggaggggtcctgcaggggcaagcaggagctagcagccgcctacttggtgctaacccctcgatgtacatagcttttctcagctgcctgcgcgccgccgacagtcagcgctgtgcgcgcggagagaggtgcgccgtgggctcaagagcctgagtgggtggtttgcgaggatgagggacgctatgcctcatgcccgttttgggtgtcctcaccagcaaggctgctcgggggcccctggttcgtccctgagcctttttcacagtgcataagcagttttttttgtttttgttttgttttgttttgtttttaaatcaatcatgttacactaatagaaacttggcactcctgtgccctctgcctggacaagcacatagcaagctgaactgtcctaaggcaggggcgagcacggaacaatggggccttcagctggagctgtggacttttgtacatacactaaaattctgaagttaaagctcaaaaaaaaaaaaaaaaaaaaaaaaaaactgtgttgtgggccgcgccccgcgcgccccctggaaaaagttttttaaacccttctgcgttgtggggcgcgcgcgggcgccccagttgggttagtgtgtgaacactgtgttggccccaagcgcggcgtgtttccccaggaggagaaaaccgcgggccgagaattggtgtggcgttgggtttctccccccacttaaaaaaacgcgcgcggggggacacccgagccgcggtcctggaacccaatcttccaggagggaggtctccgaggagggacagatacgcgggagtctctacccaacaacggtgagaggccccaacgcaaagcgcccaagaaatatctataaatttaaacggccccccgccccgtgggaggaaaaaaccaagcacagaagagagacacaagaaacgaagacaagacgaacgacaccagacagagaagaagcagaacagacaacgagagaagagcaaaacacaaagaacacgaaagaacgaaagcaacgaaggagcgaagaacgaacaaagagaccagaaggaaaacaacagagaaaggaaggagaagagaagagaagaaggaagcaagaaagaaggacaaaaaaaacaagaacaaacaacacacaaacaaaaaaaaaaaaaaaacaaa

SEQ ID NO: 314672 - DNA, 2419 bp, Homo sapiens
gctgttgcaacactgcctcactcttcccctcccaccttctctcccctcctctctgctttaattttctcagaattctctggactgaggctccagttctggcctttggggttcaagatcactgggaccaggccgtgatctctatgcccgagtctcaaccctcaactgtcaccccaaggcacttgggacgtcctggacagaccgagtcccgggaagccccagcactgccgctgccacactgccctgagcccaaatgggggagtgagaggccatagctgtctggcatgggcctctccaccgtgcctgacctgctgctgccactggtgctcctggagctgttggtgggaatatacccctcaggggttattggactggtccctcacctaggggacagggagaagagagatagtgtgtgtccccaaggaaaatatatccaccctcaaaataattcgatttgctgtaccaagtgccacaaaggtaggggcaagtggaaacggtgaatgccctcaggtctggggtgctgcttctttctctgcttcttccagttgttcttccctaactttgctgtctctcctgggctgggattttctccctccctcctctcctagagacttcagggaatcggccctggctgttgtccctagcatggggctccttccttgtgttctcacccgcagcctaactctgcggccccattcacaggaacctacttgtacaatgactgtccaggcccggggcaggatacggactgcagggagtgtgagagcggctccttcaccgcttcagaaaaccacctcagacactgcctcagctgctccaaatgccgaaaggaaatgggtcaggtggagatctcttcttgcacagtggaccgggacaccgtgtgtggctgcaggaagaaccagtaccggcattattggagtgaaaaccttttccagtgcttcaattgcagcctctgcctcaatgggaccgtgcacctctcctgccaggagaaacagaacaccgtgtgcacctgccatgcaggtttctttctaagagaaaacgagtgtgtctcctgtagtaactgtaagaaaagcctggagtgcacgaagttgtgcctaccccagattgagaatgttaagggcactgaggactcaggcaccacagtgctgttgcccctggtcattttctttggtctttgccttttatccctcctcttcattggtttaatgtatcgctaccaacggtggaagtccaagctctactccattgtttgtgggaaatcgacacctgaaaaagagggggagcttgaaggaactactactaagcccctggccccaaacccaagcttcagtcccactccaggcttcacccccaccctgggcttcagtcccgtgcccagttccaccttcacctccagctccacctatacccccggtgactgtcccaactttgcggctccccgcagagaggtggcaccaccctatcagggggctgaccccatccttgcgacagccctcgcctccgaccccatccccaacccccttcagaagtgggaggacagcgcccacaagccacagagcctagacactgatgaccccgcgacgctgtacgccgtggtggagaacgtgcccccgttgcgctggaaggaattcgtgcggcgcctagggctgagcgaccacgagatcgatcggctggagctgcagaacgggcgctgcctgcgcgaggcgcaatacagcatgctggcgacctggaggcggcgcacgccgcggcgcgaggccacgctggagctgctgggacgcgtgctccgcgacatggacctgctgggctgcctggaggacatcgaggaggcgctttgcggccccgccgccctcccgcccgcgcccagtcttctcagatgaggctgcgcccctgcgggcagctctaaggaccgtcctgcgagatcgccttccaaccccacttttttctggaaaggaggggtcctgcaggggcaagcaggagctagcagccgcctacttggtgctaacccctcgatgtacatagcttttctcagctgcctgcgcgccgccgacagtcagcgctgtgcgcgcggagagaggtgcgccgtgggctcaagagcctgagtgggtggtttgcgaggatgagggacgctatgcctcatgcccgttttgggtgtcctcaccagcaaggctgctcgggggcccctggttcgtccctgagcctttttcacagtgcataagcagttttttttgtttttgttttgttttgttttgtttttaaatcaatcatgttacactaatagaaacttggcactcctgtgccctctgcctggacaagcacatagcaagctgaactgtcctaaggcaggggcgagcacggaacaatggggccttcagctggagctgtggacttttgtacatacactaaaattctgaagttaaagctc

SEQ ID NO: 314673 - DNA, 2345 bp, Homo sapiens
gctgttgcaacactgcctcactcttcccctcccaccttctctcccctcctctctgctttaattttctcagaattctctggactgaggctccagttctggcctttggggttcaagatcactgggaccaggccgtgatctctatgcccgagtctcaaccctcaactgtcaccccaaggcacttgggacgtcctggacagaccgagtcccgggaagccccagcactgccgctgccacactgccctgagcccaaatgggggagtgagaggccatagctgtctggcatgggcctctccaccgtgcctgacctgctgctgccactggtgctcctggagctgttggtgggaatatacccctcaggggttattggactggtccctcacctaggggacagggagaagagagatagtgtgtgtccccaaggaaaatatatccaccctcaaaataattcgatttgctgtaccaagtgccacaaaggtaggggcaagtggaaacggtgaatgccctcaggtctggggtgctgcttctttctctgcttcttccagttgttcttccctaactttgctgtctctcctgggctgggattttctccctccctcctctcctagagacttcagggaatcggccctggctgttgtccctagcatggggctccttccttgtgttctcacccgcagcctaactctgcggccccattcacaggaacctacttgtacaatgactgtccaggcccggggcaggatacggactgcagggagtgtgagagcggctccttcaccgcttcagaaaaccacctcagacactgcctcagctgctccaaatgccgaaaggaaatgggtcaggtggagatctcttcttgcacagtggaccgggacaccgtgtgtggctgcaggaagaaccagtaccggcattattggagtgaaaaccttttccagtgcttcaattgcagcctctgcctcaatgggaccgtgcacctctcctgccaggagaaacagaacaccgtgtgcacctgccatgcaggtttctttctaagagaaaacgagtgtgtctcctgtagtaagcaccacagtgctgttgcccctggtcattttctttggtctttgccttttatccctcctcttcattggtttaatgtatcgctaccaacggtggaagtccaagctctactccattgtttgtgggaaatcgacacctgaaaaagagggggagcttgaaggaactactactaagcccctggccccaaacccaagcttcagtcccactccaggcttcacccccaccctgggcttcagtcccgtgcccagttccaccttcacctccagctccacctatacccccggtgactgtcccaactttgcggctccccgcagagaggtggcaccaccctatcagggggctgaccccatccttgcgacagccctcgcctccgaccccatccccaacccccttcagaagtgggaggacagcgcccacaagccacagagcctagacactgatgaccccgcgacgctgtacgccgtggtggagaacgtgcccccgttgcgctggaaggaattcgtgcggcgcctagggctgagcgaccacgagatcgatcggctggagctgcagaacgggcgctgcctgcgcgaggcgcaatacagcatgctggcgacctggaggcggcgcacgccgcggcgcgaggccacgctggagctgctgggacgcgtgctccgcgacatggacctgctgggctgcctggaggacatcgaggaggcgctttgcggccccgccgccctcccgcccgcgcccagtcttctcagatgaggctgcgcccctgcgggcagctctaaggaccgtcctgcgagatcgccttccaaccccacttttttctggaaaggaggggtcctgcaggggcaagcaggagctagcagccgcctacttggtgctaacccctcgatgtacatagcttttctcagctgcctgcgcgccgccgacagtcagcgctgtgcgcgcggagagaggtgcgccgtgggctcaagagcctgagtgggtggtttgcgaggatgagggacgctatgcctcatgcccgttttgggtgtcctcaccagcaaggctgctcgggggcccctggttcgtccctgagcctttttcacagtgcataagcagttttttttgtttttgttttgttttgttttgtttttaaatcaatcatgttacactaatagaaacttggcactcctgtgccctctgcctggacaagcacatagcaagctgaactgtcctaaggcaggggcgagcacggaacaatggggccttcagctggagctgtggacttttgtacatacactaaaattctgaagttaaagctc

SEQ ID NO: 314674 - DNA, 1043 bp, Homo sapiens
gctgttgcaacactgcctcactcttcccctcccaccttctctcccctcctctctgctttaattttctcagaattctctggactgaggctccagttctggcctttggggttcaagatcactgggaccaggccgtgatctctatgcccgagtctcaaccctcaactgtcaccccaaggcacttgggacgtcctggacagaccgagtcccgggaagccccagcactgccgctgccacactgccctgagcccaaatgggggagtgagaggccatagctgtctggcatgggcctctccaccgtgcctgacctgctgctgccactggtgctcctggagctgttggtgggaatatacccctcaggggttattggactggtccctcacctaggggacagggagaagagagatagtgtgtgtccccaaggaaaatatatccaccctcaaaataattcgatttgctgtaccaagtgccacaaaggaacctacttgtacaatgactgtccaggcccggggcaggatacggactgcagggagtgtgagagcggctccttcaccgcttcagaaaaccacctcagacactgcctcagctgctccaaatgccgaaaggaaatgggtcaggtggagatctcttcttgcacagtggaccgggacaccgtgtgtggctgcaggaagaaccagtaccggcattattggagtgaaaaccttttccagtgcttcaattgcagcctctgcctcaatgggaccgtgcacctctcctgccaggagaaacagaacaccgtgtgcacctgccatgcaggtttctttctaagagaaaacgagtgtgtctcctgtagtaactgtaagaaaagcctggagtgcacgaagttgtgcctaccccagattgagaatgttaagggcactgaggactcaggcaccacagtgctgttgcccctggtcattttctttggtctttgccttttatccctcctcttcattggtttaatgtatcgctaccaacggtggaagtccaagctctactccattggtgagtgggggctttgggaggga

SEQ ID NO: 314675 - DNA, 1740 bp, Homo sapiens
gctgttgcaacactgcctcactcttcccctcccaccttctctcccctcctctctgctttaattttctcagaattctctggactgaggctccagttctggcctttggggttcaagatcactgggaccaggccgtgatctctatgcccgagtctcaaccctcaactgtcaccccaaggcacttgggacgtcctggacagaccgagtcccgggaagccccagcactgccgctgccacactgccctgagcccaaatgggggagtgagaggccatagctgtctggcatgggcctctccaccgtgcctgacctgctgctgccactggtgctcctggagctgttggtgggaatatacccctcaggggttattggactggtccctcacctaggggacagggagaagagagatagtgtgtgtccccaaggaaaatatatccaccctcaaaataattcgatttgctgtaccaagtgccacaaaggaacctacttgtacaatgactgtccaggcccggggcaggatacggactgcagggagtgtgagagcggctccttcaccgcttcagaaaaccacctcagacactgcctcagctgctccaaatgccgaaaggaaatgggtcaggtggagatctcttcttgcacagtggaccgggacaccgtgtgtggctgcaggaagaaccagtaccggcattattggagtgaaaaccttttccagtgcttcaattgcagcctctgcctcaatgggaccgtgcacctctcctgccaggagaaacagaacaccgtgtgcacctgccatgcaggtttctttctaagagaaaacgagtgtgtctcctgtagtaaagtcctgctctgtcgcccaggctggaatgcagtggcgcgatctcggctcactgcaacctctgcctcccagattcaagcaattctcctgcttcagcctcccaagtagctgggattacaggacgtgccaccatgcctggctaatttttgtatttttagtagagatggggtttcaccatcttggtcaggctggtctcaaactcctggtgatccacctgcctctgcctcccaaagtgctgggattacagccgtgagccactgcacccagccggcttcatctcttcttgaaatcacttttataccattctatgtggttctcaccatgagcttgagtggtgggctaaagtgcctctccctgctttcagcttcctgctgggaactcactctctcaagttccttccagcaccaccccatagagttcccatcactccacactgtccagtgacaactcccaacatggaagatctgctagttctacagggtgctctctggctgccccagtaacatgtgtttttaaatttttcacatgcatgtttgaccccgactccccgaagtcaggtactgtaactagcagtgtcatttaagaaaaagccctttaacctctctttgccaaaggattcttatcagcaaaacagtgatgaaacaacaatcccataacagctagctggctaccttctcaagcacttattaaatgaggcataatgattttgcttaatcctcaatcctgagaggtgggcgatccctgtggtgatgaggaaaccgaggcttgggggttaatggcttgcctagattcacactgctagccaaggaatgaactggaatttacaccctgaccctgactgcttttcacattttctacacagccttttcaagatccctgccaattctaaaattaaatgattctatgatta

SEQ ID NO: 314676 - DNA, 351 bp, Homo sapiens
cgtcgacggaaatagtgtgtttgcttaggagtgtttactgtctggtaactactgtgctaagccctttcctgttgcctgccatccctgctgcgagcagggacaagctgggtgctcactcatggcatcttatctgttgcagatagtccactgtgtgcagaggcatgggagttgtcatgttgggaacatgctagacctcagtatccttgaggtaagatctctggttcattctctggaatgttggttccttgtatctagtacagttctgtacatgttcccaggggctttggggttggtgtaggggagctgagaggtgagatgagaatggcactgtgggtcgacgcggccgcgtgt

SEQ ID NO: 314677 - DNA, 709 bp, Homo sapiens
cgtcgacggaaatagtgtgtttgcttaggagtgtttactgtctggtaactactgtgctaagccctttcctgttgcctgccatccctgctgcgagcagggacaagctgggtgctcactcatggcatcttatctgttgcagatagtccactgtgtgcagaggcatgggagttgtcatgttgggaacatgctagacctcagtatccttgagggatgctgccttgggtctggaaactgttagaggaaaccccaagaggtgcaggcactgagcctctcaggacaatgacctggggtcccagctcccctggaggggcctcctcatgattgtttgggggttgatcacagaccaagagtgacgagtgatgtcaccctgtgactcatggccggaccttcttgcccctattgtctcagcacaacattattcgacttttccctcagcgtgggtgggcagaggaaaagccctgtggctctggggacttgggatccagagttgaagacccttcagctggctctgccctgccagtgccacagagtgccatggcccaggaagacaggttttcttccatctaggccaggccatccagtggccatcctccgtgtcctcccgcctcctcctggtgtgacttctgaaaaccaagaatttgttcctgttgactttttctgtgctatggaccattgtcctctcacccactcaataaatcttgaaacatgc

SEQ ID NO: 314678 - DNA, 1524 bp, Homo sapiens
gtatttccgcgggcgctgagcactagagagagcgtcttgtggctgcggcctgcccctcagcctcctccgcgcggttacccctgtacccgccgccatccgtcctggcgctccggatgagtcaatgaggggcagggcccgaggagtggtcttcccaagaacccctggtggcctcccaaggccggtgctgtgtacctcctccccgacaaaaggggaaactgaggccccgaggggagtgggaagagccggctggacgtcaggcccagccgctggtgcagtggtccgtcccctctgccggggtgggcccctcgggtttcgcgtgtcctcgggaaagagactggcgggtgagccgcgccctcggccttcgctgggctaagccgaccccatgcagacgtcaaacccccctaggtcggcacagcctctctgcggggaggcttagtgcccccttgagaaacggcttggcaacgctgtgcccggggccttgcacgcgggctgaggggggctagagacctcgcgacttttactcccccgaccccgatctccgactcctgactttggaagcccccaaagctgcttttcggttgcctacaaagtgtcggtcattgtgccacgtccttggaaccgtgaactcattttctcctcaataacctttaaaaagtagctgtaaaacctccattttacagaccagttggctgaggtttaaatggaggacgctcccagggccccagaggggcgaatttccagactcctttgccaggaccttgtactaagccccttccctacgcttttccctgcctaggcctcgtgggctgtgcggctatcctggagacagatgacagctctcccttggatggctttgctggttccgcaccagccagcgcccccatttttcctgcagcaccctgatctgcactccctgaggggctcccactgtccgcggtgtgaggatgtccctggatagtccactgtgtgcagaggcatgggagttgtcatgttgggaacatgctagacctcagtatccttgagggatgctgccttgggtctggaaactgttagaggaaaccccaagaggtgcaggcactgagcctctcaggacaatgacctggggtcccagctcccctggaggggcctcctcatgattgtttgggggttgatcacagaccaagagtgacgagtgatgtcaccctgtgactcatggccggaccttcttgcccctattgtctcagcacaacattattcgacttttccctcagcgtgggtgggcagaggaaaagccctgtggctctggggacttgggatccagagttgaagacccttcagctggctctgccctgccagtgccacagagtgccatggcccaggaagacaggttttcttccatctaggccaggccatccagtggccatcctccgtgtcctcccgcctcctcctggtgtgacttctgaaaaccaagaatttgttcctgttgactttttctgtgctatggaccattgtcctctcacccactcaataaatcttgaaacatgc

SEQ ID NO: 314679 - DNA, 1688 bp, Homo sapiens
gtatttccgcgggcgctgagcactagagagagcgtcttgtggctgcggcctgcccctcagcctcctccgcgcggttacccctgtacccgccgccatccgtcctggcgctccggatgagtcaatgaggggcagggcccgaggagtggtcttcccaagaacccctggtggcctcccaaggccggtgctgtgtacctcctccccgacaaaaggggaaactgaggccccgaggggagtgggaagagccggctggacgtcaggcccagccgctggtgcagtggtccgtcccctctgccggggtgggcccctcgggtttcgcgtgtcctcgggaaagagactggcgggtgagccgcgccctcggccttcgctgggctaagccgaccccatgcagacgtcaaacccccctaggtcggcacagcctctctgcggggaggcttagtgcccccttgagaaacggcttggcaacgctgtgcccggggccttgcacgcgggctgaggggggctagagacctcgcgacttttactcccccgaccccgatctccgactcctgactttggaagcccccaaagctgcttttcggttgcctacaaagtgtcggtcattgtgccacgtccttggaaccgtgaactcattttctcctcaataacctttaaaaagtagctgtaaaacctccattttacagaccagttggctgaggtttaaatggaggacgctcccagggccccagaggggcgaatttccagactcctttgccaggaccttgtactaagccccttccctacgcttttccctgcctaggcctcgtgggctgtgcggctatcctggagacagatgacagctctcccttggatggctttgctggttccgcaccagccagcgcccccatttttcctgcagcaccctgatctgcactccctgaggggctcccactgtccgcggtgtgaggatgtccctggaaattggtcttctgtgactttcttgatgggggcagatgagatctttgtactgcattaagtggatagcgctcaggtcctttgggcttggcgctttggcaatctccaggcagctcactttggcctctgttcctggatcccctttgctcttttctgcgcctgcattcatagtccactgtgtgcagaggcatgggagttgtcatgttgggaacatgctagacctcagtatccttgagggatgctgccttgggtctggaaactgttagaggaaaccccaagaggtgcaggcactgagcctctcaggacaatgacctggggtcccagctcccctggaggggcctcctcatgattgtttgggggttgatcacagaccaagagtgacgagtgatgtcaccctgtgactcatggccggaccttcttgcccctattgtctcagcacaacattattcgacttttccctcagcgtgggtgggcagaggaaaagccctgtggctctggggacttgggatccagagttgaagacccttcagctggctctgccctgccagtgccacagagtgccatggcccaggaagacaggttttcttccatctaggccaggccatccagtggccatcctccgtgtcctcccgcctcctcctggtgtgacttctgaaaaccaagaatttgttcctgttgactttttctgtgctatggaccattgtcctctcacccactcaataaatcttgaaacatgc

SEQ ID NO: 314680 - DNA, 1233 bp, Homo sapiens
gtatttccgcgggcgctgagcactagagagagcgtcttgtggctgcggcctgcccctcagcctcctccgcgcggttacccctgtacccgccgccatccgtcctggcgctccggatgagtcaatgaggggcagggcccgaggagtggtcttcccaagaacccctggtggcctcccaaggccggtgctgtgtacctcctccccgacaaaaggggaaactgaggccccgaggggagtgggaagagccggctggacgtcaggcccagccgctggtgcagtggtccgtcccctctgccggggtgggcccctcgggtttcgcgtgtcctcgggaaagagactggcgggcctcgtgggctgtgcggctatcctggagacagatgacagctctcccttggatggctttgctggttccgcaccagccagcgcccccatttttcctgcagcaccctgatctgcactccctgaggggctcccactgtccgcggtgtgaggatgtccctggaaattggtcttctgtgactttcttgatgggggcagatgagatctttgtactgcattaagtggatagcgctcaggtcctttgggcttggcgctttggcaatctccaggcagctcactttggcctctgttcctggatcccctttgctcttttctgcgcctgcattcatagtccactgtgtgcagaggcatgggagttgtcatgttgggaacatgctagacctcagtatccttgagggatgctgccttgggtctggaaactgttagaggaaaccccaagaggtgcaggcactgagcctctcaggacaatgacctggggtcccagctcccctggaggggcctcctcatgattgtttgggggttgatcacagaccaagagtgacgagtgatgtcaccctgtgactcatggccggaccttcttgcccctattgtctcagcacaacattattcgacttttccctcagcgtgggtgggcagaggaaaagccctgtggctctggggacttgggatccagagttgaagacccttcagctggctctgccctgccagtgccacagagtgccatggcccaggaagacaggttttcttccatctaggccaggccatccagtggccatcctccgtgtcctcccgcctcctcctggtgtgacttctgaaaaccaagaatttgttcctgttgactttttctgtgctatggaccattgtcctctcacccactcaataaatcttgaaacatgc

SEQ ID NO: 314681 - DNA, 1598 bp, Homo sapiens
gtatttccgcgggcgctgagcactagagagagcgtcttgtggctgcggcctgcccctcagcctcctccgcgcggttacccctgtacccgccgccatccgtcctggcgctccggatgagtcaatgaggggcagggcccgaggagtggtcttcccaagaacccctggtggcctcccaaggccggtgctgtgtacctcctccccgacaaaaggggaaactgaggccccgaggggagtgggaagagccggctggacgtcaggcccagccgctggtgcagtggtccgtcccctctgccggggtgggcccctcgggtttcgcgtgtcctcgggaaagagactggcgggtgagccgcgccctcggccttcgctgggctaagccgaccccatgcagacgtcaaacccccctaggtcggcacagcctctctgcggggaggcttagtgcccccttgagaaacggcttggcaacgctgtgcccggggccttgcacgcgggctgaggggggctagagacctcgcgacttttactcccccgaccccgatctccgactcctgactttggaagcccccaaagctgcttttcggttgcctacaaagtgtcggtcattgtgccacgtccttggaaccgtgaactcattttctcctcaataacctttaaaaagtagctgtaaaacctccattttacagaccagttggctgaggtttaaatggaggacgctcccagggccccagaggggcgaatttccagactcctttgccaggaccttgtactaagccccttccctacgcttttccctgcctaggcctcgtgggctgtgcggctatcctggagacagatgacagctctcccttggatggctttgctggttccgcaccagccagcgcccccatttttcctgcagcaccctgatctgcactccctgaggggctcccactgtccgcggtgtgaggatgtccctggatagtccactgtgtgcagaggcatgggagttgtcatgttgggaacatgctagacctcagtatccttgagcttgaagaaagacgacagaacactggagaccaagtacttacagccttctgctctgtggcccctcctcactccagggatgctgccttgggtctggaaactgttagaggaaaccccaagaggtgcaggcactgagcctctcaggacaatgacctggggtcccagctcccctggaggggcctcctcatgattgtttgggggttgatcacagaccaagagtgacgagtgatgtcaccctgtgactcatggccggaccttcttgcccctattgtctcagcacaacattattcgacttttccctcagcgtgggtgggcagaggaaaagccctgtggctctggggacttgggatccagagttgaagacccttcagctggctctgccctgccagtgccacagagtgccatggcccaggaagacaggttttcttccatctaggccaggccatccagtggccatcctccgtgtcctcccgcctcctcctggtgtgacttctgaaaaccaagaatttgttcctgttgactttttctgtgctatggaccattgtcctctcacccactcaataaatcttgaaacatgc

SEQ ID NO: 314682 - DNA, 1609 bp, Homo sapiens
gtatttccgcgggcgctgagcactagagagagcgtcttgtggctgcggcctgcccctcagcctcctccgcgcggttacccctgtacccgccgccatccgtcctggcgctccggatgagtcaatgaggggcagggcccgaggagtggtcttcccaagaacccctggtggcctcccaaggccggtgctgtgtacctcctccccgacaaaaggggaaactgaggccccgaggggagtgggaagagccggctggacgtcaggcccagccgctggtgcagtggtccgtcccctctgccggggtgggcccctcgggtttcgcgtgtcctcgggaaagagactggcgggtgagccgcgccctcggccttcgctgggctaagccgaccccatgcagacgtcaaacccccctaggtcggcacagcctctctgcggggaggcttagtgcccccttgagaaacggcttggcaacgctgtgcccggggccttgcacgcgggctgaggggggctagagacctcgcgacttttactcccccgaccccgatctccgactcctgactttggaagcccccaaagctgcttttcggttgcctacaaagtgtcggtcattgtgccacgtccttggaaccgtgaactcattttctcctcaataacctttaaaaagtagctgtaaaacctccattttacagaccagttggctgaggtttaaatggaggacgctcccagggccccagaggggcgaatttccagactcctttgccaggaccttgtactaagccccttccctacgcttttccctgcctaggcctcgtgggctgtgcggctatcctggagacagatgacagctctcccttggatggctttgctggttccgcaccagccagcgcccccatttttcctgcagcaccctgatctgcactccctgaggggctcccactgtccgcggtgtgaggatgtccctggatagtccactgtgtgcagaggcatgggagttgtcatgttgggaacatgctagacctcagtatccttgagggatgctgccttgggtctggaaactgttagaggaaaccccaagaggtgcaggcactgagcctctcaggacaatgacctggggtcccagctcccctggaggggcctcctcatggtaagtgaatgccaagaggttaagttggcctgtgtttccgaggtggaaattccaggtcgctggcttcatttgtcttctcttttagattgtttgggggttgatcacagaccaagagtgacgagtgatgtcaccctgtgactcatggccggaccttcttgcccctattgtctcagcacaacattattcgacttttccctcagcgtgggtgggcagaggaaaagccctgtggctctggggacttgggatccagagttgaagacccttcagctggctctgccctgccagtgccacagagtgccatggcccaggaagacaggttttcttccatctaggccaggccatccagtggccatcctccgtgtcctcccgcctcctcctggtgtgacttctgaaaaccaagaatttgttcctgttgactttttctgtgctatggaccattgtcctctcacccactcaataaatcttgaaacatgc

SEQ ID NO: 314683 - DNA, 983 bp, Homo sapiens
gtatttccgcgggcgctgagcactagagagagcgtcttgtggctgcggcctgcccctcagcctcctccgcgcggttacccctgtacccgccgccatccgtcctggcgctccggatgagtcaatgaggggcagggcccgaggagtggtcttcccaagaacccctggtggcctcccaaggccggcctcgtgggctgtgcggctatcctggagacagatgacagctctcccttggatggctttgctggttccgcaccagccagcgcccccatttttcctgcagcaccctgatctgcactccctgaggggctcccactgtccgcggtgtgaggatgtccctggatagtccactgtgtgcagaggcatgggagttgtcatgttgggaacatgctagacctcagtatccttgagcttgaagaaagacgacagaacactggagaccaagtacttacagccttctgctctgtggcccctcctcactccagggatgctgccttgggtctggaaactgttagaggaaaccccaagaggtgcaggcactgagcctctcaggacaatgacctggggtcccagctcccctggaggggcctcctcatgattgtttgggggttgatcacagaccaagagtgacgagtgatgtcaccctgtgactcatggccggaccttcttgcccctattgtctcagcacaacattattcgacttttccctcagcgtgggtgggcagaggaaaagccctgtggctctggggacttgggatccagagttgaagacccttcagctggctctgccctgccagtgccacagagtgccatggcccaggaagacaggttttcttccatctaggccaggccatccagtggccatcctccgtgtcctcccgcctcctcctggtgtgacttctgaaaaccaagaatttgttcctgttgactttttctgtgctatggaccattgtcctctcacccactcaataaatcttgaaacatgc

SEQ ID NO: 314684 - DNA, 612 bp, Homo sapiens
ctgattgattaactgggggcattcccattgacatcagcttgaagaaagacgacagaacactggagaccaagtacttacagccttctgctctgtggcccctcctcactccagggatgctgccttgggtctggaaactgttagaggaaaccccaagaggtgcaggcactgagcctctcaggacaatgacctggggtcccagctcccctggaggggcctcctcatgattgtttgggggttgatcacagaccaagagtgacgagtgatgtcaccctgtgactcatggccggaccttcttgcccctattgtctcagcacaacattattcgacttttccctcagcgtgggtgggcagaggaaaagccctgtggctctggggacttgggatccagagttgaagacccttcagctggctctgccctgccagtgccacagagtgccatggcccaggaagacaggttttcttccatctaggccaggccatccagtggccatcctccgtgtcctcccgcctcctcctggtgtgacttctgaaaaccaagaatttgttcctgttgactttttctgtgctatggaccattgtcctctcacccactcaataaatcttgaaacatgc

SEQ ID NO: 314685 - DNA, 1228 bp, Homo sapiens
gtatttccgcgggcgctgagcactagagagagcgtcttgtggctgcggcctgcccctcagcctcctccgcgcggttacccctgtacccgccgccatccgtcctggcgctccggatgagtcaatgaggggcagggcccgaggagtggtcttcccaagaacccctggtggcctcccaaggccggtgctgtgtacctcctccccgacaaaaggggaaactgaggccccgaggggagtgggaagagccggctggacgtcaggcccagccgctggtgcagtggtccgtcccctctgccggggtgggcccctcgggtttcgcgtgtcctcgggaaagagactggcgggcctcgtgggctgtgcggctatcctggagacagatgacagctctcccttggatggctttgctggttccgcaccagccagcgcccccatttttcctgcagcaccctgatctgcactccctgaggggctcccactgtccgcggtgtgaggatgtccctggatagtccactgtgtgcagaggcatgggagttgtcatgttgggaacatgctagacctcagtatccttgagcttgaagaaagacgacagaacactggagaccaagtacttacagccttctgctctgtggcccctcctcactccagggatgctgccttgggtctggaaactgttagaggaaaccccaagaggtgcaggcactgagcctctcaggacaatgacctggggtcccagctcccctggaggggcctcctcatggtaagtgaatgccaagaggttaagttggcctgtgtttccgaggtggaaattccaggtcgctggcttcatttgtcttctcttttagattgtttgggggttgatcacagaccaagagtgacgagtgatgtcaccctgtgactcatggccggaccttcttgcccctattgtctcagcacaacattattcgacttttccctcagcgtgggtgggcagaggaaaagccctgtggctctggggacttgggatccagagttgaagacccttcagctggctctgccctgccagtgccacagagtgccatggcccaggaagacaggttttcttccatctaggccaggccatccagtggccatcctccgtgtcctcccgcctcctcctggtgtgacttctgaaaaccaagaatttgttcctgttgactttttctgtgctatggaccattgtcctctcacccactcaataaatcttgaaacatgc

SEQ ID NO: 314686 - DNA, 1069 bp, Homo sapiens
gtatttccgcgggcgctgagcactagagagagcgtcttgtggctgcggcctgcccctcagcctcctccgcgcggttacccctgtacccgccgccatccgtcctggcgctccggatgagtcaatgaggggcagggcccgaggagtggtcttcccaagaacccctggtggcctcccaaggccggtgctgtgtacctcctccccgacaaaaggggaaactgaggccccgaggggagtgggaagagccggctggacgtcaggcccagccgctggtgcagtggtccgtcccctctgccggggtgggcccctcgggtttcgcgtgtcctcgggaaagagactggcgggcctcgtgggctgtgcggctatcctggagacagatgacagctctcccttggatggctttgctggttccgcaccagccagcgcccccatttttcctgcagcaccctgatctgcactccctgaggggctcccactgtccgcggtgtgaggatgtccctggatagtccactgtgtgcagaggcatgggagttgtcatgttgggaacatgctagacctcagtatccttgagggatgctgccttgggtctggaaactgttagaggaaaccccaagaggtgcaggcactgagcctctcaggacaatgacctggggtcccagctcccctggaggggcctcctcatgattgtttgggggttgatcacagaccaagagtgacgagtgatgtcaccctgtgactcatggccggaccttcttgcccctattgtctcagcacaacattattcgacttttccctcagcgtgggtgggcagaggaaaagccctgtggctctggggacttgggatccagagttgaagacccttcagctggctctgccctgccagtgccacagagtgccatggcccaggaagacaggttttcttccatctaggccaggccatccagtggccatcctccgtgtcctcccgcctcctcctggtgtgacttctgaaaaccaagaatttgttcctgttgactttttctgtgctatggaccattgtcctctcacccactcaataaatcttgaaacatgc

SEQ ID NO: 314687 - DNA, 1143 bp, Homo sapiens
gtatttccgcgggcgctgagcactagagagagcgtcttgtggctgcggcctgcccctcagcctcctccgcgcggttacccctgtacccgccgccatccgtcctggcgctccggatgagtcaatgaggggcagggcccgaggagtggtcttcccaagaacccctggtggcctcccaaggccggtgctgtgtacctcctccccgacaaaaggggaaactgaggccccgaggggagtgggaagagccggctggacgtcaggcccagccgctggtgcagtggtccgtcccctctgccggggtgggcccctcgggtttcgcgtgtcctcgggaaagagactggcgggcctcgtgggctgtgcggctatcctggagacagatgacagctctcccttggatggctttgctggttccgcaccagccagcgcccccatttttcctgcagcaccctgatctgcactccctgaggggctcccactgtccgcggtgtgaggatgtccctggatagtccactgtgtgcagaggcatgggagttgtcatgttgggaacatgctagacctcagtatccttgagcttgaagaaagacgacagaacactggagaccaagtacttacagccttctgctctgtggcccctcctcactccagggatgctgccttgggtctggaaactgttagaggaaaccccaagaggtgcaggcactgagcctctcaggacaatgacctggggtcccagctcccctggaggggcctcctcatgattgtttgggggttgatcacagaccaagagtgacgagtgatgtcaccctgtgactcatggccggaccttcttgcccctattgtctcagcacaacattattcgacttttccctcagcgtgggtgggcagaggaaaagccctgtggctctggggacttgggatccagagttgaagacccttcagctggctctgccctgccagtgccacagagtgccatggcccaggaagacaggttttcttccatctaggccaggccatccagtggccatcctccgtgtcctcccgcctcctcctggtgtgacttctgaaaaccaagaatttgttcctgttgactttttctgtgctatggaccattgtcctctcacccactcaataaatcttgaaacatgc

SEQ ID NO: 314688 - DNA, 826 bp, Homo sapiens
gtatttccgcgggcgctgagcactagagagagcgtcttgtggctgcggcctgcccctcagcctcctccgcgcggttacccctgtacccgccgccatccgtcctggcgctccggatgagtcaatgaggggcagggcccgaggagtggtcttcccaagaacccctggtggcctcccaaggccggtgctgtgtacctcctccccgacaaaaggggaaactgaggccccgaggggagtgggaagagccggctggacgtcaggcccagccgctggtgcagtggtccgtcccctctgccggggtgggcccctcgggtttcgcgtgtcctcgggaaagagactggcgggcctcgtgggctgtgcggctatcctggagacagatgacagctctcccttggatggctttgctggttccgcaccagccagcgcccccatttttcctgcagcaccctgatctgcactccctgaggggctcccactgtccgcggtgtgaggatgtccctggatagtccactgtgtgcagaggcatgggagttgtcatgttgggaacatgctagacctcagtatccttgagggatgctgccttgggtctggaaactgttagaggaaaccccaagaggtgcaggcactgagcctctcaggacaatgacctggggtcccagctcccctggaggggcctcctcatgctaggccaggccatccagtggccatcctccgtgtcctcccgcctcctcctggtgtgacttctgaaaaccaagaatttgttcctgttgactttttctgtgctatggaccattgtcctctcacccactcaataaatcttgaaacatgc

SEQ ID NO: 314689 - DNA, 494 bp, Homo sapiens
cagcctgggccagccccgcttcggcccctcccgggagatccgtgcgcccgaccagcaccagcatcgcggaccgcaaaggccgcccgtcccgtcaaacaagtttcttcttaggctaagaaacgcagtatatacgagtatctctatatatagtactaatggatttggtgtgcttcccccttagcgtccccctccctctgctcctcctccttcagcctggtctccccctcttctctgccctccacccccgtctctgcactgagatacataagaaacaagggtagtttactgtctgttttgttttctgggttttcagtgtcctagcggaatgcaagtaggcagccagcccgtctgttccctctccgccccgccccgccccgcccccgtcactgcgcttctgttataccatctttgcctgactctctccggcttctccattgaatggctaatgtgtatgtgaaataaagaaataaagaaaaacaaacgcgaaaaaaaaa

SEQ ID NO: 314690 - DNA, 454 bp, Homo sapiens
tgcccaggcccgcgcccgcacgcacgcacgcacacggccccgcacacagccccgccccaccccgcaaccagccctgtcgactgccttatacacccgcccccgcgctggccggccgacctagtgccttgttctcacccccgtgctggcggagcggacgccgcgctctgggtcccagaggggccgggtggctcagacgacccacccccgtctctgcactgagatacataagaaacaagggtagtttactgtctgttttgttttctgggttttcagtgtcctagcggaatgcaagtaggcagccagcccgtctgttccctctccgccccgccccgccccgcccccgtcactgcgcttctgttataccatctttgcctgactctctccggcttctccattgaatggctaatgtgtatgtgaaataaagaaataaagaaaaacaaacgcgaaaaaaaaa

SEQ ID NO: 314691 - DNA, 436 bp, Homo sapiens
gcggccgccgcctgccgggcctcccctcgccgcggccggccgccgcgctcccgcccgggcgcccagctatgtactccccgtactgcctcacccaggatgagttccacccgttcatcgaggcactgctgcctcacgtccgcgctttctcctacacctggttcaacctgcaggcgcggaagcgcaagtacttcaagaagcatgaaaagcggatgtcgaaggacgaggagcgggcggtgaaggacgagctgctgggcgagaagcccgagatcaagcagaagcagccagcccgtctgttccctctccgccccgccccgccccgcccccgtcactgcgcttctgttataccatctttgcctgactctctccggcttctccattgaatggctaatgtgtatgtgaaataaagaaataaagaaaaacaaacgcgaaaaaaaaa

SEQ ID NO: 314692 - DNA, 332 bp, Homo sapiens
tgcccaggcccgcgcccgcacgcacgcacgcacacggccccgcacacagccccgccccaccccgcaaccagccctgtcgactgccttatacacccgcccccgcgctggccggccgacctagtgccttgttctcacccccgtgctggcggagcggacgccgcgctctgggtcccagaggggccgggtggctcagacgacccaccactcccccaccctgaccgtgctgaacagacccccccacacgagagaaaataaaggagcaataaagtcacgagaactttcgtcccccaatcgagagcccgaggggcaccccagccccgcctctgctcccc

SEQ ID NO: 314693 - DNA, 2950 bp, Homo sapiens
  misc_feature (53)..(53): n is a, c, g, or t
tggttttataaggggctgcctccaccacgtcgctcttctttctgctctcatcncgtcttcccctcctcccgtcctccctcgccccgcatgtactccccgtactgcctcacccagggatgagttccacccgttcatcgaggcactgctgcctcacgtccgcgctttctcctacacctggttcaacctgcaggcgcggaagcgcaagtacttcaagaagcatgaaaagcggatgtcgaaggacgaggagcgggcggtgaaggacgagctgctgggcgagaagcccgagatcaagcagaagtgggcatcccggctgctggccaagctgcgcaaggacatccggcccgagttccgcgaggacttcgtgctgaccatcacgggcaagaagcccccctgctgcgtgctctccaaccccgaccagaagggcaagatccggcggattgactgcctgcgccaggctgacaaggtgtggcggctggacctggtcatggtgattttgtttaaggggatccccctggaaagtactgatggggagcggctctacaagtcgcctcagtgctcgaaccccggcctgtgcgtccagccacatcacattggagtcacaatcaaagaactggatctttatctggcttactttgtccacactccggaatccggacaatcagatagttcaaaccagcaaggagatgcggacatcaaaccactgcccaacgggcacttaagtttccaggactgttttgtgacttccggggtctggaatgtgacggagctggtgagagtatcacagactcctgttgcaacagcatcagggcccaacttctccctggcggacctggagagtcccagctactacaacatcaaccaggtgaccctggggcggcggtccatcacctcccctccttccaccagcaccaccaagcgccccaagtccatcgatgacagtgagatggagagccctgttgatgacgtgttctatcccgggacaggccgttccccagcagctggcagcagccagtccagcgggtggcccaacgatgtggatgcaggcccggcttctctaaagaagtcaggaaagctggacttctgcagtgccctctcctctcagggcagctccccgcgcatggctttcacccaccacccgctgcctgtgcttgctggagtcagaccagggagcccccgggccacagcatcagccctgcacttcccctccacgtccatcatccagcagtcgagcccgtatttcacgcacccgaccatccgctaccaccaccaccacgggcaggactcactgaaggagtttgtgcagtttgtgtgctcggatggctcgggccaggccaccggacagcattcgcaacgacaggcgcctcctctgccaaccggtttgtcagcatcggaccccgggacggcaactttctgaacatcccacagcagtctcagtcctggttcctctgataagatcgacaaaagaaacaacaaaatgagaagaagaggttcctcgaaaggggggagaagaaattttgagaatggaaaaatcccccagcccagcccagccccaccgaaaagcaaaaattacacgtcgtcagccactcagcccttctctcctccagcccggggacccccgcgggccccagaagcagcccagttctcagagagcccttggaaggggtctcggtggagctgtgcaccagcagccaagcagaaagaaacacgcgacatggactctgtcaagtagaggacagaaagcaagaaaggatgcagaactgccttcctccccctgaccccgccccggccttctggggaaggaacaaagtccccaaacaaagcaaccagcacaattctgaaggggcctggcctccaccctcaccccttcctaggggaagggccgggcgtgacgcgcggtcaaagtgcaatgatttttcagttcggttggctaaacagggtcagagctgagagcgaagcagaaggggctccctgtccggcccacgtgccctttccctcgacgacagtcgagggctcgggctctgtgggactgtgggagctagggtctgcggggcgcctgcccgggcgaggtcggaagctgcaggccagctgggcccgggccggagcgtgcccggcggggctgcccgggcgggcagggggtgggggctgctcctttcccaagtggtgttgtgaggggcaatgagggcaacaggagatgtggggacgtgttaggagagaaaaaaaaaaaaacaaaaatatatatgggggaaattaacttttttttttcattgaaccaagtgcaatgcatcagagagttttcctatctttgtatgttaagagattaagaaaaaaaaattctatttttgttgtaatgtcctcgcggctctggggacgctaaaagaaccgggcctgccccgccctgcgcggggataacgaaagctgagtgtttttcccttttttttgttcgtttttagtttttttttttttaagtcgttttcctgcgttgacgaggatgatctggggtttttatttgtttcgtcgttcgttctgtttcggtgggagggctgaaggaaacgttcacattttagagtttaaaaaaaacacctcgacatttaaaaaatcaaccaacacaagatcaaaaaggaaaaggacgagagaaaaattatttttaagataattaaacataaaaccctggtgcttcttacattataaagtacgttttaaagaacccacaaactattatacataaaaacaagggtagtttactgtctgttttgttttctgggttttcagtgtcctagcggaatgcaagtaggcagccagcccgtctgttccctctccgccccgccccgccccgcccccgtcactgcgcttctgttataccatctttgcctgactctctccggcttctccattgaatggctaatgtgtatgtgaaataaagaaataaagaaaaacaaacgcgaaaaaaaaa

SEQ ID NO: 314694 - DNA, 2779 bp, Homo sapiens
  misc_feature (53)..(53): n is a, c, g, or t
  misc_feature (2759)..(2759): n is a, c, g, or t
tggttttataaggggctgcctccaccacgtcgctcttctttctgctctcatcncgtcttcccctcctcccgtcctccctcgccccgcatgtactccccgtactgcctcacccagggatgagttccacccgttcatcgaggcactgctgcctcacgtccgcgctttctcctacacctggttcaacctgcaggcgcggaagcgcaagtacttcaagaagcatgaaaagcggatgtcgaaggacgaggagcgggcggtgaaggacgagctgctgggcgagaagcccgagatcaagcagaagtgggcatcccggctgctggccaagctgcgcaaggacatccggcccgagttccgcgaggacttcgtgctgaccatcacgggcaagaagcccccctgctgcgtgctctccaaccccgaccagaagggcaagatccggcggattgactgcctgcgccaggctgacaaggtgtggcggctggacctggtcatggtgattttgtttaaggggatccccctggaaagtactgatggggagcggctctacaagtcgcctcagtgctcgaaccccggcctgtgcgtccagccacatcacattggagtcacaatcaaagaactggatctttatctggcttactttgtccacactccggaatccggacaatcagatagttcaaaccagcaaggagatgcggacatcaaaccactgcccaacgggcacttaagtttccaggactgttttgtgacttccggggtctggaatgtgacggagctggtgagagtatcacagactcctgttgcaacagcatcagggcccaacttctccctggcggacctggagagtcccagctactacaacatcaaccaggtgaccctggggcggcggtccatcacctcccctccttccaccagcaccaccaagcgccccaagtccatcgatgacagtgagatggagagccctgttgatgacgtgttctatcccgggacaggccgttccccagcagctggcagcagccagtccagcgggtggcccaacgatgtggatgcaggcccggcttctctaaagaagtcaggaaagctggacttctgcagtgccctctcctctcagggcagctccccgcgcatggctttcacccaccacccgctgcctgtgcttgctggagtcagaccagggagcccccgggccacagcatcagccctgcacttcccctccacgtccatcatccagcagtcgagcccgtatttcacgcacccgaccatccgctaccaccaccaccacgggcaggactcactgaaggagtttgtgcagtttgtgtgctcggatggctcgggccaggccaccggacagcattcgcaacgacaggcgcctcctctgccaaccggtttgtcagcatcggaccccgggacggcaactttctgaacatcccacagcagtctcagtcctggttcctctgataagatcgacaaaagaaacaacaaaatgagaagaagaggttcctcgaaaggggggagaagaaattttgagaatggaaaaatcccccagcccagcccagccccaccgaaaagcaaaaattacacgtcgtcagccactcagcccttctctcctccagcccggggacccccgcgggccccagaagcagcccagttctcagagagcccttggaaggggtctcggtggagctgtgcaccagcagccaagcagaaagaaacacgcgacatggactctgtcaagtagaggacagaaagcaagaaaggatgcagaactgccttcctccccctgaccccgccccggccttctggggaaggaacaaagtccccaaacaaagcaaccagcacaattctgaaggggcctggcctccaccctcaccccttcctaggggaactcctttcccaagtggtgttgtgaggggcaatgagggcaacaggagatgtggggacgtgttaggagagaaaaaaaaaaaaacaaaaatatatatgggggaaattaacttttttttttcattgaaccaagtgcaatgcatcagagagttttcctatctttgtatgttaagagattaagaaaaaaaaattctatttttgttgtaatgtcctcgcggctctggggacgctaaaagaaccgggcctgccccgccctgcgcggggataacgaaagctgagtgtttttcccttttttttgttcgtttttagtttttttttttttaagtcgttttcctgcgttgacgaggatgatctggggtttttatttgtttcgtcgttcgttctgtttcggtgggagggctgaaggaaacgttcacattttagagtttaaaaaaaacacctcgacatttaaaaaatcaaccaacacaagatcaaaaaggaaaaggacgagagaaaaattatttttaagataattaaacataaaaccctggtgcttcttacattataaagtacgttttaaagaacccacaaactattatacataagtttatgaatcaattaaatatcctgcacttgttaggaatacgcatatcccttctttgttgagtttaacggaacgggacagcggcgtgcccccggcggctggactgctccggccgcgggtctccccgggcgcccctccctggggcccagcacccctcctcgccccatccccgtccgggtacgggggcgcggcaggggtccccggcccctcccccgcagaggtcaatgccaacgaacaaacgtcccctccctccgtcgggctccgttcccaattgatattctacgggaccatgagggcaacaggnggtgttaggttttgttaggg

SEQ ID NO: 314695 - DNA, 2125 bp, Homo sapiens
  misc_feature (53)..(53): n is a, c, g, or t
tggttttataaggggctgcctccaccacgtcgctcttctttctgctctcatcncgtcttcccctcctcccgtcctccctcgccccgcatgtactccccgtactgcctcacccagggatgagttccacccgttcatcgaggcactgctgcctcacgtccgcgctttctcctacacctggttcaacctgcaggcgcggaagcgcaagtacttcaagaagcatgaaaagcggatgtcgaaggacgaggagcgggcggtgaaggacgagctgctgggcgagaagcccgagatcaagcagaagtgggcatcccggctgctggccaagctgcgcaaggacatccggcccgagttccgcgaggacttcgtgctgaccatcacgggcaagaagcccccctgctgcgtgctctccaaccccgaccagaagggcaagatccggcggattgactgcctgcgccaggctgacaaggtgtggcggctggacctggtcatggtgattttgtttaaggggatccccctggaaagtactgatggggagcggctctacaagtcgcctcagtgctcgaaccccggcctgtgcgtccagccacatcacattggagtcacaatcaaagaactggatctttatctggcttactttgtccacactccggaatccggacaatcagatagttcaaaccagcaaggagatgcggacatcaaaccactgcccaacgggcacttaagtttccaggactgttttgtgacttccggggtctggaatgtgacggagctggtgagagtatcacagactcctgttgcaacagcatcagggcccaacttctccctggcggacctggagagtcccagctactacaacatcaaccaggtgaccctggggcggcggtccatcacctcccctccttccaccagcaccaccaagcgccccaagtccatcgatgacagtgagatggagagccctgttgatgacgtgttctatcccgggacaggccgttccccagcagctggcagcagccagtccagcgggtggcccaacgatgtggatgcaggcccggcttctctaaagaagtcaggaaagctggacttctgcagtgccctctcctctcagggcagctccccgcgcatggctttcacccaccacccgctgcctgtgcttgctggagtcagaccagggagcccccgggccacagcatcagccctgcacttcccctccacgtccatcatccagcagtcgagcccgtatttcacgcacccgaccatccgctaccaccaccaccacgggcaggactcactgaaggagtttgtgcagtttgtgtgctcggatggctcgggccaggccaccggacagcattcgcaacgacaggcgcctcctctgccaaccggtttgtcagcatcggaccccgggacggcaactttctgaacatcccacagcagtctcagtcctggttcctctgataagatcgacaaaagaaacaacaaaatgagaagaagaggttcctcgaaaggggggagaagaaattttgagaatggaaaaatcccccagcccagcccagccccaccgaaaagcaaaaattacacgtcgtcagccactcagcccttctctcctccagcccggggacccccgcgggccccagaagcagcccagttctcagagagcccttggaaggggtctcggtggagctgtgcaccagcagccaagcagaaagaaacacgcgacatggactctgtcaagtagaggacagaaagcaagaaaggatgcagaactgccttcctccccctgaccccgccccggccttctggggaaggaacaaagtccccaaacaaagcaaccagcacaattctgaaggggcctggtctccccctcttctctgccctccacccccgtctctgcactgagatacataagaaacaagggtagtttactgtctgttttgttttctgggttttcagtgtcctagcggaatgcaagtaggcagccagcccgtctgttccctctccgccccgccccgccccgcccccgtcactgcgcttctgttataccatctttgcctgactctctccggcttctccattgaatggctaatgtgtatgtgaaataaagaaataaagaaaaacaaacgcgaaaaaaaaa

SEQ ID NO: 314696 - DNA, 2030 bp, Homo sapiens
  misc_feature (53)..(53): n is a, c, g, or t
  misc_feature (1998)..(1998): n is a, c, g, or t
  misc_feature (2008)..(2008): n is a, c, g, or t
  misc_feature (2013)..(2013): n is a, c, g, or t
  misc_feature (2015)..(2015): n is a, c, g, or t
tggttttataaggggctgcctccaccacgtcgctcttctttctgctctcatcncgtcttcccctcctcccgtcctccctcgccccgcatgtactccccgtactgcctcacccagggatgagttccacccgttcatcgaggcactgctgcctcacgtccgcgctttctcctacacctggttcaacctgcaggcgcggaagcgcaagtacttcaagaagcatgaaaagcggatgtcgaaggacgaggagcgggcggtgaaggacgagctgctgggcgagaagcccgagatcaagcagaagtgggcatcccggctgctggccaagctgcgcaaggacatccggcccgagttccgcgaggacttcgtgctgaccatcacgggcaagaagcccccctgctgcgtgctctccaaccccgaccagaagggcaagatccggcggattgactgcctgcgccaggctgacaaggtgtggcggctggacctggtcatggtgattttgtttaaggggatccccctggaaagtactgatggggagcggctctacaagtcgcctcagtgctcgaaccccggcctgtgcgtccagccacatcacattggagtcacaatcaaagaactggatctttatctggcttactttgtccacactccggaatccggacaatcagatagttcaaaccagcaaggagatgcggacatcaaaccactgcccaacgggcacttaagtttccaggactgttttgtgacttccggggtctggaatgtgacggagctggtgagagtatcacagactcctgttgcaacagcatcagggcccaacttctccctggcggacctggagagtcccagctactacaacatcaaccaggtgaccctggggcggcggtccatcacctcccctccttccaccagcaccaccaagcgccccaagtccatcgatgacagtgagatggagagccctgttgatgacgtgttctatcccgggacaggccgttccccagcagctggcagcagccagtccagcgggtggcccaacgatgtggatgcaggcccggcttctctaaagaagtcaggaaagctggacttctgcagtgccctctcctctcagggcagctccccgcgcatggctttcacccaccacccgctgcctgtgcttgctggagtcagaccagggagcccccgggccacagcatcagccctgcacttcccctccacgtccatcatccagcagtcgagcccgtatttcacgcacccgaccatccgctaccaccaccaccacgggcaggactcactgaaggagtttgtgcagtttgtgtgctcggatggctcgggccaggccaccggacagcattcgcaacgacaggcgcctcctctgccaaccggtttgtcagcatcggaccccgggacggcaactttctgaacatcccacagcagtctcagtcctggttcctctgataagatcgacaaaagaaacaacaaaatgagaagaagaggttcctcgaaaggggggagaagaaattttgagaatggaaaaatcccccagcccagcccagccccaccgaaaagcaaaaattacacgtcgtcagccactcagcccttctctcctccagcccggggacccccgcgggccccagaagcagcccagttctcagagagcccttggaaggggtctcggtggagctgtgcaccagcagccaagcagaaagaaacacgcgacatggactctgtcaagtagaggacagaaagcaagaaaggatgcagaactgccttcctccccctgaccccgccccggccttctggggaaggaacaaagtccccaaacaaagcaaccagcacaattctgaaggggcctggcctccaccctcaccccttcctaggggaaccccaccctccacacagccggagctgccctagggagcctggagggccagcttgtaaagatgatggggtttagatccctcaggctctcccctccagactccgcccttcccttccctccaaccngtcgaccggncgcgnanttagtagtagtagta

SEQ ID NO: 314697 - DNA, 1899 bp, Homo sapiens
  misc_feature (53)..(53): n is a, c, g, or t
tggttttataaggggctgcctccaccacgtcgctcttctttctgctctcatcncgtcttcccctcctcccgtcctccctcgccccgcatgtactccccgtactgcctcacccagggatgagttccacccgttcatcgaggcactgctgcctcacgtccgcgctttctcctacacctggttcaacctgcaggcgcggaagcgcaagtacttcaagaagcatgaaaagcggatgtcgaaggacgaggagcgggcggtgaaggacgagctgctgggcgagaagcccgagatcaagcagaagtgggcatcccggctgctggccaagctgcgcaaggacatccggcccgagttccgcgaggacttcgtgctgaccatcacgggcaagaagcccccctgctgcgtgctctccaaccccgaccagaagggcaagatccggcggattgactgcctgcgccaggctgacaaggtgtggcggctggacctggtcatggtgattttgtttaaggggatccccctggaaagtactgatggggagcggctctacaagtcgcctcagtgctcgaaccccggcctgtgcgtccagccacatcacattggagtcacaatcaaagaactggatctttatctggcttactttgtccacactccggaatccggacaatcagatagttcaaaccagcaaggagatgcggacatcaaaccactgcccaacgggcacttaagtttccaggactgttttgtgacttccggggtctggaatgtgacggagctggtgagagtatcacagactcctgttgcaacagcatcagggcccaacttctccctggcggacctggagagtcccagctactacaacatcaaccaggtgaccctggggcggcggtccatcacctcccctccttccaccagcaccaccaagcgccccaagtccatcgatgacagtgagatggagagccctgttgatgacgtgttctatcccgggacaggccgttccccagcagctggcagcagccagtccagcgggtggcccaacgatgtggatgcaggcccggcttctctaaagaagtcaggaaagctggacttctgcagtgccctctcctctcagggcagctccccgcgcatggctttcacccaccacccgctgcctgtgcttgctggagtcagaccagggagcccccgggccacagcatcagccctgcacttcccctccacgtccatcatccagcagtcgagcccgtatttcacgcacccgaccatccgctaccaccaccaccacgggcaggactcactgaaggagtttgtgcagtttgtgtgctcggatggctcgggccaggccaccggacagcattcgcaacgacaggcgcctcctctgccaaccggtttgtcagcatcggaccccgggacggcaactttctgaacatcccacagcagtctcagtcctggttcctctgataagatcgacaaaagaaacaacaaaatgagaagaagaggttcctcgaaaggggggagaagaaattttgagaatggaaaaatcccccagcccagcccagccccaccgaaaagcaaaaattacacgtcgtcagccactcagcccttctctcctccagcccggggacccccgcgggccccagaagcagcccagttctcagagagcccttggaaggggtctcggtggagctgtgcaccagcagccaagcagaaagaaacacgcgacatggactctgtcaagtagaggacagaaagcaagaaaggatgcagaactgccttcctccccctgacgccccgcccccgtcactgcgcttctgttataccatctttgcctgactctctccggcttctccattgaatggctaatgtgtatgtgaaataaagaaataaagaaaaacaaacgcgaaaaaaaaa

SEQ ID NO: 314698 - DNA, 3173 bp, Homo sapiens
  misc_feature (3153)..(3153): n is a, c, g, or t
gcggccgccgcctgccgggcctcccctcgccgcggccggccgccgcgctcccgcccgggcgcccagctatgtactccccgtactgcctcacccaggatgagttccacccgttcatcgaggcactgctgcctcacgtccgcgctttctcctacacctggttcaacctgcaggcgcggaagcgcaagtacttcaagaagcatgaaaagcggatgtcgaaggacgaggagcgggcggtgaaggacgagctgctgggcgagaagcccgagatcaagcagaagtgggcatcccggctgctggccaagctgcgcaaggacatccggcccgagttccgcgaggacttcgtgctgaccatcacgggcaagaagcccccctgctgcgtgctctccaaccccgaccagaagggcaagatccggcggattgactgcctgcgccaggctgacaaggtgtggcggctggacctggtcatggtgattttgtttaaggggatccccctggaaagtactgatggggagcggctctacaagtcgcctcagtgctcgaaccccggcctgtgcgtccagccacatcacattggagtcacaatcaaagaactggatctttatctggcttactttgtccacactccggaatccggacaatcagatagttcaaaccagcaaggagatgcggacatcaaaccactgcccaacgggcacttaagtttccaggactgttttgtgacttccggggtctggaatgtgacggagctggtgagagtatcacagactcctgttgcaacagcatcagggcccaacttctccctggcggacctggagagtcccagctactacaacatcaaccaggtgaccctggggcggcggtccatcacctcccctccttccaccagcaccaccaagcgccccaagtccatcgatgacagtgagatggagagccctgttgatgacgtgttctatcccgggacaggccgttccccagcagctggcagcagccagtccagcgggtggcccaacgatgtggatgcaggcccggcttctctaaagaagtcaggaaagctggacttctgcagtgccctctcctctcagggcagctccccgcgcatggctttcacccaccacccgctgcctgtgcttgctggagtcagaccagggagcccccgggccacagcatcagccctgcacttcccctccacgtccatcatccagcagtcgagcccgtatttcacgcacccgaccatccgctaccaccaccaccacgggcaggactcactgaaggagtttgtgcagtttgtgtgctcggatggctcgggccaggccaccggacagcccaacggtagcggccagggcaaagtcccggggtcatttttgcaccgccgccgcctccagtggccagacctgtgcccttcctatgcctgattccaaatccaccagcactgccccagacgcgccgccttgactcctccatcaccttcattcgcaacgacaggcgcctcctctgccaaccggtttgtcagcatcggaccccgggacggcaactttctgaacatcccacagcagtctcagtcctggttcctctgataagatcgacaaaagaaacaacaaaatgagaagaagaggttcctcgaaaggggggagaagaaattttgagaatggaaaaatcccccagcccagcccagccccaccgaaaagcaaaaattacacgtcgtcagccactcagcccttctctcctccagcccggggacccccgcgggccccagaagcagcccagttctcagagagcccttggaaggggtctcggtggagctgtgcaccagcagccaagcagaaagaaacacgcgacatggactctgtcaagtagaggacagaaagcaagaaaggatgcagaactgccttcctccccctgaccccgccccggccttctggggaaggaacaaagtccccaaacaaagcaaccagcacaattctgaaggggcctggcctccaccctcaccccttcctaggggaagggccgggcgtgacgcgcggtcaaagtgcaatgatttttcagttcggttggctaaacagggtcagagctgagagcgaagcagaaggggctccctgtccggcccacgtgccctttccctcgacgacagtcgagggctcgggctctgtgggactgtgggagctagggtctgcggggcgcctgcccgggcgaggtcggaagctgcaggccagctgggcccgggccggagcgtgcccggcggggctgcccgggcgggcagggggtgggggctgctcctttcccaagtggtgttgtgaggggcaatgagggcaacaggagatgtggggacgtgttaggagagaaaaaaaaaaaaacaaaaatatatatgggggaaattaacttttttttttcattgaaccaagtgcaatgcatcagagagttttcctatctttgtatgttaagagattaagaaaaaaaaattctatttttgttgtaatgtcctcgcggctctggggacgctaaaagaaccgggcctgccccgccctgcgcggggataacgaaagctgagtgtttttcccttttttttgttcgtttttagtttttttttttttaagtcgttttcctgcgttgacgaggatgatctggggtttttatttgtttcgtcgttcgttctgtttcggtgggagggctgaaggaaacgttcacattttagagtttaaaaaaaacacctcgacatttaaaaaatcaaccaacacaagatcaaaaaggaaaaggacgagagaaaaattatttttaagataattaaacataaaaccctggtgcttcttacattataaagtacgttttaaagaacccacaaactattatacataagtttatgaatcaattaaatatcctgcacttgttaggaatacgcatatcccttctttgttgagtttaacggaacgggacagcggcgtgcccccggcggctggactgctccggccgcgggtctccccgggcgcccctccctggggcccagcacccctcctcgccccatccccgtccgggtacgggggcgcggcaggggtccccggcccctcccccgcagaggtcaatgccaacgaacaaacgtcccctccctccgtcgggctccgttcccaattgatattctacgggaccatgagggcaacaggnggtgttaggttttgttaggg

SEQ ID NO: 314699 - DNA, 2905 bp, Homo sapiens
  misc_feature (2885)..(2885): n is a, c, g, or t
gcggccgccgcctgccgggcctcccctcgccgcggccggccgccgcgctcccgcccgggcgcccagctatgtactccccgtactgcctcacccaggatgagttccacccgttcatcgaggcactgctgcctcacgtccgcgctttctcctacacctggttcaacctgcaggcgcggaagcgcaagtacttcaagaagcatgaaaagcggatgtcgaaggacgaggagcgggcggtgaaggacgagctgctgggcgagaagcccgagatcaagcagaagtgggcatcccggctgctggccaagctgcgcaaggacatccggcccgagttccgcgaggacttcgtgctgaccatcacgggcaagaagcccccctgctgcgtgctctccaaccccgaccagaagggcaagatccggcggattgactgcctgcgccaggctgacaaggtgtggcggctggacctggtcatggtgattttgtttaaggggatccccctggaaagtactgatggggagcggctctacaagtcgcctcagtgctcgaaccccggcctgtgcgtccagccacatcacattggagtcacaatcaaagaactggatctttatctggcttactttgtccacactccggaatccggacaatcagatagttcaaaccagcaaggagatgcggacatcaaaccactgcccaacgggcacttaagtttccaggactgttttgtgacttccggggtctggaatgtgacggagctggtgagagtatcacagactcctgttgcaacagcatcagggcccaacttctccctggcggacctggagagtcccagctactacaacatcaaccaggtgaccctggggcggcggtccatcacctcccctccttccaccagcaccaccaagcgccccaagtccatcgatgacagtgagatggagagccctgttgatgacgtgttctatcccgggacaggccgttccccagcagctggcagcagccagtccagcgggtggcccaacgatgtggatgcagggagcccccgggccacagcatcagccctgcacttcccctccacgtccatcatccagcagtcgagcccgtatttcacgcacccgaccatccgctaccaccaccaccacgggcaggactcactgaaggagtttgtgcagtttgtgtgctcggatggctcgggccaggccaccggacagcattcgcaacgacaggcgcctcctctgccaaccggtttgtcagcatcggaccccgggacggcaactttctgaacatcccacagcagtctcagtcctggttcctctgataagatcgacaaaagaaacaacaaaatgagaagaagaggttcctcgaaaggggggagaagaaattttgagaatggaaaaatcccccagcccagcccagccccaccgaaaagcaaaaattacacgtcgtcagccactcagcccttctctcctccagcccggggacccccgcgggccccagaagcagcccagttctcagagagcccttggaaggggtctcggtggagctgtgcaccagcagccaagcagaaagaaacacgcgacatggactctgtcaagtagaggacagaaagcaagaaaggatgcagaactgccttcctccccctgaccccgccccggccttctggggaaggaacaaagtccccaaacaaagcaaccagcacaattctgaaggggcctggcctccaccctcaccccttcctaggggaagggccgggcgtgacgcgcggtcaaagtgcaatgatttttcagttcggttggctaaacagggtcagagctgagagcgaagcagaaggggctccctgtccggcccacgtgccctttccctcgacgacagtcgagggctcgggctctgtgggactgtgggagctagggtctgcggggcgcctgcccgggcgaggtcggaagctgcaggccagctgggcccgggccggagcgtgcccggcggggctgcccgggcgggcagggggtgggggctgctcctttcccaagtggtgttgtgaggggcaatgagggcaacaggagatgtggggacgtgttaggagagaaaaaaaaaaaaacaaaaatatatatgggggaaattaacttttttttttcattgaaccaagtgcaatgcatcagagagttttcctatctttgtatgttaagagattaagaaaaaaaaattctatttttgttgtaatgtcctcgcggctctggggacgctaaaagaaccgggcctgccccgccctgcgcggggataacgaaagctgagtgtttttcccttttttttgttcgtttttagtttttttttttttaagtcgttttcctgcgttgacgaggatgatctggggtttttatttgtttcgtcgttcgttctgtttcggtgggagggctgaaggaaacgttcacattttagagtttaaaaaaaacacctcgacatttaaaaaatcaaccaacacaagatcaaaaaggaaaaggacgagagaaaaattatttttaagataattaaacataaaaccctggtgcttcttacattataaagtacgttttaaagaacccacaaactattatacataagtttatgaatcaattaaatatcctgcacttgttaggaatacgcatatcccttctttgttgagtttaacggaacgggacagcggcgtgcccccggcggctggactgctccggccgcgggtctccccgggcgcccctccctggggcccagcacccctcctcgccccatccccgtccgggtacgggggcgcggcaggggtccccggcccctcccccgcagaggtcaatgccaacgaacaaacgtcccctccctccgtcgggctccgttcccaattgatattctacgggaccatgagggcaacaggnggtgttaggttttgttaggg

SEQ ID NO: 314700 - DNA, 3288 bp, Homo sapiens
  misc_feature (3268)..(3268): n is a, c, g, or t
tcgataacaaagctgaaatcacatatttaggatttaggtctgattaaaaaatgttggggtggatgttccaactggatcaggagaaaagaaaatgaaaacagcctggggagagggaagcctgatctgtttcctcactcgcttgctcgtggatgtcattttctgtcttcttgggggcggccaaaaatcgaccggtgtcggggaccagaggcggccccgcacgcccccgcgtgtgcgtccacgggcgtctgtgcagacggacactgtgccggggcgagctgacaggagttcacggctgcgatagaacatggagatgtcatgggcgcgacagagcctggcggggataccagcagcgtgtgatgagttccacccgttcatcgaggcactgctgcctcacgtccgcgctttctcctacacctggttcaacctgcaggcgcggaagcgcaagtacttcaagaagcatgaaaagcggatgtcgaaggacgaggagcgggcggtgaaggacgagctgctgggcgagaagcccgagatcaagcagaagtgggcatcccggctgctggccaagctgcgcaaggacatccggcccgagttccgcgaggacttcgtgctgaccatcacgggcaagaagcccccctgctgcgtgctctccaaccccgaccagaagggcaagatccggcggattgactgcctgcgccaggctgacaaggtgtggcggctggacctggtcatggtgattttgtttaaggggatccccctggaaagtactgatggggagcggctctacaagtcgcctcagtgctcgaaccccggcctgtgcgtccagccacatcacattggagtcacaatcaaagaactggatctttatctggcttactttgtccacactccggaatccggacaatcagatagttcaaaccagcaaggagatgcggacatcaaaccactgcccaacgggcacttaagtttccaggactgttttgtgacttccggggtctggaatgtgacggagctggtgagagtatcacagactcctgttgcaacagcatcagggcccaacttctccctggcggacctggagagtcccagctactacaacatcaaccaggtgaccctggggcggcggtccatcacctcccctccttccaccagcaccaccaagcgccccaagtccatcgatgacagtgagatggagagccctgttgatgacgtgttctatcccgggacaggccgttccccagcagctggcagcagccagtccagcgggtggcccaacgatgtggatgcaggcccggcttctctaaagaagtcaggaaagctggacttctgcagtgccctctcctctcagggcagctccccgcgcatggctttcacccaccacccgctgcctgtgcttgctggagtcagaccagggagcccccgggccacagcatcagccctgcacttcccctccacgtccatcatccagcagtcgagcccgtatttcacgcacccgaccatccgctaccaccaccaccacgggcaggactcactgaaggagtttgtgcagtttgtgtgctcggatggctcgggccaggccaccggacagcattcgcaacgacaggcgcctcctctgccaaccggtttgtcagcatcggaccccgggacggcaactttctgaacatcccacagcagtctcagtcctggttcctctgataagatcgacaaaagaaacaacaaaatgagaagaagaggttcctcgaaaggggggagaagaaattttgagaatggaaaaatcccccagcccagcccagccccaccgaaaagcaaaaattacacgtcgtcagccactcagcccttctctcctccagcccggggacccccgcgggccccagaagcagcccagttctcagagagcccttggaaggggtctcggtggagctgtgcaccagcagccaagcagaaagaaacacgcgacatggactctgtcaagtagaggacagaaagcaagaaaggatgcagaactgccttcctccccctgaccccgccccggccttctggggaaggaacaaagtccccaaacaaagcaaccagcacaattctgaaggggcctggcctccaccctcaccccttcctaggggaagggccgggcgtgacgcgcggtcaaagtgcaatgatttttcagttcggttggctaaacagggtcagagctgagagcgaagcagaaggggctccctgtccggcccacgtgccctttccctcgacgacagtcgagggctcgggctctgtgggactgtgggagctagggtctgcggggcgcctgcccgggcgaggtcggaagctgcaggccagctgggcccgggccggagcgtgcccggcggggctgcccgggcgggcagggggtgggggctgctcctttcccaagtggtgttgtgaggggcaatgagggcaacaggagatgtggggacgtgttaggagagaaaaaaaaaaaaacaaaaatatatatgggggaaattaacttttttttttcattgaaccaagtgcaatgcatcagagagttttcctatctttgtatgttaagagattaagaaaaaaaaattctatttttgttgtaatgtcctcgcggctctggggacgctaaaagaaccgggcctgccccgccctgcgcggggataacgaaagctgagtgtttttcccttttttttgttcgtttttagtttttttttttttaagtcgttttcctgcgttgacgaggatgatctggggtttttatttgtttcgtcgttcgttctgtttcggtgggagggctgaaggaaacgttcacattttagagtttaaaaaaaacacctcgacatttaaaaaatcaaccaacacaagatcaaaaaggaaaaggacgagagaaaaattatttttaagataattaaacataaaaccctggtgcttcttacattataaagtacgttttaaagaacccacaaactattatacataagtttatgaatcaattaaatatcctgcacttgttaggaatacgcatatcccttctttgttgagtttaacggaacgggacagcggcgtgcccccggcggctggactgctccggccgcgggtctccccgggcgcccctccctggggcccagcacccctcctcgccccatccccgtccgggtacgggggcgcggcaggggtccccggcccctcccccgcagaggtcaatgccaacgaacaaacgtcccctccctccgtcgggctccgttcccaattgatattctacgggaccatgagggcaacaggnggtgttaggttttgttaggg

SEQ ID NO: 314701 - DNA, 2961 bp, Homo sapiens
  misc_feature (10)..(10): n is a, c, g, or t
  misc_feature (17)..(17): n is a, c, g, or t
  misc_feature (2941)..(2941): n is a, c, g, or t
gttccaagtntcaaagnaatgtcaacatgatgagttccacccgttcatcgaggcactgctgcctcacgtccgcgctttctcctacacctggttcaacctgcaggcgcggaagcgcaagtacttcaagaagcatgaaaagcggatgtcgaaggacgaggagcgggcggtgaaggacgagctgctgggcgagaagcccgagatcaagcagaagtgggcatcccggctgctggccaagctgcgcaaggacatccggcccgagttccgcgaggacttcgtgctgaccatcacgggcaagaagcccccctgctgcgtgctctccaaccccgaccagaagggcaagatccggcggattgactgcctgcgccaggctgacaaggtgtggcggctggacctggtcatggtgattttgtttaaggggatccccctggaaagtactgatggggagcggctctacaagtcgcctcagtgctcgaaccccggcctgtgcgtccagccacatcacattggagtcacaatcaaagaactggatctttatctggcttactttgtccacactccggaatccggacaatcagatagttcaaaccagcaaggagatgcggacatcaaaccactgcccaacgggcacttaagtttccaggactgttttgtgacttccggggtctggaatgtgacggagctggtgagagtatcacagactcctgttgcaacagcatcagggcccaacttctccctggcggacctggagagtcccagctactacaacatcaaccaggtgaccctggggcggcggtccatcacctcccctccttccaccagcaccaccaagcgccccaagtccatcgatgacagtgagatggagagccctgttgatgacgtgttctatcccgggacaggccgttccccagcagctggcagcagccagtccagcgggtggcccaacgatgtggatgcaggcccggcttctctaaagaagtcaggaaagctggacttctgcagtgccctctcctctcagggcagctccccgcgcatggctttcacccaccacccgctgcctgtgcttgctggagtcagaccagggagcccccgggccacagcatcagccctgcacttcccctccacgtccatcatccagcagtcgagcccgtatttcacgcacccgaccatccgctaccaccaccaccacgggcaggactcactgaaggagtttgtgcagtttgtgtgctcggatggctcgggccaggccaccggacagcattcgcaacgacaggcgcctcctctgccaaccggtttgtcagcatcggaccccgggacggcaactttctgaacatcccacagcagtctcagtcctggttcctctgataagatcgacaaaagaaacaacaaaatgagaagaagaggttcctcgaaaggggggagaagaaattttgagaatggaaaaatcccccagcccagcccagccccaccgaaaagcaaaaattacacgtcgtcagccactcagcccttctctcctccagcccggggacccccgcgggccccagaagcagcccagttctcagagagcccttggaaggggtctcggtggagctgtgcaccagcagccaagcagaaagaaacacgcgacatggactctgtcaagtagaggacagaaagcaagaaaggatgcagaactgccttcctccccctgaccccgccccggccttctggggaaggaacaaagtccccaaacaaagcaaccagcacaattctgaaggggcctggcctccaccctcaccccttcctaggggaagggccgggcgtgacgcgcggtcaaagtgcaatgatttttcagttcggttggctaaacagggtcagagctgagagcgaagcagaaggggctccctgtccggcccacgtgccctttccctcgacgacagtcgagggctcgggctctgtgggactgtgggagctagggtctgcggggcgcctgcccgggcgaggtcggaagctgcaggccagctgggcccgggccggagcgtgcccggcggggctgcccgggcgggcagggggtgggggctgctcctttcccaagtggtgttgtgaggggcaatgagggcaacaggagatgtggggacgtgttaggagagaaaaaaaaaaaaacaaaaatatatatgggggaaattaacttttttttttcattgaaccaagtgcaatgcatcagagagttttcctatctttgtatgttaagagattaagaaaaaaaaattctatttttgttgtaatgtcctcgcggctctggggacgctaaaagaaccgggcctgccccgccctgcgcggggataacgaaagctgagtgtttttcccttttttttgttcgtttttagtttttttttttttaagtcgttttcctgcgttgacgaggatgatctggggtttttatttgtttcgtcgttcgttctgtttcggtgggagggctgaaggaaacgttcacattttagagtttaaaaaaaacacctcgacatttaaaaaatcaaccaacacaagatcaaaaaggaaaaggacgagagaaaaattatttttaagataattaaacataaaaccctggtgcttcttacattataaagtacgttttaaagaacccacaaactattatacataagtttatgaatcaattaaatatcctgcacttgttaggaatacgcatatcccttctttgttgagtttaacggaacgggacagcggcgtgcccccggcggctggactgctccggccgcgggtctccccgggcgcccctccctggggcccagcacccctcctcgccccatccccgtccgggtacgggggcgcggcaggggtccccggcccctcccccgcagaggtcaatgccaacgaacaaacgtcccctccctccgtcgggctccgttcccaattgatattctacgggaccatgagggcaacaggnggtgttaggttttgttaggg

SEQ ID NO: 314702 - DNA, 1827 bp, Homo sapiens
gcggccgccgcctgccgggcctcccctcgccgcggccggccgccgcgctcccgcccgggcgcccagctatgtactccccgtactgcctcacccaggatgagttccacccgttcatcgaggcactgctgcctcacgtccgcgctttctcctacacctggttcaacctgcaggcgcggaagcgcaagtacttcaagaagcatgaaaagcggatgtcgaaggacgaggagcgggcggtgaaggacgagctgctgggcgagaagcccgagatcaagcagaagtgggcatcccggctgctggccaagctgcgcaaggacatccggcccgagttccgcgaggacttcgtgctgaccatcacgggcaagaagcccccctgctgcgtgctctccaaccccgaccagaagggcaagatccggcggattgactgcctgcgccaggctgacaaggtgtggcggctggacctggtcatggtgattttgtttaaggggatccccctggaaagtactgatggggagcggctctacaagtcgcctcagtgctcgaaccccggcctgtgcgtccagccacatcacattggagtcacaatcaaagaactggatctttatctggcttactttgtccacactccggaatccggacaatcagatagttcaaaccagcaaggagatgcggacatcaaaccactgcccaacgggcacttaagtttccaggactgttttgtgacttccggggtctggaatgtgacggagctggtgagagtatcacagactcctgttgcaacagcatcagggcccaacttctccctggcggacctggagagtcccagctactacaacatcaaccaggtgaccctggggcggcggtccatcacctcccctccttccaccagcaccaccaagcgccccaagtccatcgatgacagtgagatggagagccctgttgatgacgtgttctatcccgggacaggccgttccccagcagctggcagcagccagtccagcgggtggcccaacgatgtggatgcaggcccggcttctctaaagaagtcaggaaagctggacttctgcagtgccctctcctctcagggcagctccccgcgcatggctttcacccaccacccgctgcctgtgcttgctggagtcagaccaggtgagaaatggggggccccggaggggggcagttggggaggtggctgagtatctaggggcagctggccaggtgaaggggccagagctgaccccgagtgacagccccacgctctccaagtgggccaaggtgcagcagcgggtgggcatgggagccggcccctgcttcacgtagcacctcatcgaggaccaggccgggcccctgggctgcccacctggctcctgagcaacctcccacttctcactcctcacgtgcatgggtgctacatacaacacaagcctgtcccgagtcctccccaactctggcccagttctccttttgtcctgccagctgtgagcgggaaggcacagccttctgctctgccttcctgccggctcctctctcccagctcctggctgagcccaggctctggatttttgccagcatgagcccaggttgatgtggggcctggatggagaagagtactcctaaggagcccaggctcctgcggcaagtagctaccttgtctgggcctccctgccgctttctagaaaggaagggctgggtctaggggacaggtggtacctgggctgctccccaggaaaaggaactgcccactgccgtggggctgctctctgacttcagtgtcccagttgagaaggtgctcaggatgagaacacctagatcgccctgaggagataggat

SEQ ID NO: 314703 - DNA, 2474 bp, Homo sapiens
  misc_feature (2454)..(2454): n is a, c, g, or t
tgctctgcagctcctgtcacctgtccagagcaggtgtagacctcaaggcaaggctccccaaagagcctgccagaatccggacaatcagatagttcaaaccagcaaggagatgcggacatcaaaccactgcccaacgggcacttaagtttccaggactgttttgtgacttccggggtctggaatgtgacggagctggtgagagtatcacagactcctgttgcaacagcatcagggcccaacttctccctggcggacctggagagtcccagctactacaacatcaaccaggtgaccctggggcggcggtccatcacctcccctccttccaccagcaccaccaagcgccccaagtccatcgatgacagtgagatggagagccctgttgatgacgtgttctatcccgggacaggccgttccccagcagctggcagcagccagtccagcgggtggcccaacgatgtggatgcaggcccggcttctctaaagaagtcaggaaagctggacttctgcagtgccctctcctctcagggcagctccccgcgcatggctttcacccaccacccgctgcctgtgcttgctggagtcagaccagggagcccccgggccacagcatcagccctgcacttcccctccacgtccatcatccagcagtcgagcccgtatttcacgcacccgaccatccgctaccaccaccaccacgggcaggactcactgaaggagtttgtgcagtttgtgtgctcggatggctcgggccaggccaccggacagcattcgcaacgacaggcgcctcctctgccaaccggtttgtcagcatcggaccccgggacggcaactttctgaacatcccacagcagtctcagtcctggttcctctgataagatcgacaaaagaaacaacaaaatgagaagaagaggttcctcgaaaggggggagaagaaattttgagaatggaaaaatcccccagcccagcccagccccaccgaaaagcaaaaattacacgtcgtcagccactcagcccttctctcctccagcccggggacccccgcgggccccagaagcagcccagttctcagagagcccttggaaggggtctcggtggagctgtgcaccagcagccaagcagaaagaaacacgcgacatggactctgtcaagtagaggacagaaagcaagaaaggatgcagaactgccttcctccccctgaccccgccccggccttctggggaaggaacaaagtccccaaacaaagcaaccagcacaattctgaaggggcctggcctccaccctcaccccttcctaggggaagggccgggcgtgacgcgcggtcaaagtgcaatgatttttcagttcggttggctaaacagggtcagagctgagagcgaagcagaaggggctccctgtccggcccacgtgccctttccctcgacgacagtcgagggctcgggctctgtgggactgtgggagctagggtctgcggggcgcctgcccgggcgaggtcggaagctgcaggccagctgggcccgggccggagcgtgcccggcggggctgcccgggcgggcagggggtgggggctgctcctttcccaagtggtgttgtgaggggcaatgagggcaacaggagatgtggggacgtgttaggagagaaaaaaaaaaaaacaaaaatatatatgggggaaattaacttttttttttcattgaaccaagtgcaatgcatcagagagttttcctatctttgtatgttaagagattaagaaaaaaaaattctatttttgttgtaatgtcctcgcggctctggggacgctaaaagaaccgggcctgccccgccctgcgcggggataacgaaagctgagtgtttttcccttttttttgttcgtttttagtttttttttttttaagtcgttttcctgcgttgacgaggatgatctggggtttttatttgtttcgtcgttcgttctgtttcggtgggagggctgaaggaaacgttcacattttagagtttaaaaaaaacacctcgacatttaaaaaatcaaccaacacaagatcaaaaaggaaaaggacgagagaaaaattatttttaagataattaaacataaaaccctggtgcttcttacattataaagtacgttttaaagaacccacaaactattatacataagtttatgaatcaattaaatatcctgcacttgttaggaatacgcatatcccttctttgttgagtttaacggaacgggacagcggcgtgcccccggcggctggactgctccggccgcgggtctccccgggcgcccctccctggggcccagcacccctcctcgccccatccccgtccgggtacgggggcgcggcaggggtccccggcccctcccccgcagaggtcaatgccaacgaacaaacgtcccctccctccgtcgggctccgttcccaattgatattctacgggaccatgagggcaacaggnggtgttaggttttgttaggg

SEQ ID NO: 314704 - DNA, 2432 bp, Homo sapiens
  misc_feature (2412)..(2412): n is a, c, g, or t
aatgtcggtgtgtctaatgtcggagtgactaatgtcggtgtgtctaatgtcggtgtgtctcaaggagatgcggacatcaaaccactgcccaacgggcacttaagtttccaggactgttttgtgacttccggggtctggaatgtgacggagctggtgagagtatcacagactcctgttgcaacagcatcagggcccaacttctccctggcggacctggagagtcccagctactacaacatcaaccaggtgaccctggggcggcggtccatcacctcccctccttccaccagcaccaccaagcgccccaagtccatcgatgacagtgagatggagagccctgttgatgacgtgttctatcccgggacaggccgttccccagcagctggcagcagccagtccagcgggtggcccaacgatgtggatgcaggcccggcttctctaaagaagtcaggaaagctggacttctgcagtgccctctcctctcagggcagctccccgcgcatggctttcacccaccacccgctgcctgtgcttgctggagtcagaccagggagcccccgggccacagcatcagccctgcacttcccctccacgtccatcatccagcagtcgagcccgtatttcacgcacccgaccatccgctaccaccaccaccacgggcaggactcactgaaggagtttgtgcagtttgtgtgctcggatggctcgggccaggccaccggacagcattcgcaacgacaggcgcctcctctgccaaccggtttgtcagcatcggaccccgggacggcaactttctgaacatcccacagcagtctcagtcctggttcctctgataagatcgacaaaagaaacaacaaaatgagaagaagaggttcctcgaaaggggggagaagaaattttgagaatggaaaaatcccccagcccagcccagccccaccgaaaagcaaaaattacacgtcgtcagccactcagcccttctctcctccagcccggggacccccgcgggccccagaagcagcccagttctcagagagcccttggaaggggtctcggtggagctgtgcaccagcagccaagcagaaagaaacacgcgacatggactctgtcaagtagaggacagaaagcaagaaaggatgcagaactgccttcctccccctgaccccgccccggccttctggggaaggaacaaagtccccaaacaaagcaaccagcacaattctgaaggggcctggcctccaccctcaccccttcctaggggaagggccgggcgtgacgcgcggtcaaagtgcaatgatttttcagttcggttggctaaacagggtcagagctgagagcgaagcagaaggggctccctgtccggcccacgtgccctttccctcgacgacagtcgagggctcgggctctgtgggactgtgggagctagggtctgcggggcgcctgcccgggcgaggtcggaagctgcaggccagctgggcccgggccggagcgtgcccggcggggctgcccgggcgggcagggggtgggggctgctcctttcccaagtggtgttgtgaggggcaatgagggcaacaggagatgtggggacgtgttaggagagaaaaaaaaaaaaacaaaaatatatatgggggaaattaacttttttttttcattgaaccaagtgcaatgcatcagagagttttcctatctttgtatgttaagagattaagaaaaaaaaattctatttttgttgtaatgtcctcgcggctctggggacgctaaaagaaccgggcctgccccgccctgcgcggggataacgaaagctgagtgtttttcccttttttttgttcgtttttagtttttttttttttaagtcgttttcctgcgttgacgaggatgatctggggtttttatttgtttcgtcgttcgttctgtttcggtgggagggctgaaggaaacgttcacattttagagtttaaaaaaaacacctcgacatttaaaaaatcaaccaacacaagatcaaaaaggaaaaggacgagagaaaaattatttttaagataattaaacataaaaccctggtgcttcttacattataaagtacgttttaaagaacccacaaactattatacataagtttatgaatcaattaaatatcctgcacttgttaggaatacgcatatcccttctttgttgagtttaacggaacgggacagcggcgtgcccccggcggctggactgctccggccgcgggtctccccgggcgcccctccctggggcccagcacccctcctcgccccatccccgtccgggtacgggggcgcggcaggggtccccggcccctcccccgcagaggtcaatgccaacgaacaaacgtcccctccctccgtcgggctccgttcccaattgatattctacgggaccatgagggcaacaggnggtgttaggttttgttaggg

SEQ ID NO: 314705 - DNA, 2062 bp, Homo sapiens
  misc_feature (2042)..(2042): n is a, c, g, or t
aggctgttctagaggacccccgtgacaggtacagatgtgggccacacgatgtgagcagcccggcttctctaaagaagtcaggaaagctggacttctgcagtgccctctcctctcagggcagctccccgcgcatggctttcacccaccacccgctgcctgtgcttgctggagtcagaccagggagcccccgggccacagcatcagccctgcacttcccctccacgtccatcatccagcagtcgagcccgtatttcacgcacccgaccatccgctaccaccaccaccacgggcaggactcactgaaggagtttgtgcagtttgtgtgctcggatggctcgggccaggccaccggacagcattcgcaacgacaggcgcctcctctgccaaccggtttgtcagcatcggaccccgggacggcaactttctgaacatcccacagcagtctcagtcctggttcctctgataagatcgacaaaagaaacaacaaaatgagaagaagaggttcctcgaaaggggggagaagaaattttgagaatggaaaaatcccccagcccagcccagccccaccgaaaagcaaaaattacacgtcgtcagccactcagcccttctctcctccagcccggggacccccgcgggccccagaagcagcccagttctcagagagcccttggaaggggtctcggtggagctgtgcaccagcagccaagcagaaagaaacacgcgacatggactctgtcaagtagaggacagaaagcaagaaaggatgcagaactgccttcctccccctgaccccgccccggccttctggggaaggaacaaagtccccaaacaaagcaaccagcacaattctgaaggggcctggcctccaccctcaccccttcctaggggaagggccgggcgtgacgcgcggtcaaagtgcaatgatttttcagttcggttggctaaacagggtcagagctgagagcgaagcagaaggggctccctgtccggcccacgtgccctttccctcgacgacagtcgagggctcgggctctgtgggactgtgggagctagggtctgcggggcgcctgcccgggcgaggtcggaagctgcaggccagctgggcccgggccggagcgtgcccggcggggctgcccgggcgggcagggggtgggggctgctcctttcccaagtggtgttgtgaggggcaatgagggcaacaggagatgtggggacgtgttaggagagaaaaaaaaaaaaacaaaaatatatatgggggaaattaacttttttttttcattgaaccaagtgcaatgcatcagagagttttcctatctttgtatgttaagagattaagaaaaaaaaattctatttttgttgtaatgtcctcgcggctctggggacgctaaaagaaccgggcctgccccgccctgcgcggggataacgaaagctgagtgtttttcccttttttttgttcgtttttagtttttttttttttaagtcgttttcctgcgttgacgaggatgatctggggtttttatttgtttcgtcgttcgttctgtttcggtgggagggctgaaggaaacgttcacattttagagtttaaaaaaaacacctcgacatttaaaaaatcaaccaacacaagatcaaaaaggaaaaggacgagagaaaaattatttttaagataattaaacataaaaccctggtgcttcttacattataaagtacgttttaaagaacccacaaactattatacataagtttatgaatcaattaaatatcctgcacttgttaggaatacgcatatcccttctttgttgagtttaacggaacgggacagcggcgtgcccccggcggctggactgctccggccgcgggtctccccgggcgcccctccctggggcccagcacccctcctcgccccatccccgtccgggtacgggggcgcggcaggggtccccggcccctcccccgcagaggtcaatgccaacgaacaaacgtcccctccctccgtcgggctccgttcccaattgatattctacgggaccatgagggcaacaggnggtgttaggttttgttaggg

SEQ ID NO: 314706 - DNA, 838 bp, Homo sapiens
  misc_feature (9)..(9): n is a, c, g, or t
  misc_feature (15)..(15): n is a, c, g, or t
  misc_feature (818)..(818): n is a, c, g, or t
tgtctctcnctctcnctcaaagatagagattaagatagaaaactctctgatgcattgaaccaagtgcaatgcatcagagagttttcctatctttgtatgttaagagattaagaaaaaaaaattctatttttgttgtaatgtcctcgcggctctggggacgctaaaagaaccgggcctgccccgccctgcgcggggataacgaaagctgagtgtttttcccttttttttgttcgtttttagtttttttttttttaagtcgttttcctgcgttgacgaggatgatctggggtttttatttgtttcgtcgttcgttctgtttcggtgggagggctgaaggaaacgttcacattttagagtttaaaaaaaacacctcgacatttaaaaaatcaaccaacacaagatcaaaaaggaaaaggacgagagaaaaattatttttaagataattaaacataaaaccctggtgcttcttacattataaagtacgttttaaagaacccacaaactattatacataagtttatgaatcaattaaatatcctgcacttgttaggaatacgcatatcccttctttgttgagtttaacggaacgggacagcggcgtgcccccggcggctggactgctccggccgcgggtctccccgggcgcccctccctggggcccagcacccctcctcgccccatccccgtccgggtacgggggcgcggcaggggtccccggcccctcccccgcagaggtcaatgccaacgaacaaacgtcccctccctccgtcgggctccgttcccaattgatattctacgggaccatgagggcaacaggnggtgttaggttttgttaggg

SEQ ID NO: 314707 - DNA, 350 bp, Homo sapiens
cccccctgctgcgtgctctccaaccccgaccagaagggcaagatccggcggattgactgcctgcgccaggctgacaaggtgtggcggctggacctggtcatggtgattttgtttaaggggatccccctggaaagtactgatggggagcggctctacaagtcgcctcagtgctcgaaccccggcctgtgcgtccagccacatcacattggagtcacaatcaaagaactggatctttatctggcttactttgtccacactccgggtaggtcgttctcaaccatttttccctctcattttattttccttgctggcatttgttctgtttattgttcctctaatttccaagcgat

SEQ ID NO: 314708 - DNA, 744 bp, Homo sapiens
ccaaggctccagcttcttcccccagctgctcccgaccaggagggggagagcagcctccacttaccccaccccacccttgggctaaaagcccccaggcgggcagggggtgacccctggagctagttgcgtgtcccagaatggagggtgttctgacaccccaccctgagccgcaagagcagtcctggggccctggacccctctgtacagtccgtaggaaaaagtcggaatgctctcgacggcctcgtcccagcctgggacaggccccctttcccctctctctgcaggccaggagggcctccttcctgccacgagggaggggagtcgggccccaggtcgcccccgcccccagccctgcatgcaggtgccctcgctccgccccatcagttcctgcccctgcccctcatgcagactgccctgctggggccgggccggagggtggagcagaaaggggaccccggagccgagcgaggaggaccaggcagccgccgctgccgcgctaagccaccacctgcgcttaggtaggcgtcctgctcgccgactttcagttccttgggagggtgttgggtgtcgtccttttcaaaagtgttttggagctttctgtgccccccgactttcccccgcgccccgcccccgtcactgcgcttctgttataccatctttgcctgactctctccggcttctccattgaatggctaatgtgtatgtgaaataaagaaataaagaaaaacaaacgcgaaaaaaaaa

SEQ ID NO: 314709 - DNA, 3048 bp, Homo sapiens
  misc_feature (53)..(53): n is a, c, g, or t
  misc_feature (3028)..(3028): n is a, c, g, or t
tggttttataaggggctgcctccaccacgtcgctcttctttctgctctcatcncgtcttcccctcctcccgtcctccctcgccccgcatgtactccccgtactgcctcacccagggatgagttccacccgttcatcgaggcactgctgcctcacgtccgcgctttctcctacacctggttcaacctgcaggcgcggaagcgcaagtacttcaagaagcatgaaaagcggatgtcgaaggacgaggagcgggcggtgaaggacgagctgctgggcgagaagcccgagatcaagcagaagtgggcatcccggctgctggccaagctgcgcaaggacatccggcccgagttccgcgaggacttcgtgctgaccatcacgggcaagaagcccccctgctgcgtgctctccaaccccgaccagaagggcaagatccggcggattgactgcctgcgccaggctgacaaggtgtggcggctggacctggtcatggtgattttgtttaaggggatccccctggaaagtactgatggggagcggctctacaagtcgcctcagtgctcgaaccccggcctgtgcgtccagccacatcacattggagtcacaatcaaagaactggatctttatctggcttactttgtccacactccggaatccggacaatcagatagttcaaaccagcaaggagatgcggacatcaaaccactgcccaacgggcacttaagtttccaggactgttttgtgacttccggggtctggaatgtgacggagctggtgagagtatcacagactcctgttgcaacagcatcagggcccaacttctccctggcggacctggagagtcccagctactacaacatcaaccaggtgaccctggggcggcggtccatcacctcccctccttccaccagcaccaccaagcgccccaagtccatcgatgacagtgagatggagagccctgttgatgacgtgttctatcccgggacaggccgttccccagcagctggcagcagccagtccagcgggtggcccaacgatgtggatgcaggcccggcttctctaaagaagtcaggaaagctggacttctgcagtgccctctcctctcagggcagctccccgcgcatggctttcacccaccacccgctgcctgtgcttgctggagtcagaccagggagcccccgggccacagcatcagccctgcacttcccctccacgtccatcatccagcagtcgagcccgtatttcacgcacccgaccatccgctaccaccaccaccacgggcaggactcactgaaggagtttgtgcagtttgtgtgctcggatggctcgggccaggccaccggacagcattcgcaacgacaggcgcctcctctgccaaccggtttgtcagcatcggaccccgggacggcaactttctgaacatcccacagcagtctcagtcctggttcctctgataagatcgacaaaagaaacaacaaaatgagaagaagaggttcctcgaaaggggggagaagaaattttgagaatggaaaaatcccccagcccagcccagccccaccgaaaagcaaaaattacacgtcgtcagccactcagcccttctctcctccagcccggggacccccgcgggccccagaagcagcccagttctcagagagcccttggaaggggtctcggtggagctgtgcaccagcagccaagcagaaagaaacacgcgacatggactctgtcaagtagaggacagaaagcaagaaaggatgcagaactgccttcctccccctgaccccgccccggccttctggggaaggaacaaagtccccaaacaaagcaaccagcacaattctgaaggggcctggcctccaccctcaccccttcctaggggaagggccgggcgtgacgcgcggtcaaagtgcaatgatttttcagttcggttggctaaacagggtcagagctgagagcgaagcagaaggggctccctgtccggcccacgtgccctttccctcgacgacagtcgagggctcgggctctgtgggactgtgggagctagggtctgcggggcgcctgcccgggcgaggtcggaagctgcaggccagctgggcccgggccggagcgtgcccggcggggctgcccgggcgggcagggggtgggggctgctcctttcccaagtggtgttgtgaggggcaatgagggcaacaggagatgtggggacgtgttaggagagaaaaaaaaaaaaacaaaaatatatatgggggaaattaacttttttttttcattgaaccaagtgcaatgcatcagagagttttcctatctttgtatgttaagagattaagaaaaaaaaattctatttttgttgtaatgtcctcgcggctctggggacgctaaaagaaccgggcctgccccgccctgcgcggggataacgaaagctgagtgtttttcccttttttttgttcgtttttagtttttttttttttaagtcgttttcctgcgttgacgaggatgatctggggtttttatttgtttcgtcgttcgttctgtttcggtgggagggctgaaggaaacgttcacattttagagtttaaaaaaaacacctcgacatttaaaaaatcaaccaacacaagatcaaaaaggaaaaggacgagagaaaaattatttttaagataattaaacataaaaccctggtgcttcttacattataaagtacgttttaaagaacccacaaactattatacataagtttatgaatcaattaaatatcctgcacttgttaggaatacgcatatcccttctttgttgagtttaacggaacgggacagcggcgtgcccccggcggctggactgctccggccgcgggtctccccgggcgcccctccctggggcccagcacccctcctcgccccatccccgtccgggtacgggggcgcggcaggggtccccggcccctcccccgcagaggtcaatgccaacgaacaaacgtcccctccctccgtcgggctccgttcccaattgatattctacgggaccatgagggcaacaggnggtgttaggttttgttaggg

SEQ ID NO: 314710 - DNA, 2054 bp, Homo sapiens
  misc_feature (53)..(53): n is a, c, g, or t
tggttttataaggggctgcctccaccacgtcgctcttctttctgctctcatcncgtcttcccctcctcccgtcctccctcgccccgcatgtactccccgtactgcctcacccagggatgagttccacccgttcatcgaggcactgctgcctcacgtccgcgctttctcctacacctggttcaacctgcaggcgcggaagcgcaagtacttcaagaagcatgaaaagcggatgtcgaaggacgaggagcgggcggtgaaggacgagctgctgggcgagaagcccgagatcaagcagaagtgggcatcccggctgctggccaagctgcgcaaggacatccggcccgagttccgcgaggacttcgtgctgaccatcacgggcaagaagcccccctgctgcgtgctctccaaccccgaccagaagggcaagatccggcggattgactgcctgcgccaggctgacaaggtgtggcggctggacctggtcatggtgattttgtttaaggggatccccctggaaagtactgatggggagcggctctacaagtcgcctcagtgctcgaaccccggcctgtgcgtccagccacatcacattggagtcacaatcaaagaactggatctttatctggcttactttgtccacactccggaatccggacaatcagatagttcaaaccagcaaggagatgcggacatcaaaccactgcccaacgggcacttaagtttccaggactgttttgtgacttccggggtctggaatgtgacggagctggtgagagtatcacagactcctgttgcaacagcatcagggcccaacttctccctggcggacctggagagtcccagctactacaacatcaaccaggtgaccctggggcggcggtccatcacctcccctccttccaccagcaccaccaagcgccccaagtccatcgatgacagtgagatggagagccctgttgatgacgtgttctatcccgggacaggccgttccccagcagctggcagcagccagtccagcgggtggcccaacgatgtggatgcaggcccggcttctctaaagaagtcaggaaagctggacttctgcagtgccctctcctctcagggcagctccccgcgcatggctttcacccaccacccgctgcctgtgcttgctggagtcagaccagggagcccccgggccacagcatcagccctgcacttcccctccacgtccatcatccagcagtcgagcccgtatttcacgcacccgaccatccgctaccaccaccaccacgggcaggactcactgaaggagtttgtgcagtttgtgtgctcggatggctcgggccaggccaccggacagcattcgcaacgacaggcgcctcctctgccaaccggtttgtcagcatcggaccccgggacggcaactttctgaacatcccacagcagtctcagtcctggttcctctgataagatcgacaaaagaaacaacaaaatgagaagaagaggttcctcgaaaggggggagaagaaattttgagaatggaaaaatcccccagcccagcccagccccaccgaaaagcaaaaattacacgtcgtcagccactcagcccttctctcctccagcccggggacccccgcgggccccagaagcagcccagttctcagagagcccttggaaggggtctcggtggagctgtgcaccagcagccaagcagaaagaaacacgcgacatggactctgtcaagtagaggacagaaagcaagaaaggatgcagaactgccttcctccccctgaccccgccccggccttctggggaaggaacaaagtccccaaacaaagcaaccagcacaattctgaaggggcctggcctccaccctcaccccttcctaggggaaccccaccctccacacagccggagctgccctagggagcctggagggccagcttgtaaagatgatggggtttagatccctcaggctctcccctccagactccgcccttcccttccctccttcagcccccatcatgggaataaattaattttctcaatgtaaaaaaaaaaaattatcaaaa

SEQ ID NO: 314711 - DNA, 3028 bp, Homo sapiens
  misc_feature (3008)..(3008): n is a, c, g, or t
gcggccgccgcctgccgggcctcccctcgccgcggccggccgccgcgctcccgcccgggcgcccagctatgtactccccgtactgcctcacccaggatgagttccacccgttcatcgaggcactgctgcctcacgtccgcgctttctcctacacctggttcaacctgcaggcgcggaagcgcaagtacttcaagaagcatgaaaagcggatgtcgaaggacgaggagcgggcggtgaaggacgagctgctgggcgagaagcccgagatcaagcagaagtgggcatcccggctgctggccaagctgcgcaaggacatccggcccgagttccgcgaggacttcgtgctgaccatcacgggcaagaagcccccctgctgcgtgctctccaaccccgaccagaagggcaagatccggcggattgactgcctgcgccaggctgacaaggtgtggcggctggacctggtcatggtgattttgtttaaggggatccccctggaaagtactgatggggagcggctctacaagtcgcctcagtgctcgaaccccggcctgtgcgtccagccacatcacattggagtcacaatcaaagaactggatctttatctggcttactttgtccacactccggaatccggacaatcagatagttcaaaccagcaaggagatgcggacatcaaaccactgcccaacgggcacttaagtttccaggactgttttgtgacttccggggtctggaatgtgacggagctggtgagagtatcacagactcctgttgcaacagcatcagggcccaacttctccctggcggacctggagagtcccagctactacaacatcaaccaggtgaccctggggcggcggtccatcacctcccctccttccaccagcaccaccaagcgccccaagtccatcgatgacagtgagatggagagccctgttgatgacgtgttctatcccgggacaggccgttccccagcagctggcagcagccagtccagcgggtggcccaacgatgtggatgcaggcccggcttctctaaagaagtcaggaaagctggacttctgcagtgccctctcctctcagggcagctccccgcgcatggctttcacccaccacccgctgcctgtgcttgctggagtcagaccagggagcccccgggccacagcatcagccctgcacttcccctccacgtccatcatccagcagtcgagcccgtatttcacgcacccgaccatccgctaccaccaccaccacgggcaggactcactgaaggagtttgtgcagtttgtgtgctcggatggctcgggccaggccaccggacagcattcgcaacgacaggcgcctcctctgccaaccggtttgtcagcatcggaccccgggacggcaactttctgaacatcccacagcagtctcagtcctggttcctctgataagatcgacaaaagaaacaacaaaatgagaagaagaggttcctcgaaaggggggagaagaaattttgagaatggaaaaatcccccagcccagcccagccccaccgaaaagcaaaaattacacgtcgtcagccactcagcccttctctcctccagcccggggacccccgcgggccccagaagcagcccagttctcagagagcccttggaaggggtctcggtggagctgtgcaccagcagccaagcagaaagaaacacgcgacatggactctgtcaagtagaggacagaaagcaagaaaggatgcagaactgccttcctccccctgaccccgccccggccttctggggaaggaacaaagtccccaaacaaagcaaccagcacaattctgaaggggcctggcctccaccctcaccccttcctaggggaagggccgggcgtgacgcgcggtcaaagtgcaatgatttttcagttcggttggctaaacagggtcagagctgagagcgaagcagaaggggctccctgtccggcccacgtgccctttccctcgacgacagtcgagggctcgggctctgtgggactgtgggagctagggtctgcggggcgcctgcccgggcgaggtcggaagctgcaggccagctgggcccgggccggagcgtgcccggcggggctgcccgggcgggcagggggtgggggctgctcctttcccaagtggtgttgtgaggggcaatgagggcaacaggagatgtggggacgtgttaggagagaaaaaaaaaaaaacaaaaatatatatgggggaaattaacttttttttttcattgaaccaagtgcaatgcatcagagagttttcctatctttgtatgttaagagattaagaaaaaaaaattctatttttgttgtaatgtcctcgcggctctggggacgctaaaagaaccgggcctgccccgccctgcgcggggataacgaaagctgagtgtttttcccttttttttgttcgtttttagtttttttttttttaagtcgttttcctgcgttgacgaggatgatctggggtttttatttgtttcgtcgttcgttctgtttcggtgggagggctgaaggaaacgttcacattttagagtttaaaaaaaacacctcgacatttaaaaaatcaaccaacacaagatcaaaaaggaaaaggacgagagaaaaattatttttaagataattaaacataaaaccctggtgcttcttacattataaagtacgttttaaagaacccacaaactattatacataagtttatgaatcaattaaatatcctgcacttgttaggaatacgcatatcccttctttgttgagtttaacggaacgggacagcggcgtgcccccggcggctggactgctccggccgcgggtctccccgggcgcccctccctggggcccagcacccctcctcgccccatccccgtccgggtacgggggcgcggcaggggtccccggcccctcccccgcagaggtcaatgccaacgaacaaacgtcccctccctccgtcgggctccgttcccaattgatattctacgggaccatgagggcaacaggnggtgttaggttttgttaggg

SEQ ID NO: 314712 - DNA, 2990 bp, Homo sapiens
  misc_feature (2970)..(2970): n is a, c, g, or t
ttgagtccagaatctcagaatcgggcgttgggctttgccgggtgcttcagatcaatggatgagttccacccgttcatcgaggcactgctgcctcacgtccgcgctttctcctacacctggttcaacctgcaggcgcggaagcgcaagtacttcaagaagcatgaaaagcggatgtcgaaggacgaggagcgggcggtgaaggacgagctgctgggcgagaagcccgagatcaagcagaagtgggcatcccggctgctggccaagctgcgcaaggacatccggcccgagttccgcgaggacttcgtgctgaccatcacgggcaagaagcccccctgctgcgtgctctccaaccccgaccagaagggcaagatccggcggattgactgcctgcgccaggctgacaaggtgtggcggctggacctggtcatggtgattttgtttaaggggatccccctggaaagtactgatggggagcggctctacaagtcgcctcagtgctcgaaccccggcctgtgcgtccagccacatcacattggagtcacaatcaaagaactggatctttatctggcttactttgtccacactccggaatccggacaatcagatagttcaaaccagcaaggagatgcggacatcaaaccactgcccaacgggcacttaagtttccaggactgttttgtgacttccggggtctggaatgtgacggagctggtgagagtatcacagactcctgttgcaacagcatcagggcccaacttctccctggcggacctggagagtcccagctactacaacatcaaccaggtgaccctggggcggcggtccatcacctcccctccttccaccagcaccaccaagcgccccaagtccatcgatgacagtgagatggagagccctgttgatgacgtgttctatcccgggacaggccgttccccagcagctggcagcagccagtccagcgggtggcccaacgatgtggatgcaggcccggcttctctaaagaagtcaggaaagctggacttctgcagtgccctctcctctcagggcagctccccgcgcatggctttcacccaccacccgctgcctgtgcttgctggagtcagaccagggagcccccgggccacagcatcagccctgcacttcccctccacgtccatcatccagcagtcgagcccgtatttcacgcacccgaccatccgctaccaccaccaccacgggcaggactcactgaaggagtttgtgcagtttgtgtgctcggatggctcgggccaggccaccggacagcattcgcaacgacaggcgcctcctctgccaaccggtttgtcagcatcggaccccgggacggcaactttctgaacatcccacagcagtctcagtcctggttcctctgataagatcgacaaaagaaacaacaaaatgagaagaagaggttcctcgaaaggggggagaagaaattttgagaatggaaaaatcccccagcccagcccagccccaccgaaaagcaaaaattacacgtcgtcagccactcagcccttctctcctccagcccggggacccccgcgggccccagaagcagcccagttctcagagagcccttggaaggggtctcggtggagctgtgcaccagcagccaagcagaaagaaacacgcgacatggactctgtcaagtagaggacagaaagcaagaaaggatgcagaactgccttcctccccctgaccccgccccggccttctggggaaggaacaaagtccccaaacaaagcaaccagcacaattctgaaggggcctggcctccaccctcaccccttcctaggggaagggccgggcgtgacgcgcggtcaaagtgcaatgatttttcagttcggttggctaaacagggtcagagctgagagcgaagcagaaggggctccctgtccggcccacgtgccctttccctcgacgacagtcgagggctcgggctctgtgggactgtgggagctagggtctgcggggcgcctgcccgggcgaggtcggaagctgcaggccagctgggcccgggccggagcgtgcccggcggggctgcccgggcgggcagggggtgggggctgctcctttcccaagtggtgttgtgaggggcaatgagggcaacaggagatgtggggacgtgttaggagagaaaaaaaaaaaaacaaaaatatatatgggggaaattaacttttttttttcattgaaccaagtgcaatgcatcagagagttttcctatctttgtatgttaagagattaagaaaaaaaaattctatttttgttgtaatgtcctcgcggctctggggacgctaaaagaaccgggcctgccccgccctgcgcggggataacgaaagctgagtgtttttcccttttttttgttcgtttttagtttttttttttttaagtcgttttcctgcgttgacgaggatgatctggggtttttatttgtttcgtcgttcgttctgtttcggtgggagggctgaaggaaacgttcacattttagagtttaaaaaaaacacctcgacatttaaaaaatcaaccaacacaagatcaaaaaggaaaaggacgagagaaaaattatttttaagataattaaacataaaaccctggtgcttcttacattataaagtacgttttaaagaacccacaaactattatacataagtttatgaatcaattaaatatcctgcacttgttaggaatacgcatatcccttctttgttgagtttaacggaacgggacagcggcgtgcccccggcggctggactgctccggccgcgggtctccccgggcgcccctccctggggcccagcacccctcctcgccccatccccgtccgggtacgggggcgcggcaggggtccccggcccctcccccgcagaggtcaatgccaacgaacaaacgtcccctccctccgtcgggctccgttcccaattgatattctacgggaccatgagggcaacaggnggtgttaggttttgttaggg

SEQ ID NO: 314713 - DNA, 1677 bp, Homo sapiens
gcggccgccgcctgccgggcctcccctcgccgcggccggccgccgcgctcccgcccgggcgcccagctatgtactccccgtactgcctcacccaggatgagttccacccgttcatcgaggcactgctgcctcacgtccgcgctttctcctacacctggttcaacctgcaggcgcggaagcgcaagtacttcaagaagcatgaaaagcggatgtcgaaggacgaggagcgggcggtgaaggacgagctgctgggcgagaagcccgagatcaagcagaagtgggcatcccggctgctggccaagctgcgcaaggacatccggcccgagttccgcgaggacttcgtgctgaccatcacgggcaagaagcccccctgctgcgtgctctccaaccccgaccagaagggcaagatccggcggattgactgcctgcgccaggctgacaaggtgtggcggctggacctggtcatggtgattttgtttaaggggatccccctggaaagtactgatggggagcggctctacaagtcgcctcagtgctcgaaccccggcctgtgcgtccagccacatcacattggagtcacaatcaaagaactggatctttatctggcttactttgtccacactccggaatccggacaatcagatagttcaaaccagcaaggagatgcggacatcaaaccactgcccaacgggcacttaagtttccaggactgttttgtgacttccggggtctggaatgtgacggagctggtgagagtatcacagactcctgttgcaacagcatcagggcccaacttctccctggcggacctggagagtcccagctactacaacatcaaccaggtgaccctggggcggcggtccatcacctcccctccttccaccagcaccaccaagcgccccaagtccatcgatgacagtgagatggagagccctgttgatgacgtgttctatcccgggacaggccgttccccagcagctggcagcagccagtccagcgggtggcccaacgatgtggatgcaggcccggcttctctaaagaagtcaggaaagctggacttctgcagtgccctctcctctcagggcagctccccgcgcatggctttcacccaccacccgctgcctgtgcttgctggagtcagaccagggagcccccgggccacagcatcagccctgcacttcccctccacgtccatcatccagcagtcgagcccgtatttcacgcacccgaccatccgctaccaccaccaccacgggcaggactcactgaaggagtttgtgcagtttgtgtgctcggatggctcgggccaggccaccggacagcattcgcaacgacaggcgcctcctctgccaaccggtttgtcagcatcggaccccgggacggcaactttctgaacatcccacagcagtctcagtcctggttcctctgataagatcgacaaaagaaacaacaaaatgagaagaagaggttcctcgaaaggggggagaagaaattttgagaatggaaaaatcccccagcgcagccagcccgtctgttccctctccgccccgccccgccccgcccccgtcactgcgcttctgttataccatctttgcctgactctctccggcttctccattgaatggctaatgtgtatgtgaaataaagaaataaagaaaaacaaacgcgaaaaaaaaa

SEQ ID NO: 314714 - DNA, 1554 bp, Homo sapiens
gcggccgccgcctgccgggcctcccctcgccgcggccggccgccgcgctcccgcccgggcgcccagctatgtactccccgtactgcctcacccaggatgagttccacccgttcatcgaggcactgctgcctcacgtccgcgctttctcctacacctggttcaacctgcaggcgcggaagcgcaagtacttcaagaagcatgaaaagcggatgtcgaaggacgaggagcgggcggtgaaggacgagctgctgggcgagaagcccgagatcaagcagaagtgggcatcccggctgctggccaagctgcgcaaggacatccggcccgagttccgcgaggacttcgtgctgaccatcacgggcaagaagcccccctgctgcgtgctctccaaccccgaccagaagggcaagatccggcggattgactgcctgcgccaggctgacaaggtgtggcggctggacctggtcatggtgattttgtttaaggggatccccctggaaagtactgatggggagcggctctacaagtcgcctcagtgctcgaaccccggcctgtgcgtccagccacatcacattggagtcacaatcaaagaactggatctttatctggcttactttgtccacactccggaatccggacaatcagatagttcaaaccagcaaggagatgcggacatcaaaccactgcccaacgggcacttaagtttccaggactgttttgtgacttccggggtctggaatgtgacggagctggtgagagtatcacagactcctgttgcaacagcatcagggcccaacttctccctggcggacctggagagtcccagctactacaacatcaaccaggtgaccctggggcggcggtccatcacctcccctccttccaccagcaccaccaagcgccccaagtccatcgatgacagtgagatggagagccctgttgatgacgtgttctatcccgggacaggccgttccccagcagctggcagcagccagtccagcgggtggcccaacgatgtggatgcagggagcccccgggccacagcatcagccctgcacttcccctccacgtccatcatccagcagtcgagcccgtatttcacgcacccgaccatccgctaccaccaccaccacgggcaggactcactgaaggagtttgtgcagtttgtgtgctcggatggctcgggccaggccaccggacagcattcgcaacgacaggcgcctcctctgccaaccggtttgtcagcatcggaccccgggacggcaactttctgaacatcccacagcagtctcagtcctggttcctctgataagatcgacaaaagaaacaacaaaatgagaagaagaggttcctcgaaaggggggagaagaaattttgagaatggaaaaatcccccagcgcagccagcccgtctgttccctctccgccccgccccgccccgcccccgtcactgcgcttctgttataccatctttgcctgactctctccggcttctccattgaatggctaatgtgtatgtgaaataaagaaataaagaaaaacaaacgcgaaaaaaaaa

SEQ ID NO: 314715 - DNA, 2809 bp, Homo sapiens
  misc_feature (2789)..(2789): n is a, c, g, or t
cgacgacggaaccgccatgggtgctgagtggagagtggggaccgcggaccccgggggcaggatgagttccacccgttcatcgaggcactgctgcctcacgtccgcgctttctcctacacctggttcaacctgcaggcgcggaagcgcaagtacttcaagaagcatgaaaagcggatgtcgaaggacgaggagcgggcggtgaaggacgagctgctgggcgagaagcccgagatcaagcagaagtgggcatcccggctgctggccaagctgcgcaaggacatccggcccgagttccgcgaggacttcgtgctgaccatcacgggcaagaagcccccctgctgcgtgctctccaaccccgaccagaagggcaagatccggcggattgactgcctgcgccaggctgacaagaatccggacaatcagatagttcaaaccagcaaggagatgcggacatcaaaccactgcccaacgggcacttaagtttccaggactgttttgtgacttccggggtctggaatgtgacggagctggtgagagtatcacagactcctgttgcaacagcatcagggcccaacttctccctggcggacctggagagtcccagctactacaacatcaaccaggtgaccctggggcggcggtccatcacctcccctccttccaccagcaccaccaagcgccccaagtccatcgatgacagtgagatggagagccctgttgatgacgtgttctatcccgggacaggccgttccccagcagctggcagcagccagtccagcgggtggcccaacgatgtggatgcaggcccggcttctctaaagaagtcaggaaagctggacttctgcagtgccctctcctctcagggcagctccccgcgcatggctttcacccaccacccgctgcctgtgcttgctggagtcagaccagggagcccccgggccacagcatcagccctgcacttcccctccacgtccatcatccagcagtcgagcccgtatttcacgcacccgaccatccgctaccaccaccaccacgggcaggactcactgaaggagtttgtgcagtttgtgtgctcggatggctcgggccaggccaccggacagcattcgcaacgacaggcgcctcctctgccaaccggtttgtcagcatcggaccccgggacggcaactttctgaacatcccacagcagtctcagtcctggttcctctgataagatcgacaaaagaaacaacaaaatgagaagaagaggttcctcgaaaggggggagaagaaattttgagaatggaaaaatcccccagcccagcccagccccaccgaaaagcaaaaattacacgtcgtcagccactcagcccttctctcctccagcccggggacccccgcgggccccagaagcagcccagttctcagagagcccttggaaggggtctcggtggagctgtgcaccagcagccaagcagaaagaaacacgcgacatggactctgtcaagtagaggacagaaagcaagaaaggatgcagaactgccttcctccccctgaccccgccccggccttctggggaaggaacaaagtccccaaacaaagcaaccagcacaattctgaaggggcctggcctccaccctcaccccttcctaggggaagggccgggcgtgacgcgcggtcaaagtgcaatgatttttcagttcggttggctaaacagggtcagagctgagagcgaagcagaaggggctccctgtccggcccacgtgccctttccctcgacgacagtcgagggctcgggctctgtgggactgtgggagctagggtctgcggggcgcctgcccgggcgaggtcggaagctgcaggccagctgggcccgggccggagcgtgcccggcggggctgcccgggcgggcagggggtgggggctgctcctttcccaagtggtgttgtgaggggcaatgagggcaacaggagatgtggggacgtgttaggagagaaaaaaaaaaaaacaaaaatatatatgggggaaattaacttttttttttcattgaaccaagtgcaatgcatcagagagttttcctatctttgtatgttaagagattaagaaaaaaaaattctatttttgttgtaatgtcctcgcggctctggggacgctaaaagaaccgggcctgccccgccctgcgcggggataacgaaagctgagtgtttttcccttttttttgttcgtttttagtttttttttttttaagtcgttttcctgcgttgacgaggatgatctggggtttttatttgtttcgtcgttcgttctgtttcggtgggagggctgaaggaaacgttcacattttagagtttaaaaaaaacacctcgacatttaaaaaatcaaccaacacaagatcaaaaaggaaaaggacgagagaaaaattatttttaagataattaaacataaaaccctggtgcttcttacattataaagtacgttttaaagaacccacaaactattatacataagtttatgaatcaattaaatatcctgcacttgttaggaatacgcatatcccttctttgttgagtttaacggaacgggacagcggcgtgcccccggcggctggactgctccggccgcgggtctccccgggcgcccctccctggggcccagcacccctcctcgccccatccccgtccgggtacgggggcgcggcaggggtccccggcccctcccccgcagaggtcaatgccaacgaacaaacgtcccctccctccgtcgggctccgttcccaattgatattctacgggaccatgagggcaacaggnggtgttaggttttgttaggg

SEQ ID NO: 314716 - DNA, 2440 bp, Homo sapiens
  misc_feature (2420)..(2420): n is a, c, g, or t
ccaaggctccagcttcttcccccagctgctcccgaccaggagggggagagcagcctccacttaccccaccccacccttgggctaaaagcccccaggcgggcagggggtgacccctggagctagttgcgtgtcccagaatggagggtgttctgacaccccaccctgagccgcaagagcagtcctggggccctggacccctctgtacagtccgtaggaaaaagtcggaatgctctcgacggcctcgtcccagcctgggacaggccccctttcccctctctctgcaggccaggagggcctccttcctgccacgagggaggggagtcgggccccaggtcgcccccgcccccagccctgcatgcaggtgccctcgctccgccccatcagttcctgcccctgcccctcatgcagactgccctgctggggccgggccggagggtggagcagaaaggggaccccggagccgagcgaggaggaccaggcagccgccgctgccgcgctaagccaccacctgcgcttaggtaggcgtcctgctcgccgactttcagttccttgggagggtgttgggtgtcgtccttttcaaaagtgttttggagctttctgtgccccccgactttcccccgcctccccgccccccacgtggccacttttctctggattttagctgtaatgtctttactctttatttaggggtggggcattcattgtttggggtcttcagaagcccccctgggagggaggggaggatgagcacgcccagctcccctccagggtgtgacttggcccctctggcttgtctttctgtgccttactcctcctcctgcgtctcccgttcctggccccttcttgagtccttgtgcctctctctttctctctctttcttaattgtatgaaaacacaaagcacaggtcaggatcctctgagagaaaatcaacattgcaccacgtaggggtgggctatgggctgtatttattgtgaatctagtttgtgaggctgtggccccgagctggcggagggagggaagaggagggagtgacgggaggggaggaggtcagcgacctggggccgtagcggcaggcgaacggtgcctgctacccagctggaagccacaaggtggctggctccaggggcggcttttgttggaagttgagtgaagccctccccctgtcctcagcgtgcagccctagaggaccccagggctgaggggcagtggatcctgcgggagtctcccggggcgtggggagtaaggccccgggggtggggggccgggtgggccgggcgtgacgcgcggtcaaagtgcaatgatttttcagttcggttggctaaacagggtcagagctgagagcgaagcagaaggggctccctgtccggcccacgtgccctttccctcgacgacagtcgagggctcgggctctgtgggactgtgggagctagggtctgcggggcgcctgcccgggcgaggtcggaagctgcaggccagctgggcccgggccggagcgtgcccggcggggctgcccgggcgggcagggggtgggggctgctcctttcccaagtggtgttgtgaggggcaatgagggcaacaggagatgtggggacgtgttaggagagaaaaaaaaaaaaacaaaaatatatatgggggaaattaacttttttttttcattgaaccaagtgcaatgcatcagagagttttcctatctttgtatgttaagagattaagaaaaaaaaattctatttttgttgtaatgtcctcgcggctctggggacgctaaaagaaccgggcctgccccgccctgcgcggggataacgaaagctgagtgtttttcccttttttttgttcgtttttagtttttttttttttaagtcgttttcctgcgttgacgaggatgatctggggtttttatttgtttcgtcgttcgttctgtttcggtgggagggctgaaggaaacgttcacattttagagtttaaaaaaaacacctcgacatttaaaaaatcaaccaacacaagatcaaaaaggaaaaggacgagagaaaaattatttttaagataattaaacataaaaccctggtgcttcttacattataaagtacgttttaaagaacccacaaactattatacataagtttatgaatcaattaaatatcctgcacttgttaggaatacgcatatcccttctttgttgagtttaacggaacgggacagcggcgtgcccccggcggctggactgctccggccgcgggtctccccgggcgcccctccctggggcccagcacccctcctcgccccatccccgtccgggtacgggggcgcggcaggggtccccggcccctcccccgcagaggtcaatgccaacgaacaaacgtcccctccctccgtcgggctccgttcccaattgatattctacgggaccatgagggcaacaggnggtgttaggttttgttaggg

SEQ ID NO: 314717 - DNA, 950 bp, Homo sapiens
gcggccgccgcctgccgggcctcccctcgccgcggccggccgccgcgctcccgcccgggcgcccagctatgtactccccgtactgcctcacccaggatgagttccacccgttcatcgaggcactgctgcctcacgtccgcgctttctcctacacctggttcaacctgcaggcgcggaagcgcaagtacttcaagaagcatgaaaagcggatgtcgaaggacgaggagcgggcggtgaaggacgagctgctgggcgagaagcccgagatcaagcagaagtgggcatcccggctgctggccaagctgcgcaaggacatccggcccgagttccgcgaggacttcgtgctgaccatcacgggcaagaagcccccctgctgcgtgctctccaaccccgaccagaagggcaagatccggcggattgactgcctgcgccaggctgacaaggtgtggcggctggacctggtcatggtgattttgtttaaggggatccccctggaaagtactgatggggagcggctctacaagtcgcctcagtgctcgaaccccggcctgtgcgtccagccacatcacattggagtcacaatcaaagaactggatctttatctggcttactttgtccacactccgggtaggtcgttctcaaccatttttccctctcattttattttcctctctatgtattaattccctgaattctcaccctgattctagttttaagcctgtgctcctggctgggtgtgtgtgcactcaggtgatgtgcataatatgtgtagtgaggaatcagcaaaccagacctggggaccagggaggcttcctagaagacgacctacttgacctgcaccttgaaagacagtgaggaattagctcgttttgtcagctgcctgagccttctcagtgtgcctggagctgattccctcctcacaatggttgagtgatatagacagggcaggt

SEQ ID NO: 314718 - DNA, 661 bp, Homo sapiens
atcatatcatacatgctgttttatagtttgcctttttcgtagactatatcctagacagctctccatgtcagtgaacctagatatattatttataataactgaattataaaccattgtctgaatatttaggtagaattcaatttctcagcattacaaaaatgccatgctaagtatccttattacatgcctttctgttcatacaaatgataaatttctggaactgaaattgctgggacaaagggtatcagggtacacagctttacatgatgctatgtactaccaaatggacccccaagaaagacagtttaagtggcatgtcattgtcttcccaagtctgttcctaatgcagtcccacatgttcagtaaaacatcaagacacatcagttgggccaggcacggtggctcgcacttgtaatcccagcactttgggaggtcgaggcaggtggatcacttgagttgaggagttcgagatcaacctggccaacctggtgaaacccccatctctacaaaaataagccaggcctggtggtgcatgcctgtagtcccagctactaaggaggctgaggtgggagaatcgcttgaacccaggaggcagaggttgcattgggcctagatcatgccactgcactccagcctgggcgtcagagtgagaccctgtctc

SEQ ID NO: 314719 - DNA, 2059 bp, Homo sapiens
tcaagtctgttttcctcgcagcggtgcccacacccctagcatactgcctggcacacagtaaatgctcattaaatatttgtgaggtacatggacaggggaatgtggtagacagctgatgaagctgttctcccactgttcccctaggtggatcatccaaagtcaatcgattctgaactctgaggtccaagttctgccctcccccttcactctccccacaagtgggcgggacaatcctcccatgacttaagcacaggtggacaggggtggtcagagagaggaaggggcactcagagatccagcaggtgctgcaccatgagtgtctctgtgctgagccccagcagactcctgggtgatgtctctggaatcctccaagcggcctccctgctcattctgcttctgctgctgatcaaggcagttcagctctacctgcacaggcagtggctgctcaaagccctccagcagttcccgtgccctccctcccactggctcttcgggcacatccaggagctccaacaggaccaggagctacaacggattcagaaatgggtggagacattcccaagtgcctgtcctcattggctatggggaggcaaagttcgtgtccagctctatgaccctgactatatgaaggtgattctggggagatcagacccgaaatcccatggttcctacagattcctggctccatggattgggtacggcttgctcctgttgaatgggcagacatggttccagcatcgacggatgctgaccccagccttccactatgacatcctgaagccctatgtggggctcatggcagactctgtacgagtgatgctggacaaatgggaagagctccttggccaggattcccctctggaggtctttcagcacgtctccttgatgaccctggacaccatcatgaagtgtgccttcagccatcagggcagcatccaggtggacaggaattctcagtcctacatacaggccattagtgacctgaacaacctggttttttcccgtgtgaggaatgcctttcaccagaatgacaccatctacagcctgacctctgctggccgctggacacaccgcgcctgccagctggcccatcagcacacagaccaagtgatccaactgaggaaggctcaactacagaaggagggggagctggagaagatcaagaggaagaggcatttggattttctggatatcctcctcttggccaaaatggagaatgggagcatcttgtcagacaaggacctccgtgctgaggtggacacgttcatgtttgagggccacgacaccacagccagtgggatctcctggatcctctatgctctggccacacaccccaagcatcaggagaggtgccgggaggagatccacagcctcctgggtgatggagcctccatcacctggaaccacctggaccagatgccctacaccaccatgtgcattaaggaggcactgaggctctacccaccggtgccaggcattggcagagagctcagcactcccgtcaccttccctgatgggcgctccttgcccaaaggtatcatggtcctcctctccatttatggccttcaccacaacccaaaagtgtggcccaacccagaggtgtttgacccttcccgttttgcaccgggttctgctcaacacagccacgctttcctgcccttctcaggaggatcaaggaactgcatcgggaaacaatttgccatgaacgagctgaaggtggccacggccctgaccctgctccgctttgagctgctgcctgatcccaccaggatccccatccccattgcacgacttgtgttgaaatccaaaaatggaatccacctgcgtctcaggaggctccctaacccttgtgaagacaaggaccagctttgagggcctccacctgccgtcctgtcttcctgacccccgcttctgtccccttcctgtctgcccatatcctgttttctccagactgtctgcccatacacctgtctccttcttcctgcctgcttgtctgttcctatattagtttcctattactgctgtaataaactatcacaatctcagtgattttaaataa

SEQ ID NO: 314720 - DNA, 2760 bp, Homo sapiens
  misc_feature (2375)..(2376): n is a, c, g, or t
  misc_feature (2410)..(2410): n is a, c, g, or t
tcaagtctgttttcctcgcagcggtgcccacacccctagcatactgcctggcacacagtaaatgctcattaaatatttgtgaggtacatggacaggggaatgtggtagacagctgatgaagctgttctcccactgttcccctaggtggatcatccaaagtcaatcgattctgaactctgaggtccaagttctgccctcccccttcactctccccacaagtgggcgggacaatcctcccatgacttaagcacaggtggacaggggtggtcagagagaggaaggggcactcagagatccagcaggtgctgcaccatgagtgtctctgtgctgagccccagcagactcctgggtgatgtctctggaatcctccaagcggcctccctgctcattctgcttctgctgctgatcaaggcagttcagctctacctgcacaggcagtggctgctcaaagccctccagcagttcccgtgccctccctcccactggctcttcgggcacatccaggagctccaacaggaccaggagctacaacggattcagaaatgggtggagacattcccaagtgcctgtcctcattggctatggggaggcaaagttcgtgtccagctctatgaccctgactatatgaaggtgattctggggagatcagacccgaaatcccatggttcctacagattcctggctccatggattgggtacggcttgctcctgttgaatgggcagacatggttccagcatcgacggatgctgaccccagccttccactatgacatcctgaagccctatgtggggctcatggcagactctgtacgagtgatgctggacaaatgggaagagctccttggccaggattcccctctggaggtctttcagcacgtctccttgatgaccctggacaccatcatgaagtgtgccttcagccatcagggcagcatccaggtggacaggaattctcagtcctacatacaggccattagtgacctgaacaacctggttttttcccgtgtgaggaatgcctttcaccagaatgacaccatctacagcctgacctctgctggccgctggacacaccgcgcctgccagctggcccatcagcacacagaccaagtgatccaactgaggaaggctcaactacagaaggagggggagctggagaagatcaagaggaagaggcatttggattttctggatatcctcctcttggccaaaatggagaatgggagcatcttgtcagacaaggacctccgtgctgaggtggacacgttcatgtttgagggccacgacaccacagccagtgggatctcctggatcctctatgctctggccacacaccccaagcatcaggagaggtgccgggaggagatccacagcctcctgggtgatggagcctccatcacctggaaccacctggaccagatgccctacaccaccatgtgcattaaggaggcactgaggctctacccaccggtgccaggcattggcagagagctcagcactcccgtcaccttccctgatgggcgctccttgcccaaaggtatcatggtcctcctctccatttatggccttcaccacaacccaaaagtgtggcccaacccagaggtgtttgacccttcccgttttgcaccgggttctgctcaacacagccacgctttcctgcccttctcaggaggatcaaggaactgcatcgggaaacaatttgccatgaacgagctgaaggtggccacggccctgaccctgctccgctttgagctgctgcctgatcccaccaggatccccatccccattgcacgacttgtgttgaaatccaaaaatggaatccacctgcgtctcaggaggctccctaacccttgtgaagacaaggaccagctttgagggcctccacctgccgtcctgtcttcctgacccccgcttctgtccccttcctgtctgcccatatcctgttttctgtctgcccaccttcccttcttcccacctgcctgctgtcccccagtctgcctgcccttctctctctcacctttctccaggctccctacctgcttgtctacctgtctcctacccacctgtatctcttgttgggagaaaagctgagtgttgggagaagctgaggccgagcttgcatgtctgacataatgtaaaagagtcttgaatcatgtccaggatccagggtctaaaaccccttgtggcctttggaacaccaagctctgtgctgaagggtggaaggctaccctgacgcaccataatctaagcccggggcatggacttgctggctccttgctccttgctctcccaggatcaattgtatcttgagttaaaagaacctgctctccattatctcaagtaacagagcagatgctaaaccgtcacagctgtaaatnntgtgcttaatgcaacatgccctttcgacccaccncattctcaccacctgtttctttgtttgatcaccaataaataatctgcacttccagagctcggggccttcacagcctccatccttagctttggcgccctggacccactttctctctcaaactgtcttttctcactgctttgactctgccggactttgtcacccccacgacctggtgttgggtctgaacaccccaacatccctgaatctccacccacctcccaaactcctgcctgccctccagactgtctgcccatacacctgtctccttcttcctgcctgcttgtctgttcctatattagtttcctattactgctgtaataaactatcacaatctcagtgattttaaataa

SEQ ID NO: 314721 - DNA, 2205 bp, Homo sapiens
  misc_feature (1820)..(1821): n is a, c, g, or t
  misc_feature (1855)..(1855): n is a, c, g, or t
tcaagtctgttttcctcgcagcggtgcccacacccctagcatactgcctggcacacagtaaatgctcattaaatatttgtgaggtacatggacaggggaatgtggtagacagctgatgaagctgttctcccactgttcccctaggtggatcatccaaagtcaatcgattctgaactctgaggtccaagttctgccctcccccttcactctccccacaagtgggcgggacaatcctcccatgacttaagcacaggtggacaggggtggtcagagagaggaaggggcactcagagatccagcaggtgctgcaccatgagtgtctctgtgctgagccccagcagactcctgggtgatgtctctggaatcctccaagcggcctccctgctcattctgcttctgctgctgatcaaggcagttcagctctacctgcacaggcagtggctgctcaaagccctccagcagttcccgtgccctccctcccactggctcttcgggcacatccaggagctccaacaggaccaggagctacaacggattcagaaatgggtggagacattcccaagtgcctgtcctcattggctatggggaggcaaagttcgtgtccagctctatgaccctgactatatgaaggtgattctggggagatcagacccgaaatcccatggttcctacagattcctggctccatggattgggtacggcttgctcctgttgaatgggcagacatggttccagcatcgacggatgctgaccccagccttccactatgacatcctgaagccctatgtggggctcatggcagactctgtacgagtgatgctggacaaatgggaagagctccttggccaggattcccctctggaggtctttcagcacgtctccttgatgaccctggacaccatcatgaagtgtgccttcagcattggcagagagctcagcactcccgtcaccttccctgatgggcgctccttgcccaaaggtatcatggtcctcctctccatttatggccttcaccacaacccaaaagtgtggcccaacccagaggtgtttgacccttcccgttttgcaccgggttctgctcaacacagccacgctttcctgcccttctcaggaggatcaaggaactgcatcgggaaacaatttgccatgaacgagctgaaggtggccacggccctgaccctgctccgctttgagctgctgcctgatcccaccaggatccccatccccattgcacgacttgtgttgaaatccaaaaatggaatccacctgcgtctcaggaggctccctaacccttgtgaagacaaggaccagctttgagggcctccacctgccgtcctgtcttcctgacccccgcttctgtccccttcctgtctgcccatatcctgttttctgtctgcccaccttcccttcttcccacctgcctgctgtcccccagtctgcctgcccttctctctctcacctttctccaggctccctacctgcttgtctacctgtctcctacccacctgtatctcttgttgggagaaaagctgagtgttgggagaagctgaggccgagcttgcatgtctgacataatgtaaaagagtcttgaatcatgtccaggatccagggtctaaaaccccttgtggcctttggaacaccaagctctgtgctgaagggtggaaggctaccctgacgcaccataatctaagcccggggcatggacttgctggctccttgctccttgctctcccaggatcaattgtatcttgagttaaaagaacctgctctccattatctcaagtaacagagcagatgctaaaccgtcacagctgtaaatnntgtgcttaatgcaacatgccctttcgacccaccncattctcaccacctgtttctttgtttgatcaccaataaataatctgcacttccagagctcggggccttcacagcctccatccttagctttggcgccctggacccactttctctctcaaactgtcttttctcactgctttgactctgccggactttgtcacccccacgacctggtgttgggtctgaacaccccaacatccctgaatctccacccacctcccaaactcctgcctgccctccagactgtctgcccatacacctgtctccttcttcctgcctgcttgtctgttcctatattagtttcctattactgctgtaataaactatcacaatctcagtgattttaaataa

SEQ ID NO: 314722 - DNA, 1565 bp, Homo sapiens
tcaagtctgttttcctcgcagcggtgcccacacccctagcatactgcctggcacacagtaaatgctcattaaatatttgtgaggtacatggacaggggaatgtggtagacagctgatgaagctgttctcccactgttcccctaggtggatcatccaaagtcaatcgattctgaactctgaggtccaagttctgccctcccccttcactctccccacaagtgggcgggacaatcctcccatgacttaagcacaggtggacaggggtggtcagagagaggaaggggcactcagagatccagcaggtgctgcaccatgagtgtctctgtgctgagccccagcagactcctgggtgatgtctctggaatcctccaagcggcctccctgctcattctgcttctgctgctgatcaaggcagttcagctctacctgcacaggcagtggctgctcaaagccctccagcagttcccgtgccctccctcccactggctcttcgggcacatccaggagctccaacaggaccaggagctacaacggattcagaaatgggtggagacattcccaagtgcctgtcctcattggctatggggaggcaaagttcgtgtccagctctatgaccctgactatatgaaggtgattctggggagatcagacccgaaatcccatggttcctacagattcctggctccatggattgggtacggcttgctcctgttgaatgggcagacatggttccagcatcgacggatgctgaccccagccttccactatgacatcctgaagccctatgtggggctcatggcagactctgtacgagtgatgctggacaaatgggaagagctccttggccaggattcccctctggaggtctttcagcacgtctccttgatgaccctggacaccatcatgaagtgtgccttcagccatcagggcagcatccaggtggacaggaattctcagtcctacatacaggccattagtgacctgaacaacctggttttttcccgtgtgaggaatgcctttcaccagaatgacaccatctacagcctgacctctgctggccgctggacacaccgcgcctgccagctggcccatcagcacacagaccaagtgatccaactgaggaaggctcaactacagaaggagggggagctggagaagatcaagaggaagaggcatttggattttctggatatcctcctcttggccaaaatggagaatgggagcatcttgtcagacaaggacctccgtgctgaggtggacacgttcatgtttgagggccacgacaccacagccagtgggatctcctggatcctctatgctctggccacacaccccaagcatcaggagaggtgccgggaggagatccacagcctcctgggtgatggagcctccatcacctggaaccacctggaccagatgccctacaccaccatgtgcattaaggaggcactgaggctctacccaccggtgccaggcattggcagagagctcagcactcccgtcaccttccctgatgggcgctccttgcccaaaggtatgaagtttccccaccctctcacccaaag

SEQ ID NO: 314723 - DNA, 1179 bp, Homo sapiens
  misc_feature (1072)..(1072): n is a, c, g, or t
  misc_feature (1087)..(1087): n is a, c, g, or t
  misc_feature (1163)..(1163): n is a, c, g, or t
  misc_feature (1168)..(1168): n is a, c, g, or t
  misc_feature (1173)..(1173): n is a, c, g, or t
tcaagtctgttttcctcgcagcggtgcccacacccctagcatactgcctggcacacagtaaatgctcattaaatatttgtgaggtacatggacaggggaatgtggtagacagctgatgaagctgttctcccactgttcccctaggtggatcatccaaagtcaatcgattctgaactctgaggtccaagttctgccctcccccttcactctccccacaagtgggcgggacaatcctcccatgacttaagcacaggtggacaggggtggtcagagagaggaaggggcactcagagatccagcaggtgctgcaccatgagtgtctctgtgctgagccccagcagactcctgggtgatgtctctggaatcctccaagcggcctccctgctcattctgcttctgctgctgatcaaggcagttcagctctacctgcacaggcagtggctgctcaaagccctccagcagttcccgtgccctccctcccactggctcttcgggcacatccaggagctccaacaggaccaggagctacaacggattcagaaatgggtggagacattcccaagtgcctgtcctcattggctatggggaggcaaagttcgtgtccagctctatgaccctgactatatgaaggtgattctggggagatcagacccgaaatcccatggttcctacagattcctggctccatggattgggtacggcttgctcctgttgaatgggcagacatggttccagcatcgacggatgctgaccccagccttccactatgacatcctgaagccctatgtggggctcatggcagactctgtacgagtgatgctggtgagtccatgtctctctcctctccccacacccactcacagcacacactctcaccaactccactctcaaccctgtgtcccacaggcagacatagacatagactcatggaacaacactctcaggtcattgctgtgagagtagagggttccccaggagttgtattaaggtagggagaacacccagggcattcaggtcatattccacgcttttgtttccccaccatagggaagtaggagattcatgggtggantggcaagggcccttnttccttccccatttttgggaacctttcaggcacaaggggattgggagggattttggcattttttgttgggacagtnggggntttcnattggt

SEQ ID NO: 314724 - DNA, 809 bp, Homo sapiens
tcaagtctgttttcctcgcagcggtgcccacacccctagcatactgcctggcacacagtaaatgctcattaaatatttgtgaggtacatggacaggggaatgtggtagacagctgatgaagctgttctcccactgttcccctaggtggatcatccaaagtcaatcgattctgaactctgaggtccaagttctgccctcccccttcactctccccacaagtgggcgggacaatcctcccatgacttaagcacaggtggacaggggtggtcagagagaggaaggggcactcagagatccagcaggtgctgcaccatgagtgtctctgtgctgagccccagcagactcctgggtgatgtctctggaatcctccaagcggcctccctgctcattctgcttctgctgctgatcaaggcagttcagctctacctgcacaggcagtggctgctcaaagccctccagcagttcccgtgccctccctcccactggctcttcgggcacatccaggagctccaacaggaccaggagctacaacggattcagaaatgggtggagacattcccaagtgcctgtcctcattggctatggggaggcaaagttcgtgtccagctctatgaccctgactatatgaaggtgattctggggagatcagacccgaaatcccatggttcctacagattcctggctccatggattgctccagactgtctgcccatacacctgtctccttcttcctgcctgcttgtctgttcctatattagtttcctattactgctgtaataaactatcacaatctcagtgattttaaataa

SEQ ID NO: 314725 - DNA, 2814 bp, Homo sapiens
  misc_feature (2429)..(2430): n is a, c, g, or t
  misc_feature (2464)..(2464): n is a, c, g, or t
tcaagtctgttttcctcgcagcggtgcccacacccctagcatactgcctggcacacagtaaatgctcattaaatatttgtgaggtacatggacaggggaatgtggtagacagctgatgaagctgttctcccactgttcccctaggtggatcatccaaagtcaatcgattctgaactctgaggtccaagttctgccctcccccttcactctccccacaagtgggcgggacaatcctcccatgacttaagcacaggtggacaggggtggtcagagagaggaaggggcactcagagatccagcaggtgctgcaccatgagtgtctctgtgctgagccccagcagactcctgggtgatgtctctggaatcctccaagcggcctccctgctcattctgcttctgctgctgatcaaggcagttcagctctacctgcacaggcagtggctgctcaaagccctccagcagttcccgtgccctccctcccactggctcttcgggcacatccaggagctccaacaggaccaggagctacaacggattcagaaatgggtggagacattcccaagtgcctgtcctcattggctatggggaggcaaagttcgtgtccagctctatgaccctgactatatgaaggtgattctggggagatcagacccgaaatcccatggttcctacagattcctggctccatggattgggtacggcttgctcctgttgaatgggcagacatggttccagcatcgacggatgctgaccccagccttccactatgacatcctgaagccctatgtggggctcatggcagactctgtacgagtgatgctggacaaatgggaagagctccttggccaggattcccctctggaggtctttcagcacgtctccttgatgaccctggacaccatcatgaagtgtgccttcagccatcagggcagcatccaggtggacaggaattctcagtcctacatacaggccattagtgacctgaacaacctggttttttcccgtgtgaggaatgcctttcaccagaatgacaccatctacagcctgacctctgctggccgctggacacaccgcgcctgccagctggcccatcagcacacagaccaagtgatccaactgaggaaggctcaactacagaaggagggggagctggagaagatcaagaggaagaggcatttggattttctggatatcctcctcttggccaaaatggagaatgggagcatcttgtcagacaaggacctccgtgctgaggtggacacgttcatgtttgagggccacgacaccacagccagtgggatctcctggatcctctatgctctggccacacaccccaagcatcaggagaggtgccgggaggagatccacagcctcctgggtgatggagcctccatcacctggaaccacctggaccagatgccctacaccaccatgtgcattaaggaggcactgaggctctacccaccggtgccaggcattggcagagagctcagcactcccgtcaccttccctgatgggcgctccttgcccaaaggtatcatggtcctcctctccatttatggccttcaccacaacccaaaagtgtggcccaacccagaggtgtttgacccttcccgttttgcaccgggttctgctcaacacagccacgctttcctgcccttctcaggaggatcaaggaactgcatcgggaaacaatttgccatgaacgagctgaaggtggccacggccctgaccctgctccgctttgagctgctgcctgatcccaccaggatccccatccccattgcacgacttgtgttgaaatccaaaaatggaatccacctgcgtctcaggaggctccctaacccttgtgaagacaaggaccagctttgagggcctccacctgccgtcctgtcttcctgacccccgcttctgtccccttcctgtctgcccatatcctgttttctgtctgcccaccttcccttcttcccacctgcctgctgtcccccagtctgcctgcccttctctctctcacctttctccaggctccctacctgcttgtctacctgtctcctacccacctgtatctcttgttgggagaaaagctgagtgttgggagaagctgaggccgagcttgcatgtctgacataatgtaaaagagtcttgaatcatgtccaggatccagggtctaaaaccccttgtggcctttggaacaccaagctctgtgctgaagggtggaaggctaccctgacgcaccataatctaagcccggggcataaaacccctcgtggcttggatagaatccagggctcgtggctctggaatgtgtctggacttgctggctccttgctccttgctctcccaggatcaattgtatcttgagttaaaagaacctgctctccattatctcaagtaacagagcagatgctaaaccgtcacagctgtaaatnntgtgcttaatgcaacatgccctttcgacccaccncattctcaccacctgtttctttgtttgatcaccaataaataatctgcacttccagagctcggggccttcacagcctccatccttagctttggcgccctggacccactttctctctcaaactgtcttttctcactgctttgactctgccggactttgtcacccccacgacctggtgttgggtctgaacaccccaacatccctgaatctccacccacctcccaaactcctgcctgccctccagactgtctgcccatacacctgtctccttcttcctgcctgcttgtctgttcctatattagtttcctattactgctgtaataaactatcacaatctcagtgattttaaataa

SEQ ID NO: 314726 - DNA, 2707 bp, Homo sapiens
  misc_feature (2322)..(2323): n is a, c, g, or t
  misc_feature (2357)..(2357): n is a, c, g, or t
tcaagtctgttttcctcgcagcggtgcccacacccctagcatactgcctggcacacagtaaatgctcattaaatatttgtgaggtacatggacaggggaatgtggtagacagctgatgaagctgttctcccactgttcccctaggtggatcatccaaagtcaatcgattctgaactctgaggtccaagttctgccctcccccttcactctccccacaagtgggcgggacaatcctcccatgacttaagcacaggtggacaggggtggtcagagagaggaaggggcactcagagatccagcaggtgctgcaccatgagtgtctctgtgctgagccccagcagactcctgggtgatgtctctggaatcctccaagcggcctccctgctcattctgcttctgctgctgatcaaggcagttcagctctacctgcacaggcagtggctgctcaaagccctccagcagttcccgtgccctccctcccactggctcttcgggcacatccaggagctccaacaggaccaggagctacaacggattcagaaatgggtggagacattcccaagtgcctgtcctcattggctatggggaggcaaagttcgtgtccagctctatgaccctgactatatgaaggtgattctggggagatcagacccgaaatcccatggttcctacagattcctggctccatggattgggtacggcttgctcctgttgaatgggcagacatggttccagcatcgacggatgctgaccccagccttccactatgacatcctgaagccctatgtggggctcatggcagactctgtacgagtgatgctggacaaatgggaagagctccttggccaggattcccctctggaggtctttcagcacgtctccttgatgaccctggacaccatcatgaagtgtgccttcagccatcagggcagcatccaggtggacaggaattctcagtcctacatacaggccattagtgacctgaacaacctggttttttcccgtgtgaggaatgcctttcaccagaatgacaccatctacagcctgacctctgctggccgctggacacaccgcgcctgccagctggcccatcagcacacagaccaagtgatccaactgaggaaggctcaactacagaaggagggggagctggagaagatcaagaggaagaggcatttggattttctggatatcctcctcttggccaaaatggagaatgggagcatcttgtcagacaaggacctccgtgctgaggtggacacgttcatgtttgagggccacgacaccacagccagtgggatctcctggatcctctatgctctggccacacaccccaagcatcaggagaggtgccgggaggagatccacagcctcctgggtgatggagcctccatcacctggaaccacctggaccagatgccctacaccaccatgtgcattaaggaggcactgaggctctacccaccggtgccaggcattggcagagagctcagcactcccgtcaccttccctgatgggcgctccttgcccaaaggtatcatggtcctcctctccatttatggccttcaccacaacccaaaagtgtggcccaacccagaggtgtttgacccttcccgttttgcaccgggttctgctcaacacagccacgctttcctgcccttctcaggaggatcaaggaactgcatcgggaaacaatttgccatgaacgagctgaaggtggccacggccctgaccctgctccgctttgagctgctgcctgatcccaccaggatccccatccccattgcacgacttgtgttgaaatccagaccagctttgagggcctccacctgccgtcctgtcttcctgacccccgcttctgtccccttcctgtctgcccatatcctgttttctgtctgcccaccttcccttcttcccacctgcctgctgtcccccagtctgcctgcccttctctctctcacctttctccaggctccctacctgcttgtctacctgtctcctacccacctgtatctcttgttgggagaaaagctgagtgttgggagaagctgaggccgagcttgcatgtctgacataatgtaaaagagtcttgaatcatgtccaggatccagggtctaaaaccccttgtggcctttggaacaccaagctctgtgctgaagggtggaaggctaccctgacgcaccataatctaagcccggggcatggacttgctggctccttgctccttgctctcccaggatcaattgtatcttgagttaaaagaacctgctctccattatctcaagtaacagagcagatgctaaaccgtcacagctgtaaatnntgtgcttaatgcaacatgccctttcgacccaccncattctcaccacctgtttctttgtttgatcaccaataaataatctgcacttccagagctcggggccttcacagcctccatccttagctttggcgccctggacccactttctctctcaaactgtcttttctcactgctttgactctgccggactttgtcacccccacgacctggtgttgggtctgaacaccccaacatccctgaatctccacccacctcccaaactcctgcctgccctccagactgtctgcccatacacctgtctccttcttcctgcctgcttgtctgttcctatattagtttcctattactgctgtaataaactatcacaatctcagtgattttaaataa

SEQ ID NO: 314727 - DNA, 2216 bp, Homo sapiens
tcaagtctgttttcctcgcagcggtgcccacacccctagcatactgcctggcacacagtaaatgctcattaaatatttgtgaggtacatggacaggggaatgtggtagacagctgatgaagctgttctcccactgttcccctaggtggatcatccaaagtcaatcgattctgaactctgaggtccaagttctgccctcccccttcactctccccacaagtgggcgggacaatcctcccatgacttaagcacaggtggacaggggtggtcagagagaggaaggggcactcagagatccagcaggtgctgcaccatgagtgtctctgtgctgagccccagcagactcctgggtgatgtctctggaatcctccaagcggcctccctgctcattctgcttctgctgctgatcaaggcagttcagctctacctgcacaggcagtggctgctcaaagccctccagcagttcccgtgccctccctcccactggctcttcgggcacatccaggagctccaacaggaccaggagctacaacggattcagaaatgggtggagacattcccaagtgcctgtcctcattggctatggggaggcaaagttcgtgtccagctctatgaccctgactatatgaaggtgattctggggagatcagacccgaaatcccatggttcctacagattcctggctccatggattgggtacggcttgctcctgttgaatgggcagacatggttccagcatcgacggatgctgaccccagccttccactatgacatcctgaagccctatgtggggctcatggcagactctgtacgagtgatgctggacaaatgggaagagctccttggccaggattcccctctggaggtctttcagcacgtctccttgatgaccctggacaccatcatgaagtgtgccttcagccatcagggcagcatccaggtggacaggaattctcagtcctacatacaggccattagtgacctgaacaacctggttttttcccgtgtgaggaatgcctttcaccagaatgacaccatctacagcctgacctctgctggccgctggacacaccgcgcctgccagctggcccatcagcacacagaccaagtgatccaactgaggaaggctcaactacagaaggagggggagctggagaagatcaagaggaagaggcatttggattttctggatatcctcctcttggccaaaatggagaatgggagcatcttgtcagacaaggacctccgtgctgaggtggacacgttcatgtttgagggccacgacaccacagccagtgggatctcctggatcctctatgctctggccacacaccccaagcatcaggagaggtgccgggaggagatccacagcctcctgggtgatggagcctccatcacctggaaccacctggaccagatgccctacaccaccatgtgcattaaggaggcactgaggctctacccaccggtgccaggcattggcagagagctcagcactcccgtcaccttccctgatgggcgctccttgcccaaaggtatcatggtcctcctctccatttatggccttcaccacaacccaaaagtgtggcccaacccagaggtgtttgacccttcccgttttgcaccgggttctgctcaacacagccacgctttcctgcccttctcaggaggatcaaggtgagacgtcctgtgtggtaattggaatagagaaatgagggaagtctctggtcaaccctctgatctttgtgagcccgatgttcatatgtggcatcttcaggtgtgctcttaaatattggtatttgtgggaaagtcaggcacctggtgtgggcgtctctgtgtacaaaaggaaggtggcattcagagcaccccatggagactttgctccctctgcttcttcaaatgggcagcctgaattcactgtcagtgcatgttccaaacttcagtatattcatgtattttcctcactttaaggatatgaattctcaaaattagatattctccagtaaattcaacttcagctgtttgcttttctcagttgtcaggaatagtaaactgtagatttctctctccccacacatcctcaatgcagcacactaccttccctatttaattcactagtctgtcgtagagatgaatcattgaaatctttgcatctgtttataatacagatgacctgcaagtcctacctttcaagccatataagggagaggttaaggt

SEQ ID NO: 314728 - DNA, 1673 bp, Homo sapiens
tcaagtctgttttcctcgcagcggtgcccacacccctagcatactgcctggcacacagtaaatgctcattaaatatttgtgaggtacatggacaggggaatgtggtagacagctgatgaagctgttctcccactgttcccctaggtggatcatccaaagtcaatcgattctgaactctgaggtccaagttctgccctcccccttcactctccccacaagtgggcgggacaatcctcccatgacttaagcacaggtggacaggggtggtcagagagaggaaggggcactcagagatccagcaggtgctgcaccatgagtgtctctgtgctgagccccagcagactcctgggtgatgtctctggaatcctccaagcggcctccctgctcattctgcttctgctgctgatcaaggcagttcagctctacctgcacaggcagtggctgctcaaagccctccagcagttcccgtgccctccctcccactggctcttcgggcacatccaggagctccaacaggaccaggagctacaacggattcagaaatgggtggagacattcccaagtgcctgtcctcattggctatggggaggcaaagttcgtgtccagctctatgaccctgactatatgaaggtgattctggggagatcagacccgaaatcccatggttcctacagattcctggctccatggattgggtacggcttgctcctgttgaatgggcagacatggttccagcatcgacggatgctgaccccagccttccactatgacatcctgaagccctatgtggggctcatggcagactctgtacgagtgatgctggtgagtccatgtctctctcctctccccacacccactcacagcacacactctcaccaactccactctcaaccctgtgtcccacaggcagacatagacatagactcatggaacaacactctcaggtcattgctgtgagagtagagggttccccaggagttgtattaaggtagggagaacacccagggcattcaggtcatattccacgcttttgtttccccaccatagggaagtaggagattcatggtgaacacaaggcccttctcctcccactttggaacctcagcacaagggactggaggcatatgcaatcttgttggacagtaggacttcctatgctggctggcctgggcaatggcagcttcagtggcagcatggacaggccaagatgtcacccacccaggctctggcctggggccccgggtttctgcatggatttaagccaccctgggaaggaaatgaacaccaggtctatgttctcagagcaataccttccatagatagcatcatctccagtcaggactctgatttctcacccaaactgtgcccagcacattttgatgaatggaaaagaattgaagtccctgttttctctacaacagagtgcccatactagccccttaagctatctttggcactgaaactttcctactagtccctcagaactagctcagctctcagaacactgaagagtcccccattatttatcccagaacaacaataacaacaaaattttcacaagcatatgtcctaactgaatctcaaaattcaatacttaatccatgctattgtgagaggatctgttgaatgttgtattaaaagtgtgtgagaattaggtgtcagtttaccaacac

SEQ ID NO: 314729 - DNA, 1055 bp, Homo sapiens
  misc_feature (993)..(993): n is a, c, g, or t
cgggcgcctacgtgggcaccagcccccgcgcccgcccgcccgccctgcggtccggtcctggcgcccgcgcagaaccagctgtctgagctgcccgggcagcgggggagcagcgagcgggcttccgcgagccggagaaggcacaggcctgtcccgggtcccggcaggtctgcgcgtctgttcccagcgctctgcgaggcctaaaaaggaggagcaacctgtccagaatccctgcaggacaggaaaaggaggggaaatctcgacatggaaaaaccctacaataaaaatgaaggaaacctggaaaacgagggaaagccagaagatgaagtagagcctgatgatgaaggaaagtcagacgaggaagaaaagccagacgtggaggggaagacagaatgcgagggaaagagagaggatgagggagagccaggtgatgagggacaactggaagatgagggaagccaggaaaagcagggcaggtccgaaggtgagggcaagccacaaggcgagggcaagccagcctcccaggcaaagccagagagccagccgcgggccgccgaaaagcgcccggctgaagattatgtgccccggaaagcaaaaagaaaaacggacagggggacggacgattcccccaaggactctcaggaggacttacaggaaaggcatctgagcagtgaggagatgatgagagaatgtggagatgtgtcaagggctcaagaggagctaaggaaaaaacagaaaatgggtggttttcattggatgcaaagagatgtacaggatccattcgccccaaggggacaacggggtgtcaggggagtgaggggtggaggtaggggccagaggggcttacacgatatcccatacctttaatgcctttggccttccattctgatttctctgatgagaatattgctggccctgctttccctggtaggtatttgccaggcccaatgctttaaccttaagctgatactttgctttagatgtcagtctcgttanacaccgacccccattctcctcctatccctcaaccccggcatcattaccgggttttcctctta

SEQ ID NO: 314730 - DNA, 1124 bp, Homo sapiens
cgggcgcctacgtgggcaccagcccccgcgcccgcccgcccgccctgcggtccggtcctggcgcccgcgcagaaccagctgtctgagctgcccgggcagcgggggagcagcgagcgggcttccgcgagccggagaaggcacaggcctgtcccgggtcccggcaggtctgcgcgtctgttcccagcgctctgcgaggcctaaaaaggaggagcaacctgtccagaatccctgcaggacaggaaaaggaggggaaatctcgacatggaaaaaccctacaataaaaatgaaggaaacctggaaaacgagggaaagccagaagatgaagtagagcctgatgatgaaggaaagtcagacgaggaagaaaagccagacgtggaggggaagacagaatgcgagggaaagagagaggatgagggagagccaggtgatgagggacaactggaagatgagggaagccaggaaaagcagggcaggtccgaaggtgagggcaagccacaaggcgagggcaagccagcctcccaggcaaagccagagagccagccgcgggccgccgaaaagcgcccggctgaagattatgtgccccggaaagcaaaaagaaaaacggacagggggacggacgattcccccaaggactctcaggaggacttacaggaaaggcatctgagcagtgaggagatgatgagagaatgtggagatgtgtcaagggctcaagaggagctaaggaaaaaacagaaaatgggtggttttcattggatgcaaagagatgtacaggatccattcgccccaaggggacaacggggtgtcaggggagtgaggggtggaggtaggggccagaggggcttacacgatatcccatacctttaatgcctttggccttccattctgatttctctgatgagaatattgctggccctgctttccctggtaggtatttgccaggcccaatgctttaaccttaagctgatactttgctttagatgtcagtctcgttaccagcagccttttgacccaactacggcgctctatattttagtagaggattttcacccatgtgcatggaaaagatgttcatggtacattgtaaaaaaataaaattaaaattaaaaaaagtttgcagaaccgca

SEQ ID NO: 314731 - DNA, 1544 bp, Homo sapiens
cctttgtatttgggaaagaaaagcatgcattggctgaaatgaaacaaaagcccttacttgggaaaagggacccccaccagcggccctgcttgctccgtagctgggaacatcttttctggtttcctgagccagcacctgaattgcaacgaagctctgaggatactcaacaccacccagcagtgcgtcagaatggaacgtacattctcattctcagactgttcaatatggtgcccgtaacctccaaagccacacaggaggctgccagcagcattttccccaagggcctgagctcagggtcaagtccctgctggccatcttggggctgtcactgggggtctgggtcaaggacatcccaggaatggtaactgccacatacctcatcttcttactccccagctactctcttttcctcattagccttcctgattatttattgatttcttttttttattcaactgacattgtttgcaccctggctctgttggtggtcctggtgttttaatgaagcttgcctcacccagtagctgggaaattaggtgggggtgcttaagggaggtttgtaggagtcctcggacgtgggatattgggggtatctagggcttggatggtttgtggaatgtcctcagcatcctcccgtcccaacccaaccttccttcttcctcattgtggacttggatttattctcaggctaggagtctccaaaactccgtgaaaccttattgctgctgggtgtggagtggagagtgacaggaatgtgggggacggtgattgttggctccagttactaatgtttaagcagaaaaaccactttcttgttgaaaatatccctgaaaaggtcgctgctgctttgaggaggcgtgactttttcctggtggagtgtgacggaggcatggggcctgtgctcccaggctcgggggagccccctctgcacacggggagggaggaacttggggacatcagtcatgggtcacaggtggcttcaggccattcacaagagtccccggaagttgcgtgccaagtttggttttttccctgaatctctgcatatgagcatttttctggagaaaggaccatagcttttattagattctcaaaggttcagaatggggaatgtgttaaacaaaccgaaaacctgtttcagctttaaaatcctccaaaactttaaagacttttcttttttctgagaaaggctggtaaatcactgagtcatcattcagaacatacagcctcgaagggcagagctcacacccatatatgacgttaagagctcaacaaatgtttgttgagtgactgagtgaccccaggggcagactccagatcatcagacactgatacagagagcgatgctatctcctcaactctccctcttctcctaaaagctgagtctatatagggatgacaggctcagctgagcactggttgggatgcattcgaatgacttcagcaagatcctgctttcctcagcccccgctctgttttatttattgtttaatatttccaatgatccaaatcaaagtgaataaacaaagagctattttattgtt

SEQ ID NO: 314732 - DNA, 3847 bp, Homo sapiens
cctttgtatttgggaaagaaaagcatgcattggctgaaatgaaacaaaagcccttacttgggaaaagggacccccaccagcggccctgcttgctccgtagctgggaacatcttttctggtttcctgagccagcacctgaattgcaacgaagctctgaggatactcaacaccacccagcagtgcgtcagaatggaacgtacattctcattctcagactgttcaatatggtgcccgtaacctccaaagccacacaggaggctgccagcagcattttccccaagggcctgagctcagggtcaagtccctgctggccatcttggggctgtcactgggggtctgggtcaaggacatcccaggaatggtaactgccacatacctcatcttcttactccccagctactctcttttcctcattagccttcctgattatttattgatttcttttttttattcaactgacattgtttgcaccctggctctgttggtggtcctggtgttttaatgaagcttgcctcacccagtagctgggaaattaggtgggggtgcttaagggaggtttgtaggagtcctcggacgtgggatattgggggtatctagggcttggatggtttgtggaatgtcctcagcatcctcccgtcccaacccaaccttccttcttcctcattgtggacttggatttattctcaggctaggagtctccaaaactccgtgaaaccttattgctgctgggtgtggagtggagagtgacaggaatgtgggggacggtgattgttggctccagttactaatgtttaagcagaaaaaccactttcttgttgaaaatatccctgaaaaggtcgctgctgctttgaggaggcgtgactttttcctggtggagtgtgacggaggcatggggcctgtgctcccaggctcgggggagccccctctgcacacggggagggaggaacttggggacatcagtcatgggtcacaggtggcttcaggccattcacaagagtccccggaagttgcgtgccaagtttggttttttccctgaatctctgcatatgagcatttttctggagaaaggaccatagcttttattagattctcaaaggttcagaatggggaatgtgttaaacaaaccgaaaacctgtttcagctttaaaatcctccaaaactttaaagacttttcttttttctgagaaaggctggtaaatcactgagtcatcattcagaacatacagcctcgaagggcagagctcacacccatatatgacgttaagagctcaacaaatgtttgttgagtgactgagtgaccccaggggcagactccagatcatcagacactgatacagagagcgatgctatctcctcaactctccctcttctcctaaaagctgagtctatatagggatgacaggctcaggctgagcagtcgacttctctgggttttgctgtgtaagaataggtccctcaacatgaagatgtgtctgcgtctgagccagatgctgcctgggtcggttgcctggcctccgtctggtctccctccctcctactagggtggtcaagctgtgagatctcttccagcctccaaatccagctttcccattttactgatgagaaaatcaaggccacattgcagctgggtggggagtggagcgtgacaggcacgggagaggacagcgattgttgactctagttcctgatgtttaatcagaaaaaccacttttcctgtagagcacatttcctaaaaggctgctgctgtgtagggaggtgtggccttttcctggtgcagtgtgaaggagggaagtgacgggcagtcgtgaactgtctgggacagatagcacaagtcagagtttgagcaaaactagggtgttaccggcgctatgttgaaattgtctggaggcgggctttcccagcgagtctccattcagcatctggaaaaagtgtaaccagaatggaggtgtctgactctcctgtgctctctcagcgccgagctctagctgcaggctgcctgggtggccttctcacaccctcccgtgcaggagactgcatttctctttcccacagcccagcagatagctcattggcttagcaatgggcacttaacagaatccagttgttgcagccagaattaaatgcaccagtctggcttaaaccaactggaactcatccctggggtgaaggtggctgggaattagacaagagtgtgtgttagccaaaaggcacatgcatgctgtcagcaggagaatgaggagcactggttctgggcaggcagtggcaggggctccctcaggcccctgattcccagcccacagctctttctactctgcagacagagttccttggagactggccctgcattcaggcagggagcagaggggtccctgcctgcagcacccagagctgaacctgaagctacaaagatgggctgatgaggtggcccatgaggtgtcagcaacatcccaaccccctgggtctccccagtgagtcagggcactgatttgctatagctggagctacatgcacctctcctcccctcagccaccttttaggggagaaaggagggcagatttgtaacctctggttctctgcagggatcctgggctggaagaaagttcataaatggatgaatgccttttaaaactccagcttttccaagcatcattcaccaaagcatttggttaggcttagagagaaaagctggatatgagaaaatagaatgtaaaataggaggggctggttgagaggctttgatggaatcccattctctgctgtggccagaaggtggtgctagaggccagtcccacttggatgtgaccctggcctctgccaggattcaaaccacaaagaacatttggaactgggatgtttgctttgaagcagcccgaaaacaagtgaaaggaaaccaagataactctctctccctccgctggcaaggatcaaaaataccttgtgcagggaagcccgagcctcgaggggccactgcccagctaaagatgactggacaccagccatgcaccatcaggaaccagcacctgtcctcacccctgagaagagccccgggggtatcattatatccatcgcagacatctggtttgcagcaaatgtggctacacgccatcaggattatcctgccctgtggactggggctagctagttttgagatagagtcaacctccccatttttgtttgtcatgaaaacaccagctcctgcacccctggggtgctacctgacacctgtgcaaagaaaaggaggaaaacttagaagaaaaggcagagacaggcaagacagcatctcacagcttgtcaggatcagggcattaccgactattttttcttaccaaaagagcactgaatttcctaggggaaggtgagccacctttacacctcctgtcctccctcccagcccgtcaagcgatcccatcacccagcctcatcactcagcttcttcctagtacaaaactgccatcggttgtacgtcctgagctgtgggacgtcagctttaaccctagcctgtctcagggcctcgccctccagccccccgccccttagggtgatcgtgggtttcttcccttcctcctgcacaatcgcttcccttcactgaattcccttcaaagccaaagtttcttgagcactttttcttgtgtgcagtcttgtgtgtttgggtgttggtgtttttaaatttgctttctattcccccctgcctctctccatgtcgttacgcagctgagcactggttgggatgcattcgaatgacttcagcaagatcctgctttcctcagcccccgctctgttttatttattgtttaatatttccaatgatccaaatcaaagtgaataaacaaagagctattttattgtt

SEQ ID NO: 314733 - DNA, 4369 bp, Homo sapiens
  misc_feature (4244)..(4244): n is a, c, g, or t
cctttgtatttgggaaagaaaagcatgcattggctgaaatgaaacaaaagcccttacttgggaaaagggacccccaccagcggccctgcttgctccgtagctgggaacatcttttctggtttcctgagccagcacctgaattgcaacgaagctctgaggatactcaacaccacccagcagtgcgtcagaatggaacgtacattctcattctcagactgttcaatatggtgcccgtaacctccaaagccacacaggaggctgccagcagcattttccccaagggcctgagctcagggtcaagtccctgctggccatcttggggctgtcactgggggtctgggtcaaggacatcccaggaatggtaactgccacatacctcatcttcttactccccagctactctcttttcctcattagccttcctgattatttattgatttcttttttttattcaactgacattgtttgcaccctggctctgttggtggtcctggtgttttaatgaagcttgcctcacccagtagctgggaaattaggtgggggtgcttaagggaggtttgtaggagtcctcggacgtgggatattgggggtatctagggcttggatggtttgtggaatgtcctcagcatcctcccgtcccaacccaaccttccttcttcctcattgtggacttggatttattctcaggctaggagtctccaaaactccgtgaaaccttattgctgctgggtgtggagtggagagtgacaggaatgtgggggacggtgattgttggctccagttactaatgtttaagcagaaaaaccactttcttgttgaaaatatccctgaaaaggtcgctgctgctttgaggaggcgtgactttttcctggtggagtgtgacggaggcatggggcctgtgctcccaggctcgggggagccccctctgcacacggggagggaggaacttggggacatcagtcatgggtcacaggtggcttcaggccattcacaagagtccccggaagttgcgtgccaagtttggttttttccctgaatctctgcatatgagcatttttctggagaaaggaccatagcttttattagattctcaaaggttcagaatggggaatgtgttaaacaaaccgaaaacctgtttcagctttaaaatcctccaaaactttaaagacttttcttttttctgagaaaggctggtaaatcactgagtcatcattcagaacatacagcctcgaagggcagagctcacacccatatatgacgttaagagctcaacaaatgtttgttgagtgactgagtgaccccaggggcagactccagatcatcagacactgatacagagagcgatgctatctcctcaactctccctcttctcctaaaagctgagtctatatagggatgacaggctcaggctgagcagtcgacttctctgggttttgctgtgtaagaataggtccctcaacatgaagatgtgtctgcgtctgagccagatgctgcctgggtcggttgcctggcctccgtctggtctccctccctcctactagggtggtcaagctgtgagatctcttccagcctccaaatccagctttcccattttactgatgagaaaatcaaggccacattgcagctgggtggggagtggagcgtgacaggcacgggagaggacagcgattgttgactctagttcctgatgtttaatcagaaaaaccacttttcctgtagagcacatttcctaaaaggctgctgctgtgtagggaggtgtggccttttcctggtgcagtgtgaaggagggaagtgacgggcagtcgtgaactgtctgggacagatagcacaagtcagagtttgagcaaaactagggtgttaccggcgctatgttgaaattgtctggaggcgggctttcccagcgagtctccattcagcatctggaaaaagtgtaaccagaatggaggtgtctgactctcctgtgctctctcagcgccgagctctagctgcaggctgcctgggtggccttctcacaccctcccgtgcaggagactgcatttctctttcccacagcccagcagatagctcattggcttagcaatgggcacttaacagaatccagttgttgcagccagaattaaatgcaccagtctggcttaaaccaactggaactcatccctggggtgaaggtggctgggaattagacaagagtgtgtgttagccaaaaggcacatgcatgctgtcagcaggagaatgaggagcactggttctgggcaggcagtggcaggggctccctcaggcccctgattcccagcccacagctctttctactctgcagacagagttccttggagactggccctgcattcaggcagggagcagaggggtccctgcctgcagcacccagagctgaacctgaagctacaaagatgggctgatgaggtggcccatgaggtgtcagcaacatcccaaccccctgggtctccccagtgagtcagggcactgatttgctatagctggagctacatgcacctctcctcccctcagccaccttttaggggagaaaggagggcagatttgtaacctctggttctctgcagggatcctgggctggaagaaagttcataaatggatgaatgccttttaaaactccagcttttccaagcatcattcaccaaagcatttggttaggcttagagagaaaagctggatatgagaaaatagaatgtaaaataggagggaaaaaaaaaagaaggtggagagggcagttaagatctgggtgattctttagggaaacggctggttgagaggctttgatggaatcccattctctgctgtggccagaaggtggtgctagaggccagtcccacttggatgtgaccctggcctctgccaggattcaaaccacaaagaacatttggaactgggatgtttgctttgaagcagcccgaaaacaagtgaaaggaaaccaagataactctctctccctccgctggcaaggatcaaaaataccttgtgcagggaagcccgagcctcgaggggccactgcccagctaaagatgactggacaccagccatgcaccatcaggaaccagcacctgtcctcacccctgagaagagccccgggggtatcattatatccatcgcagacatctggtttgcagcaaatgtggctacacgccatcaggattatcctgccctgtggactggggctagctagttttgagatagagtcaacctccccatttttgtttgtcatgaaaacaccagctcctgcacccctggggtgctacctgacacctgtgcaaagaaaaggaggaaaacttagaagaaaaggcagagacaggcaagacagcatctcacagcttgtcaggatcagggcattaccgactattttttcttaccaaaagagcactgaatttcctaggggaaggtgagccacctttacacctcctgtcctccctcccagcccgtcaagcgatcccatcacccagcctcatcactcagcttcttcctagtacaaaactgccatcggttgtacgtcctgagctgtgggacgtcagctttaaccctagcctgtctcagggcctcgccctccagccccccgccccttagggtgatcgtgggtttcttcccttcctcctgcacaatcgcttcccttcactgaattcccttcaaagccaaagtttcttgagcactttttcttgtgtgcagtcttgtgtgtttgggtgttggtgtttttaaatttgctttctattcccccctgcctctctccatgtcgttacgcagctgagcactggttgggatgcattcgaatgacttcagcaagatcctgctttcctcagcccccgctctgttttatttattgtttaatatttccaatgatccaaatcaaagtgaataaacaaagagctattttattgtttttgggtgtgtttgttgcttttctacaagggtcatgcatttgcgcctccttcaacactccaactcagagggcctcctgggttggcgtcgccactaccgaatggccagaattcaggatacagaggagagccccagcgtaggccttggagaggcctcttctcaagcccaggagtcccattacctgccgtgtgactggcgagtcacctaagttctctgaacctcagctgcgtgtctcatgtattaaatgggcgcgacaacactggccttcagaggggatgtgggagtaaaaacaaaagcatctccagaggcccagtagacatgcaccacctgcttgaacgttngctgagtgaattcaccttggccagggcctgattgggctgggctagtgtctgtcctcccccgacagagacgggcacacccagggatggacaagagtttggtccaaagttggcactaatctcccttt

SEQ ID NO: 314734 - DNA, 3975 bp, Homo sapiens
cctttgtatttgggaaagaaaagcatgcattggctgaaatgaaacaaaagcccttacttgggaaaagggacccccaccagcggccctgcttgctccgtagctgggaacatcttttctggtttcctgagccagcacctgaattgcaacgaagctctgaggatactcaacaccacccagcagtgcgtcagaatggaacgtacattctcattctcagactgttcaatatggtgcccgtaacctccaaagccacacaggaggctgccagcagcattttccccaagggcctgagctcagggtcaagtccctgctggccatcttggggctgtcactgggggtctgggtcaaggacatcccaggaatggtaactgccacatacctcatcttcttactccccagctactctcttttcctcattagccttcctgattatttattgatttcttttttttattcaactgacattgtttgcaccctggctctgttggtggtcctggtgttttaatgaagcttgcctcacccagtagctgggaaattaggtgggggtgcttaagggaggtttgtaggagtcctcggacgtgggatattgggggtatctagggcttggatggtttgtggaatgtcctcagcatcctcccgtcccaacccaaccttccttcttcctcattgtggacttggatttattctcaggctaggagtctccaaaactccgtgaaaccttattgctgctgggtgtggagtggagagtgacaggaatgtgggggacggtgattgttggctccagttactaatgtttaagcagaaaaaccactttcttgttgaaaatatccctgaaaaggtcgctgctgctttgaggaggcgtgactttttcctggtggagtgtgacggaggcatggggcctgtgctcccaggctcgggggagccccctctgcacacggggagggaggaacttggggacatcagtcatgggtcacaggtggcttcaggccattcacaagagtccccggaagttgcgtgccaagtttggttttttccctgaatctctgcatatgagcatttttctggagaaaggaccatagcttttattagattctcaaaggttcagaatggggaatgtgttaaacaaaccgaaaacctgtttcagctttaaaatcctccaaaactttaaagacttttcttttttctgagaaaggctggtaaatcactgagtcatcattcagaacatacagcctcgaagggcagagctcacacccatatatgacgttaagagctcaacaaatgtttgttgagtgactgagtgaccccaggggcagactccagatcatcagacactgatacagagagcgatgctatctcctcaactctccctcttctcctaaaagctgagtctatatagggatgacaggctcaggctgagcagtcgacttctctgggttttgctgtgtaagaataggtccctcaacatgaagatgtgtctgcgtctgagccagatgctgcctgggtcggttgcctggcctccgtctggtctccctccctcctactagggtggtcaagctgtgagatctcttccagcctccaaatccagctttcccattttactgatgagaaaatcaaggccacattgcagctgggtggggagtggagcgtgacaggcacgggagaggacagcgattgttgactctagttcctgatgtttaatcagaaaaaccacttttcctgtagagcacatttcctaaaaggctgctgctgtgtagggaggtgtggccttttcctggtgcagtgtgaaggagggaagtgacgggcagtcgtgaactgtctgggacagatagcacaagtcagagtttgagcaaaactagggtgttaccggcgctatgttgaaattgtctggaggcgggctttcccagcgagtctccattcagcatctggaaaaagtgtaaccagaatggaggtgtctgactctcctgtgctctctcagcgccgagctctagctgcaggctgcctgggtggccttctcacaccctcccgtgcaggagactgcatttctctttcccacagcccagcagatagctcattggcttagcaatgggcacttaacagaatccagttgttgcagccagaattaaatgcaccagtctggcttaaaccaactggaactcatccctggggtgaaggtggctgggaattagacaagagtgtgtgttagccaaaaggcacatgcatgctgtcagcaggagaatgaggagcactggttctgggcaggcagtggcaggggctccctcaggcccctgattcccagcccacagctctttctactctgcagacagagttccttggagactggccctgcattcaggcagggagcagaggggtccctgcctgcagcacccagagctgaacctgaagctacaaagatgggctgatgaggtggcccatgaggtgtcagcaacatcccaaccccctgggtctccccagtgagtcagggcactgatttgctatagctggagctacatgcacctctcctcccctcagccaccttttaggggagaaaggagggcagatttgtaacctctggttctctgcagggatcctgggctggaagaaagttcataaatggatgaatgccttttaaaactccagcttttccaagcatcattcaccaaagcatttggttaggcttagagagaaaagctggatatgagaaaatagaatgtaaaataggagggaaaaaaaaaagaaggtggagagggcagttaagatctgggtgattctttagggaaacggctggttgagaggctttgatggaatcccattctctgctgtggccagaaggtggtgctagaggccagtcccacttggatgtgaccctggcctctgccaggattcaaaccacaaagaacatttggaactgggatgtttgctttgaagcagcccgaaaacaagtgaaaggaaaccaagataactctctctccctccgctggcaaggatcaaaaataccttgtgcagggaagcccgagcctcgaggggccactgcccagctaaagatgactggacaccagccatgcaccatcaggaaccagcacctgtcctcacccctgagaagagccccgggggtatcattatatccatcgcagacatctggtttgcagcaaatgtggctacacgccatcaggattatcctgccctgtggactggggctagctagttttgagatagagtcaacctccccatttttgtttgtcatgaaaacaccagctcctgcacccctggggtgctacctgacacctgtgcaaagaaaaggaggaaaacttagaagaaaaggcagagacaggcaagacagcatctcacagcttgtcaggatcagggcattaccgactattttttcttaccaaaagagcactgaatttcctaggggaaggtgagccacctttacacctcctgtcctccctcccagcccgtcaagcgatcccatcacccagcctcatcactcagcttcttcctagtacaaaactgccatcggttgtacgtcctgagctgtgggacgtcagctttaaccctagcctgtctcagggcctcgccctccagccccccgccccttagggtgatcgtgggtttcttcccttcctcctgcacaatcgcttcccttcactgaattcccttcaaagccaaagtttcttgagcactttttcttgtgtgcagtcttgtgtgtttgggtgttggtgtttttaaatttgctttctattcccccctgcctctctccatgtcgttacgcagctgagcactggttgggatgcattcgaatgacttcagcaagatcctgctttcctcagcccccgctctgttttatttattgtttaatatttccaatgatccaaatcaaagtgaataaacaaagagctattttattgttaaaaccatctggaagtgggacagcttcaggaatgttataacggaattgaggagggcagagaggatgaaccc

SEQ ID NO: 314735 - DNA, 1070 bp, Homo sapiens
atgtgacttgtatatcctatgtctaaattaggaatatgcatctgattcttctacaagaagtttgcgatcacagctgactgtgttcctgatgcatccaccaaacccagttccatctgtgggcctccctggctctgtcaccacccattgcaccctcccaatcacaggagtcacaaacctcagacatgcagctcctgctccacacttaatatatgcacgcattggatcatcccagccctggtctttctgcctccatggatacactgcatgaccctgagagtaaacctccttagatttagcatcctaggttcctcacacgcctcaccctcttccccagcccctgcgactggggaagtggggctagctagttttgagatagagtcaacctccccatttttgtttgtcatgaaaacaccagctcctgcacccctggggtgctacctgacacctgtgcaaagaaaaggaggaaaacttagaagaaaaggcagagacaggcaagacagcatctcacagcttgtcaggatcagggcattaccgactattttttcttaccaaaagagcactgaatttcctaggggaaggtgagccacctttacacctcctgtcctccctcccagcccgtcaagcgatcccatcacccagcctcatcactcagcttcttcctagtacaaaactgccatcggttgtacgtcctgagctgtgggacgtcagctttaaccctagcctgtctcagggcctcgccctccagccccccgccccttagggtgatcgtgggtttcttcccttcctcctgcacaatcgcttcccttcactgaattcccttcaaagccaaagtttcttgagcactttttcttgtgtgcagtcttgtgtgtttgggtgttggtgtttttaaatttgctttctattcccccctgcctctctccatgtcgttacgcagctgagcactggttgggatgcattcgaatgacttcagcaagatcctgctttcctcagcccccgctctgttttatttattgtttaatatttccaatgatccaaatcaaagtgaataaacaaagagctattttattgtt

SEQ ID NO: 314736 - DNA, 3241 bp, Homo sapiens
cctttgtatttgggaaagaaaagcatgcattggctgaaatgaaacaaaagcccttacttgggaaaagggacccccaccagcggccctgcttgctccgtagctgggaacatcttttctggtttcctgagccagcacctgaattgcaacgaagctctgaggatactcaacaccacccagcagtgcgtcagaatggaacgtacattctcattctcagactgttcaatatggtgcccgtaacctccaaagccacacaggaggctgccagcagcattttccccaagggcctgagctcagggtcaagtccctgctggccatcttggggctgtcactgggggtctgggtcaaggacatcccaggaatggtaactgccacatacctcatcttcttactccccagctactctcttttcctcattagccttcctgattatttattgatttcttttttttattcaactgacattgtttgcaccctggctctgttggtggtcctggtgttttaatgaagcttgcctcacccagtagctgggaaattaggtgggggtgcttaagggaggtttgtaggagtcctcggacgtgggatattgggggtatctagggcttggatggtttgtggaatgtcctcagcatcctcccgtcccaacccaaccttccttcttcctcattgtggacttggatttattctcaggctaggagtctccaaaactccgtgaaaccttattgctgctgggtgtggagtggagagtgacaggaatgtgggggacggtgattgttggctccagttactaatgtttaagcagaaaaaccactttcttgttgaaaatatccctgaaaaggtcgctgctgctttgaggaggcgtgactttttcctggtggagtgtgacggaggcatggggcctgtgctcccaggctcgggggagccccctctgcacacggggagggaggaacttggggacatcagtcatgggtcacaggtggcttcaggccattcacaagagtccccggaagttgcgtgccaagtttggttttttccctgaatctctgcatatgagcatttttctggagaaaggaccatagcttttattagattctcaaaggttcagaatggggaatgtgttaaacaaaccgaaaacctgtttcagctttaaaatcctccaaaactttaaagacttttcttttttctgagaaaggctggtaaatcactgagtcatcattcagaacatacagcctcgaagggcagagctcacacccatatatgacgttaagagctcaacaaatgtttgttgagtgactgagtgaccccaggggcagactccagatcatcagacactgatacagagagcgatgctatctcctcaactctccctcttctcctaaaagctgagtctatatagggatgacaggctcaggctgagcagtcgacttctctgggttttgctgtgtaagaataggtccctcaacatgaagatgtgtctgcgtctgagccagatgctgcctgggtcggttgcctggcctccgtctggtctccctccctcctactagggtggtcaagctgtgagatctcttccagcctccaaatccagctttcccattttactgatgagaaaatcaaggccacattgcagctgggtggggagtggagcgtgacaggcacgggagaggacagcgattgttgactctagttcctgatgtttaatcagaaaaaccacttttcctgtagagcacatttcctaaaaggctgctgctgtgtagggaggtgtggccttttcctggtgcagtgtgaaggagggaagtgacgggcagtcgtgaactgtctgggacagatagcacaagtcagagtttgagcaaaactagggtgttaccggcgctatgttgaaattgtctggaggcgggctttcccagcgagtctccattcagcatctggaaaaagtgtaaccagaatggaggtgtctgactctcctgtgctctctcagcgccgagctctagctgcaggctgcctgggtggccttctcacaccctcccgtgcaggagactgcatttctctttcccacagcccagcagatagctcattggcttagcaatgggcacttaacagaatccagttgttgcagccagaattaaatgcaccagtctggcttaaaccaactggaactcatccctggggtgaaggtggctgggaattagacaagagtgtgtgttagccaaaaggcacatgcatgctgtcagcaggagaatgaggagcactggttctgggcaggcagtggcaggggctccctcaggcccctgattcccagcccacagctctttctactctgcagacagagttccttggagactggccctgcattcaggcagggagcagaggggtccctgcctgcagcacccagagctgaacctgaagctacaaagatgggctgatgaggtggcccatgaggtgtcagcaacatcccaaccccctgggtctccccagtgagtcagggcactgatttgctatagctggagctacatgcacctctcctcccctcagccaccttttaggggagaaaggagggcagatttgtaacctctggttctctgcagggatcctgggctggaagaaagttcataaatggatgaatgccttttaaaactccagcttttccaagcatcattcaccaaagcatttggttaggcttagagagaaaagctggatatgagaaaatagaatgtaaaataggagggaaaaaaaaaagaaggtggagagggcagttaagatctgggtgattctttagggaaacggctggttgagaggctttgatggaatcccattctctgctgtggccagaaggtggtgctagaggccagtcccacttggatgtgaccctggcctctgccaggattcaaaccacaaagaacatttggaactgggatgtttgctttgaagcagcccgaaaacaagtgaaaggaaaccaagataactctctctccctccgctggcaaggatcaaaaataccttgtgcagggaagcccgagcctctctccatgtcgttacgcagctgagcactggttgggatgcattcgaatgacttcagcaagatcctgctttcctcagcccccgctctgttttatttattgtttaatatttccaatgatccaaatcaaagtgaataaacaaagagctattttattgttaaaaccatctggaagtgggacagcttcaggaatgttataacggaattgaggagggcagagaggatgaaccc

SEQ ID NO: 314737 - DNA, 2969 bp, Homo sapiens
cctttgtatttgggaaagaaaagcatgcattggctgaaatgaaacaaaagcccttacttgggaaaagggacccccaccagcggccctgcttgctccgtagctgggaacatcttttctggtttcctgagccagcacctgaattgcaacgaagctctgaggatactcaacaccacccagcagtgcgtcagaatggaacgtacattctcattctcagactgttcaatatggtgcccgtaacctccaaagccacacaggaggctgccagcagcattttccccaagggcctgagctcagggtcaagtccctgctggccatcttggggctgtcactgggggtctgggtcaaggacatcccaggaatggtaactgccacatacctcatcttcttactccccagctactctcttttcctcattagccttcctgattatttattgatttcttttttttattcaactgacattgtttgcaccctggctctgttggtggtcctggtgttttaatgaagcttgcctcacccagtagctgggaaattaggtgggggtgcttaagggaggtttgtaggagtcctcggacgtgggatattgggggtatctagggcttggatggtttgtggaatgtcctcagcatcctcccgtcccaacccaaccttccttcttcctcattgtggacttggatttattctcaggctaggagtctccaaaactccgtgaaaccttattgctgctgggtgtggagtggagagtgacaggaatgtgggggacggtgattgttggctccagttactaatgtttaagcagaaaaaccactttcttgttgaaaatatccctgaaaaggtcgctgctgctttgaggaggcgtgactttttcctggtggagtgtgacggaggcatggggcctgtgctcccaggctcgggggagccccctctgcacacggggagggaggaacttggggacatcagtcatgggtcacaggtggcttcaggccattcacaagagtccccggaagttgcgtgccaagtttggttttttccctgaatctctgcatatgagcatttttctggagaaaggaccatagcttttattagattctcaaaggttcagaatggggaatgtgttaaacaaaccgaaaacctgtttcagctttaaaatcctccaaaactttaaagacttttcttttttctgagaaaggctggtaaatcactgagtcatcattcagaacatacagcctcgaagggcagagctcacacccatatatgacgttaagagctcaacaaatgtttgttgagtgactgagtgaccccaggggcagactccagatcatcagacactgatacagagagcgatgctatctcctcaactctccctcttctcctaaaagctgagtctatatagggatgacaggctcaggctgagcagtcgacttctctgggttttgctgtgtaagaataggtccctcaacatgaagatgtgtctgcgtctgagccagatgctgcctgggtcggttgcctggcctccgtctggtctccctccctcctactagggtggtcaagctgtgagatctcttccagcctccaaatccagctttcccattttactgatgagaaaatcaaggccacattgcagctgggtggggagtggagcgtgacaggcacgggagaggacagcgattgttgactctagttcctgatgtttaatcagaaaaaccacttttcctgtagagcacatttcctaaaaggctgctgctgtgtagggaggtgtggccttttcctggtgcagtgtgaaggagggaagtgacgggcagtcgtgaactgtctgggacagatagcacaagtcagagtttgagcaaaactagggtgttaccggcgctatgttgaaattgtctggaggcgggctttcccagcgagtctccattcagcatctggaaaaagtgtaaccagaatggaggtgtctgactctcctgtgctctctcagcgccgagctctagctgcaggctgcctgggtggccttctcacaccctcccgtgcaggagactgcatttctctttcccacagcccagcagatagctcattggcttagcaatgggcacttaacagaatccagttgttgcagccagaattaaatgcaccagtctggcttaaaccaactggaactcatccctggggtgaaggtggctgggaattagacaagagtgtgtgttagccaaaaggcacatgcatgctgtcagcaggagaatgaggagcactggttctgggcaggcagtggcaggggctccctcaggcccctgattcccagcccacagctctttctactctgcagacagagttccttggagactggccctgcattcaggcagggagcagaggggtccctgcctgcagcacccagagctgaacctgaagctacaaagatgggctgatgaggtggcccatgaggtgtcagcaacatcccaaccccctgggtctccccagtgagtcagggcactgatttgctatagctggagctacatgcacctctcctcccctcagccaccttttaggggagaaaggagggcagatttgtaacctctggttctctgcagggatcctgggctggaagaaagttcataaatggatgaatgccttttaaaactccagcttttccaagcatcattcaccaaagcatttggttaggcttagagagaaaagctggatatgagaaaatagaatgtaaaataggaggggaaaaaaaaaggacgaacctgtgaagaaacagccccagaaacctagaggtggacagagggtctctgacaacattaagaaagaaactccgttccttgaggttataactcatgagttacaagactttgctgtagatgatccacatgatcggacccacgaaaacctatttgattctcttgacaggcccgccacatcctgaacgatgtactactgttagccattcccatacgtgccccgtacaccaccatgat

SEQ ID NO: 314738 - DNA, 3904 bp, Homo sapiens
cctttgtatttgggaaagaaaagcatgcattggctgaaatgaaacaaaagcccttacttgggaaaagggacccccaccagcggccctgcttgctccgtagctgggaacatcttttctggtttcctgagccagcacctgaattgcaacgaagctctgaggatactcaacaccacccagcagtgcgtcagaatggaacgtacattctcattctcagactgttcaatatggtgcccgtaacctccaaagccacacaggaggctgccagcagcattttccccaagggcctgagctcagggtcaagtccctgctggccatcttggggctgtcactgggggtctgggtcaaggacatcccaggaatggtaactgccacatacctcatcttcttactccccagctactctcttttcctcattagccttcctgattatttattgatttcttttttttattcaactgacattgtttgcaccctggctctgttggtggtcctggtgttttaatgaagcttgcctcacccagtagctgggaaattaggtgggggtgcttaagggaggtttgtaggagtcctcggacgtgggatattgggggtatctagggcttggatggtttgtggaatgtcctcagcatcctcccgtcccaacccaaccttccttcttcctcattgtggacttggatttattctcaggctaggagtctccaaaactccgtgaaaccttattgctgctgggtgtggagtggagagtgacaggaatgtgggggacggtgattgttggctccagttactaatgtttaagcagaaaaaccactttcttgttgaaaatatccctgaaaaggtcgctgctgctttgaggaggcgtgactttttcctggtggagtgtgacggaggcatggggcctgtgctcccaggctcgggggagccccctctgcacacggggagggaggaacttggggacatcagtcatgggtcacaggtggcttcaggccattcacaagagtccccggaagttgcgtgccaagtttggttttttccctgaatctctgcatatgagcatttttctggagaaaggaccatagcttttattagattctcaaaggttcagaatggggaatgtgttaaacaaaccgaaaacctgtttcagctttaaaatcctccaaaactttaaagacttttcttttttctgagaaaggctggtaaatcactgagtcatcattcagaacatacagcctcgaagggcagagctcacacccatatatgacgttaagagctcaacaaatgtttgttgagtgactgagtgaccccaggggcagactccagatcatcagacactgatacagagagcgatgctatctcctcaactctccctcttctcctaaaagctgagtctatatagggatgacaggctcaggctgagcagtcgacttctctgggttttgctgtgtaagaataggtccctcaacatgaagatgtgtctgcgtctgagccagatgctgcctgggtcggttgcctggcctccgtctggtctccctccctcctactagggtggtcaagctgtgagatctcttccagcctccaaatccagctttcccattttactgatgagaaaatcaaggccacattgcagctgggtggggagtggagcgtgacaggcacgggagaggacagcgattgttgactctagttcctgatgtttaatcagaaaaaccacttttcctgtagagcacatttcctaaaaggctgctgctgtgtagggaggtgtggccttttcctggtgcagtgtgaaggagggaagtgacgggcagtcgtgaactgtctgggacagatagcacaagtcagagtttgagcaaaactagggtgttaccggcgctatgttgaaattgtctggaggcgggctttcccagcgagtctccattcagcatctggaaaaagtgtaaccagaatggaggtgtctgactctcctgtgctctctcagcgccgagctctagctgcaggctgcctgggtggccttctcacaccctcccgtgcaggagactgcatttctctttcccacagcccagcagatagctcattggcttagcaatgggcacttaacagaatccagttgttgcagccagaattaaatgcaccagtctggcttaaaccaactggaactcatccctggggtgaaggtggctgggaattagacaagagtgtgtgttagccaaaaggcacatgcatgctgtcagcaggagaatgaggagcactggttctgggcaggcagtggcaggggctccctcaggcccctgattcccagcccacagctctttctactctgcagacagagttccttggagactggccctgcattcaggcagggagcagaggggtccctgcctgcagcacccagagctgaacctgaagctacaaagatgggctgatgaggtggcccatgaggtgtcagcaacatcccaaccccctgggtctccccagtgagtcagggcactgatttgctatagctggagctacatgcacctctcctcccctcagccaccttttaggggagaaaggagggcagatttgtaacctctggttctctgcagggatcctgggctggaagaaagttcataaatggatgaatgccttttaaaactccagcttttccaagcatcattcaccaaagcatttggttaggcttagagagaaaagctggatatgagaaaatagaatgtaaaataggagggaaaaaaaaaagaaggtggagagggcagttaagatctgggtgattctttagggaaacggctggttgagaggctttgatggaatcccattctctgctgtggccagaaggtggtgctagaggccagtcccacttggatgtgaccctggcctctgccaggattcaaaccacaaagaacatttggaactgggatgtttgctttgaagcagcccgaaaacaagtgaaaggaaaccaagataactctctctccctccgctggcaaggatcaaaaataccttgtgcagggaagcccgagcctcgaggggccactgcccagctaaagatgactggacaccagccatgcaccatcaggaaccagcacctgtcctcacccctgagaagagccccgggggtatcattatatccatcgcagacatctggtttgcagcaaatgtggctacacgccatcaggattatcctgccctgtggactggggctagctagttttgagatagagtcaacctccccatttttgtttgtcatgaaaacaccagctcctgcacccctggggtgctacctgacacctgtgcaaagaaaaggaggaaaacttagaagaaaaggcagagacaggcaagacagcatctcacagcttgtcaggatcagggcattaccgactattttttcttaccaaaagagcactgaatttcctaggggaaggtgagccacctttacacctcctgtcctccctcccagcccgtcaagcgatcccatcacccagcctcatcactcagcttcttcctagtacaaaactgccatcggttgtacgtcctgagctgtgggacgtcagctttaaccctagcctgtctcagggcctcgccctccagccccccgccccttagggtgatcgtgggtttcttcccttcctcctgcacaatcgcttcccttcactgaattcccttcaaagccaaagtttcttgagcactttttcttgtgtgcagtcttgtgtgtttgggtgttggtgtttttaaatttgctttctattcccccctgcctctctccatgtcgttacgcagctgagcactggttgggatgcattcgaatgacttcagcaagatcctgctttcctcagcccccgctctgttttatttattgtttaatatttccaatgatccaaatcaaagtgaataaacaaagagctattttattgtt

SEQ ID NO: 314739 - DNA, 1776 bp, Homo sapiens
catgatcgatcgagctcggtaccgaacgggtgatgcggttgtatctggggacgtggtggaggatgcatgttctgttctctccaggaagagctagtggttttctacccgtgtgtgttggtgagcaatgtgcagtggcaggggctccctcaggcccctgattcccagcccacagctctttctactctgcagacagagttccttggagactggccctgcattcaggcagggagcagaggggtccctgcctgcagcacccagagctgaacctgaagctacaaagatgggctgatgaggtggcccatgaggtgtcagcaacatcccaaccccctgggtctccccagtgagtcagggcactgatttgctatagctggagctacatgcacctctcctcccctcagccaccttttaggggagaaaggagggcagatttgtaacctctggttctctgcagggatcctgggctggaagaaagttcataaatggatgaatgccttttaaaactccagcttttccaagcatcattcaccaaagcatttggttaggcttagagagaaaagctggatatgagaaaatagaatgtaaaataggagggaaaaaaaaaagaaggtggagagggcagttaagatctgggtgattctttagggaaacggctggttgagaggctttgatggaatcccattctctgctgtggccagaaggtggtgctagaggccagtcccacttggatgtgaccctggcctctgccaggattcaaaccacaaagaacatttggaactgggatgtttgctttgaagcagcccgaaaacaagtgaaaggaaaccaagataactctctctccctccgctggcaaggatcaaaaataccttgtgcagggaagcccgagcctcgaggggccactgcccagctaaagatgactggacaccagccatgcaccatcaggaaccagcacctgtcctcacccctgagaagagccccgggggtatcattatatccatcgcagacatctggtttgcagcaaatgtggctacacgccatcaggattatcctgccctgtggactggggctagctagttttgagatagagtcaacctccccatttttgtttgtcatgaaaacaccagctcctgcacccctggggtgctacctgacacctgtgcaaagaaaaggaggaaaacttagaagaaaaggcagagacaggcaagacagcatctcacagcttgtcaggatcagggcattaccgactattttttcttaccaaaagagcactgaatttcctaggggaaggtgagccacctttacacctcctgtcctccctcccagcccgtcaagcgatcccatcacccagcctcatcactcagcttcttcctagtacaaaactgccatcggttgtacgtcctgagctgtgggacgtcagctttaaccctagcctgtctcagggcctcgccctccagccccccgccccttagggtgatcgtgggtttcttcccttcctcctgcacaatcgcttcccttcactgaattcccttcaaagccaaagtttcttgagcactttttcttgtgtgcagtcttgtgtgtttgggtgttggtgtttttaaatttgctttctattcccccctgcctctctccatgtcgttacgcagctgagcactggttgggatgcattcgaatgacttcagcaagatcctgctttcctcagcccccgctctgttttatttattgtttaatatttccaatgatccaaatcaaagtgaataaacaaagagctattttattgtt

SEQ ID NO: 314740 - DNA, 4191 bp, Homo sapiens
cctttgtatttgggaaagaaaagcatgcattggctgaaatgaaacaaaagcccttacttgggaaaagggacccccaccagcggccctgcttgctccgtagctgggaacatcttttctggtttcctgagccagcacctgaattgcaacgaagctctgaggatactcaacaccacccagcagtgcgtcagaatggaacgtacattctcattctcagactgttcaatatggtgcccgtaacctccaaagccacacaggaggctgccagcagcattttccccaagggcctgagctcagggtcaagtccctgctggccatcttggggctgtcactgggggtctgggtcaaggacatcccaggaatggtaactgccacatacctcatcttcttactccccagctactctcttttcctcattagccttcctgattatttattgatttcttttttttattcaactgacattgtttgcaccctggctctgttggtggtcctggtgttttaatgaagcttgcctcacccagtagctgggaaattaggtgggggtgcttaagggaggtttgtaggagtcctcggacgtgggatattgggggtatctagggcttggatggtttgtggaatgtcctcagcatcctcccgtcccaacccaaccttccttcttcctcattgtggacttggatttattctcaggctaggagtctccaaaactccgtgaaaccttattgctgctgggtgtggagtggagagtgacaggaatgtgggggacggtgattgttggctccagttactaatgtttaagcagaaaaaccactttcttgttgaaaatatccctgaaaaggtcgctgctgctttgaggaggcgtgactttttcctggtggagtgtgacggaggcatggggcctgtgctcccaggctcgggggagccccctctgcacacggggagggaggaacttggggacatcagtcatgggtcacaggtggcttcaggccattcacaagagtccccggaagttgcgtgccaagtttggttttttccctgaatctctgcatatgagcatttttctggagaaaggaccatagcttttattagattctcaaaggttcagaatggggaatgtgttaaacaaaccgaaaacctgtttcagctttaaaatcctccaaaactttaaagacttttcttttttctgagaaaggctggtaaatcactgagtcatcattcagaacatacagcctcgaagggcagagctcacacccatatatgacgttaagagctcaacaaatgtttgttgagtgactgagtgaccccaggggcagactccagatcatcagacactgatacagagagcgatgctatctcctcaactctccctcttctcctaaaagctgagtctatatagggatgacaggctcaggctgagcagtcgacttctctgggttttgctgtgtaagaataggtccctcaacatgaagatgtgtctgcgtctgagccagatgctgcctgggtcggttgcctggcctccgtctggtctccctccctcctactagggtggtcaagctgtgagatctcttccagcctccaaatccagctttcccattttactgatgagaaaatcaaggccacattgcagctgggtggggagtggagcgtgacaggcacgggagaggacagcgattgttgactctagttcctgatgtttaatcagaaaaaccacttttcctgtagagcacatttcctaaaaggctgctgctgtgtagggaggtgtggccttttcctggtgcagtgtgaaggagggaagtgacgggcagtcgtgaactgtctgggacagatagcacaagtcagagtttgagcaaaactagggtgttaccggcgctatgttgaaattgtctggaggcgggctttcccagcgagtctccattcagcatctggaaaaagtgtaaccagaatggaggtgtctgactctcctgtgctctctcagcgccgagctctagctgcaggctgcctgggtggccttctcacaccctcccgtgcaggagactgcatttctctttcccacagcccagcagatagctcattggcttagcaatgggcacttaacagaatccagttgttgcagccagaattaaatgcaccagtctggcttaaaccaactggaactcatccctggggtgaaggtggctgggaattagacaagagtgtgtgttagccaaaaggcacatgcatgctgtcagcaggagaatgaggagcactggttctgggcaggcagtggcaggggctccctcaggcccctgattcccagcccacagctctttctactctgcagacagagttccttggagactggccctgcattcaggcagggagcagaggggtccctgcctgcagcacccagagctgaacctgaagctacaaagatgggctgatgaggtggcccatgaggtgtcagcaacatcccaaccccctgggtctccccagtgagtcagggcactgatttgctatagctggagctacatgcacctctcctcccctcagccaccttttaggggagaaaggagggcagatttgtaacctctggttctctgcagggatcctgggctggaagaaagttcataaatggatgaatgccttttaaaactccagcttttccaagcatcattcaccaaagcatttggttaggcttagagagaaaagctggatatgagaaaatagaatgtaaaataggagggaaaaaaaaaagaaggtggagagggcagttaagatctgggtgattctttagggaaacggctggttgagaggctttgatggaatcccattctctgctgtggccagaaggtggtgctagaggccagtcccacttggatgtgaccctggcctctgccaggattcaaaccacaaagaacatttggaactgggatgtttgctttgaagcagcccgaaaacaagtgaaaggaaaccaagataactctctctccctccgctggcaaggatcaaaaataccttgtgcagggaagcccgagcctcgaggggccactgcccagctaaagatgactggacaccagccatgcaccatcaggaaccagcacctgtcctcacccctgagaagagccccgggggtatcattatatccatcgcagacatctggtttgcagcaaatgtggctacacgccatcaggattatcctgccctgtggactggggctagctagttttgagatagagtcaacctccccatttttgtttgtcatgaaaacaccagctcctgcacccctggggtgctacctgacacctgtgcaaagaaaaggaggaaaacttagaagaaaaggcagagacaggcaagacagcatctcacagcttgtcaggatcagggcattaccgactattttttcttaccaaaagagcactgaatttcctaggggaaggtgagccacctttacacctcctgtcctccctcccagcccgtcaagcgatcccatcacccagcctcatcactcagcttcttcctagtacaaaactgccatcggttgtacgtcctgagctgtgggacgtcagctttaaccctagcctgtctcagggcctcgccctccagccccccgccccttagggtgatcgtgggtttcttcccttcctcctgcacaatcgcttcccttcactgaattcccttcaaagccaaagtttcttgagcactttttcttgtgtgcagtcttgtgtgtttgggtgttggtgtttttaaatttgctttctattcccccctgcctctctccatgtcgttacgcagctgagcactggttgggatgcattcgaatgacttcagcaagatcctgctttcctcagcccccgctctgttttatttattgtttaatatttccaatgatccaaatcaaagtgaataaacaaagagctattttattgttaaaaaaaaaaaaaaaaactcgagactagttctctctccttttttttttccaatgagtacaaatgattcttgaatatggacgctttccatggaatagtaggaaccttcatttccactcccacagtaatgtgaaattttgttctaatttttaggattaatagaaacaggattgacaaattgaaattttgactccttcttgaagcatctattaatataagggggcgttggaagagtggtcatttcagatgctgtcgctactgtgttcgactcatctctgtagctgctgtt

SEQ ID NO: 314741 - DNA, 3170 bp, Homo sapiens
cctttgtatttgggaaagaaaagcatgcattggctgaaatgaaacaaaagcccttacttgggaaaagggacccccaccagcggccctgcttgctccgtagctgggaacatcttttctggtttcctgagccagcacctgaattgcaacgaagctctgaggatactcaacaccacccagcagtgcgtcagaatggaacgtacattctcattctcagactgttcaatatggtgcccgtaacctccaaagccacacaggaggctgccagcagcattttccccaagggcctgagctcagggtcaagtccctgctggccatcttggggctgtcactgggggtctgggtcaaggacatcccaggaatggtaactgccacatacctcatcttcttactccccagctactctcttttcctcattagccttcctgattatttattgatttcttttttttattcaactgacattgtttgcaccctggctctgttggtggtcctggtgttttaatgaagcttgcctcacccagtagctgggaaattaggtgggggtgcttaagggaggtttgtaggagtcctcggacgtgggatattgggggtatctagggcttggatggtttgtggaatgtcctcagcatcctcccgtcccaacccaaccttccttcttcctcattgtggacttggatttattctcaggctaggagtctccaaaactccgtgaaaccttattgctgctgggtgtggagtggagagtgacaggaatgtgggggacggtgattgttggctccagttactaatgtttaagcagaaaaaccactttcttgttgaaaatatccctgaaaaggtcgctgctgctttgaggaggcgtgactttttcctggtggagtgtgacggaggcatggggcctgtgctcccaggctcgggggagccccctctgcacacggggagggaggaacttggggacatcagtcatgggtcacaggtggcttcaggccattcacaagagtccccggaagttgcgtgccaagtttggttttttccctgaatctctgcatatgagcatttttctggagaaaggaccatagcttttattagattctcaaaggttcagaatggggaatgtgttaaacaaaccgaaaacctgtttcagctttaaaatcctccaaaactttaaagacttttcttttttctgagaaaggctggtaaatcactgagtcatcattcagaacatacagcctcgaagggcagagctcacacccatatatgacgttaagagctcaacaaatgtttgttgagtgactgagtgaccccaggggcagactccagatcatcagacactgatacagagagcgatgctatctcctcaactctccctcttctcctaaaagctgagtctatatagggatgacaggctcaggctgagcagtcgacttctctgggttttgctgtgtaagaataggtccctcaacatgaagatgtgtctgcgtctgagccagatgctgcctgggtcggttgcctggcctccgtctggtctccctccctcctactagggtggtcaagctgtgagatctcttccagcctccaaatccagctttcccattttactgatgagaaaatcaaggccacattgcagctgggtggggagtggagcgtgacaggcacgggagaggacagcgattgttgactctagttcctgatgtttaatcagaaaaaccacttttcctgtagagcacatttcctaaaaggctgctgctgtgtagggaggtgtggccttttcctggtgcagtgtgaaggagggaagtgacgggcagtcgtgaactgtctgggacagatagcacaagtcagagtttgagcaaaactagggtgttaccggcgctatgttgaaattgtctggaggcgggctttcccagcgagtctccattcagcatctggaaaaagtgtaaccagaatggaggtgtctgactctcctgtgctctctcagcgccgagctctagctgcaggctgcctgggtggccttctcacaccctcccgtgcaggagactgcatttctctttcccacagcccagcagatagctcattggcttagcaatgggcacttaacagaatccagttgttgcagccagaattaaatgcaccagtctggcttaaaccaactggaactcatccctggggtgaaggtggctgggaattagacaagagtgtgtgttagccaaaaggcacatgcatgctgtcagcaggagaatgaggagcactggttctgggcaggcagtggcaggggctccctcaggcccctgattcccagcccacagctctttctactctgcagacagagttccttggagactggccctgcattcaggcagggagcagaggggtccctgcctgcagcacccagagctgaacctgaagctacaaagatgggctgatgaggtggcccatgaggtgtcagcaacatcccaaccccctgggtctccccagtgagtcagggcactgatttgctatagctggagctacatgcacctctcctcccctcagccaccttttaggggagaaaggagggcagatttgtaacctctggttctctgcagggatcctgggctggaagaaagttcataaatggatgaatgccttttaaaactccagcttttccaagcatcattcaccaaagcatttggttaggcttagagagaaaagctggatatgagaaaatagaatgtaaaataggagggaaaaaaaaaagaaggtggagagggcagttaagatctgggtgattctttagggaaacggctggttgagaggctttgatggaatcccattctctgctgtggccagaaggtggtgctagaggccagtcccacttggatgtgaccctggcctctgccaggattcaaaccacaaagaacatttggaactgggatgtttgctttgaagcagcccgaaaacaagtgaaaggaaaccaagataactctctctccctccgctggcaaggatcaaaaataccttgtgcagggaagcccgagcctctctccatgtcgttacgcagctgagcactggttgggatgcattcgaatgacttcagcaagatcctgctttcctcagcccccgctctgttttatttattgtttaatatttccaatgatccaaatcaaagtgaataaacaaagagctattttattgtt

SEQ ID NO: 314742 - DNA, 107 bp, Homo sapiens
ggggggccaatttaatcacttcagtccttacaacagggaggcagggaggtcagaatgaaagtgatgtgatggatgcagagttgaagatgctaggctgctggctttgg

SEQ ID NO: 314743 - DNA, 2610 bp, Homo sapiens
gactcctaggggcttgcagacctagtgggagagaaagaacatcgcagcagccaggcagaaccaggacaggtgaggtgcaggctggctttcctctcgcagcgcggtgtggagtcctgtcctgcctcagggcttttcggagcctggatcctcaaggaacaagtagacctggccgcggggagtggggagggaaggggtgtctattgggcaacagggcggcaaagccctgaataaaggggcgcagggcaggcgcaagtgcagagccttcgtttgccaagtcgcctccagaccgcagacatgaaacttgtcttcctcgtcctgctgttcctcggggccctcggactgtgtctggctggccgtaggagaaggagtgttcagtggtgcgccgtatcccaacccgaggccacaaaatgcttccaatggcaaaggaatatgagaaaagtgcgtggccctcctgtcagctgcataaagagagactcccccatccagtgtatccaggccattgcggaaaacagggccgatgctgtgacccttgatggtggtttcatatacgaggcaggcctggccccctacaaactgcgacctgtagcggcggaagtctacgggaccgaaagacagccacgaactcactattatgccgtggctgtggtgaagaagggcggcagctttcagctgaacgaactgcaaggtctgaagtcctgccacacaggccttcgcaggaccgctggatggaatgtccctatagggacacttcgtccattcttgaattggacgggtccacctgagcccattgaggcagctgtggccaggttcttctcagccagctgtgttcccggtgcagataaaggacagttccccaacctgtgtcgcctgtgtgcggggacaggggaaaacaaatgtgccttctcctcccaggaaccgtacttcagctactctggtgccttcaagtgtctgagagacggggctggagacgtggcttttatcagagagagcacagtgtttgaggacctgtcagacgaggctgaaagggacgagtatgagttactctgcccagacaacactcggaagccagtggacaagttcaaagactgccatctggcccgggtcccttctcatgccgttgtggcacgaagtgtgaatggcaaggaggatgccatctggaatcttctccgccaggcacaggaaaagtttggaaaggacaagtcaccgaaattccagctctttggctcccctagtgggcagaaagatctgctgttcaaggactctgccattgggttttcgagggtgcccccgaggatagattctgggctgtaccttggctccggctacttcactgccatccagaacttgaggaaaagtgaggaggaagtggctgcccggcgtgcgcgggtcgtgtggtgtgcggtgggcgagcaggagctgcgcaagtgtaaccagtggagtggcttgagcgaaggcagcgtgacctgctcctcggcctccaccacagaggactgcatcgccctggtgctgaaaggagaagctgatgccatgagtttggatggaggatatgtgtacactgcaggcaaatgtggtttggtgcctgtcctggcagagaactacaaatcccaacaaagcagtgaccctgatcctaactgtgtggatagacctgtggaaggatatcttgctgtggcggtggttaggagatcagacactagccttacctggaactctgtgaaaggcaagaagtcctgccacaccgccgtggacaggactgcaggctggaatatccccatgggcctgctcttcaaccagacgggctcctgcaaatttgatgaatatttcagtcaaagctgtgcccctgggtctgacccgagatctaatctctgtgctctgtgtattggcgacgagcagggtgagaataagtgcgtgcccaacagcaacgagagatactacggctacactggggctttccggtgcctggctgagaatgctggagacgttgcatttgtgaaagatgtcactgtcttgcagaacactgatggaaataacaatgaggcatgggctaaggatttgaagctggcagactttgcgctgctgtgcctcgatggcaaacggaagcctgtgactgaggctagaagctgccatcttgccatggccccgaatcatgccgtggtgtctcggatggataaggtggaacgcctgaaacaggtgttgctccaccaacaggctaaatttgggagaaatggatctgactgcccggacaagttttgcttattccagtctgaaaccaaaaaccttctgttcaatgacaacactgagtgtctggccagactccatggcaaaacaacatatgaaaaatatttgggaccacagtatgtcgcaggcattactaatctgaaaaagtgctcaacctcccccctcctggaagcctgtgaattcctcaggaagtaaaaccgaagaagatggcccagctccccaagaaagcctcagccattcactgcccccagctcttctccccaggtgtgttggggccttggcctcccctgctgaaggtggggattgcccatccatctgcttacaattccctgctgtcgtcttagcaagaagtaaaatgagaaattttgttgatat

SEQ ID NO: 314744 - DNA, 2740 bp, Homo sapiens
gactcctaggggcttgcagacctagtgggagagaaagaacatcgcagcagccaggcagaaccaggacaggtgaggtgcaggctggctttcctctcgcagcgcggtgtggagtcctgtcctgcctcagggcttttcggagcctggatcctcaaggaacaagtagacctggccgcggggagtggggagggaaggggtgtctattgggcaacagggcggcaaagccctgaataaaggggcgcagggcaggcgcaagtgcagagccttcgtttgccaagtcgcctccagaccgcagacatgaaacttgtcttcctcgtcctgctgttcctcggggccctcggactgtgtctggctggccgtaggagaaggagtgttcagtggtgcgccgtatcccaacccgaggccacaaaatgcttccaatggcaaaggaatatgagaaaagtgcgtggccctcctgtcagctgcataaagagagactcccccatccagtgtatccaggccattgcggaaaacagggccgatgctgtgacccttgatggtggtttcatatacgaggcaggcctggccccctacaaactgcgacctgtagcggcggaagtctacgggaccgaaagacagccacgaactcactattatgccgtggctgtggtgaagaagggcggcagctttcagctgaacgaactgcaaggtctgaagtcctgccacacaggccttcgcaggaccgctggatggaatgtccctatagggacacttcgtccattcttgaattggacgggtccacctgagcccattgaggcagctgtggccaggttcttctcagccagctgtgttcccggtgcagataaaggacagttccccaacctgtgtcgcctgtgtgcggggacaggggaaaacaaatgtgccttctcctcccaggaaccgtacttcagctactctggtgccttcaagtgtctgagagacggggctggagacgtggcttttatcagagagagcacagtgtttgaggacctgtcagacgaggctgaaagggacgagtatgagttactctgcccagacaacactcggaagccagtggacaagttcaaagactgccatctggcccgggtcccttctcatgccgttgtggcacgaagtgtgaatggcaaggaggatgccatctggaatcttctccgccaggcacaggaaaagtttggaaaggacaagtcaccgaaattccagctctttggctcccctagtgggcagaaagatctgctgttcaaggactctgccattgggttttcgagggtgcccccgaggatagattctgggctgtaccttggctccggctacttcactgccatccagaacttgaggaaaagtgaggaggaagtggctgcccggcgtgcgcgggtcgtgtggtgtgcggtgggcgagcaggagctgcgcaagtgtaaccagtggagtggcttgagcgaaggcagcgtgacctgctcctcggcctccaccacagaggactgcatcgccctggtgctgaaaggagaagctgatgccatgagtttggatggaggatatgtgtacactgcaggcaaatgtggtttggtgcctgtcctggcagagaactacaaatcccaacaaagcagtgaccctgatcctaactgtgtggatagacctgtggaaggatatcttgctgtggcggtggttaggagatcagacactagccttacctggaactctgtgaaaggcaagaagtcctgccacaccgccgtggacaggactgcaggctggaatatccccatgggcctgctcttcaaccagacgggctcctgcaaatttgatgaatatttcagtcaaagctgtgcccctgggtctgacccgagatctaatctctgtgctctgtgtattggcgacgagcagggtgagaataagtgcgtgcccaacagcaacgagagatactacggctacactggggctttccggtgcctggctgagaatgctggagacgttgcatttgtgaaagatgtcactgtcttgcagaacactgatggaaataacaatgaggcatgggctaaggatttgaagctggcagactttgcgctgctgtgcctcgatggcaaacggaagcctgtgactgaggctagaagctgccatcttgccatggccccgaatcatgccgtggtgtctcggatggataaggtggaacgcctgaaacaggtgttgctccaccaacaggctaaatttgggagaaatggatctgactgcccggacaagttttgcttattccagtctgaaaccaaaaaccttctgttcaatgacaacactgagtgtctggccagactccatggcaaaacaacatatgaaaaatatttgggaccacagtatgtcgcaggcattactaatctgaaaaagtgctcaacctcccccctcctggaagcctgtgaattcctcaggaagtaaaaccgaagaagatggcccagctccccaagaaagcctcagccattcactgcccccagctcttctccccaggtgtgttggggccttggcctcccctgctgaaggtggggattgcccatccatctgcttacaattccctgctgtcgtcttagcaagaagtaaaatgagaaattttgttgatataaaaaaaaaaaaagggggcggctaaaatttcctcgaggccaagtagcgtcccagtttttggcaaagggcctatggggcgataagaagacagcgggtaacaggtggtggaagggtggctggggacaactgg

SEQ ID NO: 314745 - DNA, 657 bp, Homo sapiens
cttcccatgggtgttggtcatccttctcttctctaagacagattgggactggccaggacccgactgttctcttcgcctcaagctccctggcgagtggcctgttgcacagggttagggccacctgggaggggcaggagaggaaggaagccttgccttcctggaagtggtcatgggctgtggtccaggattctggctcagagttgcaccactgggttttatattcacttggatctttagttgttttggcgcctactgaggtctgaagtttgaatcctgcagtcaattgggatggtggcttgtaccccaaagtgccattgcaacccttgtccttcctgaggaaagggtggcagttgccctgtggaattcctgccctgctccccgtgggtgtccaggctgacagaagttgggtgagtggggccagctggatctaagccgtgtgagcattgggtggaggagtctgtctgcttagccctggagccatgggctgggaggcactcatgaggtttcccatcagtctgagcagtctgcttgggccctatcatgagctgtgtgggtaggtggggagagtaactcctgtcctggcccctgccttggaggccagcgcactgcatgtctgcccagaatgtgtgttttggccagtgtccagccaggtccagt

SEQ ID NO: 314746 - DNA, 645 bp, Homo sapiens
gactggccaccataactggcctttatggagctcttaatgtgcacacacagtggtgctggtgagagagctgccgtgactgaggggtttgggtctcagtctccccacatgggagcctgggacagagcaggaacctgtgtgagggaggcagggtgaccgacctgcacactgagctggttagtggctgagcctgggttttcctagcagcctgcctctctagaagagctgcatattagaatgtcctgagcaattgacttgtgagggcagatctcaaaacccctccattgttgccttgtcacccataagaagttgtatgggaaaaggtcacaggttaagaaggaaggaaagatggcagatggtaggaggtaggaccagaagtggtgcgaggcctggatgctgcccaaggcgggcctgccaccaggagtgtggggtgggggactccactaaggaggtggaatgactccagaactcagctccttctgccccatggttttctcagggctgttcttgggtggaagaaatacccctttgcctcctttaacccacaaattcctcttttccttagctactcactgtctgcccttttgtcgcaggctaaatttgggagaaatggatgcaccaacccggaagggatcctctagacagcca

SEQ ID NO: 314747 - DNA, 385 bp, Homo sapiens
  misc_feature (31)..(32): n is a, c, g, or t
ggtcgactactactactaaattcgcggccgnntctgctgctggtaacaaataggtagaggccagggatgctactaaacaaagcacagccagccccctgcaataaagggttattatcaggccccaaatgtcaatagtgccaaggttgagaaacccttttctgtattgacaaacaactcaggtcactgtgatgcaggtcaggaccaccctctgagaaatatggctacagggctcttcttgtgagcagccagctcaggactgcatagaccacatgcttcttgagggcaggccagtctatccatgctgtgtccccagcacttagcacagcaactcacacaaagcaggtgctaggtcgacgcggccgcgaatttagtagtagtaggcggc

SEQ ID NO: 314748 - DNA, 2980 bp, Homo sapiens
gactcctaggggcttgcagacctagtgggagagaaagaacatcgcagcagccaggcagaaccaggacaggtgaggtgcaggctggctttcctctcgcagcgcggtgtggagtcctgtcctgcctcagggcttttcggagcctggatcctcaaggaacaagtagacctggccgcggggagtggggagggaaggggtgtctattgggcaacagggcggcaaagccctgaataaaggggcgcagggcaggcgcaagtgcagagccttcgtttgccaagtcgcctccagaccgcagacatgaaacttgtcttcctcgtcctgctgttcctcggggccctcggactgtgtctggctggccgtaggagaaggagtgttcagtggtgcgccgtatcccaacccgaggccacaaaatgcttccaatggcaaaggaatatgagaaaagtgcgtggccctcctgtcagctgcataaagagagactcccccatccagtgtatccaggccattgcggaaaacagggccgatgctgtgacccttgatggtggtttcatatacgaggcaggcctggccccctacaaactgcgacctgtagcggcggaagtctacgggaccgaaagacagccacgaactcactattatgccgtggctgtggtgaagaagggcggcagctttcagctgaacgaactgcaaggtctgaagtcctgccacacaggccttcgcaggaccgctggatggaatgtccctatagggacacttcgtccattcttgaattggacgggtccacctgagcccattgaggcagctgtggccaggttcttctcagccagctgtgttcccggtgcagataaaggacagttccccaacctgtgtcgcctgtgtgcggggacaggggaaaacaaatgtgccttctcctcccaggaaccgtacttcagctactctggtgccttcaagtgtctgagagacggggctggagacgtggcttttatcagagagagcacagtgtttgaggacctgtcagacgaggctgaaagggacgagtatgagttactctgcccagacaacactcggaagccagtggacaagttcaaagactgccatctggcccgggtcccttctcatgccgttgtggcacgaagtgtgaatggcaaggaggatgccatctggaatcttctccgccaggcacaggaaaagtttggaaaggacaagtcaccgaaattccagctctttggctcccctagtgggcagaaagatctgctgttcaaggactctgccattgggttttcgagggtgcccccgaggatagattctgggctgtaccttggctccggctacttcactgccatccagaacttgaggaaaagtgaggaggaagtggctgcccggcgtgcgcgggtcgtgtggtgtgcggtgggcgagcaggagctgcgcaagtgtaaccagtggagtggcttgagcgaaggcagcgtgacctgctcctcggcctccaccacagaggactgcatcgccctggtgctgaaaggagaagctgatgccatgagtttggatggaggatatgtgtacactgcaggcaaatgtggtttggtgcctgtcctggcagagaactacaaatcccaacaaagcagtgaccctgatcctaactgtgtggatagacctgtggaaggatatcttgctgtggcggtggttaggagatcagacactagccttacctggaactctgtgaaaggcaagaagtcctgccacaccgccgtggacaggactgcaggctggaatatccccatgggcctgctcttcaaccagacgggctcctgcaaatttgatgaatatttcagtcaaagctgtgcccctgggtctgacccgagatctaatctctgtgctctgtgtattggcgacgagcagggtgagaataagtgcgtgcccaacagcaacgagagatactacggctacactggggctttccggtgcctggctgagaatgctggagacgttgcatttgtgaaagatgtcactgtcttgcagaacactgatggaaataacaatgaggcatgggctaaggatttgaagctggcagactttgcgctgctgtgcctcgatggcaaacggaagcctgtgactgaggctagaagctgccatcttgccatggccccgaatcatgccgtggtgtctcggatggataaggtggaacgcctgaaacaggtgttgctccaccaacaggctaaatttgggagaaatggatctgactgcccggacaagttttgcttattccagtctgaaaccaaaaaccttctgttcaatgacaacactgagtgtctggccagactccatggcaaaacaacatatgaaaaatatttgggaccacagtatgtcgcaggcattactaatctgaaaaagtgctcaacctcccccctcctggaagcctgtgaattcctcaggaagtaaaaccgaagaagatggcccagctccccaagaaagcctcagccattcactgcccccagctcttctccccaggtgtgttggggccttggcctcccctgctgaaggtggggattgcccatccatctgcttacaattccctgctgtcgtcttagcaagaagtaaaatgagaaattttgttgatattctctccttaaaaagtgtcactcatcttttctagaattttatactgaaatcacatgcctgacaaaatacctgtacagttggaccttcccttccaagtttttcaggtccagcccctcctctttcttgcagtcttgggtatgatgcccaagggtctggaatttaaggccaggccaagcaccggttttcctaaggggatcttgttggttattcacatagctgtctcagtgcacgtgcatgtatgtgcctgggagtgtgtgcgtgtccccaaggcagggcaggaagaacaagcataggaattataactgaaatgtaggttcagttgctcatcacttgcagagtctaattaacaagagctaggtttggtataaag

SEQ ID NO: 314749 - DNA, 3050 bp, Homo sapiens
cttcccatgggtgttggtcatccttctcttctctaagacagattgggactggccaggacccgactgttctcttcgcctcaagctccctggcgagtggcctgttgcacagggttagggccacctgggaggggcaggagaggaaggaagccttgccttcctggaagtggtcatgggctgtggtccaggattctggctcagagttgcaccactgggttttatattcacttggatctttagttgttttggcgcctactgaggtctgaagtttgaatcctgcagtcaattgggatggtggcttgtaccccaaagtgccattgcaacccttgtccttcctgaggaaagggtggcagttgccctgtggaattcctgccctgctccccgtgggtgtccaggctgacagaagttgggactgtgtctggctggccgtaggagaaggagtgttcagtggtgcgccgtatcccaacccgaggccacaaaatgcttccaatggcaaaggaatatgagaaaagtgcgtggccctcctgtcagctgcataaagagagactcccccatccagtgtatccaggccattgcggaaaacagggccgatgctgtgacccttgatggtggtttcatatacgaggcaggcctggccccctacaaactgcgacctgtagcggcggaagtctacgggaccgaaagacagccacgaactcactattatgccgtggctgtggtgaagaagggcggcagctttcagctgaacgaactgcaaggtctgaagtcctgccacacaggccttcgcaggaccgctggatggaatgtccctatagggacacttcgtccattcttgaattggacgggtccacctgagcccattgaggcagctgtggccaggttcttctcagccagctgtgttcccggtgcagataaaggacagttccccaacctgtgtcgcctgtgtgcggggacaggggaaaacaaatgtgccttctcctcccaggaaccgtacttcagctactctggtgccttcaagtgtctgagagacggggctggagacgtggcttttatcagagagagcacagtgtttgaggacctgtcagacgaggctgaaagggacgagtatgagttactctgcccagacaacactcggaagccagtggacaagttcaaagactgccatctggcccgggtcccttctcatgccgttgtggcacgaagtgtgaatggcaaggaggatgccatctggaatcttctccgccaggcacaggaaaagtttggaaaggacaagtcaccgaaattccagctctttggctcccctagtgggcagaaagatctgctgttcaaggactctgccattgggttttcgagggtgcccccgaggatagattctgggctgtaccttggctccggctacttcactgccatccagaacttgaggaaaagtgaggaggaagtggctgcccggcgtgcgcgggtcgtgtggtgtgcggtgggcgagcaggagctgcgcaagtgtaaccagtggagtggcttgagcgaaggcagcgtgacctgctcctcggcctccaccacagaggactgcatcgccctggtgctgaaaggagaagctgatgccatgagtttggatggaggatatgtgtacactgcaggcaaatgtggtttggtgcctgtcctggcagagaactacaaatcccaacaaagcagtgaccctgatcctaactgtgtggatagacctgtggaaggatatcttgctgtggcggtggttaggagatcagacactagccttacctggaactctgtgaaaggcaagaagtcctgccacaccgccgtggacaggactgcaggctggaatatccccatgggcctgctcttcaaccagacgggctcctgcaaatttgatgaatatttcagtcaaagctgtgcccctgggtctgacccgagatctaatctctgtgctctgtgtattggcgacgagcagggtgagaataagtgcgtgcccaacagcaacgagagatactacggctacactggggctttccggtgcctggctgagaatgctggagacgttgcatttgtgaaagatgtcactgtcttgcagaacactgatggaaataacaatgaggcatgggctaaggatttgaagctggcagactttgcgctgctgtgcctcgatggcaaacggaagcctgtgactgaggctagaagctgccatcttgccatggccccgaatcatgccgtggtgtctcggatggataaggtggaacgcctgaaacaggtgttgctccaccaacaggctaaatttgggagaaatggatctgactgcccggacaagttttgcttattccagtctgaaaccaaaaaccttctgttcaatgacaacactgagtgtctggccagactccatggcaaaacaacatatgaaaaatatttgggaccacagtatgtcgcaggcattactaatctgaaaaagtgctcaacctcccccctcctggaagcctgtgaattcctcaggaagtaaaaccgaagaagatggcccagctccccaagaaagcctcagccattcactgcccccagctcttctccccaggtgtgttggggccttggcctcccctgctgaaggtggggattgcccatccatctgcttacaattccctgctgtcgtcttagcaagaagtaaaatgagaaattttgttgatattctctccttaaaaagtgtcactcatcttttctagaattttatactgaaatcacatgcctgacaaaatacctgtacagttggaccttcccttccaagtttttcaggtccagcccctcctctttcttgcagtcttgggtatgatgcccaagggtctggaatttaaggccaggccaagcaccggttttcctaaggggatcttgttggttattcacatagctgtctcagtgcacgtgcatgtatgtgcctgggagtgtgtgcgtgtccccaaggcagggcaggaagaacaagcataggaattataactgaaatgtaggttcagttgctcatcacttgcagagtctaattaacaagagctaggtttggtataaag

SEQ ID NO: 314750 - DNA, 2504 bp, Homo sapiens
aagccagtctcggcctcttttactttcggaaaacagggccgatgctgtgacccttgatggtggtttcatatacgaggcaggcctggccccctacaaactgcgacctgtagcggcggaagtctacgggaccgaaagacagccacgaactcactattatgccgtggctgtggtgaagaagggcggcagctttcagctgaacgaactgcaaggtctgaagtcctgccacacaggccttcgcaggaccgctggatggaatgtccctatagggacacttcgtccattcttgaattggacgggtccacctgagcccattgaggcagctgtggccaggttcttctcagccagctgtgttcccggtgcagataaaggacagttccccaacctgtgtcgcctgtgtgcggggacaggggaaaacaaatgtgccttctcctcccaggaaccgtacttcagctactctggtgccttcaagtgtctgagagacggggctggagacgtggcttttatcagagagagcacagtgtttgaggacctgtcagacgaggctgaaagggacgagtatgagttactctgcccagacaacactcggaagccagtggacaagttcaaagactgccatctggcccgggtcccttctcatgccgttgtggcacgaagtgtgaatggcaaggaggatgccatctggaatcttctccgccaggcacaggaaaagtttggaaaggacaagtcaccgaaattccagctctttggctcccctagtgggcagaaagatctgctgttcaaggactctgccattgggttttcgagggtgcccccgaggatagattctgggctgtaccttggctccggctacttcactgccatccagaacttgaggaaaagtgaggaggaagtggctgcccggcgtgcgcgggtcgtgtggtgtgcggtgggcgagcaggagctgcgcaagtgtaaccagtggagtggcttgagcgaaggcagcgtgacctgctcctcggcctccaccacagaggactgcatcgccctggtgctgaaaggagaagctgatgccatgagtttggatggaggatatgtgtacactgcaggcaaatgtggtttggtgcctgtcctggcagagaactacaaatcccaacaaagcagtgaccctgatcctaactgtgtggatagacctgtggaaggatatcttgctgtggcggtggttaggagatcagacactagccttacctggaactctgtgaaaggcaagaagtcctgccacaccgccgtggacaggactgcaggctggaatatccccatgggcctgctcttcaaccagacgggctcctgcaaatttgatgaatatttcagtcaaagctgtgcccctgggtctgacccgagatctaatctctgtgctctgtgtattggcgacgagcagggtgagaataagtgcgtgcccaacagcaacgagagatactacggctacactggggctttccggtgcctggctgagaatgctggagacgttgcatttgtgaaagatgtcactgtcttgcagaacactgatggaaataacaatgaggcatgggctaaggatttgaagctggcagactttgcgctgctgtgcctcgatggcaaacggaagcctgtgactgaggctagaagctgccatcttgccatggccccgaatcatgccgtggtgtctcggatggataaggtggaacgcctgaaacaggtgttgctccaccaacaggctaaatttgggagaaatggatctgactgcccggacaagttttgcttattccagtctgaaaccaaaaaccttctgttcaatgacaacactgagtgtctggccagactccatggcaaaacaacatatgaaaaatatttgggaccacagtatgtcgcaggcattactaatctgaaaaagtgctcaacctcccccctcctggaagcctgtgaattcctcaggaagtaaaaccgaagaagatggcccagctccccaagaaagcctcagccattcactgcccccagctcttctccccaggtgtgttggggccttggcctcccctgctgaaggtggggattgcccatccatctgcttacaattccctgctgtcgtcttagcaagaagtaaaatgagaaattttgttgatattctctccttaaaaagtgtcactcatcttttctagaattttatactgaaatcacatgcctgacaaaatacctgtacagttggaccttcccttccaagtttttcaggtccagcccctcctctttcttgcagtcttgggtatgatgcccaagggtctggaatttaaggccaggccaagcaccggttttcctaaggggatcttgttggttattcacatagctgtctcagtgcacgtgcatgtatgtgcctgggagtgtgtgcgtgtccccaaggcagggcaggaagaacaagcataggaattataactgaaatgtaggttcagttgctcatcacttgcagagtctaattaacaagagctaggtttggtataaag

SEQ ID NO: 314751 - DNA, 2418 bp, Homo sapiens
tacttgaggatcctttcgactgacacgtggaagtctacgggaccgaaagacagccacgaactcactattatgccgtggctgtggtgaagaagggcggcagctttcagctgaacgaactgcaaggtctgaagtcctgccacacaggccttcgcaggaccgctggatggaatgtccctatagggacacttcgtccattcttgaattggacgggtccacctgagcccattgaggcagctgtggccaggttcttctcagccagctgtgttcccggtgcagataaaggacagttccccaacctgtgtcgcctgtgtgcggggacaggggaaaacaaatgtgccttctcctcccaggaaccgtacttcagctactctggtgccttcaagtgtctgagagacggggctggagacgtggcttttatcagagagagcacagtgtttgaggacctgtcagacgaggctgaaagggacgagtatgagttactctgcccagacaacactcggaagccagtggacaagttcaaagactgccatctggcccgggtcccttctcatgccgttgtggcacgaagtgtgaatggcaaggaggatgccatctggaatcttctccgccaggcacaggaaaagtttggaaaggacaagtcaccgaaattccagctctttggctcccctagtgggcagaaagatctgctgttcaaggactctgccattgggttttcgagggtgcccccgaggatagattctgggctgtaccttggctccggctacttcactgccatccagaacttgaggaaaagtgaggaggaagtggctgcccggcgtgcgcgggtcgtgtggtgtgcggtgggcgagcaggagctgcgcaagtgtaaccagtggagtggcttgagcgaaggcagcgtgacctgctcctcggcctccaccacagaggactgcatcgccctggtgctgaaaggagaagctgatgccatgagtttggatggaggatatgtgtacactgcaggcaaatgtggtttggtgcctgtcctggcagagaactacaaatcccaacaaagcagtgaccctgatcctaactgtgtggatagacctgtggaaggatatcttgctgtggcggtggttaggagatcagacactagccttacctggaactctgtgaaaggcaagaagtcctgccacaccgccgtggacaggactgcaggctggaatatccccatgggcctgctcttcaaccagacgggctcctgcaaatttgatgaatatttcagtcaaagctgtgcccctgggtctgacccgagatctaatctctgtgctctgtgtattggcgacgagcagggtgagaataagtgcgtgcccaacagcaacgagagatactacggctacactggggctttccggtgcctggctgagaatgctggagacgttgcatttgtgaaagatgtcactgtcttgcagaacactgatggaaataacaatgaggcatgggctaaggatttgaagctggcagactttgcgctgctgtgcctcgatggcaaacggaagcctgtgactgaggctagaagctgccatcttgccatggccccgaatcatgccgtggtgtctcggatggataaggtggaacgcctgaaacaggtgttgctccaccaacaggctaaatttgggagaaatggatctgactgcccggacaagttttgcttattccagtctgaaaccaaaaaccttctgttcaatgacaacactgagtgtctggccagactccatggcaaaacaacatatgaaaaatatttgggaccacagtatgtcgcaggcattactaatctgaaaaagtgctcaacctcccccctcctggaagcctgtgaattcctcaggaagtaaaaccgaagaagatggcccagctccccaagaaagcctcagccattcactgcccccagctcttctccccaggtgtgttggggccttggcctcccctgctgaaggtggggattgcccatccatctgcttacaattccctgctgtcgtcttagcaagaagtaaaatgagaaattttgttgatattctctccttaaaaagtgtcactcatcttttctagaattttatactgaaatcacatgcctgacaaaatacctgtacagttggaccttcccttccaagtttttcaggtccagcccctcctctttcttgcagtcttgggtatgatgcccaagggtctggaatttaaggccaggccaagcaccggttttcctaaggggatcttgttggttattcacatagctgtctcagtgcacgtgcatgtatgtgcctgggagtgtgtgcgtgtccccaaggcagggcaggaagaacaagcataggaattataactgaaatgtaggttcagttgctcatcacttgcagagtctaattaacaagagctaggtttggtataaag

SEQ ID NO: 314752 - DNA, 2597 bp, Homo sapiens
gactcctaggggcttgcagacctagtgggagagaaagaacatcgcagcagccaggcagaaccaggacaggtgaggtgcaggctggctttcctctcgcagcgcggtgtggagtcctgtcctgcctcagggcttttcggagcctggatcctcaaggaacaagtagacctggccgcggggagtggggagggaaggggtgtctattgggcaacagggcggcaaagccctgaataaaggggcgcagggcaggcgcaagtgcagagccttcgtttgccaagtcgcctccagaccgcagacatgaaacttgtcttcctcgtcctgctgttcctcggggccctcggactgtgtctggctggccgtaggagaaggagtgttcagtggtgcgccgtatcccaacccgaggccacaaaatgcttccaatggcaaaggaatatgagaaaagtgcgtggccctcctgtcagctgcataaagagagactcccccatccagtgtatccaggccattgcggaaaacagggccgatgctgtgacccttgatggtggtttcatatacgaggcaggcctggccccctacaaactgcgacctgtagcggcggaagtctacgggaccgaaagacagccacgaactcactattatgccgtggctgtggtgaagaagggcggcagctttcagctgaacgaactgcaaggtctgaagtcctgccacacaggccttcgcaggaccgctggatggaatgtccctatagggacacttcgtccattcttgaattggacgggtccacctgagcccattgaggcagctgtggccaggttcttctcagccagctgtgttcccggtgcagataaaggacagttccccaacctgtgtcgcctgtgtgcggggacaggggaaaacaaatgtgccttctcctcccaggaaccgtacttcagctactctggtgccttcaagtgtctgagagacggggctggagacgtggcttttatcagagagagcacagtgtttgaggacctgtcagacgaggctgaaagggacgagtatgagttactctgcccagacaacactcggaagccagtggacaagttcaaagactgccatctggcccgggtcccttctcatgccgttgtggcacgaagtgtgaatggcaaggaggatgccatctggaatcttctccgccaggcacaggaaaagtttggaaaggacaagtcaccgaaattccagctctttggctcccctagtgggcagaaagatctgctgttcaaggactctgccattgggttttcgagggtgcccccgaggatagattctgggctgtaccttggctccggctacttcactgccatccagaacttgaggaaaagtgaggaggaagtggctgcccggcgtgcgcgggtcgtgtggtgtgcggtgggcgagcaggagctgcgcaagtgtaaccagtggagtggcttgagcgaaggcagcgtgacctgctcctcggcctccaccacagaggactgcatcgccctggtgctgaaaggagaagctgatgccatgagtttggatggaggatatgtgtacactgcaggcaaatgtggtttggtgcctgtcctggcagagaactacaaatcccaacaaagcagtgaccctgatcctaactgtgtggatagacctgtggaaggatatcttgctgtggcggtggttaggagatcagacactagccttacctggaactctgtgaaaggcaagaagtcctgccacaccgccgtggacaggactgcaggctggaatatccccatgggcctgctcttcaaccagacgggctcctgcaaatttgatgaatatttcagtcaaagctgtgcccctgggtctgacccgagatctaatctctgtgctctgtgtattggcgacgagcagggtgagaataagtgcgtgcccaacagcaacgagagatactacggctacactggggctttccggtgcctggctgagaatgctggagacgttgcatttgtgaaagatgtcactgtcttgcagaacactgatggaaataacaatgaggcatgggctaaggatttgaagctggcagactttgcgctgctgtgcctcgatggcaaacggaagcctgtgactgaggctagaagctgccatcttgccatggccccgaatcatgccgtggtgtctcggatggataaggtggaacgcctgaaacaggtgttgctccaccaacaggctaaatttgggagaaatggatctgactgcccggacaagttttgcttattccagtctgaaaccaaaaaccttctgttcaatgacaacactgagtgtctggccagactccatggcaaaacaacatatgaaaaatatttgggaccacagtatgtcgcaggcattactaatctgaaaaagtgctcaacctcccccctcctggaagcctgtgaattcctcaggaagtaaaaccgaagaagatggcccagctccccaagaaagcctcagccattcactgcccccagctcttctccccaggtgtgttggggccttggcctcccctgctgaaggtggggattgcccatccatctgcttacaattccctgctgtgctgccgtgctgtgtctgcagcagga

SEQ ID NO: 314753 - DNA, 2571 bp, Homo sapiens
gactcctaggggcttgcagacctagtgggagagaaagaacatcgcagcagccaggcagaaccaggacaggtgaggtgcaggctggctttcctctcgcagcgcggtgtggagtcctgtcctgcctcagggcttttcggagcctggatcctcaaggaacaagtagacctggccgcggggagtggggagggaaggggtgtctattgggcaacagggcggcaaagccctgaataaaggggcgcagggcaggcgcaagtgcagagccttcgtttgccaagtcgcctccagaccgcagacatgaaacttgtcttcctcgtcctgctgttcctcggggccctcggactgtgtctggctggccgtaggagaaggagtgttcagtggtgcgccgtatcccaacccgaggccacaaaatgcttccaatggcaaaggaatatgagaaaagtgcgtggccctcctgtcagctgcataaagagagactcccccatccagtgtatccaggccattgcggaaaacagggccgatgctgtgacccttgatggtggtttcatatacgaggcaggcctggccccctacaaactgcgacctgtagcggcggaagtctacgggaccgaaagacagccacgaactcactattatgccgtggctgtggtgaagaagggcggcagctttcagctgaacgaactgcaaggtctgaagtcctgccacacaggccttcgcaggaccgctggatggaatgtccctatagggacacttcgtccattcttgaattggacgggtccacctgagcccattgaggcagctgtggccaggttcttctcagccagctgtgttcccggtgcagataaaggacagttccccaacctgtgtcgcctgtgtgcggggacaggggaaaacaaatgtgccttctcctcccaggaaccgtacttcagctactctggtgccttcaagtgtctgagagacggggctggagacgtggcttttatcagagagagcacagtgtttgaggacctgtcagacgaggctgaaagggacgagtatgagttactctgcccagacaacactcggaagccagtggacaagttcaaagactgccatctggcccgggtcccttctcatgccgttgtggcacgaagtgtgaatggcaaggaggatgccatctggaatcttctccgccaggcacaggaaaagtttggaaaggacaagtcaccgaaattccagctctttggctcccctagtgggcagaaagatctgctgttcaaggactctgccattgggttttcgagggtgcccccgaggatagattctgggctgtaccttggctccggctacttcactgccatccagaacttgaggaaaagtgaggaggaagtggctgcccggcgtgcgcgggtcgtgtggtgtgcggtgggcgagcaggagctgcgcaagtgtaaccagtggagtggcttgagcgaaggcagcgtgacctgctcctcggcctccaccacagaggactgcatcgccctggtgctgaaaggagaagctgatgccatgagtttggatggaggatatgtgtacactgcaggcaaatgtggtttggtgcctgtcctggcagagaactacaaatcccaacaaagcagtgaccctgatcctaactgtgtggatagacctgtggaaggatatcttgctgtggcggtggttaggagatcagacactagccttacctggaactctgtgaaaggcaagaagtcctgccacaccgccgtggacaggactgcaggctggaatatccccatgggcctgctcttcaaccagacgggctcctgcaaatttgatgaatatttcagtcaaagctgtgcccctgggtctgacccgagatctaatctctgtgctctgtgtattggcgacgagcagggtgagaataagtgcgtgcccaacagcaacgagagatactacggctacactggggctttccggtgcctggctgagaatgctggagacgttgcatttgtgaaagatgtcactgtcttgcagaacactgatggaaataacaatgaggcatgggctaaggatttgaagctggcagactttgcgctgctgtgcctcgatggcaaacggaagcctgtgactgaggctagaagctgccatcttgccatggccccgaatcatgccgtggtgtctcggatggataaggtggaacgcctgaaacaggtgttgctccaccaacaggctaaatttgggagaaatggatctgactgcccggacaagttttgcttattccagtctgaaaccaaaaaccttctgttcaatgacaacactgagtgtctggccagactccatggcaaaacaacatatgaaaaatatttgggaccacagtatgtcgcaggcattactaatctgaaaaagtgctcaacctcccccctcctggaagcctgtgaattcctcaggaagtaaaaccgaagaagatggcccagctccccaagaaagcctcagccattcactgcccccagctcttctcccagttgttggcatgctcctctgaagtgggatgccatccattcccacacaccgcagatcctgtagagtcaccccagc

SEQ ID NO: 314754 - DNA, 1922 bp, Homo sapiens
  misc_feature (5)..(5): n is a, c, g, or t
tagantcgagctcggtaccagattcccttgccatctggcccgggtcccttctcatgccgttgtggcacgaagtgtgaatggcaaggaggatgccatctggaatcttctccgccaggcacaggaaaagtttggaaaggacaagtcaccgaaattccagctctttggctcccctagtgggcagaaagatctgctgttcaaggactctgccattgggttttcgagggtgcccccgaggatagattctgggctgtaccttggctccggctacttcactgccatccagaacttgaggaaaagtgaggaggaagtggctgcccggcgtgcgcgggtcgtgtggtgtgcggtgggcgagcaggagctgcgcaagtgtaaccagtggagtggcttgagcgaaggcagcgtgacctgctcctcggcctccaccacagaggactgcatcgccctggtgctgaaaggagaagctgatgccatgagtttggatggaggatatgtgtacactgcaggcaaatgtggtttggtgcctgtcctggcagagaactacaaatcccaacaaagcagtgaccctgatcctaactgtgtggatagacctgtggaaggatatcttgctgtggcggtggttaggagatcagacactagccttacctggaactctgtgaaaggcaagaagtcctgccacaccgccgtggacaggactgcaggctggaatatccccatgggcctgctcttcaaccagacgggctcctgcaaatttgatgaatatttcagtcaaagctgtgcccctgggtctgacccgagatctaatctctgtgctctgtgtattggcgacgagcagggtgagaataagtgcgtgcccaacagcaacgagagatactacggctacactggggctttccggtgcctggctgagaatgctggagacgttgcatttgtgaaagatgtcactgtcttgcagaacactgatggaaataacaatgaggcatgggctaaggatttgaagctggcagactttgcgctgctgtgcctcgatggcaaacggaagcctgtgactgaggctagaagctgccatcttgccatggccccgaatcatgccgtggtgtctcggatggataaggtggaacgcctgaaacaggtgttgctccaccaacaggctaaatttgggagaaatggatctgactgcccggacaagttttgcttattccagtctgaaaccaaaaaccttctgttcaatgacaacactgagtgtctggccagactccatggcaaaacaacatatgaaaaatatttgggaccacagtatgtcgcaggcattactaatctgaaaaagtgctcaacctcccccctcctggaagcctgtgaattcctcaggaagtaaaaccgaagaagatggcccagctccccaagaaagcctcagccattcactgcccccagctcttctccccaggtgtgttggggccttggcctcccctgctgaaggtggggattgcccatccatctgcttacaattccctgctgtcgtcttagcaagaagtaaaatgagaaattttgttgatattctctccttaaaaagtgtcactcatcttttctagaattttatactgaaatcacatgcctgacaaaatacctgtacagttggaccttcccttccaagtttttcaggtccagcccctcctctttcttgcagtcttgggtatgatgcccaagggtctggaatttaaggccaggccaagcaccggttttcctaaggggatcttgttggttattcacatagctgtctcagtgcacgtgcatgtatgtgcctgggagtgtgtgcgtgtccccaaggcagggcaggaagaacaagcataggaattataactgaaatgtaggttcagttgctcatcacttgcagagtctaattaacaagagctaggtttggtataaag

SEQ ID NO: 314755 - DNA, 2530 bp, Homo sapiens
gactcctaggggcttgcagacctagtgggagagaaagaacatcgcagcagccaggcagaaccaggacaggtgaggtgcaggctggctttcctctcgcagcgcggtgtggagtcctgtcctgcctcagggcttttcggagcctggatcctcaaggaacaagtagacctggccgcggggagtggggagggaaggggtgtctattgggcaacagggcggcaaagccctgaataaaggggcgcagggcaggcgcaagtgcagagccttcgtttgccaagtcgcctccagaccgcagacatgaaacttgtcttcctcgtcctgctgttcctcggggccctcggactgtgtctggctggccgtaggagaaggagtgttcagtggtgcgccgtatcccaacccgaggccacaaaatgcttccaatggcaaaggaatatgagaaaagtgcgtggccctcctgtcagctgcataaagagagactcccccatccagtgtatccaggccattgcggaaaacagggccgatgctgtgacccttgatggtggtttcatatacgaggcaggcctggccccctacaaactgcgacctgtagcggcggaagtctacgggaccgaaagacagccacgaactcactattatgccgtggctgtggtgaagaagggcggcagctttcagctgaacgaactgcaaggtctgaagtcctgccacacaggccttcgcaggaccgctggatggaatgtccctatagggacacttcgtccattcttgaattggacgggtccacctgagcccattgaggcagctgtggccaggttcttctcagccagctgtgttcccggtgcagataaaggacagttccccaacctgtgtcgcctgtgtgcggggacaggggaaaacaaatgtgccttctcctcccaggaaccgtacttcagctactctggtgccttcaagtgtctgagagacggggctggagacgtggcttttatcagagagagcacagtgtttgaggacctgtcagacgaggctgaaagggacgagtatgagttactctgcccagacaacactcggaagccagtggacaagttcaaagactgccatctggcccgggtcccttctcatgccgttgtggcacgaagtgtgaatggcaaggaggatgccatctggaatcttctccgccaggcacaggaaaagtttggaaaggacaagtcaccgaaattccagctctttggctcccctagtgggcagaaagatctgctgttcaaggactctgccattgggttttcgagggtgcccccgaggatagattctgggctgtaccttggctccggctacttcactgccatccagaacttgaggaaaagtgaggaggaagtggctgcccggcgtgcgcgggtcgtgtggtgtgcggtgggcgagcaggagctgcgcaagtgtaaccagtggagtggcttgagcgaaggcagcgtgacctgctcctcggcctccaccacagaggactgcatcgccctggtgctgaaaggagaagctgatgccatgagtttggatggaggatatgtgtacactgcaggcaaatgtggtttggtgcctgtcctggcagagaactacaaatcccaacaaagcagtgaccctgatcctaactgtgtggatagacctgtggaaggatatcttgctgtggcggtggttaggagatcagacactagccttacctggaactctgtgaaaggcaagaagtcctgccacaccgccgtggacaggactgcaggctggaatatccccatgggcctgctcttcaaccagacgggctcctgcaaatttgatgaatatttcagtcaaagctgtgcccctgggtctgacccgagatctaatctctgtgctctgtgtattggcgacgagcagggtgagaataagtgcgtgcccaacagcaacgagagatactacggctacactggggctttccggtgcctggctgagaatgctggagacgttgcatttgtgaaagatgtcactgtcttgcagaacactgatggaaataacaatgaggcatgggctaaggatttgaagctggcagactttgcgctgctgtgcctcgatggcaaacggaagcctgtgactgaggctagaagctgccatcttgccatggccccgaatcatgccgtggtgtctcggatggataaggtggaacgcctgaaacaggtgttgctccaccaacaggctaaatttgggagaaatggatctgactgcccggacaagttttgcttattccagtctgaaaccaaaaaccttctgttcaatgacaacactgagtgtctggccagactccatggcaaaacaacatatgaaaaatatttgggaccacagtatgtcgcaggcattactaatctgaaaaagtgctcaacctcccccctcctggaagcctgtgaattcctcaggaagtaaaaccgaagaagatggatgggcaatccccaccttcagcaggggaggccaaggccccaaaacacctggggagaagagctgggggcagtgaatggctgaggct

SEQ ID NO: 314756 - DNA, 2556 bp, Homo sapiens
gactcctaggggcttgcagacctagtgggagagaaagaacatcgcagcagccaggcagaaccaggacaggtgaggtgcaggctggctttcctctcgcagcgcggtgtggagtcctgtcctgcctcagggcttttcggagcctggatcctcaaggaacaagtagacctggccgcggggagtggggagggaaggggtgtctattgggcaacagggcggcaaagccctgaataaaggggcgcagggcaggcgcaagtgcagagccttcgtttgccaagtcgcctccagaccgcagacatgaaacttgtcttcctcgtcctgctgttcctcggggccctcggactgtgtctggctggccgtaggagaaggagtgttcagtggtgcgccgtatcccaacccgaggccacaaaatgcttccaatggcaaaggaatatgagaaaagtgcgtggccctcctgtcagctgcataaagagagactcccccatccagtgtatccaggccattgcggaaaacagggccgatgctgtgacccttgatggtggtttcatatacgaggcaggcctggccccctacaaactgcgacctgtagcggcggaagtctacgggaccgaaagacagccacgaactcactattatgccgtggctgtggtgaagaagggcggcagctttcagctgaacgaactgcaaggtctgaagtcctgccacacaggccttcgcaggaccgctggatggaatgtccctatagggacacttcgtccattcttgaattggacgggtccacctgagcccattgaggcagctgtggccaggttcttctcagccagctgtgttcccggtgcagataaaggacagttccccaacctgtgtcgcctgtgtgcggggacaggggaaaacaaatgtgccttctcctcccaggaaccgtacttcagctactctggtgccttcaagtgtctgagagacggggctggagacgtggcttttatcagagagagcacagtgtttgaggacctgtcagacgaggctgaaagggacgagtatgagttactctgcccagacaacactcggaagccagtggacaagttcaaagactgccatctggcccgggtcccttctcatgccgttgtggcacgaagtgtgaatggcaaggaggatgccatctggaatcttctccgccaggcacaggaaaagtttggaaaggacaagtcaccgaaattccagctctttggctcccctagtgggcagaaagatctgctgttcaaggactctgccattgggttttcgagggtgcccccgaggatagattctgggctgtaccttggctccggctacttcactgccatccagaacttgaggaaaagtgaggaggaagtggctgcccggcgtgcgcgggtcgtgtggtgtgcggtgggcgagcaggagctgcgcaagtgtaaccagtggagtggcttgagcgaaggcagcgtgacctgctcctcggcctccaccacagaggactgcatcgccctggtgctgaaaggagaagctgatgccatgagtttggatggaggatatgtgtacactgcaggcaaatgtggtttggtgcctgtcctggcagagaactacaaatcccaacaaagcagtgaccctgatcctaactgtgtggatagacctgtggaaggatatcttgctgtggcggtggttaggagatcagacactagccttacctggaactctgtgaaaggcaagaagtcctgccacaccgccgtggacaggactgcaggctggaatatccccatgggcctgctcttcaaccagacgggctcctgcaaatttgatgaatatttcagtcaaagctgtgcccctgggtctgacccgagatctaatctctgtgctctgtgtattggcgacgagcagggtgagaataagtgcgtgcccaacagcaacgagagatactacggctacactggggctttccggtgcctggctgagaatgctggagacgttgcatttgtgaaagatgtcactgtcttgcagaacactgatggaaataacaatgaggcatgggctaaggatttgaagctggcagactttgcgctgctgtgcctcgatggcaaacggaagcctgtgactgaggctagaagctgccatcttgccatggccccgaatcatgccgtggtgtctcggatggataaggtggaacgcctgaaacaggtgttgctccaccaacaggctaaatttgggagaaatggatctgactgcccggacaagttttgcttattccagtctgaaaccaaaaaccttctgttcaatgacaacactgagtgtctggccagactccatggcaaaacaacatatgaaaaatatttgggaccacagtatgtcgcaggcattactaatctgattctacccgttaacagtggactttgctttgcataaaggaagggcagtttggcagagtttgccctaagaaataatgaatgtgccatgatccagtgctatctgggtcatctcctacacagcgacctctgcctggagcacttgtcctttttctttttcttttttctttctttcttttttata

SEQ ID NO: 314757 - DNA, 1277 bp, Homo sapiens
tgcatcaacgcgttgggagctctcatattgtcgacctgcaggcggcgcgaattcactagtgattagccatgttggccgggccaaccagacgggctcctgcaaatttgatgaatatttcagtcaaagctgtgcccctgggtctgacccgagatctaatctctgtgctctgtgtattggcgacgagcagggtgagaataagtgcgtgcccaacagcaacgagagatactacggctacactggggctttccggtgcctggctgagaatgctggagacgttgcatttgtgaaagatgtcactgtcttgcagaacactgatggaaataacaatgaggcatgggctaaggatttgaagctggcagactttgcgctgctgtgcctcgatggcaaacggaagcctgtgactgaggctagaagctgccatcttgccatggccccgaatcatgccgtggtgtctcggatggataaggtggaacgcctgaaacaggtgttgctccaccaacaggctaaatttgggagaaatggatctgactgcccggacaagttttgcttattccagtctgaaaccaaaaaccttctgttcaatgacaacactgagtgtctggccagactccatggcaaaacaacatatgaaaaatatttgggaccacagtatgtcgcaggcattactaatctgaaaaagtgctcaacctcccccctcctggaagcctgtgaattcctcaggaagtaaaaccgaagaagatggcccagctccccaagaaagcctcagccattcactgcccccagctcttctccccaggtgtgttggggccttggcctcccctgctgaaggtggggattgcccatccatctgcttacaattccctgctgtcgtcttagcaagaagtaaaatgagaaattttgttgatattctctccttaaaaagtgtcactcatcttttctagaattttatactgaaatcacatgcctgacaaaatacctgtacagttggaccttcccttccaagtttttcaggtccagcccctcctctttcttgcagtcttgggtatgatgcccaagggtctggaatttaaggccaggccaagcaccggttttcctaaggggatcttgttggttattcacatagctgtctcagtgcacgtgcatgtatgtgcctgggagtgtgtgcgtgtccccaaggcagggcaggaagaacaagcataggaattataactgaaatgtaggttcagttgctcatcacttgcagagtctaattaacaagagctaggtttggtataaag

SEQ ID NO: 314758 - DNA, 2604 bp, Homo sapiens
gactcctaggggcttgcagacctagtgggagagaaagaacatcgcagcagccaggcagaaccaggacaggtgaggtgcaggctggctttcctctcgcagcgcggtgtggagtcctgtcctgcctcagggcttttcggagcctggatcctcaaggaacaagtagacctggccgcggggagtggggagggaaggggtgtctattgggcaacagggcggcaaagccctgaataaaggggcgcagggcaggcgcaagtgcagagccttcgtttgccaagtcgcctccagaccgcagacatgaaacttgtcttcctcgtcctgctgttcctcggggccctcggactgtgtctggctggccgtaggagaaggagtgttcagtggtgcgccgtatcccaacccgaggccacaaaatgcttccaatggcaaaggaatatgagaaaagtgcgtggccctcctgtcagctgcataaagagagactcccccatccagtgtatccaggccattgcggaaaacagggccgatgctgtgacccttgatggtggtttcatatacgaggcaggcctggccccctacaaactgcgacctgtagcggcggaagtctacgggaccgaaagacagccacgaactcactattatgccgtggctgtggtgaagaagggcggcagctttcagctgaacgaactgcaaggtctgaagtcctgccacacaggccttcgcaggaccgctggatggaatgtccctatagggacacttcgtccattcttgaattggacgggtccacctgagcccattgaggcagctgtggccaggttcttctcagccagctgtgttcccggtgcagataaaggacagttccccaacctgtgtcgcctgtgtgcggggacaggggaaaacaaatgtgccttctcctcccaggaaccgtacttcagctactctggtgccttcaagtgtctgagagacggggctggagacgtggcttttatcagagagagcacagtgtttgaggacctgtcagacgaggctgaaagggacgagtatgagttactctgcccagacaacactcggaagccagtggacaagttcaaagactgccatctggcccgggtcccttctcatgccgttgtggcacgaagtgtgaatggcaaggaggatgccatctggaatcttctccgccaggcacaggaaaagtttggaaaggacaagtcaccgaaattccagctctttggctcccctagtgggcagaaagatctgctgttcaaggactctgccattgggttttcgagggtgcccccgaggatagattctgggctgtaccttggctccggctacttcactgccatccagaacttgaggaaaagtgaggaggaagtggctgcccggcgtgcgcgggtcgtgtggtgtgcggtgggcgagcaggagctgcgcaagtgtaaccagtggagtggcttgagcgaaggcagcgtgacctgctcctcggcctccaccacagaggactgcatcgccctggtgctgaaaggagaagctgatgccatgagtttggatggaggatatgtgtacactgcaggcaaatgtggtttggtgcctgtcctggcagagaactacaaatcccaacaaagcagtgaccctgatcctaactgtgtggatagacctgtggaaggatatcttgctgtggcggtggttaggagatcagacactagccttacctggaactctgtgaaaggcaagaagtcctgccacaccgccgtggacaggactgcaggctggaatatccccatgggcctgctcttcaaccagacgggctcctgcaaatttgatgaatatttcagtcaaagctgtgcccctgggtctgacccgagatctaatctctgtgctctgtgtattggcgacgagcagggtgagaataagtgcgtgcccaacagcaacgagagatactacggctacactggggctttccggtgcctggctgagaatgctggagacgttgcatttgtgaaagatgtcactgtcttgcagaacactgatggtaggtgaaggtgtttccttttctccttcaaagcagagtctttggcatcacaacacatcttagtgttcagatttgcctttgggaaggttttataacattttccatatttgtgattaaaagaactccaaaattctttatctcaatagacaacatgataacatctgtaggtgtcatatggattttgaaacgaaattcatacacacacactctctctctttctctcacacacacacacacactcactctcacacacacagatactagccatgctcagtagcaaatgtctccctggcttcctctagtcaaccacagaaacacactgtctgcccacatgagatcatgcatgcctattggaaactgtggatgatgctacaaactgggtgaacatatgcaaatgaagcctccctttatgaaaaaggaagtagaggccttcattcatccccatgtgagccttggtctggagactccttgggagttagtgggaacaaaattacaggtggttgcagatgatggaagataatcttccagccaatgtttgaacaatcactctctctcctggtcctcagccatttgctaccttccaa

SEQ ID NO: 314759 - DNA, 2065 bp, Homo sapiens
gactcctaggggcttgcagacctagtgggagagaaagaacatcgcagcagccaggcagaaccaggacaggtgaggtgcaggctggctttcctctcgcagcgcggtgtggagtcctgtcctgcctcagggcttttcggagcctggatcctcaaggaacaagtagacctggccgcggggagtggggagggaaggggtgtctattgggcaacagggcggcaaagccctgaataaaggggcgcagggcaggcgcaagtgcagagccttcgtttgccaagtcgcctccagaccgcagacatgaaacttgtcttcctcgtcctgctgttcctcggggccctcggactgtgtctggctggccgtaggagaaggagtgttcagtggtgcgccgtatcccaacccgaggccacaaaatgcttccaatggcaaaggaatatgagaaaagtgcgtggccctcctgtcagctgcataaagagagactcccccatccagtgtatccaggccattgcggaaaacagggccgatgctgtgacccttgatggtggtttcatatacgaggcaggcctggccccctacaaactgcgacctgtagcggcggaagtctacgggaccgaaagacagccacgaactcactattatgccgtggctgtggtgaagaagggcggcagctttcagctgaacgaactgcaaggtctgaagtcctgccacacaggccttcgcaggaccgctggatggaatgtccctatagggacacttcgtccattcttgaattggacgggtccacctgagcccattgaggcagctgtggccaggttcttctcagccagctgtgttcccggtgcagataaaggacagttccccaacctgtgtcgcctgtgtgcggggacaggggaaaacaaatgtgccttctcctcccaggaaccgtacttcagctactctggtgccttcaagtgtctgagagacggggctggagacgtggcttttatcagagagagcacagtgtttgaggacctgtcagacgaggctgaaagggacgagtatgagttactctgcccagacaacactcggaagccagtggacaagttcaaagactgccatctggcccgggtcccttctcatgccgttgtggcacgaagtgtgaatggcaaggaggatgccatctggaatcttctccgccaggcacaggaaaagtttggaaaggacaagtcaccgaaattccagctctttggctcccctagtgggcagaaagatctgctgttcaaggactctgccattgggttttcgagggtgcccccgaggatagattctgggctgtaccttggctccggctacttcactgccatccagaacttgaggaaaagtgaggaggaagtggctgcccggcgtgcgcgggtcgtgtggtgtgcggtgggcgagcaggagctgcgcaagtgtaaccagtggagtggcttgagcgaaggcagcgtgacctgctcctcggcctccaccacagaggactgcatcgccctggtgctgaaaggagaagctgatgccatgagtttggatggaggatatgtgtacactgcaggcaaatgtggtttggtgcctgtcctggcagagaactacaaatcccaacaaagcagtgaccctgatcctaactgtgtggatagacctgtggaaggatatcttgctgtggcggtggttaggagatcagacactagccttacctggaactctgtgaaaggcaagaagtcctgccacaccgccgtggacaggactgcaggctggaatatccccatgggcctgctcttcaaccagacgggctcctgcaaatttgatgaatatttcagtcaaagctgtgcccctgggtctgacccgagatctaatctctgtgctctgtgtattggcgacgagcagggtgagaataagtgcgtgcccaacagcaacgagagatactacggctacactggggctttccggtgcctggctgagaatgctggagacgttgcatttgtgaaagatgtcactgtcttgcagaacactgatggaaataacaatgaggcacagatgcagtcgaggcacggattgcagt

SEQ ID NO: 314760 - DNA, 1906 bp, Homo sapiens
gactcctaggggcttgcagacctagtgggagagaaagaacatcgcagcagccaggcagaaccaggacaggtgaggtgcaggctggctttcctctcgcagcgcggtgtggagtcctgtcctgcctcagggcttttcggagcctggatcctcaaggaacaagtagacctggccgcggggagtggggagggaaggggtgtctattgggcaacagggcggcaaagccctgaataaaggggcgcagggcaggcgcaagtgcagagccttcgtttgccaagtcgcctccagaccgcagacatgaaacttgtcttcctcgtcctgctgttcctcggggccctcggactgtgtctggctggccgtaggagaaggagtgttcagtggtgcgccgtatcccaacccgaggccacaaaatgcttccaatggcaaaggaatatgagaaaagtgcgtggccctcctgtcagctgcataaagagagactcccccatccagtgtatccaggccattgcggaaaacagggccgatgctgtgacccttgatggtggtttcatatacgaggcaggcctggccccctacaaactgcgacctgtagcggcggaagtctacgggaccgaaagacagccacgaactcactattatgccgtggctgtggtgaagaagggcggcagctttcagctgaacgaactgcaaggtctgaagtcctgccacacaggccttcgcaggaccgctggatggaatgtccctatagggacacttcgtccattcttgaattggacgggtccacctgagcccattgaggcagctgtggccaggttcttctcagccagctgtgttcccggtgcagataaaggacagttccccaacctgtgtcgcctgtgtgcggggacaggggaaaacaaatgtgccttctcctcccaggaaccgtacttcagctactctggtgccttcaagtgtctgagagacggggctggagacgtggcttttatcagagagagcacagtgtttgaggacctgtcagacgaggctgaaagggacgagtatgagttactctgcccagacaacactcggaagccagtggacaagttcaaagactgccatctggcccgggtcccttctcatgccgttgtggcacgaagtgtgaatggcaaggaggatgccatctggaatcttctccgccaggcacaggaaaagtttggaaaggacaagtcaccgaaattccagctctttggctcccctagtgggcagaaagatctgctgttcaaggactctgccattgggttttcgagggtgcccccgaggatagattctgggctgtaccttggctccggctacttcactgccatccagaacttgaggaaaagtgaggaggaagtggctgcccggcgtgcgcgggtcgtgtggtgtgcggtgggcgagcaggagctgcgcaagtgtaaccagtggagtggcttgagcgaaggcagcgtgacctgctcctcggcctccaccacagaggactgcatcgccctggtgctgaaaggagaagctgatgccatgagtttggatggaggatatgtgtacactgcaggcaaatgtggtttggtgcctgtcctggcagagaactacaaatcccaacaaagcagtgaccctgatcctaactgtgtggatagacctgtggaaggatatcttgctgtggcggtggttaggagatcagacactagccttacctggaactctgtgaaaggcaagaagtcctgccacaccgccgtggacaggactgcaggctggaatatccccatgggcctgctcttcaaccagacgggctcctgcaaatttgatgaatatttcagtcaaagctgtgcccctgggtctgacccgagatctaatctctgtgcgtcttagcaagaagtaaaatgagaaattttgttgatat

SEQ ID NO: 314761 - DNA, 2074 bp, Homo sapiens
gactcctaggggcttgcagacctagtgggagagaaagaacatcgcagcagccaggcagaaccaggacaggtgaggtgcaggctggctttcctctcgcagcgcggtgtggagtcctgtcctgcctcagggcttttcggagcctggatcctcaaggaacaagtagacctggccgcggggagtggggagggaaggggtgtctattgggcaacagggcggcaaagccctgaataaaggggcgcagggcaggcgcaagtgcagagccttcgtttgccaagtcgcctccagaccgcagacatgaaacttgtcttcctcgtcctgctgttcctcggggccctcggactgtgtctggctggccgtaggagaaggagtgttcagtggtgcgccgtatcccaacccgaggccacaaaatgcttccaatggcaaaggaatatgagaaaagtgcgtggccctcctgtcagctgcataaagagagactcccccatccagtgtatccaggccattgcggaaaacagggccgatgctgtgacccttgatggtggtttcatatacgaggcaggcctggccccctacaaactgcgacctgtagcggcggaagtctacgggaccgaaagacagccacgaactcactattatgccgtggctgtggtgaagaagggcggcagctttcagctgaacgaactgcaaggtctgaagtcctgccacacaggccttcgcaggaccgctggatggaatgtccctatagggacacttcgtccattcttgaattggacgggtccacctgagcccattgaggcagctgtggccaggttcttctcagccagctgtgttcccggtgcagataaaggacagttccccaacctgtgtcgcctgtgtgcggggacaggggaaaacaaatgtgccttctcctcccaggaaccgtacttcagctactctggtgccttcaagtgtctgagagacggggctggagacgtggcttttatcagagagagcacagtgtttgaggacctgtcagacgaggctgaaagggacgagtatgagttactctgcccagacaacactcggaagccagtggacaagttcaaagactgccatctggcccgggtcccttctcatgccgttgtggcacgaagtgtgaatggcaaggaggatgccatctggaatcttctccgccaggcacaggaaaagtttggaaaggacaagtcaccgaaattccagctctttggctcccctagtgggcagaaagatctgctgttcaaggactctgccattgggttttcgagggtgcccccgaggatagattctgggctgtaccttggctccggctacttcactgccatccagaacttgaggaaaagtgaggaggaagtggctgcccggcgtgcgcgggtcgtgtggtgtgcggtgggcgagcaggagctgcgcaagtgtaaccagtggagtggcttgagcgaaggcagcgtgacctgctcctcggcctccaccacagaggactgcatcgccctggtgctgaaaggagaagctgatgccatgagtttggatggaggatatgtgtacactgcaggcaaatgtggtttggtgcctgtcctggcagagaactacaaatcccaacaaagcagtgaccctgatcctaactgtgtggatagacctgtggaaggatatcttgctgtggcggtggttaggagatcagacactagccttacctggaactctgtgaaaggcaagaagtcctgccacaccgccgtggacaggactgcaggctggaatatccccatgggcctgctcttcaaccagacgggctcctgcaaatttggtaaggagttccaaaggtgcggtgggtgggccaccctggagggtaggcatattgtgctgtggaaccttagggaagggaggggaggggatttgcaggctgatagtggcctgcaggcctcttccagcataaggaaattctccctgtggctgccccctggaggcgtgggtgcactgggggtttccctgcacagcacttcccatgccccattcaccccaccccaagattaaagattggaatatctgcctatttcgctgcaccctaaga

SEQ ID NO: 314762 - DNA, 1014 bp, Homo sapiens
gcagtgcagcttgatctcagtatctaaggatcccggtcacagttctgactgatggaaataacaatgaggcatgggctaaggatttgaagctggcagactttgcgctgctgtgcctcgatggcaaacggaagcctgtgactgaggctagaagctgccatcttgccatggccccgaatcatgccgtggtgtctcggatggataaggtggaacgcctgaaacaggtgttgctccaccaacaggctaaatttgggagaaatggatctgactgcccggacaagttttgcttattccagtctgaaaccaaaaaccttctgttcaatgacaacactgagtgtctggccagactccatggcaaaacaacatatgaaaaatatttgggaccacagtatgtcgcaggcattactaatctgaaaaagtgctcaacctcccccctcctggaagcctgtgaattcctcaggaagtaaaaccgaagaagatggcccagctccccaagaaagcctcagccattcactgcccccagctcttctccccaggtgtgttggggccttggcctcccctgctgaaggtggggattgcccatccatctgcttacaattccctgctgtcgtcttagcaagaagtaaaatgagaaattttgttgatattctctccttaaaaagtgtcactcatcttttctagaattttatactgaaatcacatgcctgacaaaatacctgtacagttggaccttcccttccaagtttttcaggtccagcccctcctctttcttgcagtcttgggtatgatgcccaagggtctggaatttaaggccaggccaagcaccggttttcctaaggggatcttgttggttattcacatagctgtctcagtgcacgtgcatgtatgtgcctgggagtgtgtgcgtgtccccaaggcagggcaggaagaacaagcataggaattataactgaaatgtaggttcagttgctcatcacttgcagagtctaattaacaagagctaggtttggtataaag

SEQ ID NO: 314763 - DNA, 1565 bp, Homo sapiens
gactcctaggggcttgcagacctagtgggagagaaagaacatcgcagcagccaggcagaaccaggacaggtgaggtgcaggctggctttcctctcgcagcgcggtgtggagtcctgtcctgcctcagggcttttcggagcctggatcctcaaggaacaagtagacctggccgcggggagtggggagggaaggggtgtctattgggcaacagggcggcaaagccctgaataaaggggcgcagggcaggcgcaagtgcagagccttcgtttgccaagtcgcctccagaccgcagacatgaaacttgtcttcctcgtcctgctgttcctcggggccctcggactgtgtctggctggccgtaggagaaggagtgttcagtggtgcgccgtatcccaacccgaggccacaaaatgcttccaatggcaaaggaatatgagaaaagtgcgtggccctcctgtcagctgcataaagagagactcccccatccagtgtatccaggccattgcggaaaacagggccgatgctgtgacccttgatggtggtttcatatacgaggcaggcctggccccctacaaactgcgacctgtagcggcggaagtctacgggaccgaaagacagccacgaactcactattatgccgtggctgtggtgaagaagggcggcagctttcagctgaacgaactgcaaggtctgaagtcctgccacacaggccttcgcaggaccgctggatggaatgtccctatagggacacttcgtccattcttgaattggacgggtccacctgagcccattgaggcagctgtggccaggttcttctcagccagctgtgttcccggtgcagataaaggacagttccccaacctgtgtcgcctgtgtgcggggacaggggaaaacaaatgtgccttctcctcccaggaaccgtacttcagctactctggtgccttcaagtgtctgagagacggggctggagacgtggcttttatcagagagagcacagtgtttgaggacctgtcagacgaggctgaaagggacgagtatgagttactctgcccagacaacactcggaagccagtggacaagttcaaagactgccatctggcccgggtcccttctcatgccgttgtggcacgaagtgtgaatggcaaggaggatgccatctggaatcttctccgccaggcacaggaaaagtttggaaaggacaagtcaccgaaattccagctctttggctcccctagtgggcagaaagatctgctgttcaaggactctgccattgggttttcgagggtgcccccgaggatagattctgggctgtaccttggctccggctacttcactgccatccagaacttgaggaaaagtgaggaggaagtggctgcccggcgtgcgcgggtcgtgtggtgtgcggtgggcgagcaggagctgcgcaagtgtaaccagtggagtggcttgagcgaaggcagcgtgacctgctcctcggcctccaccacagaggactgcatcgccctggtgctgaaagagaagctgatgccatgagtttggatgaaagggaatctgggccagctgatata

SEQ ID NO: 314764 - DNA, 1375 bp, Homo sapiens
gactcctaggggcttgcagacctagtgggagagaaagaacatcgcagcagccaggcagaaccaggacaggtgaggtgcaggctggctttcctctcgcagcgcggtgtggagtcctgtcctgcctcagggcttttcggagcctggatcctcaaggaacaagtagacctggccgcggggagtggggagggaaggggtgtctattgggcaacagggcggcaaagccctgaataaaggggcgcagggcaggcgcaagtgcagagccttcgtttgccaagtcgcctccagaccgcagacatgaaacttgtcttcctcgtcctgctgttcctcggggccctcggactgtgtctggctggccgtaggagaaggagtgttcagtggtgcgccgtatcccaacccgaggccacaaaatgcttccaatggcaaaggaatatgagaaaagtgcgtggccctcctgtcagctgcataaagagagactcccccatccagtgtatccaggccattgcggaaaacagggccgatgctgtgacccttgatggtggtttcatatacgaggcaggcctggccccctacaaactgcgacctgtagcggcggaagtctacgggaccgaaagacagccacgaactcactattatgccgtggctgtggtgaagaagggcggcagctttcagctgaacgaactgcaaggtctgaagtcctgccacacaggccttcgcaggaccgctggatggaatgtccctatagggacacttcgtccattcttgaattggacgggtccacctgagcccattgaggcagctgtggccaggttcttctcagccagctgtgttcccggtgcagataaaggacagttccccaacctgtgtcgcctgtgtgcggggacaggggaaaacaaatgtgccttctcctcccaggaaccgtacttcagctactctggtgccttcaagtgtctgagagacggggctggagacgtggcttttatcagagagagcacagtgtttgaggacctgtcagacgaggctgaaagggacgagtatgagttactctgcccagacaacactcggaagccagtggacaagttcaaagactgccatctggcccgggtcccttctcatgccgttgtggcacgaagtgtgaatggcaaggaggatgccatctggaatcttctccgccaggcacaggaaaagtttggaaaggacaagtcaccgaaattccagctctttggctcccctagtgggcagaaagatctgctgttcaaggactctgccattgggttttcgagggtgcccccgaggatagattctgggctgtaccttggctccggctacttcactgccatccagaacttgaggaaaagtgagtgagcccaggagggtc

SEQ ID NO: 314765 - DNA, 995 bp, Homo sapiens
gactggccaccataactggcctttatggagctcttaatgtgcacacacagtggtgctggtgagagagctgccgtgactgaggggtttgggtctcagtctccccacatgggagcctgggacagagcaggaacctgtgtgagggaggcagggtgaccgacctgcacactgagctggttagtggctgagcctgggttttcctagcagcctgcctctctagaagagctgcatattagaatgtcctgagcaattgacttgtgagggcagatctcaaaacccctccattgttgccttgtcacccataagaagttgtatgggaaaaggtcacaggttaagaaggaaggaaagatggcagatggtaggaggtaggaccagaagtggtgcgaggcctggatgctgcccaaggcgggcctgccaccaggagtgtggggtgggggactccactaaggaggtggaatgactccagaactcagctccttctgccccatggttttctcagggctgttcttgggtggaagaaatacccctttgcctcctttaacccacaaattcctcttttccttagctactcactgtctgcccttttgtcgcaggctaaatttgggagaaatggatctgactgcccggacaagttttgcttattccagtctgaaaccaaaaaccttctgttcaatgacaacactgagtgtctggccagactccatggcaaaacaacatatgaaaaatatttgggaccacagtatgtcgcaggcattactaatctgaaaaagtgctcaacctcccccctcctggaagcctgtgaattcctcaggaagtaaaaccgaagaagatggcccagctccccaagaaagcctcagccattcactgcccccagctcttctccccaggtgtgttggggccttggcctcccctgctgaaggtggggattgcccatccatctgcttacaattccctgctgtcgtcttagcaagaagtaaaatgagaaattttgttgatat

SEQ ID NO: 314766 - DNA, 472 bp, Homo sapiens
tgcaccattgcactccatcctgggcgacaagaccgatactccatcttgagcctgtgtctagacacaggctaaatttgggagaaatggatctgactgcccggacaagttttgcttattccagtctgaaaccaaaaaccttctgttcaatgacaacactgagtgtctggccagactccatggcaaaacaacatatgaaaaatatttgggaccacagtatgtcgcaggcattactaatctgaaaaagtgctcaacctcccccctcctggaagcctgtgaattcctcaggaagtaaaaccgaagaagatggcccagctccccaagaaagcctcagccattcactgcccccagctcttctccccaggtgtgttggggccttggcctcccctgctgaaggtggggattgcccatccatctgcttacaattccctgctgtcgtcttagcaagaagtaaaatgagaaattttgttgatat

SEQ ID NO: 314767 - DNA, 948 bp, Homo sapiens
  misc_feature (31)..(32): n is a, c, g, or t
ggtcgactactactactaaattcgcggccgnntctgctgctggtaacaaataggtagaggccagggatgctactaaacaaagcacagccagccccctgcaataaagggttattatcaggccccaaatgtcaatagtgccaaggttgagaaacccttttctgtattgacaaacaactcaggtcactgtgatgcaggtcaggaccaccctctgagaaatatggctacagggctcttcttgtgagcagccagctcaggactgcatagaccacatgcttcttgagggcaggccagtctatccatgctgtgtccccagcacttagcacagcaactcacacaaagcaggtgctcagtaaggatctgtgaatgaatgagtgaatctgcaggtgaacatgattgcaaacaggttcacattccgggagaagctagaggaccaccaatgtcttgtgaacttgagaatgtgacagtcgattcaatcagagacaagtgcagggtggttgtgtctctcaggccagagcagggaaacaccctggctggtgagggctagactctggctcccttgaacaccgtagtcgctaggagtaggggagtgggaatatgagtgtggcaagcactgactcagtgatgggagaagggcagagaaaactcttagtattctctttgatttattggattaaataactggtttaatggaagaaatcagtttctgaatctcttgctctgttgtgtcccacagccctcctggaagcctgtgaattcctcaggaagtaaaaccgaagaagatggcccagctccccaagaaagcctcagccattcactgcccccagctcttctccccaggtgtgttggggccttggcctcccctgctgaaggtggggattgcccatccatctgcttacaattccctgctgtcgtcttagcaagaagtaaaatgagaaattttgttgatat

SEQ ID NO: 314768 - DNA, 1570 bp, Homo sapiens
ttctctccccaccacaccccacactcatcctagtcagcatcagccacaccctgcctgctgtgggccccgtggcatggtgtgtagcacatcctcaatgtgactcccttcttgtatgggcgtctcctagggcaggggctccactgcatgggtttttgatcctggccggggcaggcagctttcacgtggctctgctcctcaccagctccatggcagcctctgagctgtagggaaactgccaggatggaatgggaactcccagcttttcctgaggttgacacatagtgtggctcttccagcagcagtgggagtctgataatgggtgacgtttgctcagtggggcagagctttcttgtcacctttgtttattctttcttgggttaaatcacacaatgaacgaattcagatcaggttcagctgcaaggaacagaaaactcctgaaatagtagaggcttaaacaagacagaagttaatttctgtgtcatgtagtccagaggtggtttgcctagggctggtatgaagacaatatggggtctggaacctgggctttaatcatttggctactctgccatttgtgtggctttcatgctcaaggtcacctcatggcccacattgcatctctaagtccagtccctgcttctgcattctatgtgcaggatgaagaaagagaaggagaagaaagggcaaaaggcatgtaccaattgtctttcaaggatgtttctgagaagctggcgcccaacactcctgctgatatttcactggcctatagctacccatatggccatatgagccccagggagtctgataagtctagtctttataccaaagggccaagcacccagatacaaagcagggtttccattactgataaaaacaaaatcagatcctggactaggcaactcacaggctctgctgcacacagccatcacggtcatgagctgagtccccagctcaaggctgtgatgacgggaccctccaggcagccacagctctcatccccagccttagttgggtgtccatctgtgcctacagtctgaatgaagcttttctggtgggtcctatgttggtgacaacatgttgctttgtgatggtgagtgtgttctatctagattgctgtcctgggaagtctaatgaactgaaaccaccctgcatcggctgttaggtaaaggttgcttgtgtggactcaggtttgaagagctgactccccgtgttccttctctccagatgaatatttcagtcaaagctgtgcccctgggtctgacccgagatctaatctctgtgctctgtgtattggcgacgagcagggtgagaataagtgcgtgcccaacagcaacgagagatactacggctacactggggctttccggtgagtctgtgactgagctccatcaggatggggacttacctcatccctcagcatgtcagcattgcagttctaaggagccagatgtgacctgtcacagcagagtgggggtcatcctgtgggtcagctcatgggtggccccagtgagggctgtccccaccacacccaccgccccagagagtggaggctggcaccagggctgtctgacct

SEQ ID NO: 314769 - DNA, 796 bp, Homo sapiens
cttcccatgggtgttggtcatccttctcttctctaagacagattgggactggccaggacccgactgttctcttcgcctcaagctccctggcgagtggcctgttgcacagggttagggccacctgggaggggcaggagaggaaggaagccttgccttcctggaagtggtcatgggctgtggtccaggattctggctcagagttgcaccactgggttttatattcacttggatctttagttgttttggcgcctactgaggtctgaagtttgaatcctgcagtcaattgggatggtggcttgtaccccaaagtgccattgcaacccttgtccttcctgaggaaagggtggcagttgccctgtggaattcctgccctgctccccgtgggtgtccaggctgacagaagttgggactgtgtctggctggccgtaggagaaggagtgttcagtggtgcgccgtatcccaacccgaggccacaaaatgcttccaatggcaaaggaatatgagaaaagtgcgtggccctcctgtcagctgcataaagagagactcccccatccagtgtatccaggccattgcggtgagtcaatgccgggtgttggttgggaccaagctgaatggaagggagagagaaatggaaaaagatagaacacgagctctccttacttcctctgccattggaagcattttgtggcctcgggttgggatacggcgcaccactgaacactccttctcctacggccagccagacacagtcctgggagaggtcgacgcggccgcgaatttagtagtagtaggcggc

SEQ ID NO: 314770 - DNA, 401 bp, Homo sapiens
aaggagaagctgatgccatgagtttggatggaggatatgtgtacactgcaggcaaatgtggtttggtgcctgtcctggcagagaactacagtaagtggagttagcatcctctggtatattccctctgggtcatgggagtggggctatgagtaatcccattcggtgaatgcaggtgaaacattatgatgaacagatacattcaaaagggagaatcagggaaagaagaaatgaaaggggccgtgttacccacaaagcctattgtgttgagaattaacaagggacaggttggttttatcttcttaattttccagaagatctcagtgaattataacatacaaacagaaaagtgcacataaatgtacaactcatggcacttcacacactgtacagtccatgctctc

SEQ ID NO: 314771 - DNA, 2786 bp, Homo sapiens
gaattccggctagaaatgaatatgtaagaaagcttatagtagtttaaatcatttgtagaaccagccgagtttcttgccaagtcgcctccagaccgcagacatgaaacttgtcttcctcgtcctgctgttcctcggggccctcggactgtgtctggctggccgtaggagaaggagtgttcagtggtgcgccgtatcccaacccgaggccacaaaatgcttccaatggcaaaggaatatgagaaaagtgcgtggccctcctgtcagctgcataaagagagactcccccatccagtgtatccaggccattgcggaaaacagggccgatgctgtgacccttgatggtggtttcatatacgaggcaggcctggccccctacaaactgcgacctgtagcggcggaagtctacgggaccgaaagacagccacgaactcactattatgccgtggctgtggtgaagaagggcggcagctttcagctgaacgaactgcaaggtctgaagtcctgccacacaggccttcgcaggaccgctggatggaatgtccctatagggacacttcgtccattcttgaattggacgggtccacctgagcccattgaggcagctgtggccaggttcttctcagccagctgtgttcccggtgcagataaaggacagttccccaacctgtgtcgcctgtgtgcggggacaggggaaaacaaatgtgccttctcctcccaggaaccgtacttcagctactctggtgccttcaagtgtctgagagacggggctggagacgtggcttttatcagagagagcacagtgtttgaggacctgtcagacgaggctgaaagggacgagtatgagttactctgcccagacaacactcggaagccagtggacaagttcaaagactgccatctggcccgggtcccttctcatgccgttgtggcacgaagtgtgaatggcaaggaggatgccatctggaatcttctccgccaggcacaggaaaagtttggaaaggacaagtcaccgaaattccagctctttggctcccctagtgggcagaaagatctgctgttcaaggactctgccattgggttttcgagggtgcccccgaggatagattctgggctgtaccttggctccggctacttcactgccatccagaacttgaggaaaagtgaggaggaagtggctgcccggcgtgcgcgggtcgtgtggtgtgcggtgggcgagcaggagctgcgcaagtgtaaccagtggagtggcttgagcgaaggcagcgtgacctgctcctcggcctccaccacagaggactgcatcgccctggtgctgaaaggagaagctgatgccatgagtttggatggaggatatgtgtacactgcaggcaaatgtggtttggtgcctgtcctggcagagaactacaaatcccaacaaagcagtgaccctgatcctaactgtgtggatagacctgtggaaggatatcttgctgtggcggtggttaggagatcagacactagccttacctggaactctgtgaaaggcaagaagtcctgccacaccgccgtggacaggactgcaggctggaatatccccatgggcctgctcttcaaccagacgggctcctgcaaatttgatgaatatttcagtcaaagctgtgcccctgggtctgacccgagatctaatctctgtgctctgtgtattggcgacgagcagggtgagaataagtgcgtgcccaacagcaacgagagatactacggctacactggggctttccggtgcctggctgagaatgctggagacgttgcatttgtgaaagatgtcactgtcttgcagaacactgatggaaataacaatgaggcatgggctaaggatttgaagctggcagactttgcgctgctgtgcctcgatggcaaacggaagcctgtgactgaggctagaagctgccatcttgccatggccccgaatcatgccgtggtgtctcggatggataaggtggaacgcctgaaacaggtgttgctccaccaacaggctaaatttgggagaaatggatctgactgcccggacaagttttgcttattccagtctgaaaccaaaaaccttctgttcaatgacaacactgagtgtctggccagactccatggcaaaacaacatatgaaaaatatttgggaccacagtatgtcgcaggcattactaatctgaaaaagtgctcaacctcccccctcctggaagcctgtgaattcctcaggaagtaaaaccgaagaagatggcccagctccccaagaaagcctcagccattcactgcccccagctcttctccccaggtgtgttggggccttggcctcccctgctgaaggtggggattgcccatccatctgcttacaattccctgctgtcgtcttagcaagaagtaaaatgagaaattttgttgatattctctccttaaaaagtgtcactcatcttttctagaattttatactgaaatcacatgcctgacaaaatacctgtacagttggaccttcccttccaagtttttcaggtccagcccctcctctttcttgcagtcttgggtatgatgcccaagggtctggaatttaaggccaggccaagcaccggttttcctaaggggatcttgttggttattcacatagctgtctcagtgcacgtgcatgtatgtgcctgggagtgtgtgcgtgtccccaaggcagggcaggaagaacaagcataggaattataactgaaatgtaggttcagttgctcatcacttgcagagtctaattaacaagagctaggtttggtataaag

SEQ ID NO: 314772 - DNA, 847 bp, Homo sapiens
  misc_feature (833)..(833): n is a, c, g, or t
  misc_feature (846)..(847): n is a, c, g, or t
ttctctccccaccacaccccacactcatcctagtcagcatcagccacaccctgcctgctgtgggccccgtggcatggtgtgtagcacatcctcaatgtgactcccttcttgtatgggcgtctcctagggcaggggctccactgcatgggtttttgatcctggccggggcaggcagctttcacgtggctctgctcctcaccagctccatggcagcctctgagctgtagggaaactgccaggatggaatgggaactcccagcttttcctgaggttgacacatagtgtggctcttccagcagcagtgggagtctgataatgggtgacgtttgctcagtggggcagagctttcttgtcacctttgtttattctttcttgggttaaatcacacaatgaacgaattcagatcaggttcagctgcaaggaacagaaaactcctgaaatagtagaggcttaaacaagacagaagttaatttctgtgtcatgtagtccagaggtggtttgcctagggctggtatgaagacaatatggggtctggaacctgggctttaatcatttggctactctgccatttgtgtggctttcatgctcaaggtcacctcatggcccacattgcatctctaagtccagtccctgcttctgcattctatgtgcaggatgaagaaagagaaggagaagaaagggcaaaaggcatgtaccaattgtctttcaaggatgtttctgagaagctggcgcccaacactcctgctgatatttcactggcctatagctacccatatggccatatgagccccagggagtctgataagtctagtctttataccaaaggaggtccncgggttggtggann

SEQ ID NO: 314773 - DNA, 2736 bp, Homo sapiens
gtggtacggcccggaatttagggatgccaagtcgcctccagaccgcagacatgaaacttgtcttcctcgtcctgctgttcctcggggccctcggactgtgtctggctggccgtaggagaaggagtgttcagtggtgcgccgtatcccaacccgaggccacaaaatgcttccaatggcaaaggaatatgagaaaagtgcgtggccctcctgtcagctgcataaagagagactcccccatccagtgtatccaggccattgcggaaaacagggccgatgctgtgacccttgatggtggtttcatatacgaggcaggcctggccccctacaaactgcgacctgtagcggcggaagtctacgggaccgaaagacagccacgaactcactattatgccgtggctgtggtgaagaagggcggcagctttcagctgaacgaactgcaaggtctgaagtcctgccacacaggccttcgcaggaccgctggatggaatgtccctatagggacacttcgtccattcttgaattggacgggtccacctgagcccattgaggcagctgtggccaggttcttctcagccagctgtgttcccggtgcagataaaggacagttccccaacctgtgtcgcctgtgtgcggggacaggggaaaacaaatgtgccttctcctcccaggaaccgtacttcagctactctggtgccttcaagtgtctgagagacggggctggagacgtggcttttatcagagagagcacagtgtttgaggacctgtcagacgaggctgaaagggacgagtatgagttactctgcccagacaacactcggaagccagtggacaagttcaaagactgccatctggcccgggtcccttctcatgccgttgtggcacgaagtgtgaatggcaaggaggatgccatctggaatcttctccgccaggcacaggaaaagtttggaaaggacaagtcaccgaaattccagctctttggctcccctagtgggcagaaagatctgctgttcaaggactctgccattgggttttcgagggtgcccccgaggatagattctgggctgtaccttggctccggctacttcactgccatccagaacttgaggaaaagtgaggaggaagtggctgcccggcgtgcgcgggtcgtgtggtgtgcggtgggcgagcaggagctgcgcaagtgtaaccagtggagtggcttgagcgaaggcagcgtgacctgctcctcggcctccaccacagaggactgcatcgccctggtgctgaaaggagaagctgatgccatgagtttggatggaggatatgtgtacactgcaggcaaatgtggtttggtgcctgtcctggcagagaactacaaatcccaacaaagcagtgaccctgatcctaactgtgtggatagacctgtggaaggatatcttgctgtggcggtggttaggagatcagacactagccttacctggaactctgtgaaaggcaagaagtcctgccacaccgccgtggacaggactgcaggctggaatatccccatgggcctgctcttcaaccagacgggctcctgcaaatttgatgaatatttcagtcaaagctgtgcccctgggtctgacccgagatctaatctctgtgctctgtgtattggcgacgagcagggtgagaataagtgcgtgcccaacagcaacgagagatactacggctacactggggctttccggtgcctggctgagaatgctggagacgttgcatttgtgaaagatgtcactgtcttgcagaacactgatggaaataacaatgaggcatgggctaaggatttgaagctggcagactttgcgctgctgtgcctcgatggcaaacggaagcctgtgactgaggctagaagctgccatcttgccatggccccgaatcatgccgtggtgtctcggatggataaggtggaacgcctgaaacaggtgttgctccaccaacaggctaaatttgggagaaatggatctgactgcccggacaagttttgcttattccagtctgaaaccaaaaaccttctgttcaatgacaacactgagtgtctggccagactccatggcaaaacaacatatgaaaaatatttgggaccacagtatgtcgcaggcattactaatctgaaaaagtgctcaacctcccccctcctggaagcctgtgaattcctcaggaagtaaaaccgaagaagatggcccagctccccaagaaagcctcagccattcactgcccccagctcttctccccaggtgtgttggggccttggcctcccctgctgaaggtggggattgcccatccatctgcttacaattccctgctgtcgtcttagcaagaagtaaaatgagaaattttgttgatattctctccttaaaaagtgtcactcatcttttctagaattttatactgaaatcacatgcctgacaaaatacctgtacagttggaccttcccttccaagtttttcaggtccagcccctcctctttcttgcagtcttgggtatgatgcccaagggtctggaatttaaggccaggccaagcaccggttttcctaaggggatcttgttggttattcacatagctgtctcagtgcacgtgcatgtatgtgcctgggagtgtgtgcgtgtccccaaggcagggcaggaagaacaagcataggaattataactgaaatgtaggttcagttgctcatcacttgcagagtctaattaacaagagctaggtttggtataaag

SEQ ID NO: 314774 - DNA, 2688 bp, Homo sapiens
cgaccacgcgtccgccctcgtcctgctgttcctcggggccctcgggactgtgtctggctggccgtaggagaaggagtgttcagtggtgcgccgtatcccaacccgaggccacaaaatgcttccaatggcaaaggaatatgagaaaagtgcgtggccctcctgtcagctgcataaagagagactcccccatccagtgtatccaggccattgcggaaaacagggccgatgctgtgacccttgatggtggtttcatatacgaggcaggcctggccccctacaaactgcgacctgtagcggcggaagtctacgggaccgaaagacagccacgaactcactattatgccgtggctgtggtgaagaagggcggcagctttcagctgaacgaactgcaaggtctgaagtcctgccacacaggccttcgcaggaccgctggatggaatgtccctatagggacacttcgtccattcttgaattggacgggtccacctgagcccattgaggcagctgtggccaggttcttctcagccagctgtgttcccggtgcagataaaggacagttccccaacctgtgtcgcctgtgtgcggggacaggggaaaacaaatgtgccttctcctcccaggaaccgtacttcagctactctggtgccttcaagtgtctgagagacggggctggagacgtggcttttatcagagagagcacagtgtttgaggacctgtcagacgaggctgaaagggacgagtatgagttactctgcccagacaacactcggaagccagtggacaagttcaaagactgccatctggcccgggtcccttctcatgccgttgtggcacgaagtgtgaatggcaaggaggatgccatctggaatcttctccgccaggcacaggaaaagtttggaaaggacaagtcaccgaaattccagctctttggctcccctagtgggcagaaagatctgctgttcaaggactctgccattgggttttcgagggtgcccccgaggatagattctgggctgtaccttggctccggctacttcactgccatccagaacttgaggaaaagtgaggaggaagtggctgcccggcgtgcgcgggtcgtgtggtgtgcggtgggcgagcaggagctgcgcaagtgtaaccagtggagtggcttgagcgaaggcagcgtgacctgctcctcggcctccaccacagaggactgcatcgccctggtgctgaaaggagaagctgatgccatgagtttggatggaggatatgtgtacactgcaggcaaatgtggtttggtgcctgtcctggcagagaactacaaatcccaacaaagcagtgaccctgatcctaactgtgtggatagacctgtggaaggatatcttgctgtggcggtggttaggagatcagacactagccttacctggaactctgtgaaaggcaagaagtcctgccacaccgccgtggacaggactgcaggctggaatatccccatgggcctgctcttcaaccagacgggctcctgcaaatttgatgaatatttcagtcaaagctgtgcccctgggtctgacccgagatctaatctctgtgctctgtgtattggcgacgagcagggtgagaataagtgcgtgcccaacagcaacgagagatactacggctacactggggctttccggtgcctggctgagaatgctggagacgttgcatttgtgaaagatgtcactgtcttgcagaacactgatggaaataacaatgaggcatgggctaaggatttgaagctggcagactttgcgctgctgtgcctcgatggcaaacggaagcctgtgactgaggctagaagctgccatcttgccatggccccgaatcatgccgtggtgtctcggatggataaggtggaacgcctgaaacaggtgttgctccaccaacaggctaaatttgggagaaatggatctgactgcccggacaagttttgcttattccagtctgaaaccaaaaaccttctgttcaatgacaacactgagtgtctggccagactccatggcaaaacaacatatgaaaaatatttgggaccacagtatgtcgcaggcattactaatctgaaaaagtgctcaacctcccccctcctggaagcctgtgaattcctcaggaagtaaaaccgaagaagatggcccagctccccaagaaagcctcagccattcactgcccccagctcttctccccaggtgtgttggggccttggcctcccctgctgaaggtggggattgcccatccatctgcttacaattccctgctgtcgtcttagcaagaagtaaaatgagaaattttgttgatattctctccttaaaaagtgtcactcatcttttctagaattttatactgaaatcacatgcctgacaaaatacctgtacagttggaccttcccttccaagtttttcaggtccagcccctcctctttcttgcagtcttgggtatgatgcccaagggtctggaatttaaggccaggccaagcaccggttttcctaaggggatcttgttggttattcacatagctgtctcagtgcacgtgcatgtatgtgcctgggagtgtgtgcgtgtccccaaggcagggcaggaagaacaagcataggaattataactgaaatgtaggttcagttgctcatcacttgcagagtctaattaacaagagctaggtttggtataaag

SEQ ID NO: 314775 - DNA, 3852 bp, Homo sapiens
gactcctaggggcttgcagacctagtgggagagaaagaacatcgcagcagccaggcagaaccaggacaggtgaggtgcaggctggctttcctctcgcagcgcggtgtggagtcctgtcctgcctcagggcttttcggagcctggatcctcaaggaacaagtagacctggccgcggggagtggggagggaaggggtgtctattgggcaacagggcggcaaagccctgaataaaggggcgcagggcaggcgcaagtgcagagccttcgtttgccaagtcgcctccagaccgcagacatgaaacttgtcttcctcgtcctgctgttcctcggggccctcggactgtgtctggctggccgtaggagaaggagtgttcagtggtgcgccgtatcccaacccgaggccacaaaatgcttccaatggcaaaggaatatgagaaaagtgcgtggccctcctgtcagctgcataaagagagactcccccatccagtgtatccaggccattgcggaaaacagggccgatgctgtgacccttgatggtggtttcatatacgaggcaggcctggccccctacaaactgcgacctgtagcggcggaagtctacgggaccgaaagacagccacgaactcactattatgccgtggctgtggtgaagaagggcggcagctttcagctgaacgaactgcaaggtctgaagtcctgccacacaggccttcgcaggaccgctggatggaatgtccctatagggacacttcgtccattcttgaattggacgggtccacctgagcccattgaggcagctgtggccaggttcttctcagccagctgtgttcccggtgcagataaaggacagttccccaacctgtgtcgcctgtgtgcggggacaggggaaaacaaatgtgccttctcctcccaggaaccgtacttcagctactctggtgccttcaagtgtctgagagacggggctggagacgtggcttttatcagagagagcacagtgtttgaggacctgtcagacgaggctgaaagggacgagtatgagttactctgcccagacaacactcggaagccagtggacaagttcaaagactgccatctggcccgggtcccttctcatgccgttgtggcacgaagtgtgaatggcaaggaggatgccatctggaatcttctccgccaggcacaggaaaagtttggaaaggacaagtcaccgaaattccagctctttggctcccctagtgggcagaaagatctgctgttcaaggactctgccattgggttttcgagggtgcccccgaggatagattctgggctgtaccttggctccggctacttcactgccatccagaacttgaggaaaagtgaggaggaagtggctgcccggcgtgcgcgggtcgtgtggtgtgcggtgggcgagcaggagctgcgcaagtgtaaccagtggagtggcttgagcgaaggcagcgtgacctgctcctcggcctccaccacagaggactgcatcgccctggtgctgaaaggagaagctgatgccatgagtttggatggaggatatgtgtacactgcaggcaaatgtggtttggtgcctgtcctggcagagaactacaaatcccaacaaagcagtgaccctgatcctaactgtgtggatagacctgtggaaggatatcttgctgtggcggtggttaggagatcagacactagccttacctggaactctgtgaaaggcaagaagtcctgccacaccgccgtggacaggactgcaggctggaatatccccatgggcctgctcttcaaccagacgggctcctgcaaatttgatgaatatttcagtcaaagctgtgcccctgggtctgacccgagatctaatctctgtgctctgtgtattggcgacgagcagggtgagaataagtgcgtgcccaacagcaacgagagatactacggctacactggggctttccggtgcctggctgagaatgctggagacgttgcatttgtgaaagatgtcactgtcttgcagaacactgatggaaataacaatgaggcatgggctaaggatttgaagctggcagactttgcgctgctgtgcctcgatggcaaacggaagcctgtgactgaggctagaagctgccatcttgccatggccccgaatcatgccgtggtgtctcggatggataaggtggaacgcctgaaacaggtgttgctccaccaacaggctaaatttgggagaaatggatctgactgcccggacaagttttgcttattccagtctgaaaccaaaaaccttctgttcaatgacaacactgagtgtctggccagactccatggcaaaacaacatatgaaaaatatttgggaccacagtatgtcgcaggcattactaatctgaaaaagtgctcaacctcccccctcctggaagcctgtgaattcctcaggaagtaaaaccgaagaagatggcccagctccccaagaaagcctcagccattcactgcccccagctcttctccccaggtgtgttggggccttggcctcccctgctgaaggtggggattgcccatccatctgcttacaattccctgctgtcgtcttagcaagaagtaaaatgagaaattttgttgatataaaaaaaaacaaaaaaaaaaaaaaaaaaaaaaaaaaaaaaaaaaagggggggggggggccaaaatttccccgcagagggcgccacaaggtttgacgcgtctaccccacggtttctatcgtgaacaagaggggggccccataatagggaggaccgtaatacatgaggcaaaggagcagcggagccagcagtaataaaaaaacagcgcatcgagagagtggggaacaaatcgcgtgcagcacagcggaactctgaggagaagacggagaccccctactcaccgcggggggggggcgcaagccaatatagtgggcggacaccacccctatccactcaccgaggacagatattaaacaacgcacccccagaggggggtagcaaccaataattaaacaagcttcgaacagagagagcgctatatgacggggcgggcccaaccaccaacgcacgagagcaatatagtcgcggccggccaggctaggagaaaacgttgctgagcgccccccacagcgcgggagatattgatgagatgtaaggagacaacatcaatatattcacacgcccggggaggcctctctaccacattaaataaaccgagagccaggccgagaacgacgatcgacgagaaacacagacaacacatgcaagacagagagcaagcaaagccaaccactgcgacacgacgagacagccaagaaggaggcgagcaaaaaccgacccgaacaagacaccagacagagggagaggggagagaggcgcgaggagaggaggagggcgagagaggaaggacgaacagaacaaagagacagaaggcaggcaagtaaagacagaaaaggaagaaagaggcagacaggaggagtactaagaagaacaaaggaagagaagaaaaatggcaacgacggagccggagagagaagcaaacaaacgagaacaccagcagacgacaagcgagcggagccacagacacacgaagaagacaacaagacggagaagagcaacgagagtaagcgagagcaagggacaagaaagacaagcagaaggagaaggtcaagacagagaaaagacgaacacacaagacagagcggcaggaagacacggagacacaaaagagcagaagacacgcaacagacccgccgaggaggagagcgaacagcaatgagcagccacagaaaaaggaacgaaaaagcgagagaagcacccgagacagagaagagaaagcagtgcgcaaacaacagacgaagagc

SEQ ID NO: 314776 - DNA, 2064 bp, Homo sapiens
  misc_feature (5)..(5): n is a, c, g, or t
tagantcgagctcggtaccagattccctgtgtctgagagacggggctggagacgtggcttttatcagagagagcacagtgtttgaggacctgtcagacgaggctgaaagggacgagtatgagttactctgcccagacaacactcggaagccagtggacaagttcaaagactgccatctggcccgggtcccttctcatgccgttgtggcacgaagtgtgaatggcaaggaggatgccatctggaatcttctccgccaggcacaggaaaagtttggaaaggacaagtcaccgaaattccagctctttggctcccctagtgggcagaaagatctgctgttcaaggactctgccattgggttttcgagggtgcccccgaggatagattctgggctgtaccttggctccggctacttcactgccatccagaacttgaggaaaagtgaggaggaagtggctgcccggcgtgcgcgggtcgtgtggtgtgcggtgggcgagcaggagctgcgcaagtgtaaccagtggagtggcttgagcgaaggcagcgtgacctgctcctcggcctccaccacagaggactgcatcgccctggtgctgaaaggagaagctgatgccatgagtttggatggaggatatgtgtacactgcaggcaaatgtggtttggtgcctgtcctggcagagaactacaaatcccaacaaagcagtgaccctgatcctaactgtgtggatagacctgtggaaggatatcttgctgtggcggtggttaggagatcagacactagccttacctggaactctgtgaaaggcaagaagtcctgccacaccgccgtggacaggactgcaggctggaatatccccatgggcctgctcttcaaccagacgggctcctgcaaatttgatgaatatttcagtcaaagctgtgcccctgggtctgacccgagatctaatctctgtgctctgtgtattggcgacgagcagggtgagaataagtgcgtgcccaacagcaacgagagatactacggctacactggggctttccggtgcctggctgagaatgctggagacgttgcatttgtgaaagatgtcactgtcttgcagaacactgatggaaataacaatgaggcatgggctaaggatttgaagctggcagactttgcgctgctgtgcctcgatggcaaacggaagcctgtgactgaggctagaagctgccatcttgccatggccccgaatcatgccgtggtgtctcggatggataaggtggaacgcctgaaacaggtgttgctccaccaacaggctaaatttgggagaaatggatctgactgcccggacaagttttgcttattccagtctgaaaccaaaaaccttctgttcaatgacaacactgagtgtctggccagactccatggcaaaacaacatatgaaaaatatttgggaccacagtatgtcgcaggcattactaatctgaaaaagtgctcaacctcccccctcctggaagcctgtgaattcctcaggaagtaaaaccgaagaagatggcccagctccccaagaaagcctcagccattcactgcccccagctcttctccccaggtgtgttggggccttggcctcccctgctgaaggtggggattgcccatccatctgcttacaattccctgctgtcgtcttagcaagaagtaaaatgagaaattttgttgatattctctccttaaaaagtgtcactcatcttttctagaattttatactgaaatcacatgcctgacaaaatacctgtacagttggaccttcccttccaagtttttcaggtccagcccctcctctttcttgcagtcttgggtatgatgcccaagggtctggaatttaaggccaggccaagcaccggttttcctaaggggatcttgttggttattcacatagctgtctcagtgcacgtgcatgtatgtgcctgggagtgtgtgcgtgtccccaaggcagggcaggaagaacaagcataggaattataactgaaatgtaggttcagttgctcatcacttgcagagtctaattaacaagagctaggtttggtataaag

SEQ ID NO: 314777 - DNA, 2555 bp, Homo sapiens
gactcctaggggcttgcagacctagtgggagagaaagaacatcgcagcagccaggcagaaccaggacaggtgaggtgcaggctggctttcctctcgcagcgcggtgtggagtcctgtcctgcctcagggcttttcggagcctggatcctcaaggaacaagtagacctggccgcggggagtggggagggaaggggtgtctattgggcaacagggcggcaaagccctgaataaaggggcgcagggcaggcgcaagtgcagagccttcgtttgccaagtcgcctccagaccgcagacatgaaacttgtcttcctcgtcctgctgttcctcggggccctcggactgtgtctggctggccgtaggagaaggagtgttcagtggtgcgccgtatcccaacccgaggccacaaaatgcttccaatggcaaaggaatatgagaaaagtgcgtggccctcctgtcagctgcataaagagagactcccccatccagtgtatccaggccattgcggaaaacagggccgatgctgtgacccttgatggtggtttcatatacgaggcaggcctggccccctacaaactgcgacctgtagcggcggaagtctacgggaccgaaagacagccacgaactcactattatgccgtggctgtggtgaagaagggcggcagctttcagctgaacgaactgcaaggtctgaagtcctgccacacaggccttcgcaggaccgctggatggaatgtccctatagggacacttcgtccattcttgaattggacgggtccacctgagcccattgaggcagctgtggccaggttcttctcagccagctgtgttcccggtgcagataaaggacagttccccaacctgtgtcgcctgtgtgcggggacaggggaaaacaaatgtgccttctcctcccaggaaccgtacttcagctactctggtgccttcaagtgtctgagagacggggctggagacgtggcttttatcagagagagcacagtgtttgaggacctgtcagacgaggctgaaagggacgagtatgagttactctgcccagacaacactcggaagccagtggacaagttcaaagactgccatctggcccgggtcccttctcatgccgttgtggcacgaagtgtgaatggcaaggaggatgccatctggaatcttctccgccaggcacaggaaaagtttggaaaggacaagtcaccgaaattccagctctttggctcccctagtgggcagaaagatctgctgttcaaggactctgccattgggttttcgagggtgcccccgaggatagattctgggctgtaccttggctccggctacttcactgccatccagaacttgaggaaaagtgaggaggaagtggctgcccggcgtgcgcgggtcgtgtggtgtgcggtgggcgagcaggagctgcgcaagtgtaaccagtggagtggcttgagcgaaggcagcgtgacctgctcctcggcctccaccacagaggactgcatcgccctggtgctgaaaggagaagctgatgccatgagtttggatggaggatatgtgtacactgcaggcaaatgtggtttggtgcctgtcctggcagagaactacaaatcccaacaaagcagtgaccctgatcctaactgtgtggatagacctgtggaaggatatcttgctgtggcggtggttaggagatcagacactagccttacctggaactctgtgaaaggcaagaagtcctgccacaccgccgtggacaggactgcaggctggaatatccccatgggcctgctcttcaaccagacgggctcctgcaaatttgatgaatatttcagtcaaagctgtgcccctgggtctgacccgagatctaatctctgtgctctgtgtattggcgacgagcagggtgagaataagtgcgtgcccaacagcaacgagagatactacggctacactggggctttccggtgcctggctgagaatgctggagacgttgcatttgtgaaagatgtcactgtcttgcagaacactgatggaaataacaatgaggcatgggctaaggatttgaagctggcagactttgcgctgctgtgcctcgatggcaaacggaagcctgtgactgaggctagaagctgccatcttgccatggccccgaatcatgccgtggtgtctcggatggataaggtggaacgcctgaaacaggtgttgctccaccaacaggctaaatttgggagaaatggatctgactgcccggacaagttttgcttattccagtctgaaaccaaaaaccttctgttcaatgacaacactgagtgtctggccagactccatggcaaaacaacatatgaaaaatatttgggaccacagtatgtcgcaggcattactaatctgaaaaagtgctcaacctcccccctcctggaagcctgtgaattcctcaggaagtaaaaccgaagaagatggcccagctccccaagaaagcctcagccattcactgcccccagctcttctccccgtatccacagacctcatcccactgaagatggatactgcccagcatcaacccacaacca

SEQ ID NO: 314778 - DNA, 1795 bp, Homo sapiens
tgtgtcctcagtcagtgagactgctccaggaaggtgtccccaaagtgccagggacacagaaaaggttttgctcagaggacagaggattagtgcaacctgtgcctggtctttccagttgaattgacagcccagaaagtaggcagggctgggagagaattagtggtgcacacggtgtttcctctggctgctcagtttgaatagtccatctctttctgctgtttcactggtcacctgacagaaaaccattctctcagagagctatatagacaggcaggacgggatgcagcctcactgtggtgctggagatctgctctgtctttgcagaaaggagaagctgatgccatgagtttggatggaggatatgtgtacactgcaggcaaatgtggtttggtgcctgtcctggcagagaactacaaatcccaacaaagcagtgaccctgatcctaactgtgtggatagacctgtggaaggatatcttgctgtggcggtggttaggagatcagacactagccttacctggaactctgtgaaaggcaagaagtcctgccacaccgccgtggacaggactgcaggctggaatatccccatgggcctgctcttcaaccagacgggctcctgcaaatttgatgaatatttcagtcaaagctgtgcccctgggtctgacccgagatctaatctctgtgctctgtgtattggcgacgagcagggtgagaataagtgcgtgcccaacagcaacgagagatactacggctacactggggctttccggtgcctggctgagaatgctggagacgttgcatttgtgaaagatgtcactgtcttgcagaacactgatggaaataacaatgaggcatgggctaaggatttgaagctggcagactttgcgctgctgtgcctcgatggcaaacggaagcctgtgactgaggctagaagctgccatcttgccatggccccgaatcatgccgtggtgtctcggatggataaggtggaacgcctgaaacaggtgttgctccaccaacaggctaaatttgggagaaatggatctgactgcccggacaagttttgcttattccagtctgaaaccaaaaaccttctgttcaatgacaacactgagtgtctggccagactccatggcaaaacaacatatgaaaaatatttgggaccacagtatgtcgcaggcattactaatctgaaaaagtgctcaacctcccccctcctggaagcctgtgaattcctcaggaagtaaaaccgaagaagatggcccagctccccaagaaagcctcagccattcactgcccccagctcttctccccaggtgtgttggggccttggcctcccctgctgaaggtggggattgcccatccatctgcttacaattccctgctgtcgtcttagcaagaagtaaaatgagaaattttgttgatattctctccttaaaaagtgtcactcatcttttctagaattttatactgaaatcacatgcctgacaaaatacctgtacagttggaccttcccttccaagtttttcaggtccagcccctcctctttcttgcagtcttgggtatgatgcccaagggtctggaatttaaggccaggccaagcaccggttttcctaaggggatcttgttggttattcacatagctgtctcagtgcacgtgcatgtatgtgcctgggagtgtgtgcgtgtccccaaggcagggcaggaagaacaagcataggaattataactgaaatgtaggttcagttgctcatcacttgcagagtctaattaacaagagctaggtttggtataaag

SEQ ID NO: 314779 - DNA, 2391 bp, Homo sapiens
ttctctccccaccacaccccacactcatcctagtcagcatcagccacaccctgcctgctgtgggccccgtggcatggtgtgtagcacatcctcaatgtgactcccttcttgtatgggcgtctcctagggcaggggctccactgcatgggtttttgatcctggccggggcaggcagctttcacgtggctctgctcctcaccagctccatggcagcctctgagctgtagggaaactgccaggatggaatgggaactcccagcttttcctgaggttgacacatagtgtggctcttccagcagcagtgggagtctgataatgggtgacgtttgctcagtggggcagagctttcttgtcacctttgtttattctttcttgggttaaatcacacaatgaacgaattcagatcaggttcagctgcaaggaacagaaaactcctgaaatagtagaggcttaaacaagacagaagttaatttctgtgtcatgtagtccagaggtggtttgcctagggctggtatgaagacaatatggggtctggaacctgggctttaatcatttggctactctgccatttgtgtggctttcatgctcaaggtcacctcatggcccacattgcatctctaagtccagtccctgcttctgcattctatgtgcaggatgaagaaagagaaggagaagaaagggcaaaaggcatgtaccaattgtctttcaaggatgtttctgagaagctggcgcccaacactcctgctgatatttcactggcctatagctacccatatggccatatgagccccagggagtctgataagtctagtctttataccaaagggccaagcacccagatacaaagcagggtttccattactgataaaaacaaaatcagatcctggactaggcaactcacaggctctgctgcacacagccatcacggtcatgagctgagtccccagctcaaggctgtgatgacgggaccctccaggcagccacagctctcatccccagccttagttgggtgtccatctgtgcctacagtctgaatgaagcttttctggtgggtcctatgttggtgacaacatgttgctttgtgatggtgagtgtgttctatctagattgctgtcctgggaagtctaatgaactgaaaccaccctgcatcggctgttaggtaaaggttgcttgtgtggactcaggtttgaagagctgactccccgtgttccttctctccagatgaatatttcagtcaaagctgtgcccctgggtctgacccgagatctaatctctgtgctctgtgtattggcgacgagcagggtgagaataagtgcgtgcccaacagcaacgagagatactacggctacactggggctttccggtgcctggctgagaatgctggagacgttgcatttgtgaaagatgtcactgtcttgcagaacactgatggaaataacaatgaggcatgggctaaggatttgaagctggcagactttgcgctgctgtgcctcgatggcaaacggaagcctgtgactgaggctagaagctgccatcttgccatggccccgaatcatgccgtggtgtctcggatggataaggtggaacgcctgaaacaggtgttgctccaccaacaggctaaatttgggagaaatggatctgactgcccggacaagttttgcttattccagtctgaaaccaaaaaccttctgttcaatgacaacactgagtgtctggccagactccatggcaaaacaacatatgaaaaatatttgggaccacagtatgtcgcaggcattactaatctgaaaaagtgctcaacctcccccctcctggaagcctgtgaattcctcaggaagtaaaaccgaagaagatggcccagctccccaagaaagcctcagccattcactgcccccagctcttctccccaggtgtgttggggccttggcctcccctgctgaaggtggggattgcccatccatctgcttacaattccctgctgtcgtcttagcaagaagtaaaatgagaaattttgttgatattctctccttaaaaagtgtcactcatcttttctagaattttatactgaaatcacatgcctgacaaaatacctgtacagttggaccttcccttccaagtttttcaggtccagcccctcctctttcttgcagtcttgggtatgatgcccaagggtctggaatttaaggccaggccaagcaccggttttcctaaggggatcttgttggttattcacatagctgtctcagtgcacgtgcatgtatgtgcctgggagtgtgtgcgtgtccccaaggcagggcaggaagaacaagcataggaattataactgaaatgtaggttcagttgctcatcacttgcagagtctaattaacaagagctaggtttggtataaag

SEQ ID NO: 314780 - DNA, 2168 bp, Homo sapiens
gactcctaggggcttgcagacctagtgggagagaaagaacatcgcagcagccaggcagaaccaggacaggtgaggtgcaggctggctttcctctcgcagcgcggtgtggagtcctgtcctgcctcagggcttttcggagcctggatcctcaaggaacaagtagacctggccgcggggagtggggagggaaggggtgtctattgggcaacagggcggcaaagccctgaataaaggggcgcagggcaggcgcaagtgcagagccttcgtttgccaagtcgcctccagaccgcagacatgaaacttgtcttcctcgtcctgctgttcctcggggccctcggactgtgtctggctggccgtaggagaaggagtgttcagtggtgcgccgtatcccaacccgaggccacaaaatgcttccaatggcaaaggaatatgagaaaagtgcgtggccctcctgtcagctgcataaagagagactcccccatccagtgtatccaggccattgcggaaaacagggccgatgctgtgacccttgatggtggtttcatatacgaggcaggcctggccccctacaaactgcgacctgtagcggcggaagtctacgggaccgaaagacagccacgaactcactattatgccgtggctgtggtgaagaagggcggcagctttcagctgaacgaactgcaaggtctgaagtcctgccacacaggccttcgcaggaccgctggatggaatgtccctatagggacacttcgtccattcttgaattggacgggtccacctgagcccattgaggcagctgtggccaggttcttctcagccagctgtgttcccggtgcagataaaggacagttccccaacctgtgtcgcctgtgtgcggggacaggggaaaacaaatgtgccttctcctcccaggaaccgtacttcagctactctggtgccttcaagtgtctgagagacggggctggagacgtggcttttatcagagagagcacagtgtttgaggacctgtcagacgaggctgaaagggacgagtatgagttactctgcccagacaacactcggaagccagtggacaagttcaaagactgccatctggcccgggtcccttctcatgccgttgtggcacgaagtgtgaatggcaaggaggatgccatctggaatcttctccgccaggcacaggaaaagtttggaaaggacaagtcaccgaaattccagctctttggctcccctagtgggcagaaagatctgctgttcaaggactctgccattgggttttcgagggtgcccccgaggatagattctgggctgtaccttggctccggctacttcactgccatccagaacttgaggaaaagtgaggaggaagtggctgcccggcgtgcgcgggtcgtgtggtgtgcggtgggcgagcaggagctgcgcaagtgtaaccagtggagtggcttgagcgaaggcagcgtgacctgctcctcggcctccaccacagaggactgcatcgccctggtgctgaaaggagaagctgatgccatgagtttggatggaggatatgtgtacactgcaggcaaatgtggtttggtgcctgtcctggcagagaactacaaatcccaacaaagcagtgaccctgatcctaactgtgtggatagacctgtggaaggatatcttgctgtggcggtggttaggagatcagacactagccttacctggaactctgtgaaaggcaagaagtcctgccacaccgccgtggacaggactgcaggctggaatatccccatgggcctgctcttcaaccagacgggctcctgcaaatttgatgaatatttcagtcaaagctgtgcccctgggtctgacccgagatctaatctctgtgctctgtgtattggcgacgagcagggtgagaataagtgcgtgcccaacagcaacgagagatactacggctacactggggctttccggtgcctggctgagaatgctggagacgttgcatttgtgaaagatgtcactgtcttgcagaacactgatggaaataacaatgaggcatgggctaaggatttgaagctggcagactttgcgctgctgtgcctcgatggcaaacggaagccaaggttgtgcagatgacgaccgtatgatcgacggtccacgtgatacgcggtacgctttcaatgaacggg

SEQ ID NO: 314781 - DNA, 1981 bp, Homo sapiens
gactcctaggggcttgcagacctagtgggagagaaagaacatcgcagcagccaggcagaaccaggacaggtgaggtgcaggctggctttcctctcgcagcgcggtgtggagtcctgtcctgcctcagggcttttcggagcctggatcctcaaggaacaagtagacctggccgcggggagtggggagggaaggggtgtctattgggcaacagggcggcaaagccctgaataaaggggcgcagggcaggcgcaagtgcagagccttcgtttgccaagtcgcctccagaccgcagacatgaaacttgtcttcctcgtcctgctgttcctcggggccctcggactgtgtctggctggccgtaggagaaggagtgttcagtggtgcgccgtatcccaacccgaggccacaaaatgcttccaatggcaaaggaatatgagaaaagtgcgtggccctcctgtcagctgcataaagagagactcccccatccagtgtatccaggccattgcggaaaacagggccgatgctgtgacccttgatggtggtttcatatacgaggcaggcctggccccctacaaactgcgacctgtagcggcggaagtctacgggaccgaaagacagccacgaactcactattatgccgtggctgtggtgaagaagggcggcagctttcagctgaacgaactgcaaggtctgaagtcctgccacacaggccttcgcaggaccgctggatggaatgtccctatagggacacttcgtccattcttgaattggacgggtccacctgagcccattgaggcagctgtggccaggttcttctcagccagctgtgttcccggtgcagataaaggacagttccccaacctgtgtcgcctgtgtgcggggacaggggaaaacaaatgtgccttctcctcccaggaaccgtacttcagctactctggtgccttcaagtgtctgagagacggggctggagacgtggcttttatcagagagagcacagtgtttgaggacctgtcagacgaggctgaaagggacgagtatgagttactctgcccagacaacactcggaagccagtggacaagttcaaagactgccatctggcccgggtcccttctcatgccgttgtggcacgaagtgtgaatggcaaggaggatgccatctggaatcttctccgccaggcacaggaaaagtttggaaaggacaagtcaccgaaattccagctctttggctcccctagtgggcagaaagatctgctgttcaaggactctgccattgggttttcgagggtgcccccgaggatagattctgggctgtaccttggctccggctacttcactgccatccagaacttgaggaaaagtgaggaggaagtggctgcccggcgtgcgcgggtcgtgtggtgtgcggtgggcgagcaggagctgcgcaagtgtaaccagtggagtggcttgagcgaaggcagcgtgacctgctcctcggcctccaccacagaggactgcatcgccctggtgctgaaaggagaagctgatgccatgagtttggatggaggatatgtgtacactgcaggcaaatgtggtttggtgcctgtcctggcagagaactacaaatcccaacaaagcagtgaccctgatcctaactgtgtggatagacctgtggaaggatatcttgctgtggcggtggttaggagatcagacactagccttacctggaactctgtgaaaggcaagaagtcctgccacaccgccgtggacaggactgcaggctggaatatccccatgggcctgctcttcaaccagacgggctcctgcaaatttgatgaatatttcagtcaaagctgtgcccctgggtctgacccgagatctaatctctgtgcaggtgtgttggggccttggcctcccctgctgaaggtggggattgcccatccatctgcttacaattccctgctgtcgtcttagcaagaagtaaaatgagaaattttgttgatat

SEQ ID NO: 314782 - DNA, 1866 bp, Homo sapiens
  misc_feature (1834)..(1834): n is a, c, g, or t
gactcctaggggcttgcagacctagtgggagagaaagaacatcgcagcagccaggcagaaccaggacaggtgaggtgcaggctggctttcctctcgcagcgcggtgtggagtcctgtcctgcctcagggcttttcggagcctggatcctcaaggaacaagtagacctggccgcggggagtggggagggaaggggtgtctattgggcaacagggcggcaaagccctgaataaaggggcgcagggcaggcgcaagtgcagagccttcgtttgccaagtcgcctccagaccgcagacatgaaacttgtcttcctcgtcctgctgttcctcggggccctcggactgtgtctggctggccgtaggagaaggagtgttcagtggtgcgccgtatcccaacccgaggccacaaaatgcttccaatggcaaaggaatatgagaaaagtgcgtggccctcctgtcagctgcataaagagagactcccccatccagtgtatccaggccattgcggaaaacagggccgatgctgtgacccttgatggtggtttcatatacgaggcaggcctggccccctacaaactgcgacctgtagcggcggaagtctacgggaccgaaagacagccacgaactcactattatgccgtggctgtggtgaagaagggcggcagctttcagctgaacgaactgcaaggtctgaagtcctgccacacaggccttcgcaggaccgctggatggaatgtccctatagggacacttcgtccattcttgaattggacgggtccacctgagcccattgaggcagctgtggccaggttcttctcagccagctgtgttcccggtgcagataaaggacagttccccaacctgtgtcgcctgtgtgcggggacaggggaaaacaaatgtgccttctcctcccaggaaccgtacttcagctactctggtgccttcaagtgtctgagagacggggctggagacgtggcttttatcagagagagcacagtgtttgaggacctgtcagacgaggctgaaagggacgagtatgagttactctgcccagacaacactcggaagccagtggacaagttcaaagactgccatctggcccgggtcccttctcatgccgttgtggcacgaagtgtgaatggcaaggaggatgccatctggaatcttctccgccaggcacaggaaaagtttggaaaggacaagtcaccgaaattccagctctttggctcccctagtgggcagaaagatctgctgttcaaggactctgccattgggttttcgagggtgcccccgaggatagattctgggctgtaccttggctccggctacttcactgccatccagaacttgaggaaaagtgaggaggaagtggctgcccggcgtgcgcgggtcgtgtggtgtgcggtgggcgagcaggagctgcgcaagtgtaaccagtggagtggcttgagcgaaggcagcgtgacctgctcctcggcctccaccacagaggactgcatcgccctggtgctgaaaggagaagctgatgccatgagtttggatggaggatatgtgtacactgcaggcaaatgtggtttggtgcctgtcctggcagagaactacaaatcccaacaaagcagtgaccctgatcctaactgtgtggatagacctgtggaaggatatcttgctgtggcggtggttaggagatcagacactagccttacctggaactctgtgaaaggcaagaagtcctgccacaccgccgtggacaggactgcaggctggaatatccccatgggcctgctcttcaaccagacgggctcctgcaaatttgatgaatatttcagtcaaagctgcnacgaaggcatacctcagggtccgcacgatcga

SEQ ID NO: 314783 - DNA, 1911 bp, Homo sapiens
gactcctaggggcttgcagacctagtgggagagaaagaacatcgcagcagccaggcagaaccaggacaggtgaggtgcaggctggctttcctctcgcagcgcggtgtggagtcctgtcctgcctcagggcttttcggagcctggatcctcaaggaacaagtagacctggccgcggggagtggggagggaaggggtgtctattgggcaacagggcggcaaagccctgaataaaggggcgcagggcaggcgcaagtgcagagccttcgtttgccaagtcgcctccagaccgcagacatgaaacttgtcttcctcgtcctgctgttcctcggggccctcggactgtgtctggctggccgtaggagaaggagtgttcagtggtgcgccgtatcccaacccgaggccacaaaatgcttccaatggcaaaggaatatgagaaaagtgcgtggccctcctgtcagctgcataaagagagactcccccatccagtgtatccaggccattgcggaaaacagggccgatgctgtgacccttgatggtggtttcatatacgaggcaggcctggccccctacaaactgcgacctgtagcggcggaagtctacgggaccgaaagacagccacgaactcactattatgccgtggctgtggtgaagaagggcggcagctttcagctgaacgaactgcaaggtctgaagtcctgccacacaggccttcgcaggaccgctggatggaatgtccctatagggacacttcgtccattcttgaattggacgggtccacctgagcccattgaggcagctgtggccaggttcttctcagccagctgtgttcccggtgcagataaaggacagttccccaacctgtgtcgcctgtgtgcggggacaggggaaaacaaatgtgccttctcctcccaggaaccgtacttcagctactctggtgccttcaagtgtctgagagacggggctggagacgtggcttttatcagagagagcacagtgtttgaggacctgtcagacgaggctgaaagggacgagtatgagttactctgcccagacaacactcggaagccagtggacaagttcaaagactgccatctggcccgggtcccttctcatgccgttgtggcacgaagtgtgaatggcaaggaggatgccatctggaatcttctccgccaggcacaggaaaagtttggaaaggacaagtcaccgaaattccagctctttggctcccctagtgggcagaaagatctgctgttcaaggactctgccattgggttttcgagggtgcccccgaggatagattctgggctgtaccttggctccggctacttcactgccatccagaacttgaggaaaagtgaggaggaagtggctgcccggcgtgcgcgggtcgtgtggtgtgcggtgggcgagcaggagctgcgcaagtgtaaccagtggagtggcttgagcgaaggcagcgtgacctgctcctcggcctccaccacagaggactgcatcgccctggtgctgaaaggagaagctgatgccatgagtttggatggaggatatgtgtacactgcaggcaaatgtggtttggtgcctgtcctggcagagaactacaaatcccaacaaagcagtgaccctgatcctaactgtgtggatagacctgtggaaggatatcttgctgtggcggtggttaggagatcagacactagccttacctggaactctgtgaaaggcaagaagtcctgccacaccgccgtggacaggactgcaggctggaatatccccatgctgactaaagtcagcgccctgctgcggcggctggcccgcattggggtgctggatgagggcaagatgaagctggattacatcctgggcctgaagatagaaggattttttaaaagagacgcctgcagacccaggtcttca

SEQ ID NO: 314784 - DNA, 1384 bp, Homo sapiens
  misc_feature (1359)..(1359): n is a, c, g, or t
  misc_feature (1363)..(1363): n is a, c, g, or t
gactcctaggggcttgcagacctagtgggagagaaagaacatcgcagcagccaggcagaaccaggacaggtgaggtgcaggctggctttcctctcgcagcgcggtgtggagtcctgtcctgcctcagggcttttcggagcctggatcctcaaggaacaagtagacctggccgcggggagtggggagggaaggggtgtctattgggcaacagggcggcaaagccctgaataaaggggcgcagggcaggcgcaagtgcagagccttcgtttgccaagtcgcctccagaccgcagacatgaaacttgtcttcctcgtcctgctgttcctcggggccctcggactgtgtctggctggccgtaggagaaggagtgttcagtggtgcgccgtatcccaacccgaggccacaaaatgcttccaatggcaaaggaatatgagaaaagtgcgtggccctcctgtcagctgcataaagagagactcccccatccagtgtatccaggccattgcggaaaacagggccgatgctgtgacccttgatggtggtttcatatacgaggcaggcctggccccctacaaactgcgacctgtagcggcggaagtctacgggaccgaaagacagccacgaactcactattatgccgtggctgtggtgaagaagggcggcagctttcagctgaacgaactgcaaggtctgaagtcctgccacacaggccttcgcaggaccgctggatggaatgtccctatagggacacttcgtccattcttgaattggacgggtccacctgagcccattgaggcagctgtggccaggttcttctcagccagctgtgttcccggtgcagataaaggacagttccccaacctgtgtcgcctgtgtgcggggacaggggaaaacaaatgtgccttctcctcccaggaaccgtacttcagctactctggtgccttcaagtgtctgagagacggggctggagacgtggcttttatcagagagagcacagtgtttgaggacctgtcagacgaggctgaaagggacgagtatgagttactctgcccagacaacactcggaagccagtggacaagttcaaagactgccatctggcccgggtcccttctcatgccgttgtggcacgaagtgtgaatggcaaggaggatgccatctggaatcttctccgccaggcacaggaaaagtttggaaaggacaagtcaccgaaattccagctctttggctcccctagtgggcagaaagatctgctgttcaaggactctgccattgggttttcgagggtgcccccgaggatagattctgggctgtaccttggctccggctacttcactgccatccagaacttgaggaaaagtganaggnaaggcttatagagaggaaagg

SEQ ID NO: 314785 - DNA, 1838 bp, Homo sapiens
gactcctaggggcttgcagacctagtgggagagaaagaacatcgcagcagccaggcagaaccaggacaggtgaggtgcaggctggctttcctctcgcagcgcggtgtggagtcctgtcctgcctcagggcttttcggagcctggatcctcaaggaacaagtagacctggccgcggggagtggggagggaaggggtgtctattgggcaacagggcggcaaagccctgaataaaggggcgcagggcaggcgcaagtgcagagccttcgtttgccaagtcgcctccagaccgcagacatgaaacttgtcttcctcgtcctgctgttcctcggggccctcggactgtgtctggctggccgtaggagaaggagtgttcagtggtgcgccgtatcccaacccgaggccacaaaatgcttccaatggcaaaggaatatgagaaaagtgcgtggccctcctgtcagctgcataaagagagactcccccatccagtgtatccaggccattgcggaaaacagggccgatgctgtgacccttgatggtggtttcatatacgaggcaggcctggccccctacaaactgcgacctgtagcggcggaagtctacgggaccgaaagacagccacgaactcactattatgccgtggctgtggtgaagaagggcggcagctttcagctgaacgaactgcaaggtctgaagtcctgccacacaggccttcgcaggaccgctggatggaatgtccctatagggacacttcgtccattcttgaattggacgggtccacctgagcccattgaggcagctgtggccaggttcttctcagccagctgtgttcccggtgcagataaaggacagttccccaacctgtgtcgcctgtgtgcggggacaggggaaaacaaatgtgccttctcctcccaggaaccgtacttcagctactctggtgccttcaagtgtctgagagacggggctggagacgtggcttttatcagagagagcacagtgtttggtaagagcagggtaatgagccgtgggtactgaccccttttatcttacttgatcatgactctgacctttgagctaattagattcctaagttcatggcagaccattttcaagattcctacagggcacagctctgattttatgatctttcatattttaaatgatcagttttcttcaaacctcctgtgcctactgcctttctcttcccctcatagacacccatgcctaggtgcttggcaatgcgtcctccagtcctccaagacacatgtgctcatgcagaacagattgtgctggtttgtgtttccggtttctgggttcatagaggttttagtgagcattagaaatcctgctacttgggttttctgctcagcattttgttttagaggtttatcggtattgttgtatacatgtctagctcaggggtcctaacagttgaggagtgttccgtggaatacatccaccttttacttctctgtcaccatagtgatggacagaggttgtgctctcttttcctctaccacatgcagccacacgactgataccttcacctgtgttccttacttacctgctggacagcgtccctcctggacttataataaagcagttgatgagtatgtagaggctaaacacactgcacccaggactagtggacataagctcactacatttcatgcaagaccaatagagacagggctactatattccacccagggccactagagaaagtgacagacacccacattcactcaggaccatcagagacacaccccacatctacccaggaaccggggataatcactagtgaattcgcgccgcctgcagttcgacaatatgggagagct

SEQ ID NO: 314786 - DNA, 1314 bp, Homo sapiens
gactcctaggggcttgcagacctagtgggagagaaagaacatcgcagcagccaggcagaaccaggacaggtgaggtgcaggctggctttcctctcgcagcgcggtgtggagtcctgtcctgcctcagggcttttcggagcctggatcctcaaggaacaagtagacctggccgcggggagtggggagggaaggggtgtctattgggcaacagggcggcaaagccctgaataaaggggcgcagggcaggcgcaagtgcagagccttcgtttgccaagtcgcctccagaccgcagacatgaaacttgtcttcctcgtcctgctgttcctcggggccctcggactgtgtctggctggccgtaggagaaggagtgttcagtggtgcgccgtatcccaacccgaggccacaaaatgcttccaatggcaaaggaatatgagaaaagtgcgtggccctcctgtcagctgcataaagagagactcccccatccagtgtatccaggccattgcggaaaacagggccgatgctgtgacccttgatggtggtttcatatacgaggcaggcctggccccctacaaactgcgacctgtagcggcggaagtctacgggaccgaaagacagccacgaactcactattatgccgtggctgtggtgaagaagggcggcagctttcagctgaacgaactgcaaggtctgaagtcctgccacacaggccttcgcaggaccgctggatggaatgtccctatagggacacttcgtccattcttgaattggacgggtccacctgagcccattgaggcagctgtggccaggttcttctcagccagctgtgttcccggtgcagataaaggacagttccccaacctgtgtcgcctgtgtgcggggacaggggaaaacaaatgtgccttctcctcccaggaaccgtacttcagctactctggtgccttcaagtgtctgagagacggggctggagacgtggcttttatcagagagagcacagtgtttggtaagagcagggtaatgagccgtgggtactgaccccttttatcttacttgatcatgactctgacctttgagctaattagattcctaagttcatggcagaccattttcaagattcctacagggcacagctctgattttatgatctttcatattttaaatgatcagttttcttcaaacctcctgtgcctactgcctttctcttcccctcatagacacccatgcctaggtgcttggcaatgcgtcctccagtcctccaagacacatgtgctcatgcagaacagattgtgctggtacccggcgtctgtttatcctcta

SEQ ID NO: 314787 - DNA, 310 bp, Homo sapiens
  misc_feature (57)..(57): n is a, c, g, or t
  misc_feature (73)..(73): n is a, c, g, or t
  misc_feature (112)..(112): n is a, c, g, or t
taaaaaaaaaaaaaaaaaaaaaccccccccacaatttttaaagggggaggaaggggnaaaaaaaagggttttnaaaaaaaaaaaaaaaggggggaaaaccccccaaaaattntcaagcccaactggtctaagcagcatttaattgaagaatatgtgatacagcctcttcaatcagattgtaagttacctgaaagctgcagttcacaggctcctctctccaccaaattaggatagaataattgctggataaacaaattcagaatatcaacagatgatcacaataaacatctgtttctcattcattacagtc

SEQ ID NO: 314788 - DNA, 1278 bp, Homo sapiens
  misc_feature (2)..(3): n is a, c, g, or t
gnngagccaattagagctccagttgtcactcctacccacactgggcctgggggtgaagggaagtgtttattaggggtacatgtgaagccgtccagaagtgtcagagtctttgtagctttgaaagtcacctaggttatttgggcatgctctcctgagtcctctgctagttaagctctctgaaaagaaggtggcagacccggtttgctgatcgccccagggatcaggaggctgatcccaaagttgtcagatggagagtaaatacaaggagatactcttgctaacaggcctggataacatcactgatgaggaactggataggtttaagttctttctttcagacgagtttaatattgccacaggcaaactacatactgcaaacagaatacaagtagctaccttgatgattcaaaatgctggggcggtgtctgcagtgatgaagaccattcgtatttttcagaagttgaattatatgcttttggcaaaacgtcttcaggaggagaaggagaaagttgataagcaatacaaatcggtaacaaaaccaaagccactaagtcaagctgaaatgagtcctgctgcatctgcagccatcagaaatgatgtcgcaaagcaacgtgctgcaccaaaagtctctcctcatgttaagcctgaacagaaacagatggtggcccagcaggaatctatcagagaagggtttcagaagcgctgtttgccagttatggtactgaaagcaaagaagcccttcacgtttgagacccaagaagaaaagctggtgaaaccccgaagatcaacacgcttcaaactcagccccttggaacaattgtgaatggtttgtttgtagtccagaaggtaacagaaaagaagaaaaacatattatttgacctaagtgacaacactgggaaaatggaagtactgggggttagaaacgaggacacaatgaaatgtaaggaaggagataaggttcgacttacattcttcacactgtcaaaaaatggagaaaaactacagctgacatctggagttcatagcaccataaaggttattaaggccaaaaaaaaaacatagagaagtaaaaaggaccaattcaagccaactggtctaagcagcatttaattgaagaatatgtgatacagcctcttcaatcagattgtaagttacctgaaagctgcagttcacaggctcctctctccaccaaattaggatagaataattgctggataaacaaattcagaatatcaacagatgatcacaataaacatctgtttctcattcattacagtc

SEQ ID NO: 314789 - DNA, 1495 bp, Homo sapiens
  misc_feature (2)..(3): n is a, c, g, or t
gnngagccaattagagctccagttgtcactcctacccacactgggcctgggggtgaagggaagtgtttattaggggtacatgtgaagccgtccagaagtgtcagagtctttgtagctttgaaagtcacctaggttatttgggcatgctctcctgagtcctctgctagttaagctctctgaaaagaaggtggcagacccggtttgctgatcgccccagggatcaggaggctgatcccaaagttgtcagatggagagtaaatacaaggagatactcttgctaacaggcctggataacatcactgatgaggaactggataggtttaagttctttctttcagacgagtttaatattgccacaggcaaactacatactgcaaacagaatacaagtagctaccttgatgattcaaaatgctggggcggtgtctgcagtgatgaagaccattcgtatttttcagaagttgaattatatgcttttggcaaaacgtcttcaggaggagaaggagaaagttgataagcaatacaaatcggtaacaaaaccaaagccactaagtcaagctgaaatgagtcctgctgcatctgcagccatcagaaatgatgtcgcaaagcaacgtgctgcaccaaaagtctctcctcatgttaagcctgaacagaaacagatggtggcccagcaggaatctatcagagaagggtttcagaagcgctgtttgccagttatggtactgaaagcaaagaagcccttcacgtttgagacccaagaaggcaagcaggagatgtttcatgctacagtggctacagaaaaggaattcttctttgtaaaagtttttaatacactgctgaaagataaattcattccaaagagaataattataatagcaagatattatcggcacagtggtttcttagaggtaaatagcgcctcacgtgtgttagatgctgaatctgaccaaaaggttaatgtcccgctgaacattatcagaaaagctggtgaaaccccgaagatcaacacgcttcaaactcagccccttggaacaattgtgaatggtttgtttgtagtccagaaggtaacagaaaagaagaaaaacatattatttgacctaagtgacaacactgggaaaatggaagtactgggggttagaaacgaggacacaatgaaatgtaaggaaggagataaggttcgacttacattcttcacactgtcaaaaaatggagaaaaactacagctgacatctggagttcatagcaccataaaggttattaaggccaaaaaaaaaacatagagaagtaaaaaggaccaattcaagccaactggtctaagcagcatttaattgaagaatatgtgatacagcctcttcaatcagattgtaagttacctgaaagctgcagttcacaggctcctctctccaccaaattaggatagaataattgctggataaacaaattcagaatatcaacagatgatcacaataaacatctgtttctcattcattacagtc

SEQ ID NO: 314790 - DNA, 1931 bp, Homo sapiens
  misc_feature (841)..(841): n is a, c, g, or t
tctctggaacagttgagagacaaatgcataagcattttagaaagaccaaatgtgaagccatactccaaatattcaacatcactgcagttatttttgagtttatcaagatgtgattacaggagagtcttactgtagtcctgcttttatgtttccaaggtgtttgtgcatggactttcctcttttccaatagccaaacttgtttggatgtgatccaagatgtaccaaaaggtattgaaaattaaatgtaagagtagtcttctagcaatattgcaccattcccaggcagtttccaacgtgcatcagcatgtctgtctccagtggaacaagataacttccagcccctgaacccctggggaaactccttccctctttactgtatgttgttgccactgtaggagaaatctctcctctgcctgactctgcagctgctttacccagaacctcaggaggaactctgagtccagagccaggctgagttcagccaggcaagtctggccttggggctgtatatatctgtctcagacatcgtctgtgttttcatatattttttgactttttaaaagatgacccagaccacaatagtatgttctatttttgttttgttgtgttgtgtttttccattacattgcttagtacagtatttctaggatagaaaatttgctttcttggtctgccttggaacatacctaccaattacaacattgattttccataaaaattgagtttaaagttccaacttgcaaatgaacttttggatagccatccatttgttagtgggaaagtgtgtctgatttaggtattttcttagtaaataaccactaaaatgaatgtttaaatatcntattttgcttaagtcagggatctcactgtactgtaataaccgtttgggtacaccactgattgataacttaatgcagatagtggaggattaacataaactgtgtgcttgttacatcctcaatgaaaacaaaactaatggtttaaaatgtcctagtgtcaccacaagatggtgcatgtgacgaggaaaaaaaacatgtcttaatatggtttcaaaccaaaatccatatatttgtttaatctgtagttgtactctaactgtatatatatttttttctcatatttaactcccttctacaaagaatagcaacatcagattttaatacaggataccaaatagctattgctgttgctattccctggttgtatacctgccctcattgactattagtgggtcttagattttgacttcatccaggcttatttcgtaagttcaggaccatcctatttcatacctcctgttcctatttttctaattgaaacttcattgacattggagccaggtgtttttttcctaacacttattcctagtgttgctgatagccagtcaggccagatgagatctgatagtgacctccacggagtgcactaaagaagggtcagaagtctcctttactctttcaaccccagaggccttaatttattaatagcatctctttgaaaaagacaatctctgcatattcaagaaatgttaccagtggacactgctgaggattggaaggggccaaaagcatggtggcttttgtttttaccttgttctcttttgcattacttaaaatttttatcatgaccaagtagtaattttctaaaaataaatatttgataaaaacagtaaaattaagcaaagtattatgtcatcctcaaataaattagtatctacaacatgatcaaagaaattgtgactatacaggatatttgcataaaagaccaaaaagaaaatactaaaacttttctttctcttttttgacacagaatctcactctgttgcccaggctagattgcagtggcatgatctctgctcactgcagccttgagcttccaggctcaaacaatcctcctacctcagcctccctgggacttcggtcacatgccac

SEQ ID NO: 314791 - DNA, 461 bp, Homo sapiens
atttgcataaaagaccaaaaagaaaatactaaaacttttctttctcttttttgacacagaatctcactctgttgcccaggctagattgcagtggcatgatctctgctcactgcagccttgagcttccaggctcaaacaatcctcctacctcagcctccctgggacttcggtcacatgccaccacgcctggctgatttttgtatttttggtagagacggggttttgccatgttgcccatgttgctcttgaactcctgagctcaagtgatctgcccaccttggcctcccaaagtgctgggaatgcaggcatgcgccaccgcacctggccaaaaataccaacacttaatcgtgatcatttctggttatgtaaatacgggtaaattttctttttctttgtggttttctatttttttgaaagtgctatggtaaacatctgttgcctttgtaataaaaaatttttct

SEQ ID NO: 314792 - DNA, 2202 bp, Homo sapiens
ccagatgatcacttgagcccaggaggtagaggctgcagtgagctataatggtaccattgcaatccagcctgggcaacagagtgagaccctgtctcaaaaaaaataaaaaagtagaaagatggagtggaagcctgcccagggttgtgagcatgcacgggaaaggcacccaggtcaggggggatccccgaggagatgcctgagctgaaggattgtggttggggaaagcgtagtcccagcaaggaagcagtttgtgggtaagtgctgggaggtgagtggagtgagcttgtcagggagctgctggtggagcctggaggggaaggagggaggcagtgagagagatcggggtgggggttggggggatgtcgccagagctcaggggtggggacagccttgtgcgcatcagtcctgaggcctggggcacctttcgtctgatgagcctctgcatggagagaggctgagggctaaacacagctggatgtcacctgagttcatttataggaagagagaaatgtcgaggtgaaacgtaaaagcatctggcaggaaggtgagtctgaagccctgcacccgcgttccgactatcagtggggagctgttagcacgtaggattcttcagagcagctgggctggagctcccctgagctcaggaagccccagggtgcaagggcaaggaaatgaggggtggtgggtcagtgaagatctgggcagaccttgtgtggggaaggggtgctgctgtgacttcagggtctgaggtccaaagacagcatttgaaaagaggctctgaagccagtgtttgaagaatttgttcctgaagtacctcctgggggtaggctagaggcttctggcttcagggtcctgaagaacacattgaggtgccgtctgacactggaatagggtgcccttcattcctatgcctgagtccttaactatatttccaacctccagtgaggaggagaagattcggaaatgtgacaggagagcaaacaggacagtttgcatgtgtgtgtgcgcacacatacatgtgcgtgaaagattatcaataaaagtgcataaatttgttgatctggtaagagtttctagcaggaaggtcgagccacttactgtaggtcaagaagttgctagttgcggagttttttcttgcagttagactttacctagtggtagcagggccaccaaagctctgtgtcccagatggtgtatggcccataatccacccaacagcagcaaaggaccaggcaaaggagaacaggagcagaagcctcccagccactagccttttgggctcagtctctccaataatcctggagaggggcttcgttgggtctggacacctaccatgcattctgtgacctttccctagcttccaataaataactgtttgacgcccagagtacaggataccacaatgcactcttcctgcgtagagcacatgttcccatctgctcccattcctcaggaaccttgaattctagctctgctggcctttgagcccatgccagtaaatgtcctgatgggcattgcctactatctccagggcagctgcctttgtcctcctaacagctttattggagtacagttcacttaccatacaatccacaattgaccctgcacaatttgatgccggtttagtatagtcacagttcagcagccatcagcacagtcagtcttagagtttactacccccaaaagaaatccagccccccttagtcaccaccccaacctccccatccctaggcacccctaggctactttgatctctgtagacttgcctcttctggacatgacatagagaaaggagtcataaattctccaaggtgtctgtttcttctttaatgtcattccctgtttctcctcacattccctccccatttcctgggcccagtctcacactggtccttgcttaccctaaatgctattaattccatcactctgagtatggtgtttgctgtccgctgaatgccaagagcttcaagagtgtgtgtaaataaagccacacctttatttttgtattattctgaaccatggctaataaattgtttcaccaagaaatgtctctctaagaacagatgccctccacgctgtgcccctcccacctcttcagctcgtctcctgagtgtgcagaggtggttccggttgggaaagaagcagcggagcatctaaccatgcctgtgtccaggccgattatgcacgcagaacgcgcctaac

SEQ ID NO: 314793 - DNA, 2041 bp, Homo sapiens
ccagatgatcacttgagcccaggaggtagaggctgcagtgagctataatggtaccattgcaatccagcctgggcaacagagtgagaccctgtctcaaaaaaaataaaaaagtagaaagatggagtggaagcctgcccagggttgtgagcatgcacgggaaaggcacccaggtcaggggggatccccgaggagatgcctgagctgaaggattgtggttggggaaagcgtagtcccagcaaggaagcagtttgtgggtaagtgctgggaggtgagtggagtgagcttgtcagggagctgctggtggagcctggaggggaaggagggaggcagtgagagagatcggggtgggggttggggggatgtcgccagagctcaggggtggggacagccttgtgcgcatcagtcctgaggcctggggcacctttcgtctgatgagcctctgcatggagagaggctgagggctaaacacagctggatgtcacctgagttcatttataggaagagagaaatgtcgaggtgaaacgtaaaagcatctggcaggaaggtgagtctgaagccctgcacccgcgttccgactatcagtggggagctgttagcacgtaggattcttcagagcagctgggctggagctcccctgagctcaggaagccccagggtgcaagggcaaggaaatgaggggtggtgggtcagtgaagatctgggcagaccttgtgtggggaaggggtgctgctgtgacttcagggtctgaggtccaaagacagcatttgaaaagaggctctgaagccagtgtttgaagaatttgttcctgaagtacctcctgggggtaggctagaggcttctggcttcagggtcctgaagaacacattgaggtgccgtctgacactggaatagggtgcccttcattcctatgcctgagtccttaactatatttccaacctccagtgaggaggagaagattcggaaatgtgacaggagagcaaacaggacagtttgcatgtgtgtgtgcgcacacatacatgtgcgtgaaagattatcaataaaagtgcataaatttgttgatctggtaagagtttctagcaggaaggtcgagccacttactgtaggtcaagaagttgctagttgcggagttttttcttgcagttagactttacctagtggtagcagggccaccaaagctctgtgtcccagatggtgtatggcccataatccacccaacagcagcaaaggaccaggcaaaggagaacaggagcagaagcctcccagccactagccttttgggctcagtctctccaataatcctggagaggggcttcgttgggtctggacacctaccatgcattctgtgacctttccctagcttccaataaataactgtttgacgcccagagtacaggataccacaatgcactcttcctgcgtagagcacatgttcccatctgctcccattcctcaggaaccttgaattctagctctgctggcctttgagcccatgccagtaaatgtcctgatgggcattgcctactatctccagggcagctgcctttgtcctcctaacagctttattggagtacagttcacttaccatacaatccacaattgaccctgcacaatttgatgccggtttagtatagtcacagttcagcagccatcagcacagtcagtcttagagtttactacccccaaaagaaatccagccccccttagtcaccaccccaacctccccatccctaggcacccctaggctactttgatctctgtagacttgcctcttctggacatgacatagagaaaggagtcataaattctccaaggtgtctgtttcttctttaatgtcattccctgtttctcctcacattccctccccatttcctgggcccagtctcacactggtccttgcttaccctaaatgctattaattccatcactctgagtatggtgtttgctgtccgctgaatgccaagagcttcaagagtgtgtgtaaataaagccacacctttatttttgtattattctgaaccatggctaataaattgtttcacca

SEQ ID NO: 314794 - DNA, 2056 bp, Homo sapiens
ccagatgatcacttgagcccaggaggtagaggctgcagtgagctataatggtaccattgcaatccagcctgggcaacagagtgagaccctgtctcaaaaaaaataaaaaagtagaaagatggagtggaagcctgcccagggttgtgagcatgcacgggaaaggcacccaggtcaggggggatccccgaggagatgcctgagctgaaggattgtggttggggaaagcgtagtcccagcaaggaagcagtttgtgggtaagtgctgggaggtgagtggagtgagcttgtcagggagctgctggtggagcctggaggggaaggagggaggcagtgagagagatcggggtgggggttggggggatgtcgccagagctcaggggtggggacagccttgtgcgcatcagtcctgaggcctggggcacctttcgtctgatgagcctctgcatggagagaggctgagggctaaacacagctggatgtcacctgagttcatttataggaagccccagggtgcaagggcaaggaaatgaggggtggtgggtcagtgaagatctgggcagaccttgtgtggggaaggggtgctgctgtgacttcagggtctgaggtccaaagacagcatttgaaaagaggctctgaagccagtgtttgaagaatttgttcctgaagtacctcctgggggtaggctagaggcttctggcttcagggtcctgaagaacacattgaggtgccgtctgacactggaatagggtgcccttcattcctatgcctgagtccttaactatatttccaacctccagtgaggaggagaagattcggaaatgtgacaggagagcaaacaggacagtttgcatgtgtgtgtgcgcacacatacatgtgcgtgaaagattatcaataaaagtgcataaatttgttgatctggtaagagtttctagcaggaaggtcgagccacttactgtaggtcaagaagttgctagttgcggagttttttcttgcagttagactttacctagtggtagcagggccaccaaagctctgtgtcccagatggtgtatggcccataatccacccaacagcagcaaaggaccaggcaaaggagaacaggagcagaagcctcccagccactagccttttgggctcagtctctccaataatcctggagaggggcttcgttgggtctggacacctaccatgcattctgtgacctttccctagcttccaataaataactgtttgacgcccagagtacaggataccacaatgcactcttcctgcgtagagcacatgttcccatctgctcccattcctcaggaaccttgaattctagctctgctggcctttgagcccatgccagtaaatgtcctgatgggcattgcctactatctccagggcagctgcctttgtcctcctaacagctttattggagtacagttcacttaccatacaatccacaattgaccctgcacaatttgatgccggtttagtatagtcacagttcagcagccatcagcacagtcagtcttagagtttactacccccaaaagaaatccagccccccttagtcaccaccccaacctccccatccctaggcacccctaggctactttgatctctgtagacttgcctcttctggacatgacatagagaaaggagtcataaattctccaaggtgtctgtttcttctttaatgtcattccctgtttctcctcacattccctccccatttcctgggcccagtctcacactggtccttgcttaccctaaatgctattaattccatcactctgagtatggtgtttgctgtccgctgaatgccaagagcttcaagagtgtgtgtaaataaagccacacctttatttttgtattattctgaaccatggctaataaattgtttcaccaagaaatgtctctctaagaacagatgccctccacgctgtgcccctcccacctcttcagctcgtctcctgagtgtgcagaggtggttccggttgggaaagaagcagcggagcatctaaccatgcctgtgtccaggccgattatgcacgcagaacgcgcctaac

SEQ ID NO: 314795 - DNA, 2100 bp, Homo sapiens
gcgtgctggcccggggtggcaggagccgcagaggcttgggctgcagaaaaaggatcctgtttgctgtgtaatcctgagaatggactgcaagagaggaaaaactgggcgtctgcttgggaatctattgtggaaacccagggtgtttcccgaccagtccctgggcgccaactagagtatggactgaccaggtacctggatggagacctgagctggagaaggagatgcgcttgggaggaaattgcagaggccgtcaacatggaaaagcagccccagaacagcaggagaggcctcgccccccgagaggtgccgccagctgttgggctgctgctgatcatggccctgatgaatactctactctacctctgcctcgaccacttcttcatcgctcctcgacaatccactgtggaccccacacactgtccctatggtcacttcaggataggacagatgaaaaactgctcaccttggctgtcctgcgaggagctgagaacagaagtgagacagctgaagcgtgttggggaaggagctgtaaagagagtctttctgtctgagtggaaggagcacaaagttgcactctcacagctcaccagcctggagatgaaagatgatttcctccatggactgcagatgctgaaatctctccaaggcacacatgttgtcacgctgcttggctattgtgaggatgacaacactatgcttactgaatatcaccctctaggttccttgagtaacctggaagaaacactaaacctttcaaagtaccaaaatgtgaacacgtggcagcacaggctggagctggccatggactatgtcagcatcattaattacctgcaccacagccctgtgggcacacgggtcatgtgcgactccaacgacctgccgaagacactgtcccagtatctgctaacaagcaacttcagcattttggcaaatgacttggacgccttacccctggtgaaccacagctccgggatgctggtgaagtgcggccacagggagctgcatggggatttcgtggctccagagcaactgtggccctatggagaggacgtgcctttccacgatgatctcatgccctcatatgatgagaagattgacatttggaagatcccagacatctccagtttccttctggggcacattgaagggagtgatatggtccgattccatttgtttgatattcacaaagcatgcaagagccagactccctcagaaagacccactgcccaggacgttctggagacctaccagaaggtcttggatacacttagagatgccatgatgtctcaggcaagagagatgctgtgaaaaccagtccagccaatgaaggtgggattgaagggctgaatggaagttacagcattctactctgatggtggagttttttgcctgagtttcgtgttttattgttttttttatggcttagccatgtggttcgttgtccacatccacatgtacgtttgtatgtagtccacattggttgttagattttttttttttttctttgagatgcggtcttgctctgttgctgaggctggagtgcagtgatgtgatcttggctcactgcagcctctgcctcccaggttcaagcaattctcccacctcggcctcccaaagtgctgggattacaggcgtgagccactgcgcccggccacattcagttcttatcaaagaaataacccagacttaatcttgaatgatacgattatgcccaatattaagtaaaaaatataagaaaaggttatcttaaatagatcttaggcaaaataccagctgatgaaggcatctgatgccttcatctgttcagtcatctccaaaaacagtaaaaataaccactttttgttgggcaatatgaaatttttaaaggagtagaataccaaatgatagaaacagactgcctgaattgagaattttgatttcttaaagtgtgtttctttctaaattgctgttccttaatttgattaatttaattcatgtattatgattaaatctgaggcagatgagcttacaagtattgaaataattactaattaatcacaaatgtgaagttatgcatgatgtaaaaaatacaaacattctaattaaaggctttgcaacaca

SEQ ID NO: 314796 - DNA, 517 bp, Homo sapiens
aggcagactctagaggatgctcagcctacagcgccttacctacagcgcccttaacttactgcgcccggccacattcagttcttatcaaagaaataacccagacttaatcttgaatgatacgattatgcccaatattaagtaaaaaatataagaaaaggttatcttaaatagatcttaggcaaaataccagctgatgaaggcatctgatgccttcatctgttcagtcatctccaaaaacagtaaaaataaccactttttgttgggcaatatgaaatttttaaaggagtagaataccaaatgatagaaacagactgcctgaattgagaattttgatttcttaaagtgtgtttctttctaaattgctgttccttaatttgattaatttaattcatgtattatgattaaatctgaggcagatgagcttacaagtattgaaataattactaattaatcacaaatgtgaagttatgcatgatgtaaaaaatacaaacattctaattaaaggctttgcaacaca

SEQ ID NO: 314797 - DNA, 367 bp, Homo sapiens
tgaggcaggagacttgcttgaacccgggaggtggaggttgcagaggattgcgccactgcacttcagcctgggcgacagagcgagactctgtctcaaataaatacataaaaaaatagaactaatactggtgaaaatttacctaaaaccttggttatcaaatacatctccagtacattccgttctttttttttttttcgagactccatctcaaaaaaaaaaaggaatcggacgaagaaccacaggatgttgaagacaactgtctgaagtattcgtgagggacagcgatgtggccctctgtgttaagaataacgtgtcggggtttggcagagagaagaaaatagccactgcccgctttcaaggcaagata

SEQ ID NO: 314798 - DNA, 1520 bp, Homo sapiens
caccctggtcagcctagcactctgacctagcagtcaacatgaaggctctcattgttctggggcttgtcctcctttctgttacggtccagggcaaggtctttgaaaggtgtgagttggccagaactctgaaaagattgggaatggatggctacaggggaatcagcctagcaaactggatgtgtttggccaaatgggagagtggttacaacacacgagctacaaactacaatgctggagacagaagcactgattatgggatatttcagatcaatagccgctactggtgtaatgatggcaaaaccccaggagcagttaatgcctgtcatttatcctgcagtgctttgctgcaagataacatcgctgatgctgtagcttgtgcaaagagggttgtccgtgatccacaaggcattagagcatgggtggcatggagaaatcgttgtcaaaacagagatgtccgtcagtatgttcaaggttgtggagtgtaactccagaattttccttcttcagctcattttgtctctctcacattaagggagtaggaattaagtgaaaggtcacactaccattatttccccttcaaacaaataatatttttacagaagcaggagcaaaatatggcctttcttctaagagatataatgttcactaatgtggttattttatattaagcctacaacatttttcagtttgcaaatagaactaatactggtgaaaatttacctaaaaccttggttatcaaatacatctccagtacattccgttctttttttttttgagacagtctcgctctgtcgcccaggctggagtgcagtggcgcaatctcggctcactgcaacctccacctcccgggttcacgccattctcctgcctcagcctcccgagtagctgggattacgggcgcccgccaccacgcccggctaattttttgtatttttagtagagacagggtttcaccgtgttagccaggatggtctcgatctcctgaccttgtgatccacccacctcggcctcccaaagtgctgggattacaggcgtgagccactgcgcccggccacattcagttcttatcaaagaaataacccagacttaatcttgaatgatacgattatgcccaatattaagtaaaaaatataagaaaaggttatcttaaatagatcttaggcaaaataccagctgatgaaggcatctgatgccttcatctgttcagtcatctccaaaaacagtaaaaataaccactttttgttgggcaatatgaaatttttaaaggagtagaataccaaatgatagaaacagactgcctgaattgagaattttgatttcttaaagtgtgtttctttctaaattgctgttccttaatttgattaatttaattcatgtattatgattaaatctgaggcagatgagcttacaagtattgaaataattactaattaatcacaaatgtgaagttatgcatgatgtaaaaaatacaaacattctaattaaaggctttgcaacacacatgccttgtctgtttttat

SEQ ID NO: 314799 - DNA, 2011 bp, Homo sapiens
  misc_feature (1516)..(1516): n is a, c, g, or t
  misc_feature (1518)..(1518): n is a, c, g, or t
caccctggtcagcctagcactctgacctagcagtcaacatgaaggctctcattgttctggggcttgtcctcctttctgttacggtccagggcaaggtctttgaaaggtgtgagttggccagaactctgaaaagattgggaatggatggctacaggggaatcagcctagcaaactggatgtgtttggccaaatgggagagtggttacaacacacgagctacaaactacaatgctggagacagaagcactgattatgggatatttcagatcaatagccgctactggtgtaatgatggcaaaaccccaggagcagttaatgcctgtcatttatcctgcagtgctttgctgcaagataacatcgctgatgctgtagcttgtgcaaagagggttgtccgtgatccacaaggcattagagcatgggtggcatggagaaatcgttgtcaaaacagagatgtccgtcagtatgttcaaggttgtggagtgtaactccagaattttccttcttcagctcattttgtctctctcacattaagggagtaggaattaagtgaaaggtcacactaccattatttccccttcaaacaaataatatttttacagaagcaggagcaaaatatggcctttcttctaagagatataatgttcactaatgtggttattttatattaagcctacaacatttttcagtttgcaaatagaactaatactggtgaaaatttacctaaaaccttggttatcaaatacatctccagtacattccgttctttttttttttgagacagtctcgctctgtcgcccaggctggagtgcagtggcgcaatctcggctcactgcaacctccacctcccgggttcacgccattctcctgcctcagcctcccgagtagctgggattacgggcgcccgccaccacgcccggctaattttttgtatttttagtagagacagggtttcaccgtgttagccaggatggtctcgatctcctgaccttgtgatccacccacctcggcctcccaaagtgctgggattacaggcgtgagccactgcgcccggccacattcagttcttatcaaagaaataacccagacttaatcttgaatgatacgattatgcccaatattaagtaaaaaatataagaaaaggttatcttaaatagatcttaggcaaaataccagctgatgaaggcatctgatgccttcatctgttcagtcatctccaaaaacagtaaaaataaccactttttgttgggcaatatgaaatttttaaaggagtagaataccaaatgatagaaacagactgcctgaattgagaattttgatttcttaaagtgtgtttctttctaaattgctgttccttaatttgattaatttaattcatgtattatgattaaatctgaggcagatgagcttacaagtattgaaataattactaattaatcacaaatgtgaagttatgcatgatgtaaaaaatacaaacattctaattaaaggctttgcaacacaaaaaaaaaaaaaaaananaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggaaaaaaaaaaaaaaaaaaaaaaaaaaaacctttggggcccccttggcccaaggtttttttattttggacaattttttttttcgggcccaattttgggcccttttggccaaatccccctttggggggggttttaaaaaatcctgggcccgggttttaacaccggggggggggaaaaacccgggggttccccaatttaattcctttgggaaaaaacccctttttccgagggggggaataagaggaaggcccccccccccacccccttctcccaaaatgtgccccctcttgtgggaaagggaaatttgaagccttaattttttgtaaaatcccgggtaaatttgttataaacggtctttttttaaccaagagcccgaaatcggaaaaacctctttaaaacac

SEQ ID NO: 314800 - DNA, 1471 bp, Homo sapiens
agtcctcggctgtaatttccggtcacgagggctccggttgttctgttacgtgatccagcgtggaccgtctttgaaaggtgtgagttggccagaactctgaaaagattgggaatggatggctacaggggaatcagcctagcaaactggatgtgtttggccaaatgggagagtggttacaacacacgagctacaaactacaatgctggagacagaagcactgattatgggatatttcagatcaatagccgctactggtgtaatgatggcaaaaccccaggagcagttaatgcctgtcatttatcctgcagtgctttgctgcaagataacatcgctgatgctgtagcttgtgcaaagagggttgtccgtgatccacaaggcattagagcatgggtggcatggagaaatcgttgtcaaaacagagatgtccgtcagtatgttcaaggttgtggagtgtaactccagaattttccttcttcagctcattttgtctctctcacattaagggagtaggaattaagtgaaaggtcacactaccattatttccccttcaaacaaataatatttttacagaagcaggagcaaaatatggcctttcttctaagagatataatgttcactaatgtggttattttatattaagcctacaacatttttcagtttgcaaatagaactaatactggtgaaaatttacctaaaaccttggttatcaaatacatctccagtacattccgttctttttttttttgagacagtctcgctctgtcgcccaggctggagtgcagtggcgcaatctcggctcactgcaacctccacctcccgggttcacgccattctcctgcctcagcctcccgagtagctgggattacgggcgcccgccaccacgcccggctaattttttgtatttttagtagagacagggtttcaccgtgttagccaggatggtctcgatctcctgaccttgtgatccacccacctcggcctcccaaagtgctgggattacaggcgtgagccactgcgcccggccacattcagttcttatcaaagaaataacccagacttaatcttgaatgatacgattatgcccaatattaagtaaaaaatataagaaaaggttatcttaaatagatcttaggcaaaataccagctgatgaaggcatctgatgccttcatctgttcagtcatctccaaaaacagtaaaaataaccactttttgttgggcaatatgaaatttttaaaggagtagaataccaaatgatagaaacagactgcctgaattgagaattttgatttcttaaagtgtgtttctttctaaattgctgttccttaatttgattaatttaattcatgtattatgattaaatctgaggcagatgagcttacaagtattgaaataattactaattaatcacaaatgtgaagttatgcatgatgtaaaaaatacaaacattctaattaaaggctttgcaacaca

SEQ ID NO: 314801 - DNA, 1402 bp, Homo sapiens
ttacatcgagctcgcaccctgccatttactccatggctgggaatggatggctacaggggaatcagcctagcaaactggatgtgtttggccaaatgggagagtggttacaacacacgagctacaaactacaatgctggagacagaagcactgattatgggatatttcagatcaatagccgctactggtgtaatgatggcaaaaccccaggagcagttaatgcctgtcatttatcctgcagtgctttgctgcaagataacatcgctgatgctgtagcttgtgcaaagagggttgtccgtgatccacaaggcattagagcatgggtggcatggagaaatcgttgtcaaaacagagatgtccgtcagtatgttcaaggttgtggagtgtaactccagaattttccttcttcagctcattttgtctctctcacattaagggagtaggaattaagtgaaaggtcacactaccattatttccccttcaaacaaataatatttttacagaagcaggagcaaaatatggcctttcttctaagagatataatgttcactaatgtggttattttatattaagcctacaacatttttcagtttgcaaatagaactaatactggtgaaaatttacctaaaaccttggttatcaaatacatctccagtacattccgttctttttttttttgagacagtctcgctctgtcgcccaggctggagtgcagtggcgcaatctcggctcactgcaacctccacctcccgggttcacgccattctcctgcctcagcctcccgagtagctgggattacgggcgcccgccaccacgcccggctaattttttgtatttttagtagagacagggtttcaccgtgttagccaggatggtctcgatctcctgaccttgtgatccacccacctcggcctcccaaagtgctgggattacaggcgtgagccactgcgcccggccacattcagttcttatcaaagaaataacccagacttaatcttgaatgatacgattatgcccaatattaagtaaaaaatataagaaaaggttatcttaaatagatcttaggcaaaataccagctgatgaaggcatctgatgccttcatctgttcagtcatctccaaaaacagtaaaaataaccactttttgttgggcaatatgaaatttttaaaggagtagaataccaaatgatagaaacagactgcctgaattgagaattttgatttcttaaagtgtgtttctttctaaattgctgttccttaatttgattaatttaattcatgtattatgattaaatctgaggcagatgagcttacaagtattgaaataattactaattaatcacaaatgtgaagttatgcatgatgtaaaaaatacaaacattctaattaaaggctttgcaacaca

SEQ ID NO: 314802 - DNA, 1274 bp, Homo sapiens
caccctggtcagcctagcactctgacctagcagtcaacatgaaggctctcattgttctggggcttgtcctcctttctgttacggtccagggcaaggtctttgaaaggtgtgagttggccagaactctgaaaagattgggaatggatggctacaggggaatcagcctagcaaactggatgtgtttggccaaatgggagagtggttacaacacacgagctacaaactacaatgctggagacagaagcactgattatgggatatttcagatcaatagccgctactggtgtaatgatggcaaaaccccaggagcagttaatgcctgtcatttatcctgcagtgctttgctgcaagataacatcgctgatgctgtagcttgtgcaaagagggttgtccgtgatccacaaggcattagagcatgggtggcatggagaaatcgttgtcaaaacagagatgtccgtcagtatgttcaaggttgtggagtgtaactccagaattttccttcttcagctcattttgtctctctcacattaagggagtaggaattaagtgaaaggtcacactaccattatttccccttcaaacaaataatatttttacagaagcaggagcaaaatatggcctttcttctaagagatataatgttcactaatgtggttattttatattaagcctacaacatttttcagtttgcaaatagaactaatactggtgaaaatttacctaaaaccttggttatcaaatacatctccagtacattccgttctttttttttttgagacagtctcgctctgtcgcccaggctggagtgcagtggcgcaatctcggctcactgcaacctccacctcccgggttcacgccattctcctgcctcagcctcccgagtagctgggattacgggcgcccgccaccacgcccggctaattttttgtatttttagtagagacagggtttcaccgtgttagccaggatggtctcgatctcctgaccttgtgatccacccacctcggcctcccaaagtgctgggattacaggcgtgagccactgcgcccggccacattcagttcttatcaaagaaataacccagacttaatcttgaatgatacgattatgcccaatattaagtaaaaaatataagaaaaggttatcttaaatagatcttaggcaaaataccagctgatgaaggcatctgatgccttcatctgttcagtcatctccaaaaacagtaaaaataaccactttttgttgggcacacattatgaggggtccgagccgat

SEQ ID NO: 314803 - DNA, 1457 bp, Homo sapiens
caccctggtcagcctagcactctgacctagcagtcaacatgaaggctctcattgttctggggcttgtcctcctttctgttacggtccagggcaaggtctttgaaaggtgtgagttggccagaactctgaaaagattgggaatggatggctacaggggaatcagcctagcaaactggatgtgtttggccaaatgggagagtggttacaacacacgagctacaaactacaatgctggagacagaagcactgattatgggatatttcagatcaatagccgctactggtgtaatgatggcctttgctgcaagataacatcgctgatgctgtagcttgtgcaaagagggttgtccgtgatccacaaggcattagagcatgggtggcatggagaaatcgttgtcaaaacagagatgtccgtcagtatgttcaaggttgtggagtgtaactccagaattttccttcttcagctcattttgtctctctcacattaagggagtaggaattaagtgaaaggtcacactaccattatttccccttcaaacaaataatatttttacagaagcaggagcaaaatatggcctttcttctaagagatataatgttcactaatgtggttattttatattaagcctacaacatttttcagtttgcaaatagaactaatactggtgaaaatttacctaaaaccttggttatcaaatacatctccagtacattccgttctttttttttttgagacagtctcgctctgtcgcccaggctggagtgcagtggcgcaatctcggctcactgcaacctccacctcccgggttcacgccattctcctgcctcagcctcccgagtagctgggattacgggcgcccgccaccacgcccggctaattttttgtatttttagtagagacagggtttcaccgtgttagccaggatggtctcgatctcctgaccttgtgatccacccacctcggcctcccaaagtgctgggattacaggcgtgagccactgcgcccggccacattcagttcttatcaaagaaataacccagacttaatcttgaatgatacgattatgcccaatattaagtaaaaaatataagaaaaggttatcttaaatagatcttaggcaaaataccagctgatgaaggcatctgatgccttcatctgttcagtcatctccaaaaacagtaaaaataaccactttttgttgggcaatatgaaatttttaaaggagtagaataccaaatgatagaaacagactgcctgaattgagaattttgatttcttaaagtgtgtttctttctaaattgctgttccttaatttgattaatttaattcatgtattatgattaaatctgaggcagatgagcttacaagtattgaaataattactaattaatcacaaatgtgaagttatgcatgatgtaaaaaatacaaacattctaattaaaggctttgcaacaca

SEQ ID NO: 314804 - DNA, 1421 bp, Homo sapiens
caccctggtcagcctagcactctgacctagcagtcaacatgaaggctctcattgttctggggcttgtcctcctttctgttacggtccagggcaaggtctttgaaaggtgtgagttggccagaactctgaaaagattgggaatggatggctacaggggaatcagcctagcaaactggatgtgtttggccaaatgggagagtggttacaacacacgagctacaaactacaatgctggagacagaagcactgattatgggatatttcagatcaatagccgctactggtgtaatgatggcaaaaccccaggagcagttaatgcctgtcatttatcctgcagtgggtggcatggagaaatcgttgtcaaaacagagatgtccgtcagtatgttcaaggttgtggagtgtaactccagaattttccttcttcagctcattttgtctctctcacattaagggagtaggaattaagtgaaaggtcacactaccattatttccccttcaaacaaataatatttttacagaagcaggagcaaaatatggcctttcttctaagagatataatgttcactaatgtggttattttatattaagcctacaacatttttcagtttgcaaatagaactaatactggtgaaaatttacctaaaaccttggttatcaaatacatctccagtacattccgttctttttttttttgagacagtctcgctctgtcgcccaggctggagtgcagtggcgcaatctcggctcactgcaacctccacctcccgggttcacgccattctcctgcctcagcctcccgagtagctgggattacgggcgcccgccaccacgcccggctaattttttgtatttttagtagagacagggtttcaccgtgttagccaggatggtctcgatctcctgaccttgtgatccacccacctcggcctcccaaagtgctgggattacaggcgtgagccactgcgcccggccacattcagttcttatcaaagaaataacccagacttaatcttgaatgatacgattatgcccaatattaagtaaaaaatataagaaaaggttatcttaaatagatcttaggcaaaataccagctgatgaaggcatctgatgccttcatctgttcagtcatctccaaaaacagtaaaaataaccactttttgttgggcaatatgaaatttttaaaggagtagaataccaaatgatagaaacagactgcctgaattgagaattttgatttcttaaagtgtgtttctttctaaattgctgttccttaatttgattaatttaattcatgtattatgattaaatctgaggcagatgagcttacaagtattgaaataattactaattaatcacaaatgtgaagttatgcatgatgtaaaaaatacaaacattctaattaaaggctttgcaacaca

SEQ ID NO: 314805 - DNA, 1256 bp, Homo sapiens
caccctggtcagcctagcactctgacctagcagtcaacatgaaggctctcattgttctggggcttgtcctcctttctgttacggtccagggcaaggtctttgaaaggtgtgagttggccagaactctgaaaagattgggaatggatggctacaggggaatcagcctagcaaactggtggcatggagaaatcgttgtcaaaacagagatgtccgtcagtatgttcaaggttgtggagtgtaactccagaattttccttcttcagctcattttgtctctctcacattaagggagtaggaattaagtgaaaggtcacactaccattatttccccttcaaacaaataatatttttacagaagcaggagcaaaatatggcctttcttctaagagatataatgttcactaatgtggttattttatattaagcctacaacatttttcagtttgcaaatagaactaatactggtgaaaatttacctaaaaccttggttatcaaatacatctccagtacattccgttctttttttttttgagacagtctcgctctgtcgcccaggctggagtgcagtggcgcaatctcggctcactgcaacctccacctcccgggttcacgccattctcctgcctcagcctcccgagtagctgggattacgggcgcccgccaccacgcccggctaattttttgtatttttagtagagacagggtttcaccgtgttagccaggatggtctcgatctcctgaccttgtgatccacccacctcggcctcccaaagtgctgggattacaggcgtgagccactgcgcccggccacattcagttcttatcaaagaaataacccagacttaatcttgaatgatacgattatgcccaatattaagtaaaaaatataagaaaaggttatcttaaatagatcttaggcaaaataccagctgatgaaggcatctgatgccttcatctgttcagtcatctccaaaaacagtaaaaataaccactttttgttgggcaatatgaaatttttaaaggagtagaataccaaatgatagaaacagactgcctgaattgagaattttgatttcttaaagtgtgtttctttctaaattgctgttccttaatttgattaatttaattcatgtattatgattaaatctgaggcagatgagcttacaagtattgaaataattactaattaatcacaaatgtgaagttatgcatgatgtaaaaaatacaaacattctaattaaaggctttgcaacaca

SEQ ID NO: 314806 - DNA, 1458 bp, Homo sapiens
caccctggtcagcctagcactctgacctagcagtcaacatgaaggctctcattgttctggggcttgtcctcctttctgttacggtccagggcaaggtctttgaaaggtgtgagttggccagaactctgaaaagattgggaatggatggctacaggggaatcagcctagcaaactggatgtgtttggccaaatgggagagtggttacaacacacgagctacaaactacaatgctggagacagaagcactgattatgggatatttcagatcaatagccgctactggtgtaatgatggcaaaaccccaggagcagttaatgcctgtcatttatcctgcagtgctttgctgcaagataacatcgctgatgctgtagcttgtgcaaagagggttgtccgtgatccacaaggcattagagcatgggtggcatggagaaatcgttgtcaaaacagagatgtccgtcagtatgttcaaggttgtggagtgtaactccagaattttccttcttcagctcattttgtctctctcacattaagggagtaggaattaatatttttacagaagcaggagcaaaatatggcctttcttctaagagatataatgttcactaatgtggttattttatattaagcctacaacatttttcagtttgcaaatagaactaatactggtgaaaatttacctaaaaccttggttatcaaatacatctccagtacattccgttctttttttttttgagacagtctcgctctgtcgcccaggctggagtgcagtggcgcaatctcggctcactgcaacctccacctcccgggttcacgccattctcctgcctcagcctcccgagtagctgggattacgggcgcccgccaccacgcccggctaattttttgtatttttagtagagacagggtttcaccgtgttagccaggatggtctcgatctcctgaccttgtgatccacccacctcggcctcccaaagtgctgggattacaggcgtgagccactgcgcccggccacattcagttcttatcaaagaaataacccagacttaatcttgaatgatacgattatgcccaatattaagtaaaaaatataagaaaaggttatcttaaatagatcttaggcaaaataccagctgatgaaggcatctgatgccttcatctgttcagtcatctccaaaaacagtaaaaataaccactttttgttgggcaatatgaaatttttaaaggagtagaataccaaatgatagaaacagactgcctgaattgagaattttgatttcttaaagtgtgtttctttctaaattgctgttccttaatttgattaatttaattcatgtattatgattaaatctgaggcagatgagcttacaagtattgaaataattactaattaatcacaaatgtgaagttatgcatgatgtaaaaaatacaaacattctaattaaaggctttgcaacaca

SEQ ID NO: 314807 - DNA, 1105 bp, Homo sapiens
catttgcttcatctttttctacaggtggcatggagaaatcgttgtcaaaacagagatgtccgtcagtatgttcaaggttgtggagtgtaactccagaattttccttcttcagctcattttgtctctctcacattaagggagtaggaattaagtgaaaggtcacactaccattatttccccttcaaacaaataatatttttacagaagcaggagcaaaatatggcctttcttctaagagatataatgttcactaatgtggttattttatattaagcctacaacatttttcagtttgcaaatagaactaatactggtgaaaatttacctaaaaccttggttatcaaatacatctccagtacattccgttctttttttttttgagacagtctcgctctgtcgcccaggctggagtgcagtggcgcaatctcggctcactgcaacctccacctcccgggttcacgccattctcctgcctcagcctcccgagtagctgggattacgggcgcccgccaccacgcccggctaattttttgtatttttagtagagacagggtttcaccgtgttagccaggatggtctcgatctcctgaccttgtgatccacccacctcggcctcccaaagtgctgggattacaggcgtgagccactgcgcccggccacattcagttcttatcaaagaaataacccagacttaatcttgaatgatacgattatgcccaatattaagtaaaaaatataagaaaaggttatcttaaatagatcttaggcaaaataccagctgatgaaggcatctgatgccttcatctgttcagtcatctccaaaaacagtaaaaataaccactttttgttgggcaatatgaaatttttaaaggagtagaataccaaatgatagaaacagactgcctgaattgagaattttgatttcttaaagtgtgtttctttctaaattgctgttccttaatttgattaatttaattcatgtattatgattaaatctgaggcagatgagcttacaagtattgaaataattactaattaatcacaaatgtgaagttatgcatgatgtaaaaaatacaaacattctaattaaaggctttgcaacaca

SEQ ID NO: 314808 - DNA, 875 bp, Homo sapiens
caccctggtcagcctagcactctgacctagcagtcaacatgaaggctctcattgttctggggcttgtcctcctttctgttacggtccagggcaaggtctttgaaaggtgtgagttggccagaactctgaaaagattgggaatggatggctacaggggaatcagcctagcaaactggatgtgtttggccaaatgggagagtggttacaacacacgagctacaaactacaatgctggagacagaagcactgattatgggatatttcagatcaatagccgctactggtgtaatgatggcaaaaccccaggagcagttaatgcctgtcatttatcctgcagtgctttgctgcaagataacatcgctgatgctgtagcttgtgcaaagagggttgtccgtgatccacaaggcattagagcatgggtggcatggagaaatcgttgtcaaaacagagatgtccgtcagtatgttcaaggttgtggagtgtaactccagaattttccttcttcagctcattttgtctctctcacattaagggagtaggaattaagtgaaaggtcacactaccattatttccccttcaaacaaataatatttttacagaagcaggagcaaaatatggcctttcttctaagagatataatgttcactaatgtggttattttatattaagcctacaacatttttcagtttgcaaatagaactaatactggtgaaaatttacctaaaaccttggttatcaaatacatctccagtacattccgttctttttttttttagacagcctgggtgacagagtgagattctgtctcgggggaaaaaaatgatacagttttggaggcataaaagatttcagagatccattgaattctctttaca

SEQ ID NO: 314809 - DNA, 846 bp, Homo sapiens
  misc_feature (114)..(114): n is a, c, g, or t
atcgggcgggatacaggcgtgagcactgcgccggcgcatcagttcttatcaaagaaataacccagacttaatcttgaatgatacgattatgcccaatattaagtaaaaaatatnagaaaaggttatcttaaatagatcttaggcaaaataccagctgatgaaggcatctgatgccttcatctgttcagtcatctccaaaaacagcaaagaaccacacggagtcccgagtagctgggattacgggcgcccgccaccacgcccggctaattttttgtatttttagtagagacagggtttcaccgtgttagccaggatggtctcgatctcctgaccttgtgatccacccacctcggcctcccaaagtgctgggattacaggcgtgagccactgcgcccggccacattcagttcttatcaaagaaataacccagacttaatcttgaatgatacgattatgcccaatattaagtaaaaaatataagaaaaggttatcttaaatagatcttaggcaaaataccagctgatgaaggcatctgatgccttcatctgttcagtcatctccaaaaacagtaaaaataaccactttttgttgggcaatatgaaatttttaaaggagtagaataccaaatgatagaaacagactgcctgaattgagaattttgatttcttaaagtgtgtttctttctaaattgctgttccttaatttgattaatttaattcatgtattatgattaaatctgaggcagatgagcttacaagtattgaaataattactaattaatcacaaatgtgaagttatgcatgatgtaaaaaatacaaacattctaattaaaggctttgcaacaca

SEQ ID NO: 314810 - DNA, 735 bp, Homo sapiens
tgaggcaggagacttgcttgaacccgggaggtggaggttgcagaggattgcgccactgcacttcagcctgggcgacagagcgagactctgtctcaaataaatacataaaatcccgagtagctgggattacgggcgcccgccaccacgcccggctaattttttgtatttttagtagagacagggtttcaccgtgttagccaggatggtctcgatctcctgaccttgtgatccacccacctcggcctcccaaagtgctgggattacaggcgtgagccactgcgcccggccacattcagttcttatcaaagaaataacccagacttaatcttgaatgatacgattatgcccaatattaagtaaaaaatataagaaaaggttatcttaaatagatcttaggcaaaataccagctgatgaaggcatctgatgccttcatctgttcagtcatctccaaaaacagtaaaaataaccactttttgttgggcaatatgaaatttttaaaggagtagaataccaaatgatagaaacagactgcctgaattgagaattttgatttcttaaagtgtgtttctttctaaattgctgttccttaatttgattaatttaattcatgtattatgattaaatctgaggcagatgagcttacaagtattgaaataattactaattaatcacaaatgtgaagttatgcatgatgtaaaaaatacaaacattctaattaaaggctttgcaacaca

SEQ ID NO: 314811 - DNA, 543 bp, Homo sapiens
cactagtagatggcaaagacataaaaaatagccaattaagttttctctgtaagagtgaagtaaagggattacaggcgtgagccactgcgcccggccacattcagttcttatcaaagaaataacccagacttaatcttgaatgatacgattatgcccaatattaagtaaaaaatataagaaaaggttatcttaaatagatcttaggcaaaataccagctgatgaaggcatctgatgccttcatctgttcagtcatctccaaaaacagtaaaaataaccactttttgttgggcaatatgaaatttttaaaggagtagaataccaaatgatagaaacagactgcctgaattgagaattttgatttcttaaagtgtgtttctttctaaattgctgttccttaatttgattaatttaattcatgtattatgattaaatctgaggcagatgagcttacaagtattgaaataattactaattaatcacaaatgtgaagttatgcatgatgtaaaaaatacaaacattctaattaaaggctttgcaacaca

SEQ ID NO: 314812 - DNA, 624 bp, Homo sapiens
caccctggtcagcctagcactctgacctagcagtcaacatgaaggctctcattgttctggggcttgtcctcctttctgttacggtccagggcaaggtctttgaaaggtgtgagttggccagaactctgaaaagattgggaatggatggctacaggggaatcagcctagcaaactggatgtgtttggccaaatgggagagtggttacaacacacgagctacaaactacaatgctggagacagaagcactgattatgggatatttcagatcaatagccgctactggtgtaatgatggcaaaaccccaggagcagttaatgcctgtcatttatcctgcagtgctttgctgcaagataacatcgctgatgctgtagcttgtgcaaagagggttgtccgtgatccacaaggcattagagcatgggtggcatggagaaatcgttgtcaaaacagagatgtccgtcagtatgttcaaggttgtggagtgtaactccagaatctctcctcatttgctcattcccgacccctcacaataaggaagctggattactctctaagcgaccatcccaacatacctcctcaaacacgttcccctgttacgccgctccttccatttaacggtctcattt

SEQ ID NO: 314813 - DNA, 607 bp, Homo sapiens
caccctggtcagcctagcactctgacctagcagtcaacatgaaggctctcattgttctggggcttgtcctcctttctgttacggtccagggcaaggtctttgaaaggtgtgagttggccagaactctgaaaagattgggaatggatggctacaggggaatcagcctagcaaactggtggcatggagaaatcgttgtcaaaacagagatgtccgtcagtatgttcaaggttgtggagtgtaactccagaattttccttcttcagctcattttgtctctctcacattaagggagtaggaattaagtgaaaggtcacactaccattatttccccttcaaacaaataatatttttacagaagcaggagcaaaatatggcctttcttctaagagatataatgttcactaatgtggttattttatattaagcctacaacatttttcagtttgcaaatagaactaatactggtgaaaatttacctaaaaccttggttatcaaatacatctccagtacattccgttcttttttttttttttttttttttttgggaaaaggtcccgctgggcccccagggggggggggcgggggcgcaatcggggcccggggaacc

SEQ ID NO: 314814 - DNA, 816 bp, Homo sapiens
caccctggtcagcctagcactctgacctagcagtcaacatgaaggctctcattgttctggggcttgtcctcctttctgttacggtccagggcaaggtctttgaaaggtgtgagttggccagaactctgaaaagattgggaatggatggctacaggggaatcagcctagcaaactggatgtgtttggccaaatgggagagtggttacaacacacgagctacaaactacaatgctggagacagaagcactgattatgggatatttcagatcaatagccgctactggtgtaatgatggcaaaaccccaggagcagttaatgcctgtcatttatcctgcagtggtaagacaagctaatatttgaccaatctggttatacttacaagaattgagactcaatacaaatgaaaaagccttgaaaggttcatgagggacctagaaaaactacatctcaacttccagaaagtcattattattttcctcataattccctgagtaagaaattaaagaagtggtatcataaaaggttgatgttttttaatatacagaagtttctggaatgacctattaatttactgtcaatggccttactgatgctttgtccagaacaatgccattgctcctgcttactttggggaggttttgggataatttagttgtatggtcctttttcaattgttttacttttttttttatgaaatgttctaaatgtatagaaaattagagacattagtataataaacagccatatgcccattatgcactttaaaagttgttaacattttgccatagttgcttcttctatgcctttttttttttt

SEQ ID NO: 314815 - DNA, 1500 bp, Homo sapiens
caccctggtcagcctagcactctgacctagcagtcaacatgaaggctctcattgttctggggcttgtcctcctttctgttacggtccagggcaaggtctttgaaaggtgtgagttggccagaactctgaaaagattgggaatggatggctacaggggaatcagcctagcaaactggatgtgtttggccaaatgggagagtggttacaacacacgagctacaaactacaatgctggagacagaagcactgattatgggatatttcagatcaatagccgctactggtgtaatgatggcaaaaccccaggagcagttaatgcctgtcatttatcctgcagtgctttgctgcaagataacatcgctgatgctgtagcttgtgcaaagagggttgtccgtgatccacaaggcattagagcatgggtggcatggagaaatcgttgtcaaaacagagatgtccgtcagtatgttcaaggttgtggagtgtaactccagaattttccttcttcagctcattttgtctctctcacattaagggagtaggaattaagtgaaaggtcacactaccattatttccccttcaaacaaataatatttttacagaagcaggagcaaaatatggcctttcttctaagagatataatgttcactaatgtggttattttatattaagcctacaacatttttcagtttgcaaatagaactaatactggtgaaaatttacctaaaaccttggttatcaaatacatctccagtacattccgttctttttttttttgagacagtctcgctctgtcgcccaggctggagtgcagtggcgcaatctcggctcactgcaacctccacctcccgggttcacgccattctcctgcctcagcctcccgagtagctgggattacgggcgcccgccaccacgcccggctaattttttgtatttttagtagagacagggtttcaccgtgttagccaggatggtctcgatctcctgaccttgtgatccacccacctcggcctcccaaagtgctgggattacaggcgtgagccactgcgcccggccacattcagttcttatcaaagaaataacccagacttaatcttgaatgatacgattatgcccaatattaagtaaaaaatataagaaaaggttatcttaaatagatcttaggcaaaataccagctgatgaaggcatctgatgccttcatctgttcagtcatctccaaaaacagtaaaaataaccactttttgttgggcaatatgaaatttttaaaggagtagaataccaaatgatagaaacagactgcctgaattgagaattttgatttcttaaagtgtgtttctttctaaattgctgttccttaatttgattaatttaattcatgtattatgattaaatctgaggcagatgagcttacaagtattgaaataattactaattaatcacaaatgtgaagttatgcatgatgtaaaaaatacaaacattctaattaaaggctttgcaacaca

SEQ ID NO: 314816 - DNA, 1538 bp, Homo sapiens
caccctggtcagcctagcactctgacctagcagtcaacatgaaggctctcattgttctggggcttgtcctcctttctgttacggtccagggcaaggtctttgaaaggtgtgagttggccagaactctgaaaagattgggaatggatggctacaggggaatcagcctagcaaactggatgtgtttggccaaatgggagagtggttacaacacacgagctacaaactacaatgctggagacagaagcactgattatgggatatttcagatcaatagccgctactggtgtaatgatggcaaaaccccaggagcagttaatgcctgtcatttatcctgcagtgctttgctgcaagataacatcgctgatgctgtagcttgtgcaaagagggttgtccgtgatccacaaggcattagagcatgggtggcatggagaaatcgttgtcaaaacagagatgtccgtcagtatgttcaaggttgtggagtgtaactccagaattttccttcttcagctcattttgtctctctcacattaagggagtaggaattaagtgaaaggtcacactaccattatttccccttcaaacaaataatatttttacagaagcaggagcaaaatatggcctttcttctaagagatataatgttcactaatgtggttattttatattaagcctacaacatttttcagtttgcaaatagaactaatactggtgaaaatttacctaaaaccttggttatcaaatacatctccagtacattccgttctttttttttttgagacagtctcgctctgtcgcccaggctggagtgcagtggcgcaatctcggctcactgcaacctccacctcccgggttcacgccattctcctgcctcagcctcccgagtagctgggattacgggcgcccgccaccacgcccggctaattttttgtatttttagtagagacagggtttcaccgtgttagccaggatggtctcgatctcctgaccttgtgatccacccacctcggcctcccaaagtgctgggattacaggcgtgagccactgcgcccggccacattcagttcttatcaaagaaataacccagacttaatcttgaatgatacgattatgcccaatattaagtaaaaaatataagaaaaggttatcttaaatagatcttaggcaaaataccagctgatgaaggcatctgatgccttcatctgttcagtcatctccaaaaacagtaaaaataaccactttttgttgggcaatatgaaatttttaaaggagtagaataccaaatgatagaaacagactgcctgaattgagaattttgatttcttaaagtgtgtttctttctaaattgctgttccttaatttgattaatttaattcatgtattatgattaaatctgaggcagatgagcttacaagtattgaaataattactaattaatcacaaatgtgaagttatgcatgatgtaaaaaatacaaacattctaattaaaggctttgcaacacaaaaaaaaaagaaactatacataaaaacttgtcggcggt

SEQ ID NO: 314817 - DNA, 1745 bp, Homo sapiens
  misc_feature (1516)..(1516): n is a, c, g, or t
  misc_feature (1518)..(1518): n is a, c, g, or t
caccctggtcagcctagcactctgacctagcagtcaacatgaaggctctcattgttctggggcttgtcctcctttctgttacggtccagggcaaggtctttgaaaggtgtgagttggccagaactctgaaaagattgggaatggatggctacaggggaatcagcctagcaaactggatgtgtttggccaaatgggagagtggttacaacacacgagctacaaactacaatgctggagacagaagcactgattatgggatatttcagatcaatagccgctactggtgtaatgatggcaaaaccccaggagcagttaatgcctgtcatttatcctgcagtgctttgctgcaagataacatcgctgatgctgtagcttgtgcaaagagggttgtccgtgatccacaaggcattagagcatgggtggcatggagaaatcgttgtcaaaacagagatgtccgtcagtatgttcaaggttgtggagtgtaactccagaattttccttcttcagctcattttgtctctctcacattaagggagtaggaattaagtgaaaggtcacactaccattatttccccttcaaacaaataatatttttacagaagcaggagcaaaatatggcctttcttctaagagatataatgttcactaatgtggttattttatattaagcctacaacatttttcagtttgcaaatagaactaatactggtgaaaatttacctaaaaccttggttatcaaatacatctccagtacattccgttctttttttttttgagacagtctcgctctgtcgcccaggctggagtgcagtggcgcaatctcggctcactgcaacctccacctcccgggttcacgccattctcctgcctcagcctcccgagtagctgggattacgggcgcccgccaccacgcccggctaattttttgtatttttagtagagacagggtttcaccgtgttagccaggatggtctcgatctcctgaccttgtgatccacccacctcggcctcccaaagtgctgggattacaggcgtgagccactgcgcccggccacattcagttcttatcaaagaaataacccagacttaatcttgaatgatacgattatgcccaatattaagtaaaaaatataagaaaaggttatcttaaatagatcttaggcaaaataccagctgatgaaggcatctgatgccttcatctgttcagtcatctccaaaaacagtaaaaataaccactttttgttgggcaatatgaaatttttaaaggagtagaataccaaatgatagaaacagactgcctgaattgagaattttgatttcttaaagtgtgtttctttctaaattgctgttccttaatttgattaatttaattcatgtattatgattaaatctgaggcagatgagcttacaagtattgaaataattactaattaatcacaaatgtgaagttatgcatgatgtaaaaaatacaaacattctaattaaaggctttgcaacacaaaaaaaaaaaaaaaananaaaaaaaaatttaaatataaaatttaactaaaaaatttatattattttatctgtataaaaaaaaaaataaatataaatatatttttcttgtgtggccccctctggcccaaattattttatagttgggacaaggttaatgatgggcccccaaattgggcctcattggcccatattgcctattggggtgtgtgaacaatataaacctctggacaaactaccttttgcag

SEQ ID NO: 314818 - DNA, 1434 bp, Homo sapiens
caccctggtcagcctagcactctgacctagcagtcaacatgaaggctctcattgttctggggcttgtcctcctttctgttacggtccagggcaaggtctttgaaaggtgtgagttggccagaactctgaaaagattgggaatggatggctacaggggaatcagcctagcaaactggatgtgtttggccaaatgggagagtggttacaacacacgagctacaaactacaatgctggagacagaagcactgattatgggatatttcagatcaatagccgctactggtgtaatgatggcaaaaccccaggagcagttaatgcctgtcatttatcctgcagtgctttgctgcaagataacatcgctgatgctgtagcttgtgcaaagagggttgtccgtgatccacaaggcattagagcatgggtggcatggagaaatcgttgtcaaaacagagatgtccgtcagtatgttcaaggttgtggagtgtaactccagaattttccttcttcagctcattttgtctctctcacattaagggagtaggaattaagtgaaaggtcacactaccattatttccccttcaaacaaataatatttttacagaagcaggagcaaaatatggcctttcttctaagagatataatgttcactaatgtggttattttatattaagcctacaacatttttcagtttgcaaatagaactaatactggtgaaaatttacctaaaaccttggttatcaaatacatctccagtacattccgttctttttttttttgagacagtctcgctctgtcgcccaggctggagtgcagtggcgcaatctcggctcactgcaacctccacctcccgggttcacgccattctcctgcctcagcctcccgagtagctgggattacgggcgcccgccaccacgcccggctaattttttgtatttttagtagagacagggtttcaccgtgttagccaggatggtctcgatctcctgaccttgtgatccacccacctcggcctcccaaagtgctgggattacaggcgtgagccactgcgcccggccacattcagttcttatcaaagaaataacccagacttaatcttgaatgatacgattatgcccaatattaagtaaaaaatataagaaaaggttatcttaaatagatcttaggcaaaataccagctgatgaaggcatctgatgccttcatctgttcagtcatctccaaaaacagtaaaaataaccactttttgttgggcaatatgaaatttttaaaggagtagaataccaaatgatagaaacagactgcctgaattgagaattttgatttcttaaagtgtgtttctttctaaattgctgttccttaatttgattaatttaattcatgtccccgtacatcgttagaagcttgaattcgagcagtagtagtagtagtaggcggccgc

SEQ ID NO: 314819 - DNA, 1448 bp, Homo sapiens
caccctggtcagcctagcactctgacctagcagtcaacatgaaggctctcattgttctggggcttgtcctcctttctgttacggtccagggcaaggtctttgaaaggtgtgagttggccagaactctgaaaagattgggaatggatggctacaggggaatcagcctagcaaactggatgtgtttggccaaatgggagagtggttacaacacacgagctacaaactacaatgctggagacagaagcactgattatgggatatttcagatcaatagccgctactggtgtaatgatggcaaaaccccaggagcagttaatgcctgtcatttatcctgcagtgctttgctgcaagataacatcgctgatgctgtagcttgtgcaaagagggttgtccgtgatccacaaggcattagagcatgggtggcatggagaaatcgttgtcaaaacagagatgtccgtcagtatgttcaaggttgtggagtgtaactccagaattttccttcttcagctcattttgtctctctcacattaagggagtaggaattaagtgaaaggtcacactaccattatttccccttcaaacaaataatatttttacagaagcaggagcaaaatatggcctttcttctaagagatataatgttcactaatgtggttattttatattaagcctacaacatttttcagtttgcaaatagaactaatactggtgaaaatttacctgagacagtctcgctctgtcgcccaggctggagtgcagtggcgcaatctcggctcactgcaacctccacctcccgggttcacgccattctcctgcctcagcctcccgagtagctgggattacgggcgcccgccaccacgcccggctaattttttgtatttttagtagagacagggtttcaccgtgttagccaggatggtctcgatctcctgaccttgtgatccacccacctcggcctcccaaagtgctgggattacaggcgtgagccactgcgcccggccacattcagttcttatcaaagaaataacccagacttaatcttgaatgatacgattatgcccaatattaagtaaaaaatataagaaaaggttatcttaaatagatcttaggcaaaataccagctgatgaaggcatctgatgccttcatctgttcagtcatctccaaaaacagtaaaaataaccactttttgttgggcaatatgaaatttttaaaggagtagaataccaaatgatagaaacagactgcctgaattgagaattttgatttcttaaagtgtgtttctttctaaattgctgttccttaatttgattaatttaattcatgtattatgattaaatctgaggcagatgagcttacaagtattgaaataattactaattaatcacaaatgtgaagttatgcatgatgtaaaaaatacaaacattctaattaaaggctttgcaacaca

SEQ ID NO: 314820 - DNA, 1447 bp, Homo sapiens
caccctggtcagcctagcactctgacctagcagtcaacatgaaggctctcattgttctggggcttgtcctcctttctgttacggtccagggcaaggtctttgaaaggtgtgagttggccagaactctgaaaagattgggaatggatggctacaggggaatcagcctagcaaactggatgtgtttggccaaatgggagagtggttacaacacacgagctacaaactacaatgctggagacagaagcactgattatgggatatttcagatcaatagccgctactggtgtaatgatggcaaaaccccaggagcagttaatgcctgtcatttatcctgcagtgctttgctgcaagataacatcgctgatgctgtagcttgtgcaaagagggttgtccgtgatccacaaggcattagagcatgggtggcatggagaaatcgttgtctttccttcttcagctcattttgtctctctcacattaagggagtaggaattaagtgaaaggtcacactaccattatttccccttcaaacaaataatatttttacagaagcaggagcaaaatatggcctttcttctaagagatataatgttcactaatgtggttattttatattaagcctacaacatttttcagtttgcaaatagaactaatactggtgaaaatttacctaaaaccttggttatcaaatacatctccagtacattccgttctttttttttttgagacagtctcgctctgtcgcccaggctggagtgcagtggcgcaatctcggctcactgcaacctccacctcccgggttcacgccattctcctgcctcagcctcccgagtagctgggattacgggcgcccgccaccacgcccggctaattttttgtatttttagtagagacagggtttcaccgtgttagccaggatggtctcgatctcctgaccttgtgatccacccacctcggcctcccaaagtgctgggattacaggcgtgagccactgcgcccggccacattcagttcttatcaaagaaataacccagacttaatcttgaatgatacgattatgcccaatattaagtaaaaaatataagaaaaggttatcttaaatagatcttaggcaaaataccagctgatgaaggcatctgatgccttcatctgttcagtcatctccaaaaacagtaaaaataaccactttttgttgggcaatatgaaatttttaaaggagtagaataccaaatgatagaaacagactgcctgaattgagaattttgatttcttaaagtgtgtttctttctaaattgctgttccttaatttgattaatttaattcatgtattatgattaaatctgaggcagatgagcttacaagtattgaaataattactaattaatcacaaatgtgaagttatgcatgatgtaaaaaatacaaacattctaattaaaggctttgcaacaca

SEQ ID NO: 314821 - DNA, 875 bp, Homo sapiens
caccctggtcagcctagcactctgacctagcagtcaacatgaaggctctcattgttctggggcttgtcctcctttctgttacggtccagggcaaggtctttgaaaggtgtgagttggccagaactctgaaaagattgggaatggatggctacaggggaatcagcctagcaaactggatgtgtttggccaaatgggagagtggttacaacacacgagctacaaactacaatgctggagacagaagcactgattatgggatatttcagatcaatagccgctactggtgtaatgatggcaaaaccccaggagcagttaatgcctgtcatttatcctgcagtgctttgctgcaagataacatcgctgatgctgtagcttgtgcaaagagggttgtccgtgatccacaaggcattagagcatgggtggcatggagaaatcgttgtcaaaacagagatgtccgtcagtatgttcaaggttgtggagtgtaactccagaattttccttcttcagctcattttgtctctctcacattaagggagtaggaattaagtgaaaggtcacactaccattatttccccttcaaacaaataatatttttacagaagcaggagcaaaatatggcctttcttctaagagatataatgttcactaatgtggttattttatattaagcctacaacatttttcagtttgcaaatagaactaatactggtgaaaatttacctaaaaccttggttatcaaatacatctccagtacattccgttctttttttttttagaacagcctcactccagctgggaagaccaaacgagactctgtttcacacaaatcctaattattcattcaaggtcttactggcaaaccaaacaaaaaaaaa

SEQ ID NO: 314822 - DNA, 1048 bp, Homo sapiens
tatgaatgttatcagtgtgggaggccttcagccagagtgcacactcgccccaacatgaaagaattcacactgaaaagaagccatatacatgcaaaacatgtggtaaggcctttagtcagcgcacatctcttattctacatgaaagaagtcatactggagagaaaccctatgaatgtaatgaatgtgggaaggcatttagcagtggctcagaccttattcgacatcagagaagtcattcttcagagaaaccctatgaatgtagtaaatgtgggaaggcatatagtcggagttcatccctgattcgacatcagaatacacattctgaagaaaaagcctaaggttgttttaaatctataaaatcaacgaatgaggctatcaaacatatggcaaatatgtatttgtctataatgtaaattttgtgtatatgggaccatttgatgatatgtcccactttgaaagccaaagagcaaaagtcattggtgattttgacctcaggatttgaaattaactgaaggaaactcagaagtttggtcagtcattgtgaatgaagatcatttttcatttgataagggattacaggcgtgagccactgcgcccggccacattcagttcttatcaaagaaataacccagacttaatcttgaatgatacgattatgcccaatattaagtaaaaaatataagaaaaggttatcttaaatagatcttaggcaaaataccagctgatgaaggcatctgatgccttcatctgttcagtcatctccaaaaacagtaaaaataaccactttttgttgggcaatatgaaatttttaaaggagtagaataccaaatgatagaaacagactgcctgaattgagaattttgatttcttaaagtgtgtttctttctaaattgctgttccttaatttgattaatttaattcatgtattatgattaaatctgaggcagatgagcttacaagtattgaaataattactaattaatcacaaatgtgaagttatgcatgatgtaaaaaatacaaacattctaattaaaggctttgcaacaca

SEQ ID NO: 314823 - DNA, 721 bp, Homo sapiens
caccctggtcagcctagcactctgacctagcagtcaacatgaaggctctcattgttctggggcttgtcctcctttctgttacggtccagggcaaggtctttgaaaggtgtgagttggccagaactctgaaaagattgggaatggatggctacaggggaatcagcctagcaaactggatgtgtttggccaaatgggagagtggttacaacacacgagctacaaactacaatgctggagacagaagcactgattatgggatatttcagatcaatagccgctactggtgtaatgatggcaaaaccccaggagcagttaatgcctgtcatttatcctgcagtgctttgctgcaagataacatcgctgatgctgtagcttgtgcaaagagggttgtccgtgatccacaaggcattagagcatgggtggcatggagaaatcgttgtcaaaacagagatgtccgtttttgttgggcaatatgaaatttttaaaggagtagaataccaaatgatagaaacagactgcctgaattgagaattttgatttcttaaagtgtgtttctttctaaattgctgttccttaatttgattaatttaattcatgtattatgattaaatctgaggcagatgagcttacaagtattgaaataattactaattaatcacaaatgtgaagttatgcatgatgtaaaaaatacaaacattctaattaaaggctttgcaacaca

SEQ ID NO: 314824 - DNA, 852 bp, Homo sapiens
  misc_feature (734)..(734): n is a, c, g, or t
  misc_feature (740)..(740): n is a, c, g, or t
  misc_feature (742)..(743): n is a, c, g, or t
tgtcgaagacacttccggtggcgacggaggtaggcttacgaggcctgtgtcgggtagaaagggtccttcctggaccgggaccctctgccacgaccatggaccgtaggaaaaagcctttggacgtcacggcctcctcgttggtagatcttaaggctgaactcttccgaaagcaagaagaattcaaacaagaaaaacttctaaaagattctggagtttttggaaaaccaaaaacaactaacaagaaaccaagtatctggagcaaacagaatgtaggcgtttcaaatcgagctgagaaggatgctgaacagaagattgaagaacagaagactttagacaaagcaagacaatgtatttcaaaggcattgaagcagggaaggttccctattttcctcatgcagatactatcatctattccatctctacagcaatttgcttccaggcagctgtcatggaagttcagactttgagaccatcttactggaagttccttttaagactcaccaagggcaaatttgctgtcatgaaccgaaaagtccttgatgtttttggtactggtgcatctaaacactttcaggatttcatccccaggttggatccaagatacacaactgttaacaccagagttgcccacagagtttcctgaagatgactgtacttattaatgtgactaaatgtttcatcttgaagagttaattatgttgacccaaggaggggccaagctcgaacttcagggngattcngnngaaaaaccctcattggttgggtctcatgaatccgaatcgaagcttggaaagtgcgaaaaaaggccccaccaaaaatcggtccggggggcggcatttttgggcaattgcc

SEQ ID NO: 314825 - DNA, 2968 bp, Homo sapiens
tgtcgaagacacttccggtggcgacggaggtaggcttacgaggcctgtgtcgggtagaaagggtccttcctggaccgggaccctctgccacgaccatggaccgtaggaaaaagcctttggacgtcacggcctcctcgttggtagatcttaaggctgaactcttccgaaagcaagaagaattcaaacaagaaaaacttctaaaagattctggagtttttggaaaaccaaaaacaactaacaagaaaccaagtatctggagcaaacagaatgtaggcgtttcaaatcgagctgagaaggatgctgaacagaagattgaagaacagaagactttagacaaagcaagggaaaaattggaagaaaaagccaaattatatgaaaaaatgactaaaggagactttatagatgaagaagtagaggatatgtaccttgtggatttcacacagaagatcatagacaagcgcaaagaaatggaggcatctggtgcccatagagattctcaaaaggcaggagaaagggacgacgatgaggaaaaccttcctgagggagagatccctcctccccaagaccccagtgaagaatgggtggattacgtggactctttggggcgttcccggcgctgtatgagaaaggatttgccagatctgctggagatggataaaaatcttcaggggagactttttattagtcctgctaatgaaaaaaccctattatctgaagatatgagaaaagaacttcagcgccagcaatgggaggaagaagaaagagaggccctgaagaggcccatggggcccgtacattatgaagacattcgggaaaatgaggcccggcaacttggtgttgggtattttgcctttgcccgagacaaagagttgagaaacaagcagatgaaaaccttagagatgctgcgtgaacagacaacagatcagagaacaaaacgagaaaacataaaggaaaagcgaaaggctatcttagaggcaagacttgccaaacttcgacaaaaaaagatgaaaaaatcaaaagaaggtggaacagaagaagaaaatagagatggagatgttattgggcctttgccaccggagccagaggctgtgccaaccccacgtcctgctgcccagagtagcaaagtagaagtcattgtccaggagaggaaggacaccaagcctggagtgccacacatccgggagtgggaccgcggaaaagaattttcctttggatactggtcgaagaggcagtcagatctccgggctgagagagatcctgagtttgccccgccgtcagattactttgtgggtcagaagagaactggtttttccagcagccaggcatggagcagacctgggccagcacagagtgacccagggcagtgccctgaccagagccacggacctagccctgaacatacgtcacccactcctgcccccgacaacccaccacaagcccccacagttactttcaaaactctggatgacatgatttcctattacaaacaagtgacatgatctttcaaagcacgctgacttgggtttgtactttgacagtgcctttctctcccagagggagaaataactttaggaactgaattgtacctttgtcctgtcctttccctaggaggcacagacttcgggttggatttgtcagcaaggaggaaagttatggaaactttggccacttggctgttcattttattctaagtgggatagggacatacctacctggatttacatgtgagctgcgatagaatagaagtatttattctgtaaaattagacactgagatgtgcttataaccctgtttcatatctactcccacgacttactcatatttaagggttcttttccattccttttgcaaatccgagcatgcaggtgtctttattccaagggttcagcttccagatcagccgatggaccataggtcacgaggaatttctccctgtcaagcagtggaaaactgcatgggaggcaaaatgctctgttctccaagaggacccggaagtaatcacataggaaatgataaggaagaccaggaggagctcttcgtagtccagaaaggtagaagtgggagttgtttacttaattttactgtcataccatgctattacctacactcctgtgtgcagtgggcattcagtaaatgtgtgttgaaggactgggacgtacgtggaggctgctggacctggtcagagactgatgtgccttagcggcaatggttagagcttttcagtgcatcccacctccctgtcgcccccatgctcggcttcctcacattcaggagcctgacttggatcagacttggggctgcacagtggagcaggtgggttcccatgtcattagtaataaggagagggttgggggtgggcagggctccagaaagtcagcagtgtgcctgggcacccaccccatcctctacctgccacacctcagagggttcctacagctgcacacaagcagttgagagttgatgaccaggcccatagggctcccacagctggttcccaggccagtgagtgctgtgagaatacagtagcacaagtccttgttctctgaagagtgggaaggagaggagtgagtgaagtagcctgtcccctgcaggtcctctgcgatggcattgtctcggttcccgcagtgctgcagtgtggaagggagtgccccatcctcattacagatgacacactggagtgtggaggggtcgatgacttgtgcagggtcatatggtacctaaggggcagatctcagacttaaacacaattgatgtctaacccctagacagtctttttagtgccctctgctctcagtcttgttgccctagtatcaagcaatcttagacaaacatcctgaattcttacaaacttacctctaaactctgaggataaagttgccagtccttttaatggtcagcctaatcattctgtcagcctaatcgggtaattgctttttttaataaatacacataaaaaccacaaaaacag

SEQ ID NO: 314826 - DNA, 2753 bp, Homo sapiens
tgtcgaagacacttccggtggcgacggaggtaggcttacgaggcctgtgtcgggtagaaagggtccttcctggaccgggaccctctgccacgaccatggaccgtaggaaaaagcctttggacgtcacggcctcctcgttggtagatcttaaggctgaactcttccgaaagcaagaagaattcaaacaagaaaaacttctaaaagattctggagtttttggaaaaccaaaaacaactaacaagaaaccaagtatctggagcaaacagaatgtaggcgtttcaaatcgagctgagaaggatgctgaacagaagattgaagaacagaagactttagacaaagcaagggaaaaattggaagaaaaagccaaattatatgaaaaaatgactaaaggagactttatagatgaagaagtagaggatatgtaccttgtggatttcacacagaagatcatagacaagcgcaaagaaatggaggcatctggtgcccatagagattctcaaaaggcaggagaaagggacgacgatgaggaaaaccttcctgagggagagatccctcctccccaagaccccagtgaagaatgggtggattacgtggactctttggggcgttcccggcgctgtatgagaaaggatttgccagatctgctggagatggataaaaatcttcaggggagactttttattagtcctgctaatgaaaaaaccctattatctgaagatatgagaaaagaacttcagcgccagcaatgggaggaagaagaaagagaggccctgaagaggcccatggggcccgtacattatgaagacattcgggaaaatgaggcccggcaacttggtgttgggtattttgcctttgcccgagacaaagagttgagaaacaagcagatgaaaaccttagagatgctgcgtgaacagacaacagatcagagaacaaaacgagaaaacataaaggaaaagcgaaaggctatcttagaggcaagacttgccaaacttcgacaaaaaaagatgaaaaaatcaaaagaaggtggaacagaagaagaaaatagagatggagatgttattgggcctttgccaccggagccagaggctgtgccaaccccacgtcctgctgcccagagtagcaaagtagaagtcattgtccaggagaggaaggacaccaagcctggagtgccacacatccgggagtgggaccgcggaaaagaattttcctttggatactggtcgaagaggcagtcagatctccgggctgagagagatcctgagtttgccccgccgtcagattactttgtgggtcagaagagaactggtttttccagcagccaggcatggagcagacctgggccagcacagagtgacccagggcagtgccctgaccagagccacggacctagccctgaacatacgtcacccactcctgcccccgacaacccaccacaagcccccacagttactttcaaaactctggatgacatgatttcctattacaaacaagtgacatgatctttcaaagcacgctgacttgggtttgtactttgacagtgcctttctctcccagagggagaaataactttaggaactgaattgtacctttgtcctgtcctttccctaggaggcacagacttcgggttggatttgtcagcaaggaggaaagttatggaaactttggccacttggctgttcattttattctaagtgggatagggacatacctacctggatttacatgtgagctgcgatagaatagaagtatttattctgtaaaattagacactgagatgtgcttataaccctgtttcatatctactcccacgacttactcatatttaagggttcttttccattccttttgcaaatccgagcatgcaggtgtctttattccaagggttcagcttccagatcagccgatggaccataggtcacgaggaatttctccctgtcaagcagtggaaaactgcatgggaggcaaaatgctctgttctccaagaggacccggaagtaatcacataggaaatgataaggaagaccaggaggagctcttcgtagtccagaaaggtagaagtgggagttgtttacttaattttactgtcataccatgctattacctacactcctgtgtgcagtgggcattcagtaaatgtgtgttgaaggactgggacgtacgtggaggctgctggacctggtcagagactgatgtgccttagcggcaatggttagagcttttcagtgcatcccacctccctgtcgcccccatgctcggcttcctcacattcaggagcctgacttggatcagacttggggctgcacagtggagcagaaattgacaagctaatcttaaaattcacatggaaatgcaaggaacccagaatagtcaaaacaatctagagaaaaaacaaagaggactcacacttcctgatttcaagattgaccacaaagctacgataatctacacagtgtggtagtggcataagaatagacacatagatcagtggaatagaggcgagagtccagaaataaaacatatatccgtggtcaattgatttttgacagtggtgccaggaccatccagtggggaaagagcagtcttttcaacaaatggttctgggacaagtgaatattccatgcaaaagaatgggtttggacttctgcctcacaccacatacaaaaaatcaactcacgatgaatcaaagacctaaatgtaagagctaaaactacaaaacctactgaaacagcttgtaggataaagagggaggagac

SEQ ID NO: 314827 - DNA, 2510 bp, Homo sapiens
  misc_feature (60)..(60): n is a, c, g, or t
  misc_feature (62)..(62): n is a, c, g, or t
  misc_feature (87)..(88): n is a, c, g, or t
aagaagaagatgataatataatttatgttacgcataagttaatgaagggtgtgaaaaagnangagtttgtgtaaacatgttcagtannagatccctcctccccaagaccccagtgaagaatgggtggattacgtggactctttggggcgttcccggcgctgtatgagaaaggatttgccagatctgctggagatggataaaaatcttcaggggagactttttattagtcctgctaatgaaaaaaccctattatctgaagatatgagaaaagaacttcagcgccagcaatgggaggaagaagaaagagaggccctgaagaggcccatggggcccgtacattatgaagacattcgggaaaatgaggcccggcaacttggtgttgggtattttgcctttgcccgagacaaagagttgagaaacaagcagatgaaaaccttagagatgctgcgtgaacagacaacagatcagagaacaaaacgagaaaacataaaggaaaagcgaaaggctatcttagaggcaagacttgccaaacttcgacaaaaaaagatgaaaaaatcaaaagaaggtggaacagaagaagaaaatagagatggagatgttattgggcctttgccaccggagccagaggctgtgccaaccccacgtcctgctgcccagagtagcaaagtagaagtcattgtccaggagaggaaggacaccaagcctggagtgccacacatccgggagtgggaccgcggaaaagaattttcctttggatactggtcgaagaggcagtcagatctccgggctgagagagatcctgagtttgccccgccgtcagattactttgtgggtcagaagagaactggtttttccagcagccaggcatggagcagacctgggccagcacagagtgacccagggcagtgccctgaccagagccacggacctagccctgaacatacgtcacccactcctgcccccgacaacccaccacaagcccccacagttactttcaaaactctggatgacatgatttcctattacaaacaagtgacatgatctttcaaagcacgctgacttgggtttgtactttgacagtgcctttctctcccagagggagaaataactttaggaactgaattgtacctttgtcctgtcctttccctaggaggcacagacttcgggttggatttgtcagcaaggaggaaagttatggaaactttggccacttggctgttcattttattctaagtgggatagggacatacctacctggatttacatgtgagctgcgatagaatagaagtatttattctgtaaaattagacactgagatgtgcttataaccctgtttcatatctactcccacgacttactcatatttaagggttcttttccattccttttgcaaatccgagcatgcaggtgtctttattccaagggttcagcttccagatcagccgatggaccataggtcacgaggaatttctccctgtcaagcagtggaaaactgcatgggaggcaaaatgctctgttctccaagaggacccggaagtaatcacataggaaatgataaggaagaccaggaggagctcttcgtagtccagaaaggtagaagtgggagttgtttacttaattttactgtcataccatgctattacctacactcctgtgtgcagtgggcattcagtaaatgtgtgttgaaggactgggacgtacgtggaggctgctggacctggtcagagactgatgtgccttagcggcaatggttagagcttttcagtgcatcccacctccctgtcgcccccatgctcggcttcctcacattcaggagcctgacttggatcagacttggggctgcacagtggagcaggtgggttcccatgtcattagtaataaggagagggttgggggtgggcagggctccagaaagtcagcagtgtgcctgggcacccaccccatcctctacctgccacacctcagagggttcctacagctgcacacaagcagttgagagttgatgaccaggcccatagggctcccacagctggttcccaggccagtgagtgctgtgagaatacagtagcacaagtccttgttctctgaagagtgggaaggagaggagtgagtgaagtagcctgtcccctgcaggtcctctgcgatggcattgtctcggttcccgcagtgctgcagtgtggaagggagtgccccatcctcattacagatgacacactggagtgtggaggggtcgatgacttgtgcagggtcatatggtacctaaggggcagatctcagacttaaacacaattgatgtctaacccctagacagtctttttagtgccctctgctctcagtcttgttgccctagtatcaagcaatcttagacaaacatcctgaattcttacaaacttacctctaaactctgaggataaagttgccagtccttttaatggtcagcctaatcattctgtcagcctaatcgggtaattgctttttttaataaatacacataaaaaccacaaaaacag

SEQ ID NO: 314828 - DNA, 2934 bp, Homo sapiens
tgtcgaagacacttccggtggcgacggaggtaggcttacgaggcctgtgtcgggtagaaagggtccttcctggaccgggaccctctgccacgaccatggaccgtaggaaaaagcctttggacgtcacggcctcctcgttggtagatcttaaggctgaactcttccgaaagcaagaagaattcaaacaagaaaaacttctaaaagattctggagtttttggaaaaccaaaaacaactaacaagaaaccaagtatctggagcaaacagaatgtaggcgtttcaaatcgagctgagaaggatgctgaacagaagattgaagaacagaagactttagacaaagcaagggaaaaattggaagaaaaagccaaattatatgaaaaaatgactaaaggagactttatagatgaagaagtagaggatatgtaccttgtggatttcacacagaagatcatagacaagcgcaaagaaatggaggcatctggtgcccatagagattctcaaaaggcaggagaaagggacgacgatgaggaaaaccttcctgagggagagatccctcctccccaagaccccagtgaagaatgggtggattacgtggactctttggggcgttcccggcgctgtatgagaaaggatttgccagatctgctggagatggataaaaatcttcaggggagactttttattagtcctgctaatgaaaaaaccctattatctgaagatatgagaaaagaacttcagcgccagcaatgggaggaagaagaaagagaggccctgaagaggcccatggggcccgtacattatgaagacattcgggaaaatgaggcccggcaacttggtgttgggtattttgcctttgcccgagacaaagagttgagaaacaagcagatgaaaaccttagagatgctgcgtgaacagacaacagatcagagaacaaaacgagaaaacataaaggaaaagcgaaaggctatcttagaggcaagacttgccaaacttcgacaaaaaaagatgaaaaaatcaaaagaaggtggaacagaagaagaaaatagagatggagatgttattgggcctttgccaccggagccagaggctgtgccaaccccacgtcctgctgcccagagtagcaaagtagaagtcattgtccaggagaggaaggacaccaagcctggaaattttcctttggatactggtcgaagaggcagtcagatctccgggctgagagagatcctgagtttgccccgccgtcagattactttgtgggtcagaagagaactggtttttccagcagccaggcatggagcagacctgggccagcacagagtgacccagggcagtgccctgaccagagccacggacctagccctgaacatacgtcacccactcctgcccccgacaacccaccacaagcccccacagttactttcaaaactctggatgacatgatttcctattacaaacaagtgacatgatctttcaaagcacgctgacttgggtttgtactttgacagtgcctttctctcccagagggagaaataactttaggaactgaattgtacctttgtcctgtcctttccctaggaggcacagacttcgggttggatttgtcagcaaggaggaaagttatggaaactttggccacttggctgttcattttattctaagtgggatagggacatacctacctggatttacatgtgagctgcgatagaatagaagtatttattctgtaaaattagacactgagatgtgcttataaccctgtttcatatctactcccacgacttactcatatttaagggttcttttccattccttttgcaaatccgagcatgcaggtgtctttattccaagggttcagcttccagatcagccgatggaccataggtcacgaggaatttctccctgtcaagcagtggaaaactgcatgggaggcaaaatgctctgttctccaagaggacccggaagtaatcacataggaaatgataaggaagaccaggaggagctcttcgtagtccagaaaggtagaagtgggagttgtttacttaattttactgtcataccatgctattacctacactcctgtgtgcagtgggcattcagtaaatgtgtgttgaaggactgggacgtacgtggaggctgctggacctggtcagagactgatgtgccttagcggcaatggttagagcttttcagtgcatcccacctccctgtcgcccccatgctcggcttcctcacattcaggagcctgacttggatcagacttggggctgcacagtggagcaggtgggttcccatgtcattagtaataaggagagggttgggggtgggcagggctccagaaagtcagcagtgtgcctgggcacccaccccatcctctacctgccacacctcagagggttcctacagctgcacacaagcagttgagagttgatgaccaggcccatagggctcccacagctggttcccaggccagtgagtgctgtgagaatacagtagcacaagtccttgttctctgaagagtgggaaggagaggagtgagtgaagtagcctgtcccctgcaggtcctctgcgatggcattgtctcggttcccgcagtgctgcagtgtggaagggagtgccccatcctcattacagatgacacactggagtgtggaggggtcgatgacttgtgcagggtcatatggtacctaaggggcagatctcagacttaaacacaattgatgtctaacccctagacagtctttttagtgccctctgctctcagtcttgttgccctagtatcaagcaatcttagacaaacatcctgaattcttacaaacttacctctaaactctgaggataaagttgccagtccttttaatggtcagcctaatcattctgtcagcctaatcgggtaattgctttttttaataaatacacataaaaaccacaaaaacag

SEQ ID NO: 314829 - DNA, 367 bp, Homo sapiens
taacaataaattcaactgattcgttaatcagttctaataactttctttcttatttttaccaaattttcctttggatactggtcgaagaggcagtcagatctccgggctgagagagatcctgagtttgccccgccgtcagattactttgtgggtcagaagagaactggtttttccagcagccaggcatggagcagacctgggccagcacagagtgacccagggcagtgccctgaccagagccacggacctagccctgaacatacgtcacccactcctgcccccgacaacccaccacaagcccccacagttactttcaaaactctggatgacatgatttcctattacaaacaagtgacatgatctttca

SEQ ID NO: 314830 - DNA, 1650 bp, Homo sapiens
tgtcgaagacacttccggtggcgacggaggtaggcttacgaggcctgtgtcgggtagaaagggtccttcctggaccgggaccctctgccacgaccatggaccgtaggaaaaagcctttggacgtcacggcctcctcgttggtagatcttaaggctgaactcttccgaaagcaagaagaattcaaacaagaaaaacttctaaaagattctggagtttttggaaaaccaaaaacaactaacaagaaaccaagtatctggagcaaacagaatgtaggcgtttcaaatcgagctgagaaggatgctgaacagaagattgaagaacagaagactttagacaaagcaagacaatgtatttcaaaggcattgaagcagggaaggttccctattttcctcatgcagatactatcatctattccatctctacagcaatttgcttccaggcagctgtcatggaagttcagactttgagaccatcttactggaagttccttttaagactcaccaagggcaaatttgctgtcatgaaccgaaaagtccttgatgtttttggtactggtgcatctaaacactttcaggatttcatccccaggttggatccaagatacacaactgttaacaccagagttgcccacagagtttcctgaagatgactgtacttattaatgtgactaaatgtttcatcttgaagagttaattatgttgacccaaggaggggccaagctcgaacttcagtgttatttcagttagagatactcttttcatttgttttgtttttcttatgaatcagaaattcagaagctttttaggaagatgttgcttaataattaagcttcctccatagccagaataagattctggatcactgtagtgactgacattatatattattgatcaaattatgtccacaagcaatattatataatctacgtagaagtgtaataacaaacaagagtacacttaaaattactttaaaagatgtctttagttcattccaatataattcttgattaaaattaggattatttctacattttaggatttacaaaggatcacgggtacatggatttggtctatatatttttttaaagttttgaattggtatctgtagtagtggaatgttatagatttgaagtaactctccacggacagtgctgctttcgtgtagagcaatttaattggagaagtggccattcttacttcagggatgcaaagatgggtctcataccatttggataaatgtcgtggtatccatgctttttttcaactaataacatcatctctcttcatgaccagttaattgggctatttggcagcccagtgaacctatgtactaatggcaagttaggggcaaatggaaatggacacatccgataaagttgaaatgtatgttttaatctttcacagaagtattacacttgaatatttaaaaacaaaacttttaaacttcctataggtttatgatgtttgttttcatttatatggacataatccttcatagctcagtttatatgccattgttgtattagaagggatcaaaatcctatggaacaaagtagtcttggcaagttggcagtttgtgtcctctcagctgtttaacttatgtaatggatgttttgcacctgaaaacactataaaaatccagtggttgtcg

SEQ ID NO: 314831 - DNA, 648 bp, Homo sapiens
tgtcgaagacacttccggtggcgacggaggtaggcttacgaggcctgtgtcgggtagaaagggtccttcctggaccgggaccctctgccacgaccatggaccgtaggaaaaagcctttggacgtcacggcctcctcgttggtagatcttaaggctgaactcttccgaaagcaagaagaattcaaacaagaaaaacttctaaaagattctggagtttttggaaaaccaaaaacaactaacaagaaaccaagtatctggagcaaacagaatgtaggcgtttcaaatcgagctgagaaggatgctgaacagaagattgaagaacagaagactttagacaaagcaagggaaaaaaaaaaaaaaaaaaaaaaaaaaaaaatttgtgggggggccttgggccttggaaaaagttttttaaacctttggtggggggggggggcccgtgggtacgtgtgcaactgtggggcaaacgagtgttccctaagggaaaccgcggcgcacaggcacaacgtgcgggggtttctccaccaaattaaaaacgcgcgggggggcaccggaggggttgtgaaaaattccagagggggtccggggggcatcaaggggctcttccagcgggaggtccaggagagccgattaattaacccggatgatg

SEQ ID NO: 314832 - DNA, 2740 bp, Homo sapiens
tgtcgaagacacttccggtggcgacggaggtaggcttacgaggcctgtgtcgggtagaaagggtccttcctggaccgggaccctctgccacgaccatggaccgtaggaaaaagcctttggacgtcacggcctcctcgttggtagatcttaaggctgaactcttccgaaagcaagaagaattcaaacaagaaaaacttctaaaagattctggagtttttggaaaaccaaaaacaactaacaagaaaccaagtatctggagcaaacagaatgtaggcgtttcaaatcgagctgagaaggatgctgaacagaagattgaagaacagaagactttagacaaagcaagggaaaaattggaagaaaaagccaaattatatgaaaaaatgactaaaggagactttatagatgaagaagtagaggatatgtaccttgtggatttcacacagaagatcatagacaagcgcaaagaaatggaggcatctggtgcccatagagattctcaaaaggcaggagaaagggacgacgatgaggaaaaccttcctgagggagagatccctcctccccaagaccccagtgaagaatgggtggattacgtggactctttggggcgttcccggcgctgtatgagaaaggatttgccagatctgctggagatggataaaaatcttcaggggagactttttattagtcctgctaatgaaaaaaccctattatctgaagatatgagaaaagaacttcagcgccagcaatgggaggaagaagaaagagaggccctgaagaggcccatggggcccgtacattatgaagacattcgggaaaatgatggagatgttattgggcctttgccaccggagccagaggctgtgccaaccccacgtcctgctgcccagagtagcaaagtagaagtcattgtccaggagaggaaggacaccaagcctggagtgccacacatccgggagtgggaccgcggaaaagaattttcctttggatactggtcgaagaggcagtcagatctccgggctgagagagatcctgagtttgccccgccgtcagattactttgtgggtcagaagagaactggtttttccagcagccaggcatggagcagacctgggccagcacagagtgacccagggcagtgccctgaccagagccacggacctagccctgaacatacgtcacccactcctgcccccgacaacccaccacaagcccccacagttactttcaaaactctggatgacatgatttcctattacaaacaagtgacatgatctttcaaagcacgctgacttgggtttgtactttgacagtgcctttctctcccagagggagaaataactttaggaactgaattgtacctttgtcctgtcctttccctaggaggcacagacttcgggttggatttgtcagcaaggaggaaagttatggaaactttggccacttggctgttcattttattctaagtgggatagggacatacctacctggatttacatgtgagctgcgatagaatagaagtatttattctgtaaaattagacactgagatgtgcttataaccctgtttcatatctactcccacgacttactcatatttaagggttcttttccattccttttgcaaatccgagcatgcaggtgtctttattccaagggttcagcttccagatcagccgatggaccataggtcacgaggaatttctccctgtcaagcagtggaaaactgcatgggaggcaaaatgctctgttctccaagaggacccggaagtaatcacataggaaatgataaggaagaccaggaggagctcttcgtagtccagaaaggtagaagtgggagttgtttacttaattttactgtcataccatgctattacctacactcctgtgtgcagtgggcattcagtaaatgtgtgttgaaggactgggacgtacgtggaggctgctggacctggtcagagactgatgtgccttagcggcaatggttagagcttttcagtgcatcccacctccctgtcgcccccatgctcggcttcctcacattcaggagcctgacttggatcagacttggggctgcacagtggagcaggtgggttcccatgtcattagtaataaggagagggttgggggtgggcagggctccagaaagtcagcagtgtgcctgggcacccaccccatcctctacctgccacacctcagagggttcctacagctgcacacaagcagttgagagttgatgaccaggcccatagggctcccacagctggttcccaggccagtgagtgctgtgagaatacagtagcacaagtccttgttctctgaagagtgggaaggagaggagtgagtgaagtagcctgtcccctgcaggtcctctgcgatggcattgtctcggttcccgcagtgctgcagtgtggaagggagtgccccatcctcattacagatgacacactggagtgtggaggggtcgatgacttgtgcagggtcatatggtacctaaggggcagatctcagacttaaacacaattgatgtctaacccctagacagtctttttagtgccctctgctctcagtcttgttgccctagtatcaagcaatcttagacaaacatcctgaattcttacaaacttacctctaaactctgaggataaagttgccagtccttttaatggtcagcctaatcattctgtcagcctaatcgggtaattgctttttttaataaatacacataaaaaccacaaaaacag

SEQ ID NO: 314833 - DNA, 2277 bp, Homo sapiens
cggccgctactactactaaattcgcggccgtcgaaaagaacttcagcgccagcaatgggaggaagaagaaagagaggccctgaagaggcccatggggcccgtacattatgaagacattcgggaaaatgaggcccggcaacttggtgttgggtattttgcctttgcccgagacaaagagttgagaaacaagcagatgaaaaccttagagatgctgcgtgaacagacaacagatcagagaacaaaacgagaaaacataaaggaaaagcgaaaggctatcttagaggcaagacttgccaaacttcgacaaaaaaagatgaaaaaatcaaaagaaggtggaacagaagaagaaaatagagatggagatgttattgggcctttgccaccggagccagaggctgtgccaaccccacgtcctgctgcccagagtagcaaagtagaagtcattgtccaggagaggaaggacaccaagcctggagtgccacacatccgggagtgggaccgcggaaaagaattttcctttggatactggtcgaagaggcagtcagatctccgggctgagagagatcctgagtttgccccgccgtcagattactttgtgggtcagaagagaactggtttttccagcagccaggcatggagcagacctgggccagcacagagtgacccagggcagtgccctgaccagagccacggacctagccctgaacatacgtcacccactcctgcccccgacaacccaccacaagcccccacagttactttcaaaactctggatgacatgatttcctattacaaacaagtgacatgatctttcaaagcacgctgacttgggtttgtactttgacagtgcctttctctcccagagggagaaataactttaggaactgaattgtacctttgtcctgtcctttccctaggaggcacagacttcgggttggatttgtcagcaaggaggaaagttatggaaactttggccacttggctgttcattttattctaagtgggatagggacatacctacctggatttacatgtgagctgcgatagaatagaagtatttattctgtaaaattagacactgagatgtgcttataaccctgtttcatatctactcccacgacttactcatatttaagggttcttttccattccttttgcaaatccgagcatgcaggtgtctttattccaagggttcagcttccagatcagccgatggaccataggtcacgaggaatttctccctgtcaagcagtggaaaactgcatgggaggcaaaatgctctgttctccaagaggacccggaagtaatcacataggaaatgataaggaagaccaggaggagctcttcgtagtccagaaaggtagaagtgggagttgtttacttaattttactgtcataccatgctattacctacactcctgtgtgcagtgggcattcagtaaatgtgtgttgaaggactgggacgtacgtggaggctgctggacctggtcagagactgatgtgccttagcggcaatggttagagcttttcagtgcatcccacctccctgtcgcccccatgctcggcttcctcacattcaggagcctgacttggatcagacttggggctgcacagtggagcaggtgggttcccatgtcattagtaataaggagagggttgggggtgggcagggctccagaaagtcagcagtgtgcctgggcacccaccccatcctctacctgccacacctcagagggttcctacagctgcacacaagcagttgagagttgatgaccaggcccatagggctcccacagctggttcccaggccagtgagtgctgtgagaatacagtagcacaagtccttgttctctgaagagtgggaaggagaggagtgagtgaagtagcctgtcccctgcaggtcctctgcgatggcattgtctcggttcccgcagtgctgcagtgtggaagggagtgccccatcctcattacagatgacacactggagtgtggaggggtcgatgacttgtgcagggtcatatggtacctaaggggcagatctcagacttaaacacaattgatgtctaacccctagacagtctttttagtgccctctgctctcagtcttgttgccctagtatcaagcaatcttagacaaacatcctgaattcttacaaacttacctctaaactctgaggataaagttgccagtccttttaatggtcagcctaatcattctgtcagcctaatcgggtaattgctttttttaataaatacacataaaaaccacaaaaacag

SEQ ID NO: 314834 - DNA, 2470 bp, Homo sapiens
ttgcataaaggtagttgccatactatttttgtgtttcaaattttataactgctcacaagtaacctgtgtaactttgatgttttaaatctggtcccaaatgtggtacttttggggtggcttggatgggaaaatagaaagttacttaaaggattaaggtgtaggacggaatgggttggttttcttgagtgttaaggcttgcaagatgctctgtgaactcttatgaaactttgtaagacatcagagggttcataggagagtacttcatagggcttcattgtgaggatctcaaggacagcttcttagaggtggcctgaagatcaattaactagtctatttttagaagaaaatttcatctttttggacaggaatattgcaaatttggcttcaagcaaataattttctgattttctgttcagacaacagatcagagaacaaaacgagaaaacataaaggaaaagcgaaaggctatcttagaggcaagacttgccaaacttcgacaaaaaaagatgaaaaaatcaaaagaaggtggaacagaagaagaaaatagagatggagatgttattgggcctttgccaccggagccagaggctgtgccaaccccacgtcctgctgcccagagtagcaaagtagaagtcattgtccaggagaggaaggacaccaagcctggagtgccacacatccgggagtgggaccgcggaaaagaattttcctttggatactggtcgaagaggcagtcagatctccgggctgagagagatcctgagtttgccccgccgtcagattactttgtgggtcagaagagaactggtttttccagcagccaggcatggagcagacctgggccagcacagagtgacccagggcagtgccctgaccagagccacggacctagccctgaacatacgtcacccactcctgcccccgacaacccaccacaagcccccacagttactttcaaaactctggatgacatgatttcctattacaaacaagtgacatgatctttcaaagcacgctgacttgggtttgtactttgacagtgcctttctctcccagagggagaaataactttaggaactgaattgtacctttgtcctgtcctttccctaggaggcacagacttcgggttggatttgtcagcaaggaggaaagttatggaaactttggccacttggctgttcattttattctaagtgggatagggacatacctacctggatttacatgtgagctgcgatagaatagaagtatttattctgtaaaattagacactgagatgtgcttataaccctgtttcatatctactcccacgacttactcatatttaagggttcttttccattccttttgcaaatccgagcatgcaggtgtctttattccaagggttcagcttccagatcagccgatggaccataggtcacgaggaatttctccctgtcaagcagtggaaaactgcatgggaggcaaaatgctctgttctccaagaggacccggaagtaatcacataggaaatgataaggaagaccaggaggagctcttcgtagtccagaaaggtagaagtgggagttgtttacttaattttactgtcataccatgctattacctacactcctgtgtgcagtgggcattcagtaaatgtgtgttgaaggactgggacgtacgtggaggctgctggacctggtcagagactgatgtgccttagcggcaatggttagagcttttcagtgcatcccacctccctgtcgcccccatgctcggcttcctcacattcaggagcctgacttggatcagacttggggctgcacagtggagcaggtgggttcccatgtcattagtaataaggagagggttgggggtgggcagggctccagaaagtcagcagtgtgcctgggcacccaccccatcctctacctgccacacctcagagggttcctacagctgcacacaagcagttgagagttgatgaccaggcccatagggctcccacagctggttcccaggccagtgagtgctgtgagaatacagtagcacaagtccttgttctctgaagagtgggaaggagaggagtgagtgaagtagcctgtcccctgcaggtcctctgcgatggcattgtctcggttcccgcagtgctgcagtgtggaagggagtgccccatcctcattacagatgacacactggagtgtggaggggtcgatgacttgtgcagggtcatatggtacctaaggggcagatctcagacttaaacacaattgatgtctaacccctagacagtctttttagtgccctctgctctcagtcttgttgccctagtatcaagcaatcttagacaaacatcctgaattcttacaaacttacctctaaactctgaggataaagttgccagtccttttaatggtcagcctaatcattctgtcagcctaatcgggtaattgctttttttaataaatacacataaaaaccacaaaaacag

SEQ ID NO: 314835 - DNA, 869 bp, Homo sapiens
tggtgagcaagagtctggcccgagttagctagagctgttgccatgacaagcattttcttaagaaagctctgctgttgagatcgtccaaagctgggggctgggagggggggcacgaacttcgtggggcaccatccctccgaagagagcaagatcagagacacccgcccagctctcctgcaccctttttctttcaggaacctgagaggtccttcccattggaggggcagggggaggagacccagcccactccccggccttagccagaaaggcaagagagcaaagccagcgtctctagcttggttgccacactggggagactggtgggtggtcaccccaccctaccctcatccatggaaacccggagggagagtcccgcctgaagaaacctggatctttgctagaaagagaggtaggcttgcagagaatgaattgacttgtgatttgcaaactttgtttctttcttttctctcaatggcttctaaaactccccgattttcctctttctagaatatttcatgcgactgggtttggaggattttttttaaaatatgtgtgtgtgcacagatttgtcaaatactgttttacctattatcagttctgagaaaccatatagtcgaacaagtgatttatctctcttttcctagttcttgtcattcctgggctatggggtagggtaatggagggttctctttttgacaccaaaattgagctcttggaaaaaatatttatctcccctccctcaacccattccgttcctgccctccccttccccccttggcttgggaatgagacgcaggatggaaaactgttgcaaaaatattttccgtgtctgttccctttctcgaaagcccaaaagagagatggaaaaa

SEQ ID NO: 314836 - DNA, 1330 bp, Homo sapiens
ggctgggcgttgggactccatggcaaattgttccctaagtgaagtatgatatgcaattaacgtttttctccttctcctcaccattgctttttgtgggagggaagctctctctgctctctcctgtccccttttcccatctacttccattcctgcttccccaaccttccatgaccctcccttcctctttcttcacctctctcggactgactgtggagcaaagctgtctcactctctgattctttgcagatcgacgtaattaacacattccagacgggagcctcttttaagggagtcctaaggcgacagaacatgggtcaacaccttgatgtaaaacttgttcctagttcatcctatgtagcagttgcaccagtcaaatcttcccccaccacttctgttcctgctgtttcatctcctcctatgggcagtgagtgatagtctattatgatgcatgatttgctaaaatgaccacaagagagcacgtggcatccactttaaccaaccatggttatcttttccttttggtttttccctttgatattttgacttaagggaagaaaaagacaaaaatcctactctaaaaccagactgtgtgcccttgtattttatttttgtaatgtagaaaagctattaaaccttaactgttttaaagacaataattctgttttctgattgttcctctgcattgctcatttcttccttttcttgagttttgttttgttttgctttgccttttttgtttgtctgtttgttgctttgctgggatatgttgttgttcctctcttctcctcctgctcctttgagtctgaactctacctcctaagcttagatgtgaggttaggccagaggaaaacccaagagctttctttacatgggggcaaagtttgggatcttttgaggaaaggtaggaagggagctaatgtgcccatgggtgtgttttgactagtggacctgtcataattgagccagtattaaacttggtcaataataatagtccatttggccaccactgtattgctgactggcaattttagcataaaagttgtagctggctgggcacgatggctcacgcctgtaatcccaacactttgggaggccaaagcagatcacgaggtcaggagatcaagaccatcctggctaacatggtgaaaccccgtctctactaaaaatacaaaaaattagctgggcgtggtggcgggcacctgtagtcctatagctactcgggaggctaagacaggagaatcacttgaactcaggaggcggaggttacagtgagccaagtggagagccactgcactccaccctgggcgatagagcaagactctgtctcaaa

SEQ ID NO: 314837 - DNA, 609 bp, Homo sapiens
gacctacaggagctttaggtagactaacctcactgctgaaaacccagaggggcgtggcacactcgcttgtgtggaaaagcctctaaatgcatcccttcctttctttcctgcttcctttgccttacaattgaagcagcccgtggtaccatcacagtatgcagagacttcctcacctttcatatctagggaccacccccgatgcattggtgagggtgggcacttataaatgcctgctattgttaagccattccagcctcttcctctgaatagaccagacgccctttcacttagttcagtgccagtccttttgccttcccaaccctgctgttaggtctacctggccaggtagacctaactggtccacaagagaaaatgagagactcgatttggctgccaggaacacctgggcctaggcaagaacacaagaggtttctgggggtggggaggaaataggtctcgctgaaggtgacagatcccttggggggcgtccagctgtctggatcactgtccagggactgtggccagcccaagatacctccgaggtgagtcctagatcactaggagcagcagtctgtcggtgggatgcgatggatggttaggtctacctgg

SEQ ID NO: 314838 - DNA, 789 bp, Homo sapiens
gaatagatgctatctggaagggtctttgtaaaagaaactcaccttgttatatctcccccattcaaagtgtaaggccatggtggggaatctgatggtttcatgtgtaaaaatgacaatagtctcttgatgtctgagcatcttttgcaggattcagacttgcttcctgacaaggaggaagcaataatttcttcaagcctcttcccttcttgcaatttctgaaatgggatagaagccacccctgctgctcttatgtcccctgtctatagccccacaataacttttattttttccactttccatgcatcaattgtaactactttctcctgggtgaatgcgctgatctaagcattgataattctgtcttcccctgctctcaccccccatagctttattgttttaatcctgagattttccatttcaaaaacactgtaaattccaagatctcaagggtggtctccagaaaacaggcgtatttctctctgctgattggctagagatcttcaaaataagtttcactgtctaaaactggccttgcaaatgttttagaaagttccccagtcggccaggcatggtggctcacgcctgtaatcccagcactttgggaggccaaggtgggtggatcacctgaggtcgggagttcaagaccagcctgaccaacatggagaaaccgcgtctctactaaaaatccaaaattagccgggcgtagtggcacatgcctgtaatcccagctactcgggaggctgaggcagaagaattacttgaacccgggaggcagaggttgtagtgagc

SEQ ID NO: 314839 - DNA, 420 bp, Homo sapiens
gctactactactaaattcgcggccgcgtcgactgggattggagaacttctgtggggccagttcatctccgcaatacctacccgatccctgaagttcctgaaggaggctgggcatggcaccaccaaagaggagatcaccaaggatgccgagggactggatgagattgaccatgctgagatggagctgcgccgaggccagatcctctggttccggggcctgaaccgtatccagactcaggtactctgatagtggtctgtccttcccttgggagaagcagcttcccatcttggaaggtgttgggagggtagcagttcttgtcggccagcatctcttcccttccaaaggctcactactgatgggcagccctagatcctcagcttcaggacagacacgcaaaaggatctgtgtggggtcctctga

SEQ ID NO: 314840 - DNA, 493 bp, Homo sapiens
  misc_feature (479)..(479): n is a, c, g, or t
gctgccatactactactcctagaacaaatgcagagtttctcaaaggtgtcggaataacatgggcttaagtgagatactggcagtggcaacagaaatgtgagaatttggaggtagaatagacaggatttgctctctaccttttaattagtttccaaggttgagggagtaggaggggagggtgaaagggatatcaaagatgattgtaattcccagtctgagctcaacagtaaggttggtggcatcaggccgcagccctcctttctctagagtgacagtgacacatttgctctttgttttcttttgtgtgactagtgtgccctgtagtatttacactgacttcggaagcttcctggaggtcaggaaatggagcctgggctttatccactccctcactgttttccctcccatcttacctcagggcatcgcaggcacagatgttgcgagagggccaagaggaccctgtcgtccagcacccaggncagcctggagatcg

SEQ ID NO: 314841 - DNA, 3613 bp, Homo sapiens
agaaaatggaaaggatatggatgaattgtgtaaacttagatccttctcccttttggcccaaaagaacccttgatttagttccagaatccaaccagtttctttgttaaaagggtccttttgaagcaattaagtgctggtaagaatatttctctgttgttgccaggttaccttctgcttttaaattgccatcttgtaaagtgtatgtggttcttaagtgccagggagatcagccttgcccatgaaggttgcatatgtgtggtatacagtttttacctgaaagcctgagctttctcttattcctaaagtggtggcaaaagaatgaactgggtatgaccctgcccccttactgggcttggatattgaggaccagacgctgccaaatctaggacaagacagaccatcaaagcagacttttgtgggctcctctttggggtgaccactgctttcaaagccatctgccaaggctctccagggcaggacctgactggtggggaatgagtgttcagaagccttgggagaggccaaagagccattctagcatgatctgagaaaaccttcctgcagaggccagaaaccttgagcttaggtgcctggggaccagcttcgacattctctccagtttctgattctaatttttgccacgtgtcacaacttttccagtctctgagaaggtcccagcctttctcaaatattctgattttgaaaatatgtatccaaagtgggaggcccctgtgacattttgccaacttaaacgagaaaaagaccccccgcacccggcacactcccccttcctccagccccgcttcagccacatgctccagctgctgcccagtaaagccctgtgcctttttttcccctgaatactgcccaaagcatccccttcccatctgcctctcaggagttggggactttgctaggagattttttaagtgttccttactgggacaacgtggagccacgtttgcaggagctccatttgtatccctgctggtgttgacttctgtgtaggggccagttcatgtccctgactctcacctcccattagataaatgaagcccacccccctttctagagtgatgagagtcaagaagaggggatgtatgaacggccaaattcccatgtgagaggaagatgacctgatccacctagccttttcttctggatctgtcctccctcacccctttcacctgagctgtccacagtaggaaacataaagaaacaatgtcccctacatatccccatgactacataatccatcatcgtaggaaataggaaagcaaatttgattttggttttgtaaaacgtacatgcttcaataattctttttttgtgtcttaaatactcataggggaaaaaaacagctcacccaaggtgttaggtttcacatatatattcatcaactattttagaagatttaattctatcaaatcttgtattacctcagatcattttaaatagcaagccaataacgagctttgaaggctattttaccattcctgttcacaaaaggttctcatggtgcctgacaggttacccttgagggcttgtgtctactttttaaaagtcaatggttttttttcttgtgttctagtttccataataggagagaaaatatagaaatatatgcaaaaattatagttttctttagatcagaaactgatatttttgggtcagccatatgtattttgtttaaaggatttaaaataaagtgccgtcatgtagccctgtggaagggagcacataaccagctgtttggcatgacaggtgacttagtatatttgtaattggttttaaaaccaatacaccatactttctttctgcaaacagccatctttatacttagggaagaaaaattgttgggttctagacttttttaatataaattttgttgatatggaattaggtaagtttaagtgtctatgtgcatatgttttttatataagttttttctattcagtttcactgatccaactggcagtgggtaaatatggcataagttaataacacttttccccaaaatggtgctttggatttgaaaagggtctgatggggagaaggagaacgtatcatcctagcttcctctcttaataaacctagaaaaacgggtagtaaactgtggatagtcaggaaaacacccagcaagggacacagctgtcaggaaatgaatcttccccccaacccccaccatgcagatggatagacagaatctttcctgactagtcattaggatcaggggcctctgttggatttgtgtttcttgaagaatagctggcagagtggtataaaagacacgaatatctcctggtctataaggatactctgatttggggtttgcatttttcatggtttttatttcctgttccccctggagttttccattagtgagtttttgtgcaaggatcttatttgtgatgccttccctcccctagaaagattttgtgcaatatattaaatggggacagaattctaaatggataaaacaatggctggttctagccctgagtgacagtcttaaggctagatccttcccatagtatcatctgtcctctggaatgactctcctgtccctaaaggggttaagagagagatcacctagaaatccctctggacacttgtgggttctttagggtttgagtttcttcttccccttgagcttcagagaggagagttggcatggttaaatctgaatggttacctcactgctgaaaacccagaggggcgtggcacactcgcttgtgtggaaaagcctctaaatgcatcccttcctttctttcctgcttcctttgccttacaattgaagcagcccgtggtaccatcacagtatgcagagacttcctcacctttcatatctagggaccacccccgatgcattggtgagggtgggcacttataaatgcctgctattgttaagccattccagcctcttcctctgaatagaccagacgccctttcacttagttcagtgccagtccttttgccttcccaaccctgctgttaggcctgctgttccctttgctcttgattaggagagatggaaggagatgagctcccataactgaattggcctttggttcatgttttctccccatatgtatatatgccatatgtgaatatgccatatatatgtgccaacaaatctatctacgttgttcttttcaaattagcacgcagataggaattttgagtttcttcttcttttagtaactagtataacaagcactggtatttttgtacaaaaaagaaaaacaaaagattgactattgtggtctgcatgacataaacaaacaaatggtgatatcaaagcaacgtataccccagtccagtgtgtgttgccataatttgcaattcagcttaacagtgcacccaatctatatttgcattttgatattatttaagctctatgtacaaggttttgcatgtatttatatggttcttagggaaaaaaaatgctataaactgcaaatctgaaattcaaatgtgttgttccactgagaccagaagaagaagaggagttttaaaagggataatttgttggagccaataaagctttttgctgatgaacagaaaccaatactgctgtgcactgagaataaaaactcatgcccacttgtaa

SEQ ID NO: 314842 - DNA, 3291 bp, Homo sapiens
ctacatggctctcagctatagactctgggcttggatattgaggaccagacgctgccaaatctaggacaagacagaccatcaaagcagacttttgtgggctcctctttggggtgaccactgctttcaaagccatctgccaaggctctccagggcaggacctgactggtggggaatgagtgttcagaagccttgggagaggccaaagagccattctagcatgatctgagaaaaccttcctgcagaggccagaaaccttgagcttaggtgcctggggaccagcttcgacattctctccagtttctgattctaatttttgccacgtgtcacaacttttccagtctctgagaaggtcccagcctttctcaaatattctgattttgaaaatatgtatccaaagtgggaggcccctgtgacattttgccaacttaaacgagaaaaagaccccccgcacccggcacactcccccttcctccagccccgcttcagccacatgctccagctgctgcccagtaaagccctgtgcctttttttcccctgaatactgcccaaagcatccccttcccatctgcctctcaggagttggggactttgctaggagattttttaagtgttccttactgggacaacgtggagccacgtttgcaggagctccatttgtatccctgctggtgttgacttctgtgtaggggccagttcatgtccctgactctcacctcccattagataaatgaagcccacccccctttctagagtgatgagagtcaagaagaggggatgtatgaacggccaaattcccatgtgagaggaagatgacctgatccacctagccttttcttctggatctgtcctccctcacccctttcacctgagctgtccacagtaggaaacataaagaaacaatgtcccctacatatccccatgactacataatccatcatcgtaggaaataggaaagcaaatttgattttggttttgtaaaacgtacatgcttcaataattctttttttgtgtcttaaatactcataggggaaaaaaacagctcacccaaggtgttaggtttcacatatatattcatcaactattttagaagatttaattctatcaaatcttgtattacctcagatcattttaaatagcaagccaataacgagctttgaaggctattttaccattcctgttcacaaaaggttctcatggtgcctgacaggttacccttgagggcttgtgtctactttttaaaagtcaatggttttttttcttgtgttctagtttccataataggagagaaaatatagaaatatatgcaaaaattatagttttctttagatcagaaactgatatttttgggtcagccatatgtattttgtttaaaggatttaaaataaagtgccgtcatgtagccctgtggaagggagcacataaccagctgtttggcatgacaggtgacttagtatatttgtaattggttttaaaaccaatacaccatactttctttctgcaaacagccatctttatacttagggaagaaaaattgttgggttctagacttttttaatataaattttgttgatatggaattaggtaagtttaagtgtctatgtgcatatgttttttatataagttttttctattcagtttcactgatccaactggcagtgggtaaatatggcataagttaataacacttttccccaaaatggtgctttggatttgaaaagggtctgatggggagaaggagaacgtatcatcctagcttcctctcttaataaacctagaaaaacgggtagtaaactgtggatagtcaggaaaacacccagcaagggacacagctgtcaggaaatgaatcttccccccaacccccaccatgcagatggatagacagaatctttcctgactagtcattaggatcaggggcctctgttggatttgtgtttcttgaagaatagctggcagagtggtataaaagacacgaatatctcctggtctataaggatactctgatttggggtttgcatttttcatggtttttatttcctgttccccctggagttttccattagtgagtttttgtgcaaggatcttatttgtgatgccttccctcccctagaaagattttgtgcaatatattaaatggggacagaattctaaatggataaaacaatggctggttctagccctgagtgacagtcttaaggctagatccttcccatagtatcatctgtcctctggaatgactctcctgtccctaaaggggttaagagagagatcacctagaaatccctctggacacttgtgggttctttagggtttgagtttcttcttccccttgagcttcagagaggagagttggcatggttaaatctgaatggttacctcactgctgaaaacccagaggggcgtggcacactcgcttgtgtggaaaagcctctaaatgcatcccttcctttctttcctgcttcctttgccttacaattgaagcagcccgtggtaccatcacagtatgcagagacttcctcacctttcatatctagggaccacccccgatgcattggtgagggtgggcacttataaatgcctgctattgttaagccattccagcctcttcctctgaatagaccagacgccctttcacttagttcagtgccagtccttttgccttcccaaccctgctgttaggcctgctgttccctttgctcttgattaggagagatggaaggagatgagctcccataactgaattggcctttggttcatgttttctccccatatgtatatatgccatatgtgaatatgccatatatatgtgccaacaaatctatctacgttgttcttttcaaattagcacgcagataggaattttgagtttcttcttcttttagtaactagtataacaagcactggtatttttgtacaaaaaagaaaaacaaaagattgactattgtggtctgcatgacataaacaaacaaatggtgatatcaaagcaacgtataccccagtccagtgtgtgttgccataatttgcaattcagcttaacagtgcacccaatctatatttgcattttgatattatttaagctctatgtacaaggttttgcatgtatttatatggttcttagggaaaaaaaatgctataaactgcaaatctgaaattcaaatgtgttgttccactgagaccagaagaagaagaggagttttaaaagggataatttgttggagccaataaagctttttgctgatgaacagaaaccaatactgctgtgcactgagaataaaaactcatgcccacttgtaa

SEQ ID NO: 314843 - DNA, 2435 bp, Homo sapiens
  misc_feature (42)..(42): n is a, c, g, or t
actgcctctgttcttgtgtacattgtatccagccaatgtatncttatcccctacatatccccatgactacataatccatcatcgtaggaaataggaaagcaaatttgattttggttttgtaaaacgtacatgcttcaataattctttttttgtgtcttaaatactcataggggaaaaaaacagctcacccaaggtgttaggtttcacatatatattcatcaactattttagaagatttaattctatcaaatcttgtattacctcagatcattttaaatagcaagccaataacgagctttgaaggctattttaccattcctgttcacaaaaggttctcatggtgcctgacaggttacccttgagggcttgtgtctactttttaaaagtcaatggttttttttcttgtgttctagtttccataataggagagaaaatatagaaatatatgcaaaaattatagttttctttagatcagaaactgatatttttgggtcagccatatgtattttgtttaaaggatttaaaataaagtgccgtcatgtagccctgtggaagggagcacataaccagctgtttggcatgacaggtgacttagtatatttgtaattggttttaaaaccaatacaccatactttctttctgcaaacagccatctttatacttagggaagaaaaattgttgggttctagacttttttaatataaattttgttgatatggaattaggtaagtttaagtgtctatgtgcatatgttttttatataagttttttctattcagtttcactgatccaactggcagtgggtaaatatggcataagttaataacacttttccccaaaatggtgctttggatttgaaaagggtctgatggggagaaggagaacgtatcatcctagcttcctctcttaataaacctagaaaaacgggtagtaaactgtggatagtcaggaaaacacccagcaagggacacagctgtcaggaaatgaatcttccccccaacccccaccatgcagatggatagacagaatctttcctgactagtcattaggatcaggggcctctgttggatttgtgtttcttgaagaatagctggcagagtggtataaaagacacgaatatctcctggtctataaggatactctgatttggggtttgcatttttcatggtttttatttcctgttccccctggagttttccattagtgagtttttgtgcaaggatcttatttgtgatgccttccctcccctagaaagattttgtgcaatatattaaatggggacagaattctaaatggataaaacaatggctggttctagccctgagtgacagtcttaaggctagatccttcccatagtatcatctgtcctctggaatgactctcctgtccctaaaggggttaagagagagatcacctagaaatccctctggacacttgtgggttctttagggtttgagtttcttcttccccttgagcttcagagaggagagttggcatggttaaatctgaatggttacctcactgctgaaaacccagaggggcgtggcacactcgcttgtgtggaaaagcctctaaatgcatcccttcctttctttcctgcttcctttgccttacaattgaagcagcccgtggtaccatcacagtatgcagagacttcctcacctttcatatctagggaccacccccgatgcattggtgagggtgggcacttataaatgcctgctattgttaagccattccagcctcttcctctgaatagaccagacgccctttcacttagttcagtgccagtccttttgccttcccaaccctgctgttaggcctgctgttccctttgctcttgattaggagagatggaaggagatgagctcccataactgaattggcctttggttcatgttttctccccatatgtatatatgccatatgtgaatatgccatatatatgtgccaacaaatctatctacgttgttcttttcaaattagcacgcagataggaattttgagtttcttcttcttttagtaactagtataacaagcactggtatttttgtacaaaaaagaaaaacaaaagattgactattgtggtctgcatgacataaacaaacaaatggtgatatcaaagcaacgtataccccagtccagtgtgtgttgccataatttgcaattcagcttaacagtgcacccaatctatatttgcattttgatattatttaagctctatgtacaaggttttgcatgtatttatatggttcttagggaaaaaaaatgctataaactgcaaatctgaaattcaaatgtgttgttccactgagaccagaagaagaagaggagttttaaaagggataatttgttggagccaataaagctttttgctgatgaacagaaaccaatactgctgtgcactgagaataaaaactcatgcccacttgtaa

SEQ ID NO: 314844 - DNA, 3692 bp, Homo sapiens
agaaaatggaaaggatatggatgaattgtgtaaacttagatccttctcccttttggcccaaaagaacccttgatttagttccagaatccaaccagtttctttgttaaaagggtccttttgaagcaattaagtgctggtaagaatatttctctgttgttgccaggttaccttctgcttttaaattgccatcttgtaaagtgtatgtggttcttaagtgccagggagatcagccttgcccatgaaggttgcatatgtgtggtatacagtttttacctgaaagcctgagctttctcttattcctaaagtggtggcaaaagaatgaactgggtatgaccctgcccccttactgggcttggatattgaggaccagacgctgccaaatctaggacaagacagaccatcaaagcagacttttgtgggctcctctttggggtgaccactgctttcaaagccatctgccaaggctctccagggcaggacctgactggtggggaatgagtgttcagaagccttgggagaggccaaagagccattctagcatgatctgagaaaaccttcctgcagaggccagaaaccttgagcttaggtgcctggggaccagcttcgacattctctccagtttctgattctaatttttgccacgtgtcacaacttttccagtctctgagaaggtcccagcctttctcaaatattctgattttgaaaatatgtatccaaagtgggaggcccctgtgacattttgccaacttaaacgagaaaaagaccccccgcacccggcacactcccccttcctccagccccgcttcagccacatgctccagctgctgcccagtaaagccctgtgcctttttttcccctgaatactgcccaaagcatccccttcccatctgcctctcaggagttggggactttgctaggagattttttaagtgttccttactgggacaacgtggagccacgtttgcaggagctccatttgtatccctgctggtgttgacttctgtgtaggggccagttcatgtccctgactctcacctcccattagataaatgaagcccacccccctttctagagtgatgagagtcaagaagaggggatgtatgaacggccaaattcccatgtgagaggaagatgacctgatccacctagccttttcttctggatctgtcctccctcacccctttcacctgagctgtccacagtaggaaacataaagaaacaatgtcccctacatatccccatgactacataatccatcatcgtaggaaataggaaagcaaatttgattttggttttgtaaaacgtacatgcttcaataattctttttttgtgtcttaaatactcataggggaaaaaaacagctcacccaaggtgttaggtttcacatatatattcatcaactattttagaagatttaattctatcaaatcttgtattacctcagatcattttaaatagcaagccaataacgagctttgaaggctattttaccattcctgttcacaaaaggttctcatggtgcctgacaggttacccttgagggcttgtgtctactttttaaaagtcaatggttttttttcttgtgttctagtttccataataggagagaaaatatagaaatatatgcaaaaattatagttttctttagatcagaaactgatatttttgggtcagccatatgtattttgtttaaaggatttaaaataaagtgccgtcatgtagccctgtggaagggagcacataaccagctgtttggcatgacaggtgacttagtatatttgtaattggttttaaaaccaatacaccatactttctttctgcaaacagccatctttatacttagggaagaaaaattgttgggttctagacttttttaatataaattttgttgatatggaattaggtaagtttaagtgtctatgtgcatatgttttttatataagttttttctattcagtttcactgatccaactggcagtgggtaaatatggcataagttaataacacttttccccaaaatggtgctttggatttgaaaagggtctgatggggagaaggagaacgtatcatcctagcttcctctcttaataaacctagaaaaacgggtagtaaactgtggatagtcaggaaaacacccagcaagggacacagctgtcaggaaatgaatcttccccccaacccccaccatgcagatggatagacagaatctttcctgactagtcattaggatcaggggcctctgttggatttgtgtttcttgaagaatagctggcagagtggtataaaagacacgaatatctcctggtctataaggatactctgatttggggtttgcatttttcatggtttttatttcctgttccccctggagttttccattagtgagtttttgtgcaaggatcttatttgtgatgccttccctcccctagaaagattttgtgcaatatattaaatggggacagaattctaaatggataaaacaatggctggttctagccctgagtgacagtcttaaggctagatccttcccatagtatcatctgtcctctggaatgactctcctgtccctaaaggggttaagagagagatcacctagaaatccctctggacacttgtgggttctttagggtttgagtttcttcttccccttgagcttcagagaggagagttggcatggttaaatctgaatggttacctcactgctgaaaacccagaggggcgtggcacactcgcttgtgtggaaaagcctctaaatgcatcccttcctttctttcctgcttcctttgccttacaattgaagcagcccgtggtaccatcacagtatgcagagacttcctcacctttcatatctagggaccacccccgatgcattggtgagggtgggcacttataaatgcctgctattgttaagccattccagcctcttcctctgaatagaccagacgccctttcacttagttcagtgccagtccttttgccttcccaaccctgctgttaggcctgctgttccctttgctcttgattaggagagatggaaggagatgagctcccataactgaattggcctttggttcatgttttctccccatatgtatatatgccatatgtgaatatgccatatatatgtgccaacaaatctatctacgttgttcttttcaaattagcacgcagataggaattttgagtttcttcttcttttagtaactagtataacaagcactggtatttttgtacaaaaaagaaaaacaaaagattgactattgtggtctgcatgacataaacaaacaaatggtgatatcaaagcaacgtataccccagtccagtgtgtgttgccataatttgcaattcagcttaacagtgcacccaatctatatttgcattttgatattatttaagctctatgtacaaggttttgcatgtatttatatggttcttagggaaaaaaaatgctataaactgcaaatctgaaattcaaatgtgttgttccactgagaccagaagaagaagaggagttttaaaagggataatttgttggagccaataaagctttttgctgatgaacagaaaccaatactgctgtgcactgagaataaaaactcatgcccacttgtaaaaaaaaacaagaccagcacacagaaaacagaacaaaacgacaacaaccaaaacagacacacggcaacaaaacaaggggg

SEQ ID NO: 314845 - DNA, 1533 bp, Homo sapiens
ggctcgccgcggcttcgtcggccgtctgcccttcgtcccgtaccgaccctcgagcacatggacagagtatgatccagagaaatgaatcttccccccaacccccaccatgcagatggatagacagaatctttcctgactagtcattaggatcaggggcctctgttggatttgtgtttcttgaagaatagctggcagagtggtataaaagacacgaatatctcctggtctataaggatactctgatttggggtttgcatttttcatggtttttatttcctgttccccctggagttttccattagtgagtttttgtgcaaggatcttatttgtgatgccttccctcccctagaaagattttgtgcaatatattaaatggggacagaattctaaatggataaaacaatggctggttctagccctgagtgacagtcttaaggctagatccttcccatagtatcatctgtcctctggaatgactctcctgtccctaaaggggttaagagagagatcacctagaaatccctctggacacttgtgggttctttagggtttgagtttcttcttccccttgagcttcagagaggagagttggcatggttaaatctgaatggttacctcactgctgaaaacccagaggggcgtggcacactcgcttgtgtggaaaagcctctaaatgcatcccttcctttctttcctgcttcctttgccttacaattgaagcagcccgtggtaccatcacagtatgcagagacttcctcacctttcatatctagggaccacccccgatgcattggtgagggtgggcacttataaatgcctgctattgttaagccattccagcctcttcctctgaatagaccagacgccctttcacttagttcagtgccagtccttttgccttcccaaccctgctgttaggcctgctgttccctttgctcttgattaggagagatggaaggagatgagctcccataactgaattggcctttggttcatgttttctccccatatgtatatatgccatatgtgaatatgccatatatatgtgccaacaaatctatctacgttgttcttttcaaattagcacgcagataggaattttgagtttcttcttcttttagtaactagtataacaagcactggtatttttgtacaaaaaagaaaaacaaaagattgactattgtggtctgcatgacataaacaaacaaatggtgatatcaaagcaacgtataccccagtccagtgtgtgttgccataatttgcaattcagcttaacagtgcacccaatctatatttgcattttgatattatttaagctctatgtacaaggttttgcatgtatttatatggttcttagggaaaaaaaatgctataaactgcaaatctgaaattcaaatgtgttgttccactgagaccagaagaagaagaggagttttaaaagggataatttgttggagccaataaagctttttgctgatgaacagaaaccaatactgctgtgcactgagaataaaaactcatgcccacttgtaa

SEQ ID NO: 314846 - DNA, 3564 bp, Homo sapiens
agaaaatggaaaggatatggatgaattgtgtaaacttagatccttctcccttttggcccaaaagaacccttgatttagttccagaatccaaccagtttctttgttaaaagggtccttttgaagcaattaagtgctggtaagaatatttctctgttgttgccaggttaccttctgcttttaaattgccatcttgtaaagtgtatgtggttcttaagtgccagggagatcagccttgcccatgaaggttgcatatgtgtggtatacagtttttacctgaaagcctgagctttctcttattcctaaagtggtggcaaaagaatgaactgggtatgaccctgcccccttactgggcttggatattgaggaccagacgctgccaaatctaggacaagacagaccatcaaagcagacttttgtgggctcctctttggggtgaccactgctttcaaagccatctgccaaggctctccagggcaggacctgactggtggggaatgagtgttcagaagccttgggagaggccaaagagccattctagcatgatctgagaaaaccttcctgcagaggccagaaaccttgagcttaggtgcctggggaccagcttcgacattctctccagtttctgattctaatttttgccacgtgtcacaacttttccagtctctgagaaggtcccagcctttctcaaatattctgattttgaaaatatgtatccaaagtgggaggcccctgtgacattttgccaacttaaacgagaaaaagaccccccgcacccggcacactcccccttcctccagccccgcttcagccacatgctccagctgctgcccagtaaagccctgtgcctttttttcccctgaatactgcccaaagcatccccttcccatctgcctctcaggagttggggactttgctaggagattttttaagtgttccttactgggacaacgtggagccacgtttgcaggagctccatttgtatccctgctggtgttgacttctgtgtaggggccagttcatgtccctgactctcacctcccattagataaatgaagcccacccccctttctagagtgatgagagtcaagaagaggggatgtatgaacggccaaattcccatgtgagaggaagatgacctgatccacctagccttttcttctggatctgtcctccctcacccctttcacctgagctgtccacagtaggaaacataaagaaacaatgtcccctacatatccccatgactacataatccatcatcgtaggaaataggaaagcaaatttgattttggttttgtaaaacgtacatgcttcaataattctttttttgtgtcttaaatactcataggggaaaaaaacagctcacccaaggtgttaggtttcacatatatattcatcaactattttagaagatttaattctatcaaatcttgtattacctcagatcattttaaatagcaagccaataacgagctttgaaggctattttaccattcctgttcacaaaaggttctcatggtgcctgacaggttacccttgagggcttgtgtctactttttaaaagtcaatggttttttttcttgtgttctagtttccataataggagagaaaatatagaaatatatgcaaaaattatagttttctttagatcagaaactgatatttttgggtcagccatatgtattttgtttaaaggatttaaaataaagtgccgtcatgtagccctgtggaagggagcacataaccagctgtttggcatgacaggtgacttagtatatttgtaattggttttaaaaccaatacaccatactttctttctgcaaacagccatctttatacttagggaagaaaaattgttgggttctagacttttttaatataaattttgttgatatggaattaggtaagtttaagtgtctatgtgcatatgttttttatataagttttttctattcagtttcactgatccaactggcagtgggtaaatatggcataagttaataacacttttccccaaaatggtgctttggatttgaaaagggtctgatggggagaaggagaacgtatcatcctagcttcctctcttaataaacctagaaaaacgggtagtaaactgtggatagtcaggaaaacacccagcaagggacacagctgtcaggaaatgaatcttccccccaacccccaccatgcagatggatagacagaatctttcctgactagtcattaggatcaggggcctctgttggatttgtgtttcttgaagaatagctggcagagtggtataaaagacacgaatatctcctggtctataaggatactctgatttggggtttgcatttttcatggtttttatttcctgttccccctggagttttccattagtgagtttttgtgcaaggatcttatttgtgatgccttccctcccctagaaagattttgtgcaatatattaaatggggacagaattctaaatggataaaacaatggctggttctagccctgagtgacagtcttaaggctagatccttcccatagtatcatctgtcctctggaatgactctcctgtccctaaaggggttaagagagagatcacctagaaatccctctggacacttgtgggttctttagggtttgagtttcttcttccccttgagcttcagagaggagagttggcatggttaaatctgaatggttacctcactgctgaaaacccagaggggcgtggcacactcgcttgtgtggaaaagcctctaaatgcatcccttcctttctttcctgcttcctttgccttacaattgaagcagcccgtggtaccatcacagtatgcagagacttcctcacctttcatatctagggaccacccccgatgcattggtgagggtgggcacttataaatgcctgctattgttaagccattccagcctcttcctctgaatagaccagacgccctttcacttagttcagtgccagtccttttgccttcccaaccctgctgttaggcctgctgttccctttgctcttgattaggagagatggaaggagatgagctcccataactgaattggcctttggttcatgttttctccccatatgtatatatgccatatgtgaatatgccatatatatgtgccaacaaatctatctacgttgttcttttcaaattagcacgcagataggaattttgagtttcttcttcttttagtaactagtataacaagcactggtatttttgtacaaaaaagaaaaacaaaagattgactattgtggtctgcatgacataaacaaacaaatggtgatatcaaagcaacgtataccccagtccagtgtgtgttgccataatttgcaattcagcttaacagtgcacccaatctatatttgcattttgatattatttaagctctatgtacaaggttttgcatgtatttatatggttcttagggaaaaaaaatgctataaactgcaaatctgaaattcaaatgtgttgttccactgagaccgacgtacccgtcgactcttaaagggactatctctcggacccatagctgtctgctacttgaacctatag

SEQ ID NO: 314847 - DNA, 3715 bp, Homo sapiens
agaaaatggaaaggatatggatgaattgtgtaaacttagatccttctcccttttggcccaaaagaacccttgatttagttccagaatccaaccagtttctttgttaaaagggtccttttgaagcaattaagtgctggtaagaatatttctctgttgttgccaggttaccttctgcttttaaattgccatcttgtaaagtgtatgtggttcttaagtgccagggagatcagccttgcccatgaaggttgcatatgtgtggtatacagtttttacctgaaagcctgagctttctcttattcctaaagtggtggcaaaagaatgaactgggtatgaccctgcccccttactgggcttggatattgaggaccagacgctgccaaatctaggacaagacagaccatcaaagcagacttttgtgggctcctctttggggtgaccactgctttcaaagccatctgccaaggctctccagggcaggacctgactggtggggaatgagtgttcagaagccttgggagaggccaaagagccattctagcatgatctgagaaaaccttcctgcagaggccagaaaccttgagcttaggtgcctggggaccagcttcgacattctctccagtttctgattctaatttttgccacgtgtcacaacttttccagtctctgagaaggtcccagcctttctcaaatattctgattttgaaaatatgtatccaaagtgggaggcccctgtgacattttgccaacttaaacgagaaaaagaccccccgcacccggcacactcccccttcctccagccccgcttcagccacatgctccagctgctgcccagtaaagccctgtgcctttttttcccctgaatactgcccaaagcatccccttcccatctgcctctcaggagttggggactttgctaggagattttttaagtgttccttactgggacaacgtggagccacgtttgcaggagctccatttgtatccctgctggtgttgacttctgtgtaggggccagttcatgtccctgactctcacctcccattagataaatgaagcccacccccctttctagagtgatgagagtcaagaagaggggatgtatgaacggccaaattcccatgtgagaggaagatgacctgatccacctagccttttcttctggatctgtcctccctcacccctttcacctgagctgtccacagtaggaaacataaagaaacaatgtcccctacatatccccatgactacataatccatcatcgtaggaaataggaaagcaaatttgattttggttttgtaaaacgtacatgcttcaataattctttttttgtgtcttaaatactcataggggaaaaaaacagctcacccaaggtgttaggtttcacatatatattcatcaactattttagaagatttaattctatcaaatcttgtattacctcagatcattttaaatagcaagccaataacgagctttgaaggctattttaccattcctgttcacaaaaggttctcatggtgcctgacaggttacccttgagggcttgtgtctactttttaaaagtcaatggttttttttcttgtgttctagtttccataataggagagaaaatatagaaatatatgcaaaaattatagttttctttagatcagaaactgatatttttgggtcagccatatgtattttgtttaaaggatttaaaataaagtgccgtcatgtagccctgtggaagggagcacataaccagctgtttggcatgacaggtgacttagtatatttgtaattggttttaaaaccaatacaccatactttctttctgcaaacagccatctttatacttagggaagaaaaattgttgggttctagacttttttaatataaattttgttgatatggaattaggtaagtttaagtgtctatgtgcatatgttttttatataagttttttctattcagtttcactgatccaactggcagtgggtaaatatggcataagttaataacacttttccccaaaatggtgctttggatttgaaaagggtctgatggggagaaggagaacgtatcatcctagcttcctctcttaataaacctagaaaaacgggtagtaaactgtggatagtcaggaaaacacccagcaagggacacagctgtcaggaaatgaatcttccccccaacccccaccatgcagatggatagacagaatctttcctgactagtcattaggatcaggggcctctgttggatttgtgtttcttgaagaatagctggcagagtggtataaaagacacgaatatctcctggtctataaggatactctgatttggggtttgcatttttcatggtttttatttcctgttccccctggagttttccattagtgagtttttgtgcaaggatcttatttgtgatgccttccctcccctagaaagattttgtgcaatatattaaatggggacagaattctaaatggataaaacaatggctggttctagccctgagtgacagtcttaaggctagatccttcccatagtatcatctgtcctctggaatgactctcctgtccctaaaggggttaagagagagatcacctagaaatccctctggacacttgtgggttctttagggtttgagtttcttcttccccttgagcttcagagaggagagttggcatggttaaatctgaatggttacctcactgctgaaaacccagaggggcgtggcacactcgcttgtgtggaaaagcctctaaatgcatcccttcctttctttcctgcttcctttgccttacaattgaagcagcccgtggtaccatcacagtatgcagagacttcctcacctttcatatctagggaccacccccgatgcattggtgagggtgggcacttataaatgcctgctattgttaagccattccagcctcttcctctgaatagaccagacgccctttcacttagttcagtgccagtccttttgccttcccaaccctgctgttaggcctgctgttccctttgctcttgattaggagagatggaaggagatgagctcccataactgaattggcctttggttcatgttttctccccatatgtatatatgccatatgtgaatatgccatatatatgtgccaacaaatctatctacgttgttcttttcaaattagcacgcagataggaattttgagtttcttcttcttttagtaactagtataacaagcactggtatttttgtacaaaaaagaaaaacaaaagattgactattgtggtctgcatgacataaacaaacaaatggtgatatcaaagcaacgtataccccagtccagtgtgtgttgccataatttgcaattcagcttaacagtgcacccaatctatatttgcattttgatattatttaagctctatgtacaaggttttgcatgtatttatatggttcttagggaaaaaatgctcaacatcgctgattataagagaaatgcaaatcaaaactaccatgagataccacctcacaccagtcagaatggccatcattaataaatccacaaataacaagtgctggaggggctgtggagaaaagggaaccctcctgcactgttggtgggaatgtaaactggtacagccactatggagaacagtttggagataccttagaaatctatacatagaacttccatatgaccctgcaatcccactcttgggcatctatccggacaagctc

SEQ ID NO: 314848 - DNA, 5060 bp, Homo sapiens
  misc_feature (4961)..(4961): n is a, c, g, or t
tggtgagcaagagtctggcccgagttagctagagctgttgccatgacaagcattttcttaagaaagctctgctgttgagatcgtccaaagctgggggctgggagggggggcacgaacttcgtggggcaccatccctccgaagagagcaagatcagagacacccgcccagctctcctgcaccctttttctttcaggaacctgagaggtccttcccattggaggggcagggggaggagacccagcccactccccggccttagccagaaaggcaagagagcaaagccagcgtctctagcttggttgccacactggggagactggtgggtggtcaccccaccctaccctcatccatggaaacccggagggagagtcccgcctgaagaaacctggatctttgctagaaagagagagatccagttgtcatcggtatccaggaagctctcctcttcctcctcctgacgtctaccactacagttgctggttgttgctaaggttgctgccatggtaacatgcacatcctgtttacaccttcatctgggcaagttggtctaagctaggaacctacctaccctggacaaccactatcatcaccacctggggacaccaatcatcgtgacacggagtccaccttccactcagttcccccatcctcttcctcctctcgctgccagacttcatagagaagaaaggatctagacttcggacggctactcgggagcttattgcacaagatatattcaatctattccctcactgggcccccagagaagcaagaagtaggaagaagttgagacagggaggcaggagacactggtcagttgaagggaaacgctacatcttctctggttgaggggcttggtaacagcaggcaaaatgacgaacccatcagaccgtgtcttgcctgccaactcgatggccgagagccgtgaaggggactttggctgcacagtaatggaactgaggaagctcatggagctgcgttcgagggatgcactgacccagattaatgtccactatggaggtgtacagaatctctgcagtagactgaaaacctcccctgtggaaggtctgtctgggaaccctgcagatctggagaaacgtaggcaggtgtttggacacaacgtgatccccccccaaaaagcccaagactttcttagaattagtgtgggaagctcttcaagatgtcacgctcatcatcctggagattgcagccatcatctccctggtcctgtccttttatcgccctgctggtgaagaaaatgaactgtgtggtcaagtcgcaactaccccagaagatgaaaatgaggcacaagctggctggattgagggggcagccatccttttctcagtgatcatcgtggtgttagtgactgcctttaatgattggagcaaagagaagcaattccgggggctgcagtgccgcattgaacaggagcaaaagttctccatcatccgaaacggtcaactcatccagctccctgtggctgagattgtggttggtgatattgcccaagtcaaatacggtgatctgctgcctgcagatggaatcctgatccaagggaatgatctgaagattgatgagagctctctgacaggggaatctgaccatgtcaagaagtccctggacaaagaccccatgttgctctcagggacccatgtcatggaaggttctggccggatggtggtgacagctgttggtgtcaactctcagactggaatcatccttactctcttgggggtcaatgaggatgacgaaggggagaaaaagaagaaaggtaaaaaacaaggagtccctgaaaatcgcaacaaagcaaagacccaagacggagtggccctggaaatccagccactcaacagccaggagggaatcgacaatgaggaaaaggacaagaaggcagtcaaggtgcctaaaaaggagaagtcagtgctgcagggcaagctgactcgcctggctgttcagattgggaaagccggtctgctcatgtctgctctcacggttttcatcctgattctatactttgtgattgacaactttgtgataaatcgcagaccatggctccctgagtgtactcccatctacatccagtactttgtcaagttcttcatcatcggcatcactgtactggtggtggctgtgccagaggggctgcctctggctgtcaccatctcactggcctactctgtgaagaaaatgatgaaagacaataacctagtacggcacttggatgcttgtgagaccatgggcaacgccaccgccatctgctctgataagacaggcacgttgaccatgaaccgcatgactgtggtacaagcttatattgggggcatccattaccgtcaaatcccaagccctgatgtcttcctgcccaaagtcctggacctcattgtcaatggcatttctatcaacagtgcttatacctccaagattctgcctccagagaaggagggaggcctgcctcggcaggtgggcaacaagaccgagtgtgctctgctaggctttgtcacagatctgaagcaggattatcaggctgtgcgtaatgaagtgcccgaggagaagctctacaaggtgtacacctttaactcagtgcgcaagtcaatgagcaccgtcatcaggaatcccaacggtggcttccgtatgtacagcaagggcgcctctgagatcatcttgcgcaagtgtaatcgaatcctggaccggaaaggggaagcagtgccattcaagaataaagacagagatgatatggtacgcactgtcatcgagcccatggcctgtgatggactccggactatctgcatagcttaccgggacttcgatgacacagagccctcttgggacaatgagaatgagatcctcaccgaactgacctgtatcgcggtggtgggcattgaggaccctgtgcgcccagaggtgccagatgctattgccaaatgcaaacaagctggcattactgtcagaatggtgacaggtgacaacatcaacacagcccgggccattgccaccaaatgtggcattctgacacctggggatgacttcctgtgcttagaaggcaaagaattcaaccggctcatccgcaacgagaaaggcgaggtagagcaagaaaagctggacaagatctggcctaagcttcgggtcctggcgcgatcttctcccactgacaagcacaccctggtgaaaggcataattgacagcactgttggggaacaccggcaggtcgtggctgtcactggtgatggcacaaatgacgggcctgctctgaagaaagcggatgttggttttgccatgggcatcgcaggcacagatgtagcaaaggaggcttcagacatcatcctaacagatgacaacttcaccagcattgtgaaggcagtgatgtggggacgaaatgtctatgacagcatctccaagttcctgcagttccagctcactgtcaatgtggtggccgtgattgtagccttcactggagcctgtatcactcaggattccccattgaaagctgtgcagatgttgtgggttaatctgatcatggacacttttgcttcattggccctggccacagagccccctacggaatctctgttgaagcggcgcccctatggccgaaataagcctctgatctcacgcactatgatgaagaacatcttgggccatgcattctatcagctcattgtcatctttatccttgtctttgcgggtgagaaattctttgatattgatagtgggaggaaggcacctctacattcaccacccagccagcactataccattgtttttaacaccttcgtgctgatgcagctcttcaatgaaatcaactcccgaaagatccatggagagaagaacgtcttttcaggcatctaccgcaacattatcttctgctctgtagtcttgggcacattcatctgccagattttcatcgtggaatttgggggtaaacccttcagttgtacaagcctcagcctgtctcagtggctgtggtgtctcttcattgggattggagaacttctgtggggccagttcatctccgcaatacctacccgatccctgaagttcctgaaggaggctgggcatggcaccaccaaagaggagatcaccaaggatgccgagggactggatgagattgaccatgctgagatggagctgcgccgaggccagatcctctggttccggggcctgaaccgtatccagactcagatcaaagtggtcaaagcgttccatagttccctccacgaaagcattcagaaaccctacaaccaaaagtccatccacagcttcatgacccaccctgaattcgccatagaggaggagttgccacgaacaccactcctggatgaggaagaggaggaaaatcctgacaaggcttctaagtttgggactagggtgctcctgttggatggtgaggtcactccatatgccaatacaaacaacaatgcggtggattgcaaccaagtgcagctcccccagtcggacagctctctacagagcctagagacatcagtttgaattttctttctctgactctcatccctattttacctatttccattttcgtctgtcccatctatgaggtgatgatgggacttttcatcgtcacgtcagctgctgtgttaacagcagtgtgtgtgaagtgaacctctacctgaccatgaagaggcaagagcacagacttacaaggatttcaacttaagcttgacttggggtttgtagcgggacccagtcaaaccccattcaggtcatggtagaatctactccttggtagtcacttgtcatttttaaagaaatgatgacaatcctcttggcatcaccccaccccacattctccccgatgttcctctcctgaattctggattttgtcctacaagtctgtgccatttataagctaagttgagggttcagagggagacaaatatccccaagtgaaatatgttgcggtagagatggaatgtataaaatccgccagtagtgtgaatgnttttcaatttttcccactttgaaaacttacacctaaaggcctgtaggcctctaactctttctgccctttcattcaaacctctccaaagttctttgtctt

SEQ ID NO: 314849 - DNA, 2912 bp, Homo sapiens
agaaaatggaaaggatatggatgaattgtgtaaacttagatccttctcccttttggcccaaaagaacccttgatttagttccagaatccaaccagtttctttgttaaaagggtccttttgaagcaattaagtgctggtaagaatatttctctgttgttgccaggttaccttctgcttttaaattgccatcttgtaaagtgtatgtggttcttaagtgccagggagatcagccttgcccatgaaggttgcatatgtgtggtatacagtttttacctgaaagcctgagctttctcttattcctaaagtggtggcaaaagaatgaactgggtatgaccctgcccccttactgggcttggatattgaggaccagacgctgccaaatctaggacaagacagaccatcaaagcagacttttgtgggctcctctttggggtgaccactgctttcaaagccatctgccaaggctctccagggcaggacctgactggtggggaatgagtgttcagaagccttgggagaggccaaagagccattctagcatgatctgagaaaaccttcctgcagaggccagaaaccttgagcttaggtgcctggggaccagcttcgacattctctccagtttctgattctaatttttgccacgtgtcacaacttttccagtctctgagaaggtcccagcctttctcaaatattctgattttgaaaatatgtatccaaagtgggaggcccctgtgacattttgccaacttaaacgagaaaaagaccccccgcacccggcacactcccccttcctccagccccgcttcagccacatgctccagctgctgcccagtaaagccctgtgcctttttttcccctgaatactgcccaaagcatccccttcccatctgcctctcaggagttggggactttgctaggagattttttaagtgttccttactgggacaacgtggagccacgtttgcaggagctccatttgtatccctgctggtgttgacttctgtgtaggggccagttcatgtccctgactctcacctcccattagataaatgaagcccacccccctttctagagtgatgagagtcaagaagaggggatgtatgaacggccaaattcccatgtgagaggaagatgacctgatccacctagccttttcttctggatctgtcctccctcacccctttcacctgagctgtccacagtaggaaacataaagaaacaatgtcccctacatatccccatgactacataatccatcatcgtaggaaataggaaagcaaatttgattttggttttgtaaaacgtacatgcttcaataattctttttttgtgtcttaaatactcataggggaaaaaaacagctcacccaaggtgttaggtttcacatatatattcatcaactattttagaagatttaattctatcaaatcttgtattacctcagatcattttaaatagcaagccaataacgagctttgaaggctattttaccattcctgttcacaaaaggttctcatggtgcctgacaggttacccttgagggcttgtgtctactttttaaaagtcaatggttttttttcttgtgttctagtttccataataggagagaaaatatagaaatatatgcaaaaattatagttttctttagatcagaaactgatatttttgggtcagccatatgtattttgtttaaaggatttaaaataaagtgccgtcatgtagccctgtggaagggagcacataaccagctgtttggcatgacaggtgacttagtatatttgtaattggttttaaaaccaatacaccatactttctttctgcaaacagccatctttatacttagggaagaaaaattgttgggttctagacttttttaatataaattttgttgatatggaattaggtaagtttaagtgtctatgtgcatatgttttttatataagttttttctattcagtttcactgatccaactggcagtgggtaaatatggcataagttaataacacttttccccaaaatggtgctttggatttgaaaagggtctgatggggagaaggagaacgtatcatcctatgcttcctttgccttacaattgaagcagcccgtggtaccatcacagtatgcagagacttcctcacctttcatatctagggaccacccccgatgcattggtgagggtgggcacttataaatgcctgctattgttaagccattccagcctcttcctctgaatagaccagacgccctttcacttagttcagtgccagtccttttgccttcccaaccctgctgttaggcctgctgttccctttgctcttgattaggagagatggaaggagatgagctcccataactgaattggcctttggttcatgttttctccccatatgtatatatgccatatgtgaatatgccatatatatgtgccaacaaatctatctacgttgttcttttcaaattagcacgcagataggaattttgagtttcttcttcttttagtaactagtataacaagcactggtatttttgtacaaaaaagaaaaacaaaagattgactattgtggtctgcatgacataaacaaacaaatggtgatatcaaagcaacgtataccccagtccagtgtgtgttgccataatttgcaattcagcttaacagtgcacccaatctatatttgcattttgatattatttaagctctatgtacaaggttttgcatgtatttatatggttcttagggaaaaaaaatgctataaactgcaaatctgaaattcaaatgtgttgttccactgagaccagaagaagaagaggagttttaaaagggataatttgttggagccaataaagctttttgctgatgaacagaaaccaatactgctgtgcactgagaataaaaactcatgcccacttgtaa

SEQ ID NO: 314850 - DNA, 1152 bp, Homo sapiens
cagagtccaaacagtgctcagagtccaaacagtgcccagagtccaaacagtgctcagagtccaaacagtgctcagagtccaaacagtgcccatagtccaaacagtgctcagagtccaaacagtgctcagagtccaaacagtgcccagagtccaaacagtgctcagagtccaaacagtgcccttccccttgagcttcagagaggagagttggcatggttaaatctgaatggttacctcactgctgaaaacccagaggggcgtggcacactcgcttgtgtggaaaagcctctaaatgcatcccttcctttctttcctgcttcctttgccttacaattgaagcagcccgtggtaccatcacagtatgcagagacttcctcacctttcatatctagggaccacccccgatgcattggtgagggtgggcacttataaatgcctgctattgttaagccattccagcctcttcctctgaatagaccagacgccctttcacttagttcagtgccagtccttttgccttcccaaccctgctgttaggcctgctgttccctttgctcttgattaggagagatggaaggagatgagctcccataactgaattggcctttggttcatgttttctccccatatgtatatatgccatatgtgaatatgccatatatatgtgccaacaaatctatctacgttgttcttttcaaattagcacgcagataggaattttgagtttcttcttcttttagtaactagtataacaagcactggtatttttgtacaaaaaagaaaaacaaaagattgactattgtggtctgcatgacataaacaaacaaatggtgatatcaaagcaacgtataccccagtccagtgtgtgttgccataatttgcaattcagcttaacagtgcacccaatctatatttgcattttgatattatttaagctctatgtacaaggttttgcatgtatttatatggttcttagggaaaaaaaatgctataaactgcaaatctgaaattcaaatgtgttgttccactgagaccagaagaagaagaggagttttaaaagggataatttgttggagccaataaagctttttgctgatgaacagaaaccaatactgctgtgcactgagaataaaaactcatgcccacttgtaa

SEQ ID NO: 314851 - DNA, 5238 bp, Homo sapiens
  misc_feature (5139)..(5139): n is a, c, g, or t
tggtgagcaagagtctggcccgagttagctagagctgttgccatgacaagcattttcttaagaaagctctgctgttgagatcgtccaaagctgggggctgggagggggggcacgaacttcgtggggcaccatccctccgaagagagcaagatcagagacacccgcccagctctcctgcaccctttttctttcaggaacctgagaggtccttcccattggaggggcagggggaggagacccagcccactccccggccttagccagaaaggcaagagagcaaagccagcgtctctagcttggttgccacactggggagactggtgggtggtcaccccaccctaccctcatccatggaaacccggagggagagtcccgcctgaagaaacctggatctttgctagaaagagagagatccagttgtcatcggtatccaggaagctctcctcttcctcctcctgacgtctaccactacagttgctggttgttgctaaggttgctgccatggtaacatgcacatcctgtttacaccttcatctgggcaagttggtctaagctaggaacctacctaccctggacaaccactatcatcaccacctggggacaccaatcatcgtgacacggagtccaccttccactcagttcccccatcctcttcctcctctcgctgccagacttcatagagaagaaaggatctagacttcggacggctactcgggagcttattgcacaagatatattcaatctattccctcactgggcccccagagaagcaagaagtaggaagaagttgagacagggaggcaggagacactggtcagttgaagggaaacgctacatcttctctggttgaggggcttggtaacagcaggcaaaatgacgaacccatcagaccgtgtcttgcctgccaactcgatggccgagagccgtgaaggggactttggctgcacagtaatggaactgaggaagctcatggagctgcgttcgagggatgcactgacccagattaatgtccactatggaggtgtacagaatctctgcagtagactgaaaacctcccctgtggaaggtctgtctgggaaccctgcagatctggagaaacgtaggcaggtgtttggacacaacgtgatccccccccaaaaagcccaagactttcttagaattagtgtgggaagctcttcaagatgtcacgctcatcatcctggagattgcagccatcatctccctggtcctgtccttttatcgccctgctggtgaagaaaatgaactgtgtggtcaagtcgcaactaccccagaagatgaaaatgaggcacaagctggctggattgagggggcagccatccttttctcagtgatcatcgtggtgttagtgactgcctttaatgattggagcaaagagaagcaattccgggggctgcagtgccgcattgaacaggagcaaaagttctccatcatccgaaacggtcaactcatccagctccctgtggctgagattgtggttggtgatattgcccaagtcaaatacggtgatctgctgcctgcagatggaatcctgatccaagggaatgatctgaagattgatgagagctctctgacaggggaatctgaccatgtcaagaagtccctggacaaagaccccatgttgctctcagggacccatgtcatggaaggttctggccggatggtggtgacagctgttggtgtcaactctcagactggaatcatccttactctcttgggggtcaatgaggatgacgaaggggagaaaaagaagaaaggtaaaaaacaaggagtccctgaaaatcgcaacaaagcaaagacccaagacggagtggccctggaaatccagccactcaacagccaggagggaatcgacaatgaggaaaaggacaagaaggcagtcaaggtgcctaaaaaggagaagtcagtgctgcagggcaagctgactcgcctggctgttcagattgggaaagccggtctgctcatgtctgctctcacggttttcatcctgattctatactttgtgattgacaactttgtgataaatcgcagaccatggctccctgagtgtactcccatctacatccagtactttgtcaagttcttcatcatcggcatcactgtactggtggtggctgtgccagaggggctgcctctggctgtcaccatctcactggcctactctgtgaagaaaatgatgaaagacaataacctagtacggcacttggatgcttgtgagaccatgggcaacgccaccgccatctgctctgataagacaggcacgttgaccatgaaccgcatgactgtggtacaagcttatattgggggcatccattaccgtcaaatcccaagccctgatgtcttcctgcccaaagtcctggacctcattgtcaatggcatttctatcaacagtgcttatacctccaagattctgcctccagagaaggagggaggcctgcctcggcaggtgggcaacaagaccgagtgtgctctgctaggctttgtcacagatctgaagcaggattatcaggctgtgcgtaatgaagtgcccgaggagaagctctacaaggtgtacacctttaactcagtgcgcaagtcaatgagcaccgtcatcaggaatcccaacggtggcttccgtatgtacagcaagggcgcctctgagatcatcttgcgcaagtgtaatcgaatcctggaccggaaaggggaagcagtgccattcaagaataaagacagagatgatatggtacgcactgtcatcgagcccatggcctgtgatggactccggactatctgcatagcttaccgggacttcgatgacacagagccctcttgggacaatgagaatgagatcctcaccgaactgacctgtatcgcggtggtgggcattgaggaccctgtgcgcccagaggtgccagatgctattgccaaatgcaaacaagctggcattactgtcagaatggtgacaggtgacaacatcaacacagcccgggccattgccaccaaatgtggcattctgacacctggggatgacttcctgtgcttagaaggcaaagaattcaaccggctcatccgcaacgagaaaggcgaggtagagcaagaaaagctggacaagatctggcctaagcttcgggtcctggcgcgatcttctcccactgacaagcacaccctggtgaaaggcataattgacagcactgttggggaacaccggcaggtcgtggctgtcactggtgatggcacaaatgacgggcctgctctgaagaaagcggatgttggttttgccatgggcatcgcaggcacagatgtagcaaaggaggcttcagacatcatcctaacagatgacaacttcaccagcattgtgaaggcagtgatgtggggacgaaatgtctatgacagcatctccaagttcctgcagttccagctcactgtcaatgtggtggccgtgattgtagccttcactggagcctgtatcactcaggattccccattgaaagctgtgcagatgttgtgggttaatctgatcatggacacttttgcttcattggccctggccacagagccccctacggaatctctgttgaagcggcgcccctatggccgaaataagcctctgatctcacgcactatgatgaagaacatcttgggccatgcattctatcagctcattgtcatctttatccttgtctttgcgggtgagaaattctttgatattgatagtgggaggaaggcacctctacattcaccacccagccagcactataccattgtttttaacaccttcgtgctgatgcagctcttcaatgaaatcaactcccgaaagatccatggagagaagaacgtcttttcaggcatctaccgcaacattatcttctgctctgtagtcttgggcacattcatctgccagattttcatcgtggaatttgggggtaaacccttcagttgtacaagcctcagcctgtctcagtggctgtggtgtctcttcattgggattggagaacttctgtggggccagttcatctccgcaatacctacccgatccctgaagttcctgaaggaggctgggcatggcaccaccaaagaggagatcaccaaggatgccgagggactggatgagattgaccatgctgagatggagctgcgccgaggccagatcctctggttccggggcctgaaccgtatccagactcagatcgacgtaattaacacattccagacgggagcctcttttaagggagtcctaaggcgacagaacatgggtcaacaccttgatgtaaaacttgttcctagttcatcctatgtagcagttgcaccagtcaaatcttcccccaccacttctgttcctgctgtttcatctcctcctatgggcaatcaaagtggtcaaagcgttccatagttccctccacgaaagcattcagaaaccctacaaccaaaagtccatccacagcttcatgacccaccctgaattcgccatagaggaggagttgccacgaacaccactcctggatgaggaagaggaggaaaatcctgacaaggcttctaagtttgggactagggtgctcctgttggatggtgaggtcactccatatgccaatacaaacaacaatgcggtggattgcaaccaagtgcagctcccccagtcggacagctctctacagagcctagagacatcagtttgaattttctttctctgactctcatccctattttacctatttccattttcgtctgtcccatctatgaggtgatgatgggacttttcatcgtcacgtcagctgctgtgttaacagcagtgtgtgtgaagtgaacctctacctgaccatgaagaggcaagagcacagacttacaaggatttcaacttaagcttgacttggggtttgtagcgggacccagtcaaaccccattcaggtcatggtagaatctactccttggtagtcacttgtcatttttaaagaaatgatgacaatcctcttggcatcaccccaccccacattctccccgatgttcctctcctgaattctggattttgtcctacaagtctgtgccatttataagctaagttgagggttcagagggagacaaatatccccaagtgaaatatgttgcggtagagatggaatgtataaaatccgccagtagtgtgaatgnttttcaatttttcccactttgaaaacttacacctaaaggcctgtaggcctctaactctttctgccctttcattcaaacctctccaaagttctttgtctt

SEQ ID NO: 314852 - DNA, 817 bp, Homo sapiens
agctcggtaccccaggtagactaactatgcagagacttcctcacctttcatatctagggaccacccccgatgcattggtgagggtgggcacttataaatgcctgctattgttaagccattccagcctcttcctctgaatagaccagacgccctttcacttagttcagtgccagtccttttgccttcccaaccctgctgttaggcctgctgttccctttgctcttgattaggagagatggaaggagatgagctcccataactgaattggcctttggttcatgttttctccccatatgtatatatgccatatgtgaatatgccatatatatgtgccaacaaatctatctacgttgttcttttcaaattagcacgcagataggaattttgagtttcttcttcttttagtaactagtataacaagcactggtatttttgtacaaaaaagaaaaacaaaagattgactattgtggtctgcatgacataaacaaacaaatggtgatatcaaagcaacgtataccccagtccagtgtgtgttgccataatttgcaattcagcttaacagtgcacccaatctatatttgcattttgatattatttaagctctatgtacaaggttttgcatgtatttatatggttcttagggaaaaaaaatgctataaactgcaaatctgaaattcaaatgtgttgttccactgagaccagaagaagaagaggagttttaaaagggataatttgttggagccaataaagctttttgctgatgaacagaaaccaatactgctgtgcactgagaataaaaactcatgcccacttgtaa

SEQ ID NO: 314853 - DNA, 822 bp, Homo sapiens
  misc_feature (16)..(16): n is a, c, g, or t
gtgactctcgaggatnccaggcaaagctcttatgcagagacttcctcacctttcatatctagggaccacccccgatgcattggtgagggtgggcacttataaatgcctgctattgttaagccattccagcctcttcctctgaatagaccagacgccctttcacttagttcagtgccagtccttttgccttcccaaccctgctgttaggcctgctgttccctttgctcttgattaggagagatggaaggagatgagctcccataactgaattggcctttggttcatgttttctccccatatgtatatatgccatatgtgaatatgccatatatatgtgccaacaaatctatctacgttgttcttttcaaattagcacgcagataggaattttgagtttcttcttcttttagtaactagtataacaagcactggtatttttgtacaaaaaagaaaaacaaaagattgactattgtggtctgcatgacataaacaaacaaatggtgatatcaaagcaacgtataccccagtccagtgtgtgttgccataatttgcaattcagcttaacagtgcacccaatctatatttgcattttgatattatttaagctctatgtacaaggttttgcatgtatttatatggttcttagggaaaaaaaatgctataaactgcaaatctgaaattcaaatgtgttgttccactgagaccagaagaagaagaggagttttaaaagggataatttgttggagccaataaagctttttgctgatgaacagaaaccaatactgctgtgcactgagaataaaaactcatgcccacttgtaa

SEQ ID NO: 314854 - DNA, 3276 bp, Homo sapiens
agaaaatggaaaggatatggatgaattgtgtaaacttagatccttctcccttttggcccaaaagaacccttgatttagttccagaatccaaccagtttctttgttaaaagggtccttttgaagcaattaagtgctggtaagaatatttctctgttgttgccaggttaccttctgcttttaaattgccatcttgtaaagtgtatgtggttcttaagtgccagggagatcagccttgcccatgaaggttgcatatgtgtggtatacagtttttacctgaaagcctgagctttctcttattcctaaagtggtggcaaaagaatgaactgggtatgaccctgcccccttactgggcttggatattgaggaccagacgctgccaaatctaggacaagacagaccatcaaagcagacttttgtgggctcctctttggggtgaccactgctttcaaagccatctgccaaggctctccagggcaggacctgactggtggggaatgagtgttcagaagccttgggagaggccaaagagccattctagcatgatctgagaaaaccttcctgcagaggccagaaaccttgagcttaggtgcctggggaccagcttcgacattctctccagtttctgattctaatttttgccacgtgtcacaacttttccagtctctgagaaggtcccagcctttctcaaatattctgattttgaaaatatgtatccaaagtgggaggcccctgtgacattttgccaacttaaacgagaaaaagaccccccgcacccggcacactcccccttcctccagccccgcttcagccacatgctccagctgctgcccagtaaagccctgtgcctttttttcccctgaatactgcccaaagcatccccttcccatctgcctctcaggagttggggactttgctaggagattttttaagtgttccttactgggacaacgtggagccacgtttgcaggagctccatttgtatccctgctggtgttgacttctgtgtaggggccagttcatgtccctgactctcacctcccattagataaatgaagcccacccccctttctagagtgatgagagtcaagaagaggggatgtatgaacggccaaattcccatgtgagaggaagatgacctgatccacctagccttttcttctggatctgtcctccctcacccctttcacctgagctgtccacagtaggaaacataaagaaacaatgtcccctacatatccccatgactacataatccatcatcgtaggaaataggaaagcaaatttgattttggttttgtaaaacgtacatgcttcaataattctttttttgtgtcttaaatactcataggggaaaaaaacagctcacccaaggtgttaggtttcacatatatattcatcaactattttagaagatttaattctatcaaatcttgtattacctcagatcattttaaatagcaagccaataacgagctttgaaggctattttaccattcctgttcacaaaaggttctcatggtgcctgacaggttacccttgagggcttgtgtctactttttaaaagtcaatggttttttttcttgtgttctagtttccataataggagagaaaatatagaaatatatgcaaaaattatagttttctttagatcagaaactgatatttttgggtcagccatatgtattttgtttaaaggatttaaaataaagtgccgtcatgtagccctgtggaagggagcacataaccagctgtttggcatgacaggtgacttagtatatttgtaattggttttaaaaccaatacaccatactttctttctgcaaacagccatctttatacttagggaagaaaaattgttgggttctagacttttttaatataaattttgttgatatggaattaggtaagtttaagtgtctatgtgcatatgttttttatataagttttttctattcagtttcactgatccaactggcagtgggtaaatatggcataagttaataacacttttccccaaaatggtgctttggatttgaaaagggtctgatggggagaaggagaacgtatcatcctagcttcctctcttaataaacctagaaaaacgggtagtaaactgtggatagtcaggaaaacacccagcaagggacacagctgtcaggaaatgaatcttccccccaacccccaccatgcagatggatagacagaatctttcctgactagtcattaggatcaggggcctctgttggatttgtgtttcttgaagaatagctggcagagtggtataaaagacacgaatatctcctggtctataaggatactctgatttggggtttgcatttttcatggtttttatttcctgttccccctggagttttccattagtgagtttttgtgcaaggatcttatttgtgatgccttccctcccctagaaagattttgtgcaatatattaaatggggacagaattctaaatggataaaacaatggctggttctagccctgagtgacagtcttaaggctagatccttcccatagtatcatctgtcctctggaatgactctcctgtccctaaaggggttaagagagagatcacctagaaatccctctggacacttgtgggttctttagggtttgagtttcttcttccccttgagcttcagagaggagagttggcatggttaaatctgaatggttacctcactgctgaaaacccagaggggcgtggcacactcgcttgtgtggaaaagcctctaaatgcatcccttcctttctttcctgcttcctttgccttacaattgaagcagcccgtggtaccatcacagtatgcagagacttcctcacctttcatatctagggaccacccccgatgcattggtgagggtgggcacttataaatgcctgctattgttaagccattccagcctcttcctctgaatagaccagacgccctttcacttagttcagtgccagtccttttgccttcccaaccctgctgttaggtctacctggccaggtagacctaactggtccacaagagaaaatgagagactcgatttggctgccaggaacacctgggcctaggcaagaacacaagaggtttctgggggtggggaggaaataggtctcgctgaaggtgacagatcccttggggggcgtccagctgtctggatcactgtccagggactgtggccagcccaagatacctccgaggtgagtcctagatcactaggagcagcagtctgtcggtgggatgcgatggatggttaggtctacctgg

SEQ ID NO: 314855 - DNA, 631 bp, Homo sapiens
ctaatcaagagcaaagggaacagcaggcctaacagcagggttgggagagatggaaggagatgagctcccataactgaattggcctttggttcatgttttctccccatatgtatatatgccatatgtgaatatgccatatatatgtgccaacaaatctatctacgttgttcttttcaaattagcacgcagataggaattttgagtttcttcttcttttagtaactagtataacaagcactggtatttttgtacaaaaaagaaaaacaaaagattgactattgtggtctgcatgacataaacaaacaaatggtgatatcaaagcaacgtataccccagtccagtgtgtgttgccataatttgcaattcagcttaacagtgcacccaatctatatttgcattttgatattatttaagctctatgtacaaggttttgcatgtatttatatggttcttagggaaaaaaaatgctataaactgcaaatctgaaattcaaatgtgttgttccactgagaccagaagaagaagaggagttttaaaagggataatttgttggagccaataaagctttttgctgatgaacagaaaccaatactgctgtgcactgagaataaaaactcatgcccacttgtaa

SEQ ID NO: 314856 - DNA, 5168 bp, Homo sapiens
  misc_feature (5069)..(5069): n is a, c, g, or t
tggtgagcaagagtctggcccgagttagctagagctgttgccatgacaagcattttcttaagaaagctctgctgttgagatcgtccaaagctgggggctgggagggggggcacgaacttcgtggggcaccatccctccgaagagagcaagatcagagacacccgcccagctctcctgcaccctttttctttcaggaacctgagaggtccttcccattggaggggcagggggaggagacccagcccactccccggccttagccagaaaggcaagagagcaaagccagcgtctctagcttggttgccacactggggagactggtgggtggtcaccccaccctaccctcatccatggaaacccggagggagagtcccgcctgaagaaacctggatctttgctagaaagagagagatccagttgtcatcggtatccaggaagctctcctcttcctcctcctgacgtctaccactacagttgctggttgttgctaaggttgctgccatggtaacatgcacatcctgtttacaccttcatctgggcaagttggtctaagctaggaacctacctaccctggacaaccactatcatcaccacctggggacaccaatcatcgtgacacggagtccaccttccactcagttcccccatcctcttcctcctctcgctgccagacttcatagagaagaaaggatctagacttcggacggctactcgggagcttattgcacaagatatattcaatctattccctcactgggcccccagagaagcaagaagtaggaagaagttgagacagggaggcaggagacactggtcagttgaagggaaacgctacatcttctctggttgaggggcttggtaacagcaggcaaaatgacgaacccatcagaccgtgtcttgcctgccaactcgatggccgagagccgtgaaggggactttggctgcacagtaatggaactgaggaagctcatggagctgcgttcgagggatgcactgacccagattaatgtccactatggaggtgtacagaatctctgcagtagactgaaaacctcccctgtggaaggtctgtctgggaaccctgcagatctggagaaacgtaggcaggtgtttggacacaacgtgatccccccccaaaaagcccaagactttcttagaattagtgtgggaagctcttcaagatgtcacgctcatcatcctggagattgcagccatcatctccctggtcctgtccttttatcgccctgctggtgaagaaaatgaactgtgtggtcaagtcgcaactaccccagaagatgaaaatgaggcacaagctggctggattgagggggcagccatccttttctcagtgatcatcgtggtgttagtgactgcctttaatgattggagcaaagagaagcaattccgggggctgcagtgccgcattgaacaggagcaaaagttctccatcatccgaaacggtcaactcatccagctccctgtggctgagattgtggttggtgatattgcccaagtcaaatacggtgatctgctgcctgcagatggaatcctgatccaagggaatgatctgaagattgatgagagctctctgacaggggaatctgaccatgtcaagaagtccctggacaaagaccccatgttgctctcagggacccatgtcatggaaggttctggccggatggtggtgacagctgttggtgtcaactctcagactggaatcatccttactctcttgggggtcaatgaggatgacgaaggggagaaaaagaagaaaggtaaaaaacaaggagtccctgaaaatcgcaacaaagcaaagacccaagacggagtggccctggaaatccagccactcaacagccaggagggaatcgacaatgaggaaaaggacaagaaggcagtcaaggtgcctaaaaaggagaagtcagtgctgcagggcaagctgactcgcctggctgttcagattgggaaagccggtctgctcatgtctgctctcacggttttcatcctgattctatactttgtgattgacaactttgtgataaatcgcagaccatggctccctgagtgtactcccatctacatccagtactttgtcaagttcttcatcatcggcatcactgtactggtggtggctgtgccagaggggctgcctctggctgtcaccatctcactggcctactctgtgaagaaaatgatgaaagacaataacctagtacggcacttggatgcttgtgagaccatgggcaacgccaccgccatctgctctgataagacaggcacgttgaccatgaaccgcatgactgtggtacaagcttatattgggggcatccattaccgtcaaatcccaagccctgatgtcttcctgcccaaagtcctggacctcattgtcaatggcatttctatcaacagtgcttatacctccaagattctgcctccagagaaggagggaggcctgcctcggcaggtgggcaacaagaccgagtgtgctctgctaggctttgtcacagatctgaagcaggattatcaggctgtgcgtaatgaagtgcccgaggagaagctctacaaggtgtacacctttaactcagtgcgcaagtcaatgagcaccgtcatcaggaatcccaacggtggcttccgtatgtacagcaagggcgcctctgagatcatcttgcgcaagtgtaatcgaatcctggaccggaaaggggaagcagtgccattcaagaataaagacagagatgatatggtacgcactgtcatcgagcccatggcctgtgatggactccggactatctgcatagcttaccgggacttcgatgacacagagccctcttgggacaatgagaatgagatcctcaccgaactgacctgtatcgcggtggtgggcattgaggaccctgtgcgcccagaggtgccagatgctattgccaaatgcaaacaagctggcattactgtcagaatggtgacaggtgacaacatcaacacagcccgggccattgccaccaaatgtggcattctgacacctggggatgacttcctgtgcttagaaggcaaagaattcaaccggctcatccgcaacgagaaaggcgaggtagagcaagaaaagctggacaagatctggcctaagcttcgggtcctggcgcgatcttctcccactgacaagcacaccctggtgaaaggcataattgacagcactgttggggaacaccggcaggtcgtggctgtcactggtgatggcacaaatgacgggcctgctctgaagaaagcggatgttggttttgccatgggcatcgcaggcacagatgtagcaaaggaggcttcagacatcatcctaacagatgacaacttcaccagcattgtgaaggcagtgatgtggggacgaaatgtctatgacagcatctccaagttcctgcagttccagctcactgtcaatgtggtggccgtgattgtagccttcactggagcctgtatcactcaggattccccattgaaagctgtgcagatgttgtgggttaatctgatcatggacacttttgcttcattggccctggccacagagccccctacggaatctctgttgaagcggcgcccctatggccgaaataagcctctgatctcacgcactatgatgaagaacatcttgggccatgcattctatcagctcattgtcatctttatccttgtctttgcgggtgagaaattctttgatattgatagtgggaggaaggcacctctacattcaccacccagccagcactataccattgtttttaacaccttcgtgctgatgcagctcttcaatgaaatcaactcccgaaagatccatggagagaagaacgtcttttcaggcatctaccgcaacattatcttctgctctgtagtcttgggcacattcatctgccagattttcatcgtggaatttgggggtaaacccttcagttgtacaagcctcagcctgtctcagtggctgtggtgtctcttcattgggattggagaacttctgtggggccagttcatctccgcaatacctacccgatccctgaagttcctgaaggaggctgggcatggcaccaccaaagaggagatcaccaaggatgccgagggactggatgagattgaccatgctgagatggagctgcgccgaggccagatcctctggttccggggcctgaaccgtatccagactcagatcgacgtaattaacacattccagacgggagcctcttttaagggagtcctaaggcgacagaacatgggtcaacaccttgatgtaaaacttgttcctagttcatcctatatcaaagtggtcaaagcgttccatagttccctccacgaaagcattcagaaaccctacaaccaaaagtccatccacagcttcatgacccaccctgaattcgccatagaggaggagttgccacgaacaccactcctggatgaggaagaggaggaaaatcctgacaaggcttctaagtttgggactagggtgctcctgttggatggtgaggtcactccatatgccaatacaaacaacaatgcggtggattgcaaccaagtgcagctcccccagtcggacagctctctacagagcctagagacatcagtttgaattttctttctctgactctcatccctattttacctatttccattttcgtctgtcccatctatgaggtgatgatgggacttttcatcgtcacgtcagctgctgtgttaacagcagtgtgtgtgaagtgaacctctacctgaccatgaagaggcaagagcacagacttacaaggatttcaacttaagcttgacttggggtttgtagcgggacccagtcaaaccccattcaggtcatggtagaatctactccttggtagtcacttgtcatttttaaagaaatgatgacaatcctcttggcatcaccccaccccacattctccccgatgttcctctcctgaattctggattttgtcctacaagtctgtgccatttataagctaagttgagggttcagagggagacaaatatccccaagtgaaatatgttgcggtagagatggaatgtataaaatccgccagtagtgtgaatgnttttcaatttttcccactttgaaaacttacacctaaaggcctgtaggcctctaactctttctgccctttcattcaaacctctccaaagttctttgtctt

SEQ ID NO: 314857 - DNA, 5130 bp, Homo sapiens
  misc_feature (5031)..(5031): n is a, c, g, or t
tggtgagcaagagtctggcccgagttagctagagctgttgccatgacaagcattttcttaagaaagctctgctgttgagatcgtccaaagctgggggctgggagggggggcacgaacttcgtggggcaccatccctccgaagagagcaagatcagagacacccgcccagctctcctgcaccctttttctttcaggaacctgagaggtccttcccattggaggggcagggggaggagacccagcccactccccggccttagccagaaaggcaagagagcaaagccagcgtctctagcttggttgccacactggggagactggtgggtggtcaccccaccctaccctcatccatggaaacccggagggagagtcccgcctgaagaaacctggatctttgctagaaagagagagatccagttgtcatcggtatccaggaagctctcctcttcctcctcctgacgtctaccactacagttgctggttgttgctaaggttgctgccatggtaacatgcacatcctgtttacaccttcatctgggcaagttggtctaagctaggaacctacctaccctggacaaccactatcatcaccacctggggacaccaatcatcgtgacacggagtccaccttccactcagttcccccatcctcttcctcctctcgctgccagacttcatagagaagaaaggatctagacttcggacggctactcgggagcttattgcacaagatatattcaatctattccctcactgggcccccagagaagcaagaagtaggaagaagttgagacagggaggcaggagacactggtcagttgaagggaaacgctacatcttctctggttgaggggcttggtaacagcaggcaaaatgacgaacccatcagaccgtgtcttgcctgccaactcgatggccgagagccgtgaaggggactttggctgcacagtaatggaactgaggaagctcatggagctgcgttcgagggatgcactgacccagattaatgtccactatggaggtgtacagaatctctgcagtagactgaaaacctcccctgtggaaggtctgtctgggaaccctgcagatctggagaaacgtaggcaggtgtttggacacaacgtgatccccccccaaaaagcccaagactttcttagaattagtgtgggaagctcttcaagatgtcacgctcatcatcctggagattgcagccatcatctccctggtcctgtccttttatcgccctgctggtgaagaaaatgaactgtgtggtcaagtcgcaactaccccagaagatgaaaatgaggcacaagctggctggattgagggggcagccatccttttctcagtgatcatcgtggtgttagtgactgcctttaatgattggagcaaagagaagcaattccgggggctgcagtgccgcattgaacaggagcaaaagttctccatcatccgaaacggtcaactcatccagctccctgtggctgagattgtggttggtgatattgcccaagtcaaatacggtgatctgctgcctgcagatggaatcctgatccaagggaatgatctgaagattgatgagagctctctgacaggggaatctgaccatgtcaagaagtccctggacaaagaccccatgttgctctcagggacccatgtcatggaaggttctggccggatggtggtgacagctgttggtgtcaactctcagactggaatcatccttactctcttgggggtcaatgaggatgacgaaggggagaaaaagaagaaaggtaaaaaacaaggagtccctgaaaatcgcaacaaagcaaagacccaagacggagtggccctggaaatccagccactcaacagccaggagggaatcgacaatgaggaaaaggacaagaaggcagtcaaggtgcctaaaaaggagaagtcagtgctgcagggcaagctgactcgcctggctgttcagattgggaaagccggtctgctcatgtctgctctcacggttttcatcctgattctatactttgtgattgacaactttgtgataaatcgcagaccatggctccctgagtgtactcccatctacatccagtactttgtcaagttcttcatcatcggcatcactgtactggtggtggctgtgccagaggggctgcctctggctgtcaccatctcactggcctactctgtgaagaaaatgatgaaagacaataacctagtacggcacttggatgcttgtgagaccatgggcaacgccaccgccatctgctctgataagacaggcacgttgaccatgaaccgcatgactgtggtacaagcttatattgggggcatccattaccgtcaaatcccaagccctgatgtcttcctgcccaaagtcctggacctcattgtcaatggcatttctatcaacagtgcttatacctccaagattctgcctccagagaaggagggaggcctgcctcggcaggtgggcaacaagaccgagtgtgctctgctaggctttgtcacagatctgaagcaggattatcaggctgtgcgtaatgaagtgcccgaggagaagctctacaaggtgtacacctttaactcagtgcgcaagtcaatgagcaccgtcatcaggaatcccaacggtggcttccgtatgtacagcaagggcgcctctgagatcatcttgcgcaagtgtaatcgaatcctggaccggaaaggggaagcagtgccattcaagaataaagacagagatgatatggtacgcactgtcatcgagcccatggcctgtgatggactccggactatctgcatagcttaccgggacttcgatgacacagagccctcttgggacaatgagaatgagatcctcaccgaactgacctgtatcgcggtggtgggcattgaggaccctgtgcgcccagaggtgccagatgctattgccaaatgcaaacaagctggcattactgtcagaatggtgacaggtgacaacatcaacacagcccgggccattgccaccaaatgtggcattctgacacctggggatgacttcctgtgcttagaaggcaaagaattcaaccggctcatccgcaacgagaaaggcgaggtagagcaagaaaagctggacaagatctggcctaagcttcgggtcctggcgcgatcttctcccactgacaagcacaccctggtgaaaggcataattgacagcactgttggggaacaccggcaggtcgtggctgtcactggtgatggcacaaatgacgggcctgctctgaagaaagcggatgttggttttgccatgggcatcgcaggcacagatgtagcaaaggaggcttcagacatcatcctaacagatgacaacttcaccagcattgtgaaggcagtgatgtggggacgaaatgtctatgacagcatctccaagttcctgcagttccagctcactgtcaatgtggtggccgtgattgtagccttcactggagcctgtatcactcaggattccccattgaaagctgtgcagatgttgtgggttaatctgatcatggacacttttgcttcattggccctggccacagagccccctacggaatctctgttgaagcggcgcccctatggccgaaataagcctctgatctcacgcactatgatgaagaacatcttgggccatgcattctatcagctcattgtcatctttatccttgtctttgcgggtgagaaattctttgatattgatagtgggaggaaggcacctctacattcaccacccagccagcactataccattgtttttaacaccttcgtgctgatgcagctcttcaatgaaatcaactcccgaaagatccatggagagaagaacgtcttttcaggcatctaccgcaacattatcttctgctctgtagtcttgggcacattcatctgccagttcatctccgcaatacctacccgatccctgaagttcctgaaggaggctgggcatggcaccaccaaagaggagatcaccaaggatgccgagggactggatgagattgaccatgctgagatggagctgcgccgaggccagatcctctggttccggggcctgaaccgtatccagactcagatcgacgtaattaacacattccagacgggagcctcttttaagggagtcctaaggcgacagaacatgggtcaacaccttgatgtaaaacttgttcctagttcatcctatgtagcagttgcaccagtcaaatcttcccccaccacttctgttcctgctgtttcatctcctcctatgggcaatcaaagtggtcaaagcgttccatagttccctccacgaaagcattcagaaaccctacaaccaaaagtccatccacagcttcatgacccaccctgaattcgccatagaggaggagttgccacgaacaccactcctggatgaggaagaggaggaaaatcctgacaaggcttctaagtttgggactagggtgctcctgttggatggtgaggtcactccatatgccaatacaaacaacaatgcggtggattgcaaccaagtgcagctcccccagtcggacagctctctacagagcctagagacatcagtttgaattttctttctctgactctcatccctattttacctatttccattttcgtctgtcccatctatgaggtgatgatgggacttttcatcgtcacgtcagctgctgtgttaacagcagtgtgtgtgaagtgaacctctacctgaccatgaagaggcaagagcacagacttacaaggatttcaacttaagcttgacttggggtttgtagcgggacccagtcaaaccccattcaggtcatggtagaatctactccttggtagtcacttgtcatttttaaagaaatgatgacaatcctcttggcatcaccccaccccacattctccccgatgttcctctcctgaattctggattttgtcctacaagtctgtgccatttataagctaagttgagggttcagagggagacaaatatccccaagtgaaatatgttgcggtagagatggaatgtataaaatccgccagtagtgtgaatgnttttcaatttttcccactttgaaaacttacacctaaaggcctgtaggcctctaactctttctgccctttcattcaaacctctccaaagttctttgtctt

SEQ ID NO: 314858 - DNA, 1924 bp, Homo sapiens
  misc_feature (1779)..(1779): n is a, c, g, or t
  misc_feature (1784)..(1784): n is a, c, g, or t
tggtgagcaagagtctggcccgagttagctagagctgttgccatgacaagcattttcttaagaaagctctgctgttgagatcgtccaaagctgggggctgggagggggggcacgaacttcgtggggcaccatccctccgaagagagcaagatcagagacacccgcccagctctcctgcaccctttttctttcaggaacctgagaggtccttcccattggaggggcagggggaggagacccagcccactccccggccttagccagaaaggcaagagagcaaagccagcgtctctagcttggttgccacactggggagactggtgggtggtcaccccaccctaccctcatccatggaaacccggagggagagtcccgcctgaagaaacctggatctttgctagaaagagagagatccagttgtcatcggtatccaggaagctctcctcttcctcctcctgacgtctaccactacagttgctggttgttgctaaggttgctgccatggtaacatgcacatcctgtttacaccttcatctgggcaagttggtctaagctaggaacctacctaccctggacaaccactatcatcaccacctggggacaccaatcatcgtgacacggagtccaccttccactcagttcccccatcctcttcctcctctcgctgccagacttcatagagaagaaaggatctagacttcggacggctactcgggagcttattgcacaagatatattcaatctattccctcactgggcccccagagaagcaagaagtaggaagaagttgagacagggaggcaggagacactggtcagttgaagggaaacgctacatcttctctggttgaggggcttggtaacagcaggcaaaatgacgaacccatcagaccgtgtcttgcctgccaactcgatggccgagagccgtgaaggggactttggctgcacagtaatggaactgaggaagctcatggagctgcgttcgagggatgcactgacccagattaatgtccactatggaggtgtacagaatctctgcagtagactgaaaacctcccctgtggaaggtctgtctgggaaccctgcagatctggagaaacgtaggcaggtgtttggacacaacgtgatccccccccaaaaagcccaagactttcttagaattagtgtgggaagctcttcaagatgtcacgctcatcatcctggagattgcagccatcatctccctggtcctgtccttttatcgccctgctggtgaagaaaatgaactgtgtggtcaagtcgcaactaccccagaagatgaaaatgaggcacaagctggctggattgagggggcagccatccttttctcagtgatcatcgtggtgttagtgactgcctttaatgattggagcaaagagaagcaattccgggggctgcagtgccgcattgaacaggagcaaaagttctccatcatccgaaacggtcaactcatccagctccctgtggctgagattgtggttggtgatattgcccaagtcaaatacggtgatctgctgcctgcagatggaatcctgatccaagggaatgatctgaagattgatgagagctctctgacaggggaatctgaccatgtcaagaagtccctggacaaagaccccatgttgctctcagggacccatgtcatggaaggttctggccggatggtggtgacagctgttggtgtcaactctcagactggaatcatccttactctcttgggggtcaatgaggatgacgaaggggagaaaaagaagaatttagnggggnacaggcctgttcccccctaatatcttctttgctaataaaagcccaaattactgctatcacgggggatacagtgacactcctgctgcaaagagaaagtgtatagatggccataaatggtcctgcaacttaaattcagtgta

SEQ ID NO: 314859 - DNA, 1511 bp, Homo sapiens
  misc_feature (1412)..(1412): n is a, c, g, or t
gcaaattattattagagagttttaagttcctgcatgctgctgacacaaatgaagattggtttgtctgcctggctgcacagttttcatggtcactcgtcacccaacctgtattatgtgcagattggtgtatgctggctctttgaggtctttaaacagataactaaacctcaatgcataatttttccattccacattcacaaaatgtttggcctcagcacagaaatccacatatctcaatcatctttttaagtttggctatgaatttgcatctagttcccatgtccttgccctccatctaaaagaactaatgaaacttcttgttttctgtttcattttaaaagtagattgtttgggaatgctaacgttgctttgggttttctactttttttaatgcagctttcaaaacgtcctagttgccgtcactcaccccagcccaccccactgcttgaaagttgagccatgtgatgtttctagtgccccatgatctcttctgatgtgtgtttggttttgatgctgagcagtcatgttttatagtctgggttttgtttctctcctaaatccaccatctccttgttctgccggccaattctcacctctctattttctcatcctccttttccttcccctggtatagatcaaagtggtcaaagcgttccatagttccctccacgaaagcattcagaaaccctacaaccaaaagtccatccacagcttcatgacccaccctgaattcgccatagaggaggagttgccacgaacaccactcctggatgaggaagaggaggaaaatcctgacaaggcttctaagtttgggactagggtgctcctgttggatggtgaggtcactccatatgccaatacaaacaacaatgcggtggattgcaaccaagtgcagctcccccagtcggacagctctctacagagcctagagacatcagtttgaattttctttctctgactctcatccctattttacctatttccattttcgtctgtcccatctatgaggtgatgatgggacttttcatcgtcacgtcagctgctgtgttaacagcagtgtgtgtgaagtgaacctctacctgaccatgaagaggcaagagcacagacttacaaggatttcaacttaagcttgacttggggtttgtagcgggacccagtcaaaccccattcaggtcatggtagaatctactccttggtagtcacttgtcatttttaaagaaatgatgacaatcctcttggcatcaccccaccccacattctccccgatgttcctctcctgaattctggattttgtcctacaagtctgtgccatttataagctaagttgagggttcagagggagacaaatatccccaagtgaaatatgttgcggtagagatggaatgtataaaatccgccagtagtgtgaatgnttttcaatttttcccactttgaaaacttacacctaaaggcctgtaggcctctaactctttctgccctttcattcaaacctctccaaagttctttgtctt

SEQ ID NO: 314860 - DNA, 1262 bp, Homo sapiens
tcggtacttcatcccgagaaaagggtgggagggaagctctctctgctctctcctgtccccttttcccatctacttccattcctgcttccccaaccttccatgaccctcccttcctctttcttcacctctctcggactgactgtggagcaaagctgtctcactctctgattctttgcagatcgacgtaattaacacattccagacgggagcctcttttaagggagtcctaaggcgacagaacatgggtcaacaccttgatgtaaaacttgttcctagttcatcctatgtagcagttgcaccagtcaaatcttcccccaccacttctgttcctgctgtttcatctcctcctatgggcagtgagtgatagtctattatgatgcatgatttgctaaaatgaccacaagagagcacgtggcatccactttaaccaaccatggttatcttttccttttggtttttccctttgatattttgacttaagggaagaaaaagacaaaaatcctactctaaaaccagactgtgtgcccttgtattttatttttgtaatgtagaaaagctattaaaccttaactgttttaaagacaataattctgttttctgattgttcctctgcattgctcatttcttccttttcttgagttttgttttgttttgctttgccttttttgtttgtctgtttgttgctttgctgggatatgttgttgttcctctcttctcctcctgctcctttgagtctgaactctacctcctaagcttagatgtgaggttaggccagaggaaaacccaagagctttctttacatgggggcaaagtttgggatcttttgaggaaaggtaggaagggagctaatgtgcccatgggtgtgttttgactagtggacctgtcataattgagccagtattaaacttggtcaataataatagtccatttggccaccactgtattgctgactggcaattttagcataaaagttgtagctggctgggcacgatggctcacgcctgtaatcccaacactttgggaggccaaagcagatcacgaggtcaggagatcaagaccatcctggctaacatggtgaaaccccgtctctactaaaaatacaaaaaattagctgggcgtggtggcgggcacctgtagtcctatagctactcgggaggctaagacaggagaatcacttgaactcaggaggcggaggttacagtgagccaagtggagagccactgcactccaccctgggcgatagagcaagactctgtctcaaa

SEQ ID NO: 314861 - DNA, 173 bp, Homo sapiens
acctccagtgcttctcctctccccactaggtgagaaattctttgatattgatagtgggaggaaggcacctctacattcaccacccagccagcactataccattgtttttaacaccttcgtgctgatgcagctcttcaatgaaatcaactcccgaaagatccatggagagaaga

SEQ ID NO: 314862 - DNA, 4744 bp, Homo sapiens
  misc_feature (4645)..(4645): n is a, c, g, or t
gcttagactgggtacctcttgcccttgcagatgctggatacttatggctgctctaatggtttctttttgtctatctttgaacctttattccagagatccagttgtcatcggtatccaggaagctctcctcttcctcctcctgacgtctaccactacagttgctggttgttgctaaggttgctgccatggtaacatgcacatcctgtttacaccttcatctgggcaagttggtctaagctaggaacctacctaccctggacaaccactatcatcaccacctggggacaccaatcatcgtgacacggagtccaccttccactcagttcccccatcctcttcctcctctcgctgccagacttcatagagaagaaaggatctagacttcggacggctactcgggagcttattgcacaagatatattcaatctattccctcactgggcccccagagaagcaagaagtaggaagaagttgagacagggaggcaggagacactggtcagttgaagggaaacgctacatcttctctggttgaggggcttggtaacagcaggcaaaatgacgaacccatcagaccgtgtcttgcctgccaactcgatggccgagagccgtgaaggggactttggctgcacagtaatggaactgaggaagctcatggagctgcgttcgagggatgcactgacccagattaatgtccactatggaggtgtacagaatctctgcagtagactgaaaacctcccctgtggaaggtctgtctgggaaccctgcagatctggagaaacgtaggcaggtgtttggacacaacgtgatccccccccaaaaagcccaagactttcttagaattagtgtgggaagctcttcaagatgtcacgctcatcatcctggagattgcagccatcatctccctggtcctgtccttttatcgccctgctggtgaagaaaatgaactgtgtggtcaagtcgcaactaccccagaagatgaaaatgaggcacaagctggctggattgagggggcagccatccttttctcagtgatcatcgtggtgttagtgactgcctttaatgattggagcaaagagaagcaattccgggggctgcagtgccgcattgaacaggagcaaaagttctccatcatccgaaacggtcaactcatccagctccctgtggctgagattgtggttggtgatattgcccaagtcaaatacggtgatctgctgcctgcagatggaatcctgatccaagggaatgatctgaagattgatgagagctctctgacaggggaatctgaccatgtcaagaagtccctggacaaagaccccatgttgctctcagggacccatgtcatggaaggttctggccggatggtggtgacagctgttggtgtcaactctcagactggaatcatccttactctcttgggggtcaatgaggatgacgaaggggagaaaaagaagaaaggtaaaaaacaaggagtccctgaaaatcgcaacaaagcaaagacccaagacggagtggccctggaaatccagccactcaacagccaggagggaatcgacaatgaggaaaaggacaagaaggcagtcaaggtgcctaaaaaggagaagtcagtgctgcagggcaagctgactcgcctggctgttcagattgggaaagccggtctgctcatgtctgctctcacggttttcatcctgattctatactttgtgattgacaactttgtgataaatcgcagaccatggctccctgagtgtactcccatctacatccagtactttgtcaagttcttcatcatcggcatcactgtactggtggtggctgtgccagaggggctgcctctggctgtcaccatctcactggcctactctgtgaagaaaatgatgaaagacaataacctagtacggcacttggatgcttgtgagaccatgggcaacgccaccgccatctgctctgataagacaggcacgttgaccatgaaccgcatgactgtggtacaagcttatattgggggcatccattaccgtcaaatcccaagccctgatgtcttcctgcccaaagtcctggacctcattgtcaatggcatttctatcaacagtgcttatacctccaagattctgcctccagagaaggagggaggcctgcctcggcaggtgggcaacaagaccgagtgtgctctgctaggctttgtcacagatctgaagcaggattatcaggctgtgcgtaatgaagtgcccgaggagaagctctacaaggtgtacacctttaactcagtgcgcaagtcaatgagcaccgtcatcaggaatcccaacggtggcttccgtatgtacagcaagggcgcctctgagatcatcttgcgcaagtgtaatcgaatcctggaccggaaaggggaagcagtgccattcaagaataaagacagagatgatatggtacgcactgtcatcgagcccatggcctgtgatggactccggactatctgcatagcttaccgggacttcgatgacacagagccctcttgggacaatgagaatgagatcctcaccgaactgacctgtatcgcggtggtgggcattgaggaccctgtgcgcccagaggtgccagatgctattgccaaatgcaaacaagctggcattactgtcagaatggtgacaggtgacaacatcaacacagcccgggccattgccaccaaatgtggcattctgacacctggggatgacttcctgtgcttagaaggcaaagaattcaaccggctcatccgcaacgagaaaggcgaggtagagcaagaaaagctggacaagatctggcctaagcttcgggtcctggcgcgatcttctcccactgacaagcacaccctggtgaaaggcataattgacagcactgttggggaacaccggcaggtcgtggctgtcactggtgatggcacaaatgacgggcctgctctgaagaaagcggatgttggttttgccatgggcatcgcaggcacagatgtagcaaaggaggcttcagacatcatcctaacagatgacaacttcaccagcattgtgaaggcagtgatgtggggacgaaatgtctatgacagcatctccaagttcctgcagttccagctcactgtcaatgtggtggccgtgattgtagccttcactggagcctgtatcactcaggattccccattgaaagctgtgcagatgttgtgggttaatctgatcatggacacttttgcttcattggccctggccacagagccccctacggaatctctgttgaagcggcgcccctatggccgaaataagcctctgatctcacgcactatgatgaagaacatcttgggccatgcattctatcagctcattgtcatctttatccttgtctttgcgggtgagaaattctttgatattgatagtgggaggaaggcacctctacattcaccacccagccagcactataccattgtttttaacaccttcgtgctgatgcagctcttcaatgaaatcaactcccgaaagatccatggagagaagaacgtcttttcaggcatctaccgcaacattatcttctgctctgtagtcttgggcacattcatctgccagattttcatcgtggaatttgggggtaaacccttcagttgtacaagcctcagcctgtctcagtggctgtggtgtctcttcattgggattggagaacttctgtggggccagttcatctccgcaatacctacccgatccctgaagttcctgaaggaggctgggcatggcaccaccaaagaggagatcaccaaggatgccgagggactggatgagattgaccatgctgagatggagctgcgccgaggccagatcctctggttccggggcctgaaccgtatccagactcagatcaaagtggtcaaagcgttccatagttccctccacgaaagcattcagaaaccctacaaccaaaagtccatccacagcttcatgacccaccctgaattcgccatagaggaggagttgccacgaacaccactcctggatgaggaagaggaggaaaatcctgacaaggcttctaagtttgggactagggtgctcctgttggatggtgaggtcactccatatgccaatacaaacaacaatgcggtggattgcaaccaagtgcagctcccccagtcggacagctctctacagagcctagagacatcagtttgaattttctttctctgactctcatccctattttacctatttccattttcgtctgtcccatctatgaggtgatgatgggacttttcatcgtcacgtcagctgctgtgttaacagcagtgtgtgtgaagtgaacctctacctgaccatgaagaggcaagagcacagacttacaaggatttcaacttaagcttgacttggggtttgtagcgggacccagtcaaaccccattcaggtcatggtagaatctactccttggtagtcacttgtcatttttaaagaaatgatgacaatcctcttggcatcaccccaccccacattctccccgatgttcctctcctgaattctggattttgtcctacaagtctgtgccatttataagctaagttgagggttcagagggagacaaatatccccaagtgaaatatgttgcggtagagatggaatgtataaaatccgccagtagtgtgaatgnttttcaatttttcccactttgaaaacttacacctaaaggcctgtaggcctctaactctttctgccctttcattcaaacctctccaaagttctttgtctt

SEQ ID NO: 314863 - DNA, 1145 bp, Homo sapiens
  misc_feature (1)..(1): n is a, c, g, or t
ncccaggtaactaacaaaaccagagtcatctggggaagagtactcgggcccatggaaacagtggcatggttcgtgccaaattccgaagcaatcttcctgctaaggccattggacacagaatccgagtgatgctgtacccctcaaggatttaaactaacgaaaaatcaataaataaatgtggatttgtgctcttgtatttttaagtggattaaaaaacttactacctgggttaggtctacctggccaggtagacctaagcactcgcttgtgtggaaaagcctctaaatgcatcccttcctttctttcctgcttcctttgccttacaattgaagcagcccgtggtaccatcacagtatgcagagacttcctcacctttcatatctagggaccacccccgatgcattggtgagggtgggcacttataaatgcctgctattgttaagccattccagcctcttcctctgaatagaccagacgccctttcacttagttcagtgccagtccttttgccttcccaaccctgctgttaggcctgctgttccctttgctcttgattaggagagatggaaggagatgagctcccataactgaattggcctttggttcatgttttctccccatatgtatatatgccatatgtgaatatgccatatatatgtgccaacaaatctatctacgttgttcttttcaaattagcacgcagataggaattttgagtttcttcttcttttagtaactagtataacaagcactggtatttttgtacaaaaaagaaaaacaaaagattgactattgtggtctgcatgacataaacaaacaaatggtgatatcaaagcaacgtataccccagtccagtgtgtgttgccataatttgcaattcagcttaacagtgcacccaatctatatttgcattttgatattatttaagctctatgtacaaggttttgcatgtatttatatggttcttagggaaaaaaaatgctataaactgcaaatctgaaattcaaatgtgttgttccactgagaccagaagaagaagaggagttttaaaagggataatttgttggagccaataaagctttttgctgatgaacagaaaccaatactgctgtgcactgagaataaaaactcatgcccacttgtaa

SEQ ID NO: 314864 - DNA, 5267 bp, Homo sapiens
tggtgagcaagagtctggcccgagttagctagagctgttgccatgacaagcattttcttaagaaagctctgctgttgagatcgtccaaagctgggggctgggagggggggcacgaacttcgtggggcaccatccctccgaagagagcaagatcagagacacccgcccagctctcctgcaccctttttctttcaggaacctgagaggtccttcccattggaggggcagggggaggagacccagcccactccccggccttagccagaaaggcaagagagcaaagccagcgtctctagcttggttgccacactggggagactggtgggtggtcaccccaccctaccctcatccatggaaacccggagggagagtcccgcctgaagaaacctggatctttgctagaaagagagagatccagttgtcatcggtatccaggaagctctcctcttcctcctcctgacgtctaccactacagttgctggttgttgctaaggttgctgccatggtaacatgcacatcctgtttacaccttcatctgggcaagttggtctaagctaggaacctacctaccctggacaaccactatcatcaccacctggggacaccaatcatcgtgacacggagtccaccttccactcagttcccccatcctcttcctcctctcgctgccagacttcatagagaagaaaggatctagacttcggacggctactcgggagcttattgcacaagatatattcaatctattccctcactgggcccccagagaagcaagaagtaggaagaagttgagacagggaggcaggagacactggtcagttgaagggaaacgctacatcttctctggttgaggggcttggtaacagcaggcaaaatgacgaacccatcagaccgtgtcttgcctgccaactcgatggccgagagccgtgaaggggactttggctgcacagtaatggaactgaggaagctcatggagctgcgttcgagggatgcactgacccagattaatgtccactatggaggtgtacagaatctctgcagtagactgaaaacctcccctgtggaaggtctgtctgggaaccctgcagatctggagaaacgtaggcaggtgtttggacacaacgtgatccccccccaaaaagcccaagactttcttagaattagtgtgggaagctcttcaagatgtcacgctcatcatcctggagattgcagccatcatctccctggtcctgtccttttatcgccctgctggtgaagaaaatgaactgtgtggtcaagtcgcaactaccccagaagatgaaaatgaggcacaagctggctggattgagggggcagccatccttttctcagtgatcatcgtggtgttagtgactgcctttaatgattggagcaaagagaagcaattccgggggctgcagtgccgcattgaacaggagcaaaagttctccatcatccgaaacggtcaactcatccagctccctgtggctgagattgtggttggtgatattgcccaagtcaaatacggtgatctgctgcctgcagatggaatcctgatccaagggaatgatctgaagattgatgagagctctctgacaggggaatctgaccatgtcaagaagtccctggacaaagaccccatgttgctctcagggacccatgtcatggaaggttctggccggatggtggtgacagctgttggtgtcaactctcagactggaatcatccttactctcttgggggtcaatgaggatgacgaaggggagaaaaagaagaaaggtaaaaaacaaggagtccctgaaaatcgcaacaaagcaaagacccaagacggagtggccctggaaatccagccactcaacagccaggagggaatcgacaatgaggaaaaggacaagaaggcagtcaaggtgcctaaaaaggagaagtcagtgctgcagggcaagctgactcgcctggctgttcagattgggaaagccggtctgctcatgtctgctctcacggttttcatcctgattctatactttgtgattgacaactttgtgataaatcgcagaccatggctccctgagtgtactcccatctacatccagtactttgtcaagttcttcatcatcggcatcactgtactggtggtggctgtgccagaggggctgcctctggctgtcaccatctcactggcctactctgtgaagaaaatgatgaaagacaataacctagtacggcacttggatgcttgtgagaccatgggcaacgccaccgccatctgctctgataagacaggcacgttgaccatgaaccgcatgactgtggtacaagcttatattgggggcatccattaccgtcaaatcccaagccctgatgtcttcctgcccaaagtcctggacctcattgtcaatggcatttctatcaacagtgcttatacctccaagattctgcctccagagaaggagggaggcctgcctcggcaggtgggcaacaagaccgagtgtgctctgctaggctttgtcacagatctgaagcaggattatcaggctgtgcgtaatgaagtgcccgaggagaagctctacaaggtgtacacctttaactcagtgcgcaagtcaatgagcaccgtcatcaggaatcccaacggtggcttccgtatgtacagcaagggcgcctctgagatcatcttgcgcaagtgtaatcgaatcctggaccggaaaggggaagcagtgccattcaagaataaagacagagatgatatggtacgcactgtcatcgagcccatggcctgtgatggactccggactatctgcatagcttaccgggacttcgatgacacagagccctcttgggacaatgagaatgagatcctcaccgaactgacctgtatcgcggtggtgggcattgaggaccctgtgcgcccagaggtgccagatgctattgccaaatgcaaacaagctggcattactgtcagaatggtgacaggtgacaacatcaacacagcccgggccattgccaccaaatgtggcattctgacacctggggatgacttcctgtgcttagaaggcaaagaattcaaccggctcatccgcaacgagaaaggcgaggtagagcaagaaaagctggacaagatctggcctaagcttcgggtcctggcgcgatcttctcccactgacaagcacaccctggtgaaaggcataattgacagcactgttggggaacaccggcaggtcgtggctgtcactggtgatggcacaaatgacgggcctgctctgaagaaagcggatgttggttttgccatgggcatcgcaggcacagatgtagcaaaggaggcttcagacatcatcctaacagatgacaacttcaccagcattgtgaaggcagtgatgtggggacgaaatgtctatgacagcatctccaagttcctgcagttccagctcactgtcaatgtggtggccgtgattgtagccttcactggagcctgtatcactcaggattccccattgaaagctgtgcagatgttgtgggttaatctgatcatggacacttttgcttcattggccctggccacagagccccctacggaatctctgttgaagcggcgcccctatggccgaaataagcctctgatctcacgcactatgatgaagaacatcttgggccatgcattctatcagctcattgtcatctttatccttgtctttgcgggtgagaaattctttgatattgatagtgggaggaaggcacctctacattcaccacccagccagcactataccattgtttttaacaccttcgtgctgatgcagctcttcaatgaaatcaactcccgaaagatccatggagagaagaacgtcttttcaggcatctaccgcaacattatcttctgctctgtagtcttgggcacattcatctgccagattttcatcgtggaatttgggggtaaacccttcagttgtacaagcctcagcctgtctcagtggctgtggtgtctcttcattgggattggagaacttctgtggggccagttcatctccgcaatacctacccgatccctgaagttcctgaaggaggctgggcatggcaccaccaaagaggagatcaccaaggatgccgagggactggatgagattgaccatgctgagatggagctgcgccgaggccagatcctctggttccggggcctgaaccgtatccagactcagatcgacgtaattaacacattccagacgggagcctcttttaagggagtcctaaggcgacagaacatgggtcaacaccttgatgtaaaacttgttcctagttcatcctatgtagcagttgcaccagtcaaatcttcccccaccacttctgttcctgctgtttcatctcctcctatgggcagtgagtgatagtctattatgatgcatgatttgctaaaatgaccacaagagagcacgtggcatccactttaaccaaccatggttatcttttccttttggtttttccctttgatattttgacttaagggaagaaaaagacaaaaatcctactctaaaaccagactgtgtgcccttgtattttatttttgtaatgtagaaaagctattaaaccttaactgttttaaagacaataattctgttttctgattgttcctctgcattgctcatttcttccttttcttgagttttgttttgttttgctttgccttttttgtttgtctgtttgttgctttgctgggatatgttgttgttcctctcttctcctcctgctcctttgagtctgaactctacctcctaagcttagatgtgaggttaggccagaggaaaacccaagagctttctttacatgggggcaaagtttgggatcttttgaggaaaggtaggaagggagctaatgtgcccatgggtgtgttttgactagtggacctgtcataattgagccagtattaaacttggtcaataataatagtccatttggccaccactgtattgctgactggcaattttagcataaaagttgtagctggctgggcacgatggctcacgcctgtaatcccaacactttgggaggccaaagcagatcacgaggtcaggagatcaagaccatcctggctaacatggtgaaaccccgtctctactaaaaatacaaaaaattagctgggcgtggtggcgggcacctgtagtcctatagctactcgggaggctaagacaggagaatcacttgaactcaggaggcggaggttacagtgagccaagtggagagccactgcactccaccctgggcgatagagcaagactctgtctcaaa

SEQ ID NO: 314865 - DNA, 4837 bp, Homo sapiens
tggtgagcaagagtctggcccgagttagctagagctgttgccatgacaagcattttcttaagaaagctctgctgttgagatcgtccaaagctgggggctgggagggggggcacgaacttcgtggggcaccatccctccgaagagagcaagatcagagacacccgcccagctctcctgcaccctttttctttcaggaacctgagaggtccttcccattggaggggcagggggaggagacccagcccactccccggccttagccagaaaggcaagagagcaaagccagcgtctctagcttggttgccacactggggagactggtgggtggtcaccccaccctaccctcatccatggaaacccggagggagagtcccgcctgaagaaacctggatctttgctagaaagagagagatccagttgtcatcggtatccaggaagctctcctcttcctcctcctgacgtctaccactacagttgctggttgttgctaaggttgctgccatggtaacatgcacatcctgtttacaccttcatctgggcaagttggtctaagctaggaacctacctaccctggacaaccactatcatcaccacctggggacaccaatcatcgtgacacggagtccaccttccactcagttcccccatcctcttcctcctctcgctgccagacttcatagagaagaaaggatctagacttcggacggctactcgggagcttattgcacaagatatattcaatctattccctcactgggcccccagagaagcaagaagtaggaagaagttgagacagggaggcaggagacactggtcagttgaagggaaacgctacatcttctctggttgaggggcttggtaacagcaggcaaaatgacgaacccatcagaccgtgtcttgcctgccaactcgatggccgagagccgtgaaggggactttggctgcacagtaatggaactgaggaagctcatggagctgcgttcgagggatgcactgacccagattaatgtccactatggaggtgtacagaatctctgcagtagactgaaaacctcccctgtggaaggtctgtctgggaaccctgcagatctggagaaacgtaggcaggtgtttggacacaacgtgatccccccccaaaaagcccaagactttcttagaattagtgtgggaagctcttcaagatgtcacgctcatcatcctggagattgcagccatcatctccctggtcctgtccttttatcgccctgctggtgaagaaaatgaactgtgtggtcaagtcgcaactaccccagaagatgaaaatgaggcacaagctggctggattgagggggcagccatccttttctcagtgatcatcgtggtgttagtgactgcctttaatgattggagcaaagagaagcaattccgggggctgcagtgccgcattgaacaggagcaaaagttctccatcatccgaaacggtcaactcatccagctccctgtggctgagattgtggttggtgatattgcccaagtcaaatacggtgatctgctgcctgcagatggaatcctgatccaagggaatgatctgaagattgatgagagctctctgacaggggaatctgaccatgtcaagaagtccctggacaaagaccccatgttgctctcagggacccatgtcatggaaggttctggccggatggtggtgacagctgttggtgtcaactctcagactggaatcatccttactctcttgggggtcaatgaggatgacgaaggggagaaaaagaagaaaggtaaaaaacaaggagtccctgaaaatcgcaacaaagcaaagacccaagacggagtggccctggaaatccagccactcaacagccaggagggaatcgacaatgaggaaaaggacaagaaggcagtcaaggtgcctaaaaaggagaagtcagtgctgcagggcaagctgactcgcctggctgttcagattgggaaagccggtctgctcatgtctgctctcacggttttcatcctgattctatactttgtgattgacaactttgtgataaatcgcagaccatggctccctgagtgtactcccatctacatccagtactttgtcaagttcttcatcatcggcatcactgtactggtggtggctgtgccagaggggctgcctctggctgtcaccatctcactggcctactctgtgaagaaaatgatgaaagacaataacctagtacggcacttggatgcttgtgagaccatgggcaacgccaccgccatctgctctgataagacaggcacgttgaccatgaaccgcatgactgtggtacaagcttatattgggggcatccattaccgtcaaatcccaagccctgatgtcttcctgcccaaagtcctggacctcattgtcaatggcatttctatcaacagtgcttatacctccaagattctgcctccagagaaggagggaggcctgcctcggcaggtgggcaacaagaccgagtgtgctctgctaggctttgtcacagatctgaagcaggattatcaggctgtgcgtaatgaagtgcccgaggagaagctctacaaggtgtacacctttaactcagtgcgcaagtcaatgagcaccgtcatcaggaatcccaacggtggcttccgtatgtacagcaagggcgcctctgagatcatcttgcgcaagtgtaatcgaatcctggaccggaaaggggaagcagtgccattcaagaataaagacagagatgatatggtacgcactgtcatcgagcccatggcctgtgatggactccggactatctgcatagcttaccgggacttcgatgacacagagccctcttgggacaatgagaatgagatcctcaccgaactgacctgtatcgcggtggtgggcattgaggaccctgtgcgcccagaggtgccagatgctattgccaaatgcaaacaagctggcattactgtcagaatggtgacaggtgacaacatcaacacagcccgggccattgccaccaaatgtggcattctgacacctggggatgacttcctgtgcttagaaggcaaagaattcaaccggctcatccgcaacgagaaaggcgaggtagagcaagaaaagctggacaagatctggcctaagcttcgggtcctggcgcgatcttctcccactgacaagcacaccctggtgaaaggcataattgacagcactgttggggaacaccggcaggtcgtggctgtcactggtgatggcacaaatgacgggcctgctctgaagaaagcggatgttggttttgccatgggcatcgcaggcacagatgtagcaaaggaggcttcagacatcatcctaacagatgacaacttcaccagcattgtgaaggcagtgatgtggggacgaaatgtctatgacagcatctccaagttcctgcagttccagctcactgtcaatgtggtggccgtgattgtagccttcactggagcctgtatcactcaggattccccattgaaagctgtgcagatgttgtgggttaatctgatcatggacacttttgcttcattggccctggccacagagccccctacggaatctctgttgaagcggcgcccctatggccgaaataagcctctgatctcacgcactatgatgaagaacatcttgggccatgcattctatcagctcattgtcatctttatccttgtctttgcgggtgagaaattctttgatattgatagtgggaggaaggcacctctacattcaccacccagccagcactataccattgtttttaacaccttcgtgctgatgcagctcttcaatgaaatcaactcccgaaagatccatggagagaagaacgtcttttcaggcatctaccgcaacattatcttctgctctgtagtcttgggcacattcatctgccagattttcatcgtggaatttgggggtaaacccttcagttgtacaagcctcagcctgtctcagtggctgtggtgtctcttcattgggattggagaacttctgtggggccagttcatctccgcaatacctacccgatccctgaagttcctgaaggaggctgggcatggcaccaccaaagaggagatcaccaaggatgccgagggactggatgagattgaccatgctgagatggagctgcgccgaggccagatcctctggttccggggcctgaaccgtatccagactcagcatcttttgcaggattcagacttgcttcctgacaaggaggaagcaataatttcttcaagcctcttcccttcttgcaatttctgaaatgggatagaagccacccctgctgctcttatgtcccctgtctatagccccacaataacttttattttttccactttccatgcatcaattgtaactactttctcctgggtgaatgcgctgatctaagcattgataattctgtcttcccctgctctcaccccccatagctttattgttttaatcctgagattttccatttcaaaaacactgtaaattccaagatctcaagggtggtctccagaaaacaggcgtatttctctctgctgattggctagagatcttcaaaataagtttcactgtctaaaactggccttgcaaatgttttagaaagttccccagtcggccaggcatggtggctcacgcctgtaatcccagcactttgggaggccaaggtgggtggatcacctgaggtcgggagttcaagaccagcctgaccaacatggagaaaccgcgtctctactaaaaatccaaaattagccgggcgtagtggcacatgcctgtaatcccagctactcgggaggctgaggcagaagaattacttgaacccgggaggcagaggttgtagtgagc

SEQ ID NO: 314866 - DNA, 1949 bp, Homo sapiens
  misc_feature (1779)..(1779): n is a, c, g, or t
  misc_feature (1784)..(1784): n is a, c, g, or t
tggtgagcaagagtctggcccgagttagctagagctgttgccatgacaagcattttcttaagaaagctctgctgttgagatcgtccaaagctgggggctgggagggggggcacgaacttcgtggggcaccatccctccgaagagagcaagatcagagacacccgcccagctctcctgcaccctttttctttcaggaacctgagaggtccttcccattggaggggcagggggaggagacccagcccactccccggccttagccagaaaggcaagagagcaaagccagcgtctctagcttggttgccacactggggagactggtgggtggtcaccccaccctaccctcatccatggaaacccggagggagagtcccgcctgaagaaacctggatctttgctagaaagagagagatccagttgtcatcggtatccaggaagctctcctcttcctcctcctgacgtctaccactacagttgctggttgttgctaaggttgctgccatggtaacatgcacatcctgtttacaccttcatctgggcaagttggtctaagctaggaacctacctaccctggacaaccactatcatcaccacctggggacaccaatcatcgtgacacggagtccaccttccactcagttcccccatcctcttcctcctctcgctgccagacttcatagagaagaaaggatctagacttcggacggctactcgggagcttattgcacaagatatattcaatctattccctcactgggcccccagagaagcaagaagtaggaagaagttgagacagggaggcaggagacactggtcagttgaagggaaacgctacatcttctctggttgaggggcttggtaacagcaggcaaaatgacgaacccatcagaccgtgtcttgcctgccaactcgatggccgagagccgtgaaggggactttggctgcacagtaatggaactgaggaagctcatggagctgcgttcgagggatgcactgacccagattaatgtccactatggaggtgtacagaatctctgcagtagactgaaaacctcccctgtggaaggtctgtctgggaaccctgcagatctggagaaacgtaggcaggtgtttggacacaacgtgatccccccccaaaaagcccaagactttcttagaattagtgtgggaagctcttcaagatgtcacgctcatcatcctggagattgcagccatcatctccctggtcctgtccttttatcgccctgctggtgaagaaaatgaactgtgtggtcaagtcgcaactaccccagaagatgaaaatgaggcacaagctggctggattgagggggcagccatccttttctcagtgatcatcgtggtgttagtgactgcctttaatgattggagcaaagagaagcaattccgggggctgcagtgccgcattgaacaggagcaaaagttctccatcatccgaaacggtcaactcatccagctccctgtggctgagattgtggttggtgatattgcccaagtcaaatacggtgatctgctgcctgcagatggaatcctgatccaagggaatgatctgaagattgatgagagctctctgacaggggaatctgaccatgtcaagaagtccctggacaaagaccccatgttgctctcagggacccatgtcatggaaggttctggccggatggtggtgacagctgttggtgtcaactctcagactggaatcatccttactctcttgggggtcaatgaggatgacgaaggggagaaaaagaagaatttagnggggnacaggcctgttcccccctaatatccatcatgcaaccttatttatctgtcttgggattccagtttagtgcttggatttatttcctgattacactacatagttaagtgagacatctgccattgccttactctgggaaaaccaacctgagtatcttaccatatagatg

SEQ ID NO: 314867 - DNA, 314 bp, Homo sapiens
cagtgatcatcgtggtgttagtgactgcctttaatgattggagcaaagagaagcaattccgggggctgcagtgccgcattgaacaggagcaaaagttctccatcatccgaaacggtcaactcatccagctccctgtggctgagattgtggttggtgatattgcccaagtcaaatacggtgagagctccgtgtttcttttgcttaccccaccaccacccccatttaagggataggtcctttggcatgagggggctgggaattgctgaaaacccaaaaagataagatccaaaattgtattcacttctaggttagag

SEQ ID NO: 314868 - DNA, 944 bp, Homo sapiens
cagtcataaaaatgtagcctatcttttgaatatggaaagccagtattacacgtatgacagtgataagtttatgaagggaaagtaatttagatgacttgagaaattatgaccgtgtgacatagcctttgtgtgatacatattctttccatttctggattctgtcatgtagtttgcaaaacaagactagaaagtttctatgtcgttgcttattttcaccgacaaattcaacacaacagtatggttgaaggatagtctcatccgagactgtcaaccgtgtgttgtgctgtattcctgacactgtttagcacttcacacatattattttatttaatccttacagcagcgttgtgaaatgggtctgtctcccattttacaaatgagaaaagagaagtcactttgtgtcacttcagggacacatgagcttaggtagcttttccccacttaacttagtctgtaggtagcaaagctggaacttgaatcctcatcttattgattgcagaatctttctctgcactgctctttctgctacattttattttaagaatatttgggaaattaacagcattttgtctttgttactacaggggaaaacaaactatcctagtaattgtatgttttatgttcccagggaagcaaaggtgtctaccagtaccactggcaaagccacaatgtcaagcacagtggtgtggacgacatggtgctactgtccaagatcacagagaactccatcgtggagaatctgaagaagagatacatggatgactacatttttgtatcctttattggctgctttggacatttctaagtgatattacagtgtccacagttaaattgtggctttatgctgggtgcagtggctcacgtgtgtaatcccagcactttggaaggctaaggcaggagttccagaccatcctggcaacacagggagaccccatctctattat

SEQ ID NO: 314869 - DNA, 659 bp, Homo sapiens
cagatgtacctccctcaccacctggtgtctcacggtaccgggccccagatgctcctttttctggctcattgtcatgcagcgacagtgccaccccatggatgcggtgcgcatcctcagggccctgctcctggtgtagattgtccgttctcgcctcatgtttatgcttttccagcagcagaactccgtggcgggatctctgagcaccgttttctcactgcgtccttcgacctgttaaccccactgtgctttttgcaggcttgaactgaagttgaaaaaggaaaactggggcccctggagtgcaggggggctcccggcaagtgcagttccaccaagggtttggggacctggctgtcctcaagcccagtaacaaagtgctgcaggtcagcatcggacctggactgcccaagaactcccgtaagtgctccacgggccctgcaggcagaactgccgccgctcccccgagtctcccgagcaaatgctgcaaacatgtgcacagatgtgggggctgagaatcagtacaccttctgcttgctggggctcacgctttcttcagaatggaacatttcaaactaaagcaacagcaaggaaaatgagcaggttaaaagtttctgagggacttagtacttatgtatcagtacacctggcattacaatattgtg

SEQ ID NO: 314870 - DNA, 258 bp, Homo sapiens
ggcggcagaggatcccaggatgcgtagatcagaagagcaaacgctggtgttgcagatagtggcgggtattctccacctgggaaacatcagcttcaaagaagttggcaactacgcggctgtggagagtgaagagtgtgcgtagccctggcatgtggccattgaatgaggggtggctagctctgattagaagtaacctagcactttcctttgcttagatctcaaatgggaatattgggaagaagtgataaatctacatgt

SEQ ID NO: 314871 - DNA, 4741 bp, Homo sapiens
cgagactcagccagaggagtacggattaaggggccgaagaaagaggagtgaggcaggggagcgaggcggacgctccgagcgcatcggactcacctgggccggcggcgagcggcgagtacgagtggactcttgccctccgcagcatgcgccccgcctgctaagtcgccgccgtctcgccctcacctagcaccgccaatcccgcctggatggagtcccctctgggttcccattggctcctgtgagtgcttgggtgtcgggagcctgtttttggcgaggggaaccaacttttgaagttcgcccagaagactgcgttccagccccagttccccggcagcgggacccggcgaagacgcgaccgcggcgcgagtcaccatgggaagcaaaggtgtctaccagtaccactggcaaagccacaatgtcaagcacagtggtgtggacgacatggtgctactgtccaagatcacagagaactccatcgtggagaatctgaagaagagatacatggatgactacatttttacatatataggatctgtattaatctcagtcaaccctttcaagcagatgccatattttggggaaaaggaaattgaaatgtaccaaggagcggcacagtatgaaaacccaccacatatctatgcccttgcagataatatgtacagaaacatgatcattgacagagagaaccagtgcgtcattatcagtggtgaaagtggtgctggaaaaacagtggctgccaaatatatcatgagctacatctccagagtgtctggaggagggaccaaagtccagcacgtgaaggacattatcctgcagtccaacccgctgctggaggccttcgggaacgccaagaccgtccggaacaacaactccagccgatttggaaaatactttgaaatccagttcagtccaggtggggaaccagatggtggaaagatctccaacttccttctggaaaaatctagggtggtgatgaggaacccaggagagcggagttttcacatattttaccagctcatcgagggcgcctctgcagagcagaaacacagccttggcatcaccagcatggactattattactacctgagcctctcgggctcatacaaggttgatgacattgacgacaggcgggagtttcaggaaactctgcacgccatgaatgtgattgggatctttgcagaagagcaaacgctggtgttgcagatagtggcgggtattctccacctgggaaacatcagcttcaaagaagttggcaactacgcggctgtggagagtgaagagtttttagcttttcctgcatatctgctagggataaaccaggaccggttgaaagaaaagctaacaagccggcagatggatagcaagtggggaggcaaatccgaatccatccacgtgaccctcaacgtagagcaggcctgttacacccgggatgcgctcgccaaggccctgcacgcccgggtctttgatttcttggtagattccatcaataaagccatggagaaagaccatgaagaatacaacattggcgtcctagacatctatggctttgaaatattccagaaaaatggctttgaacagttttgtatcaattttgttaatgaaaaactgcagcagatttttattgaactgacattaaaggcagaacaggaagaatatgttcaagagggaataagatggacacccattgagtactttaataataaaatcgtatgtgacctcatagagaacaaagtgaaccctcctggcatcatgagcatcctggatgacgtgtgcgccacgatgcatgcggtgggtgagggggcagatcagacgctgctccagaaacttcagatgcagattgggagtcatgagcacttcaacagttggaaccaaggcttcatcattcatcattatgctgggaaggtatcctatgacatggatggcttttgtgaaaggaaccgggatgtgctttttatggatctcatcgagcttatgcagagcagcgagctgcctttcataaagtctttatttccggaaaatctgcaggctgacaagaaagggcgcccaactactgccggaagcaaaataaagaaacaagccaatgaccttgtgagcaccctgatgaaatgtacgccccactacattcgctgcatcaagccaaacgaaaccaagaagcccagagactgggaggaaagcagggtaaagcatcaagtcgaatatttgggtctgaaagagaacattcgagtgagaagagctggctatgcctatcggcgcatcttccaaaaattcctacagaggtatgccattctgaccaaagccacctggccttcttggcagggagaggagaagcaaggcgtcctgcacctgctgcagtcggtcaacatggacagcgaccagttccagctggggaggagtaaagtgttcatcaaagcccccgagtctctatttcttttagaagagatgagagagagaaagtatgatgggtatgctcgagtgatacagaaatcatggaggaaattcgtggcccggaagaaatacgttcaaatgagagaagaagcctcagacctcttattgaacaagaaggagagaaggagaaacagtattaacaggaactttataggggattatattgggatggaagagcacccagaactccagcagttcgtgggcaagagggagaagattgatttcgcagacacagtcaccaagtatgacaggaggttcaagggtgtaaagcgagacctgctccttaccccaaagtgcttgtacttaatcggacgagaaaaagtcaaacagggcccagacaagggcctggtgaaagaagtcctgaagcggaaaatcgagatagaacggatcttgtctgtgtccctcagtactatgcaggatgacatttttattctccatgagcaagagtatgacagtttgcttgaatctgtcttcaaaactgaattcctaagcctcttagcaaagcgttacgaggagaagacccagaagcaactacctctgaaattcagcaatacgcttgaactgaagttgaaaaaggaaaactggggcccctggagtgcaggggggctcccggcaagtgcagttccaccaagggtttggggacctggctgtcctcaagcccagtaacaaagtgctgcaggtcagcatcggacctggactgcccaagaactcccgtcctaccagaaggaacactacccaaaatacaggttattccagtgggactcaaaatgccaactacccagtgagagctgcccctcctcccccaggataccatcagaacggagtcatcagaaaccagtatgtgccatatccccatgctcctggaagccagaggtccaatcagaaaagcctgtacacctccatggcccgcccgcccttgcctcggcagcagtctaccagttcagaccgagtgtcacagacgccagagagcctggatttcctcaaggtcccggaccagggagctgcaggggtcaggagacaaacaaccagtcggcctcccccagcagggggcagacccaagccccagcccaagcccaagcctcaggtgccacagtgcaaggctttgtatgcctatgacgctcaggacacagacgaactcagctttaatgccaatgacattattgatattatcaaagaagatccttctggctggtggacgggtcgactacgaggcaagcagggcctgttccccaacaactatgtgaccaagatctgaggtgcccgtgactctgacacatggggcagaggagctccaggcacagaccaggggaggggatatttaggggctccccttacaatccacaatgagcaattgcttctccaaggcctggagctattctggtaccttccccatggaggacactgaaaaggctgggttggggacagggagtatcactccataagtgatcctaaaaggtagcctcttcataggaacccaggaggacaaaaccaccatgcattaagatttatttattgtatttaaacctggtgagaggacaagtgaggtctgctcagaccttgtaggcttctatcaaaacagcaccctgcttgctcaccaggcctagagaatggctgtaggtggccgctgacaagtgcctttagttgaagagcacatttctttcatctctcttgtccatacctgatagacacattcctctctgccaccttccttcagggaggacccgccctctgcagactgggcttagcgtgagcaggcacttcccatgtacgtgccaagggtaagctggcctgctgagcccagggcgacagaggggcactggtttacactttgccgggaccatcagggccgccaagcaggtcaggggctgggggctgggggctgggctgctggctttgctttctctgggtcttcaattagaatgtggctggcccatattggtttgtgtttaaatgctgtacttactacaagaaggatcttttttcaagctgtacatttataaaaacagatcatatactgtatatataaaaatcttgagatggtagaaacatgtatgaatgtactaagtagtattccactgtactcattcataaggtaggttttcttacaaaactcacaccaggtacttaaagatgtgctctgcttttttccaactacggagtgtcactgctttctagctcagtccctgcagactcttctcaactctttccctataggaaacttactccgcgtcctgcccccacctcctaaataaataaaggaatcggcgaacaccttcttcttttatgacatttgtta

SEQ ID NO: 314872 - DNA, 4589 bp, Homo sapiens
tttaggagctcatatgcaactgaattcatatttattgagtaaccaagggattggtggggaggtggtacctttgtctgttgtcctgagggcagccctttattctttgtgtgcagtgatcaatttgtctaggacaaggcggcagtaaccacattccctttacaactaagggaacaagtaccctcctccatggaaggagcttatttgcctgtttgtttttccctggggatagatgtagacatgaaataaacatcttcctcttctgaagtgaagatggttctagcagtgctgtgtttctttaaaattgggtttaccataagaatcattattacttcattcattaattgtttgtttgttttcttttttgggagccagggtctggctctgttgcccaggctggagtgcagtggcatgatcatggctcactgcaacctcgacctgcgtggcttaagcaatcctcccacctcagcaggaactacaggcacgcacagtatgaaaacccaccacatatctatgcccttgcagataatatgtacagaaacatgatcattgacagagagaaccagtgcgtcattatcagtggtgaaagtggtgctggaaaaacagtggctgccaaatatatcatgagctacatctccagagtgtctggaggagggaccaaagtccagcacgtgaaggacattatcctgcagtccaacccgctgctggaggccttcgggaacgccaagaccgtccggaacaacaactccagccgatttggaaaatactttgaaatccagttcagtccaggtggggaaccagatggtggaaagatctccaacttccttctggaaaaatctagggtggtgatgaggaacccaggagagcggagttttcacatattttaccagctcatcgagggcgcctctgcagagcagaaacacagccttggcatcaccagcatggactattattactacctgagcctctcgggctcatacaaggttgatgacattgacgacaggcgggagtttcaggaaactctgcacgccatgaatgtgattgggatctttgcagaagagcaaacgctggtgttgcagatagtggcgggtattctccacctgggaaacatcagcttcaaagaagttggcaactacgcggctgtggagagtgaagagtttttagcttttcctgcatatctgctagggataaaccaggaccggttgaaagaaaagctaacaagccggcagatggatagcaagtggggaggcaaatccgaatccatccacgtgaccctcaacgtagagcaggcctgttacacccgggatgcgctcgccaaggccctgcacgcccgggtctttgatttcttggtagattccatcaataaagccatggagaaagaccatgaagaatacaacattggcgtcctagacatctatggctttgaaatattccagaaaaatggctttgaacagttttgtatcaattttgttaatgaaaaactgcagcagatttttattgaactgacattaaaggcagaacaggaagaatatgttcaagagggaataagatggacacccattgagtactttaataataaaatcgtatgtgacctcatagagaacaaagtgaaccctcctggcatcatgagcatcctggatgacgtgtgcgccacgatgcatgcggtgggtgagggggcagatcagacgctgctccagaaacttcagatgcagattgggagtcatgagcacttcaacagttggaaccaaggcttcatcattcatcattatgctgggaaggtatcctatgacatggatggcttttgtgaaaggaaccgggatgtgctttttatggatctcatcgagcttatgcagagcagcgagctgcctttcataaagtctttatttccggaaaatctgcaggctgacaagaaagggcgcccaactactgccggaagcaaaataaagaaacaagccaatgaccttgtgagcaccctgatgaaatgtacgccccactacattcgctgcatcaagccaaacgaaaccaagaagcccagagactgggaggaaagcagggtaaagcatcaagtcgaatatttgggtctgaaagagaacattcgagtgagaagagctggctatgcctatcggcgcatcttccaaaaattcctacagaggtatgccattctgaccaaagccacctggccttcttggcagggagaggagaagcaaggcgtcctgcacctgctgcagtcggtcaacatggacagcgaccagttccagctggggaggagtaaagtgttcatcaaagcccccgagtctctatttcttttagaagagatgagagagagaaagtatgatgggtatgctcgagtgatacagaaatcatggaggaaattcgtggcccggaagaaatacgttcaaatgagagaagaagcctcagacctcttattgaacaagaaggagagaaggagaaacagtattaacaggaactttataggggattatattgggatggaagagcacccagaactccagcagttcgtgggcaagagggagaagattgatttcgcagacacagtcaccaagtatgacaggaggttcaagggtgtaaagcgagacctgctccttaccccaaagtgcttgtacttaatcggacgagaaaaagtcaaacagggcccagacaagggcctggtgaaagaagtcctgaagcggaaaatcgagatagaacggatcttgtctgtgtccctcagtactatgcaggatgacatttttattctccatgagcaagagtatgacagtttgcttgaatctgtcttcaaaactgaattcctaagcctcttagcaaagcgttacgaggagaagacccagaagcaactacctctgaaattcagcaatacgcttgaactgaagttgaaaaaggaaaactggggcccctggagtgcaggggggctcccggcaagtgcagttccaccaagggtttggggacctggctgtcctcaagcccagtaacaaagtgctgcaggtcagcatcggacctggactgcccaagaactcccgtcctaccagaaggaacactacccaaaatacaggttattccagtgggactcaaaatgccaactacccagtgagagctgcccctcctcccccaggataccatcagaacggagtcatcagaaaccagtatgtgccatatccccatgctcctggaagccagaggtccaatcagaaaagcctgtacacctccatggcccgcccgcccttgcctcggcagcagtctaccagttcagaccgagtgtcacagacgccagagagcctggatttcctcaaggtcccggaccagggagctgcaggggtcaggagacaaacaaccagtcggcctcccccagcagggggcagacccaagccccagcccaagcccaagcctcaggtgccacagtgcaaggctttgtatgcctatgacgctcaggacacagacgaactcagctttaatgccaatgacattattgatattatcaaagaagatccttctggctggtggacgggtcgactacgaggcaagcagggcctgttccccaacaactatgtgaccaagatctgaggtgcccgtgactctgacacatggggcagaggagctccaggcacagaccaggggaggggatatttaggggctccccttacaatccacaatgagcaattgcttctccaaggcctggagctattctggtaccttccccatggaggacactgaaaaggctgggttggggacagggagtatcactccataagtgatcctaaaaggtagcctcttcataggaacccaggaggacaaaaccaccatgcattaagatttatttattgtatttaaacctggtgagaggacaagtgaggtctgctcagaccttgtaggcttctatcaaaacagcaccctgcttgctcaccaggcctagagaatggctgtaggtggccgctgacaagtgcctttagttgaagagcacatttctttcatctctcttgtccatacctgatagacacattcctctctgccaccttccttcagggaggacccgccctctgcagactgggcttagcgtgagcaggcacttcccatgtacgtgccaagggtaagctggcctgctgagcccagggcgacagaggggcactggtttacactttgccgggaccatcagggccgccaagcaggtcaggggctgggggctgggggctgggctgctggctttgctttctctgggtcttcaattagaatgtggctggcccatattggtttgtgtttaaatgctgtacttactacaagaaggatcttttttcaagctgtacatttataaaaacagatcatatactgtatatataaaaatcttgagatggtagaaacatgtatgaatgtactaagtagtattccactgtactcattcataaggtaggttttcttacaaaactcacaccaggtacttaaagatgtgctctgcttttttccaactacggagtgtcactgctttctagctcagtccctgcagactcttctcaactctttccctataggaaacttactccgcgtcctgcccccacctcctaaataaataaaggaatcggcgaaca

SEQ ID NO: 314873 - DNA, 3284 bp, Homo sapiens
gaggatcctttgcggctgcttcccccgggtcttgatttctggtagattccatcaataaagccatggagaaagaccatgaagaatacaacattggcgtcctagacatctatggctttgaaatattccagaaaaatggctttgaacagttttgtatcaattttgttaatgaaaaactgcagcagatttttattgaactgacattaaaggcagaacaggaagaatatgttcaagagggaataagatggacacccattgagtactttaataataaaatcgtatgtgacctcatagagaacaaagtgaaccctcctggcatcatgagcatcctggatgacgtgtgcgccacgatgcatgcggtgggtgagggggcagatcagacgctgctccagaaacttcagatgcagattgggagtcatgagcacttcaacagttggaaccaaggcttcatcattcatcattatgctgggaaggtatcctatgacatggatggcttttgtgaaaggaaccgggatgtgctttttatggatctcatcgagcttatgcagagcagcgagctgcctttcataaagtctttatttccggaaaatctgcaggctgacaagaaagggcgcccaactactgccggaagcaaaataaagaaacaagccaatgaccttgtgagcaccctgatgaaatgtacgccccactacattcgctgcatcaagccaaacgaaaccaagaagcccagagactgggaggaaagcagggtaaagcatcaagtcgaatatttgggtctgaaagagaacattcgagtgagaagagctggctatgcctatcggcgcatcttccaaaaattcctacagaggtatgccattctgaccaaagccacctggccttcttggcagggagaggagaagcaaggcgtcctgcacctgctgcagtcggtcaacatggacagcgaccagttccagctggggaggagtaaagtgttcatcaaagcccccgagtctctatttcttttagaagagatgagagagagaaagtatgatgggtatgctcgagtgatacagaaatcatggaggaaattcgtggcccggaagaaatacgttcaaatgagagaagaagcctcagacctcttattgaacaagaaggagagaaggagaaacagtattaacaggaactttataggggattatattgggatggaagagcacccagaactccagcagttcgtgggcaagagggagaagattgatttcgcagacacagtcaccaagtatgacaggaggttcaagggtgtaaagcgagacctgctccttaccccaaagtgcttgtacttaatcggacgagaaaaagtcaaacagggcccagacaagggcctggtgaaagaagtcctgaagcggaaaatcgagatagaacggatcttgtctgtgtccctcagtactatgcaggatgacatttttattctccatgagcaagagtatgacagtttgcttgaatctgtcttcaaaactgaattcctaagcctcttagcaaagcgttacgaggagaagacccagaagcaactacctctgaaattcagcaatacgcttgaactgaagttgaaaaaggaaaactggggcccctggagtgcaggggggctcccggcaagtgcagttccaccaagggtttggggacctggctgtcctcaagcccagtaacaaagtgctgcaggtcagcatcggacctggactgcccaagaactcccgtcctaccagaaggaacactacccaaaatacaggttattccagtgggactcaaaatgccaactacccagtgagagctgcccctcctcccccaggataccatcagaacggagtcatcagaaaccagtatgtgccatatccccatgctcctggaagccagaggtccaatcagaaaagcctgtacacctccatggcccgcccgcccttgcctcggcagcagtctaccagttcagaccgagtgtcacagacgccagagagcctggatttcctcaaggtcccggaccagggagctgcaggggtcaggagacaaacaaccagtcggcctcccccagcagggggcagacccaagccccagcccaagcccaagcctcaggtgccacagtgcaaggctttgtatgcctatgacgctcaggacacagacgaactcagctttaatgccaatgacattattgatattatcaaagaagatccttctggctggtggacgggtcgactacgaggcaagcagggcctgttccccaacaactatgtgaccaagatctgaggtgcccgtgactctgacacatggggcagaggagctccaggcacagaccaggggaggggatatttaggggctccccttacaatccacaatgagcaattgcttctccaaggcctggagctattctggtaccttccccatggaggacactgaaaaggctgggttggggacagggagtatcactccataagtgatcctaaaaggtagcctcttcataggaacccaggaggacaaaaccaccatgcattaagatttatttattgtatttaaacctggtgagaggacaagtgaggtctgctcagaccttgtaggcttctatcaaaacagcaccctgcttgctcaccaggcctagagaatggctgtaggtggccgctgacaagtgcctttagttgaagagcacatttctttcatctctcttgtccatacctgatagacacattcctctctgccaccttccttcagggaggacccgccctctgcagactgggcttagcgtgagcaggcacttcccatgtacgtgccaagggtaagctggcctgctgagcccagggcgacagaggggcactggtttacactttgccgggaccatcagggccgccaagcaggtcaggggctgggggctgggggctgggctgctggctttgctttctctgggtcttcaattagaatgtggctggcccatattggtttgtgtttaaatgctgtacttactacaagaaggatcttttttcaagctgtacatttataaaaacagatcatatactgtatatataaaaatcttgagatggtagaaacatgtatgaatgtactaagtagtattccactgtactcattcataaggtaggttttcttacaaaactcacaccaggtacttaaagatgtgctctgcttttttccaactacggagtgtcactgctttctagctcagtccctgcagactcttctcaactctttccctataggaaacttactccgcgtcctgcccccacctcctaaataaataaaggaatcggcgaaca

SEQ ID NO: 314874 - DNA, 2238 bp, Homo sapiens
ccccgctgatccgcttagcaggaggggcggaagaaatacgttcaaatgagagaagaagcctcagacctcttattgaacaagaaggagagaaggagaaacagtattaacaggaactttataggggattatattgggatggaagagcacccagaactccagcagttcgtgggcaagagggagaagattgatttcgcagacacagtcaccaagtatgacaggaggttcaagggtgtaaagcgagacctgctccttaccccaaagtgcttgtacttaatcggacgagaaaaagtcaaacagggcccagacaagggcctggtgaaagaagtcctgaagcggaaaatcgagatagaacggatcttgtctgtgtccctcagtactatgcaggatgacatttttattctccatgagcaagagtatgacagtttgcttgaatctgtcttcaaaactgaattcctaagcctcttagcaaagcgttacgaggagaagacccagaagcaactacctctgaaattcagcaatacgcttgaactgaagttgaaaaaggaaaactggggcccctggagtgcaggggggctcccggcaagtgcagttccaccaagggtttggggacctggctgtcctcaagcccagtaacaaagtgctgcaggtcagcatcggacctggactgcccaagaactcccgtcctaccagaaggaacactacccaaaatacaggttattccagtgggactcaaaatgccaactacccagtgagagctgcccctcctcccccaggataccatcagaacggagtcatcagaaaccagtatgtgccatatccccatgctcctggaagccagaggtccaatcagaaaagcctgtacacctccatggcccgcccgcccttgcctcggcagcagtctaccagttcagaccgagtgtcacagacgccagagagcctggatttcctcaaggtcccggaccagggagctgcaggggtcaggagacaaacaaccagtcggcctcccccagcagggggcagacccaagccccagcccaagcccaagcctcaggtgccacagtgcaaggctttgtatgcctatgacgctcaggacacagacgaactcagctttaatgccaatgacattattgatattatcaaagaagatccttctggctggtggacgggtcgactacgaggcaagcagggcctgttccccaacaactatgtgaccaagatctgaggtgcccgtgactctgacacatggggcagaggagctccaggcacagaccaggggaggggatatttaggggctccccttacaatccacaatgagcaattgcttctccaaggcctggagctattctggtaccttccccatggaggacactgaaaaggctgggttggggacagggagtatcactccataagtgatcctaaaaggtagcctcttcataggaacccaggaggacaaaaccaccatgcattaagatttatttattgtatttaaacctggtgagaggacaagtgaggtctgctcagaccttgtaggcttctatcaaaacagcaccctgcttgctcaccaggcctagagaatggctgtaggtggccgctgacaagtgcctttagttgaagagcacatttctttcatctctcttgtccatacctgatagacacattcctctctgccaccttccttcagggaggacccgccctctgcagactgggcttagcgtgagcaggcacttcccatgtacgtgccaagggtaagctggcctgctgagcccagggcgacagaggggcactggtttacactttgccgggaccatcagggccgccaagcaggtcaggggctgggggctgggggctgggctgctggctttgctttctctgggtcttcaattagaatgtggctggcccatattggtttgtgtttaaatgctgtacttactacaagaaggatcttttttcaagctgtacatttataaaaacagatcatatactgtatatataaaaatcttgagatggtagaaacatgtatgaatgtactaagtagtattccactgtactcattcataaggtaggttttcttacaaaactcacaccaggtacttaaagatgtgctctgcttttttccaactacggagtgtcactgctttctagctcagtccctgcagactcttctcaactctttccctataggaaacttactccgcgtcctgcccccacctcctaaataaataaaggaatcggcgaaca

SEQ ID NO: 314875 - DNA, 1972 bp, Homo sapiens
cagatgtacctccctcaccacctggtgtctcacggtaccgggccccagatgctcctttttctggctcattgtcatgcagcgacagtgccaccccatggatgcggtgcgcatcctcagggccctgctcctggtgtagattgtccgttctcgcctcatgtttatgcttttccagcagcagaactccgtggcgggatctctgagcaccgttttctcactgcgtccttcgacctgttaaccccactgtgctttttgcaggcttgaactgaagttgaaaaaggaaaactggggcccctggagtgcaggggggctcccggcaagtgcagttccaccaagggtttggggacctggctgtcctcaagcccagtaacaaagtgctgcaggtcagcatcggacctggactgcccaagaactcccgtcctaccagaaggaacactacccaaaatacaggttattccagtgggactcaaaatgccaactacccagtgagagctgcccctcctcccccaggataccatcagaacggagtcatcagaaaccagtatgtgccatatccccatgctcctggaagccagaggtccaatcagaaaagcctgtacacctccatggcccgcccgcccttgcctcggcagcagtctaccagttcagaccgagtgtcacagacgccagagagcctggatttcctcaaggtcccggaccagggagctgcaggggtcaggagacaaacaaccagtcggcctcccccagcagggggcagacccaagccccagcccaagcccaagcctcaggtgccacagtgcaaggctttgtatgcctatgacgctcaggacacagacgaactcagctttaatgccaatgacattattgatattatcaaagaagatccttctggctggtggacgggtcgactacgaggcaagcagggcctgttccccaacaactatgtgaccaagatctgaggtgcccgtgactctgacacatggggcagaggagctccaggcacagaccaggggaggggatatttaggggctccccttacaatccacaatgagcaattgcttctccaaggcctggagctattctggtaccttccccatggaggacactgaaaaggctgggttggggacagggagtatcactccataagtgatcctaaaaggtagcctcttcataggaacccaggaggacaaaaccaccatgcattaagatttatttattgtatttaaacctggtgagaggacaagtgaggtctgctcagaccttgtaggcttctatcaaaacagcaccctgcttgctcaccaggcctagagaatggctgtaggtggccgctgacaagtgcctttagttgaagagcacatttctttcatctctcttgtccatacctgatagacacattcctctctgccaccttccttcagggaggacccgccctctgcagactgggcttagcgtgagcaggcacttcccatgtacgtgccaagggtaagctggcctgctgagcccagggcgacagaggggcactggtttacactttgccgggaccatcagggccgccaagcaggtcaggggctgggggctgggggctgggctgctggctttgctttctctgggtcttcaattagaatgtggctggcccatattggtttgtgtttaaatgctgtacttactacaagaaggatcttttttcaagctgtacatttataaaaacagatcatatactgtatatataaaaatcttgagatggtagaaacatgtatgaatgtactaagtagtattccactgtactcattcataaggtaggttttcttacaaaactcacaccaggtacttaaagatgtgctctgcttttttccaactacggagtgtcactgctttctagctcagtccctgcagactcttctcaactctttccctataggaaacttactccgcgtcctgcccccacctcctaaataaataaaggaatcggcgaaca

SEQ ID NO: 314876 - DNA, 4321 bp, Homo sapiens
cgagactcagccagaggagtacggattaaggggccgaagaaagaggagtgaggcaggggagcgaggcggacgctccgagcgcatcggactcacctgggccggcggcgagcggcgagtacgagtggactcttgccctccgcagcatgcgccccgcctgctaagtcgccgccgtctcgccctcacctagcaccgccaatcccgcctggatggagtcccctctgggttcccattggctcctgtgagtgcttgggtgtcgggagcctgtttttggcgaggggaaccaacttttgaagttcgcccagaagactgcgttccagccccagttccccggcagcgggacccggcgaagacgcgaccgcggcgcgagtcaccatgggaagcaaaggtgtctaccagtaccactggcaaagccacaatgtcaagcacagtggtgtggacgacatggtgctactgtccaagatcacagagaactccatcgtggagaatctgaagaagagatacatggatgactacatttttacatatataggatctgtattaatctcagtcaaccctttcaagcagatgccatattttggggaaaaggaaattgaaatgtaccaaggagcggcacagtatgaaaacccaccacatatctatgcccttgcagataatatgtacagaaacatgatcattgacagagagaaccagtgcgtcattatcagtggtgaaagtggtgctggaaaaacagtggctgccaaatatatcatgagctacatctccagagtgtctggaggagggaccaaagtccagcacgtgaaggacattatcctgcagtccaacccgctgctggaggccttcgggaacgccaagaccgtccggaacaacaactccagccgatttggaaaatactttgaaatccagttcagtccaggtggggaaccagatggtggaaagatctccaacttccttctggaaaaatctagggtggtgatgaggaacccaggagagcggagttttcacatattttaccagctcatcgagggcgcctctgcagagcagaaacacagccttggcatcaccagcatggactattattactacctgagcctctcgggctcatacaaggttgatgacattgacgacaggcgggagtttcaggaaactctgcacgccatgaatgtgattgggatctttgcagaagagcaaacgctggtgttgcagatagtggcgggtattctccacctgggaaacatcagcttcaaagaagttggcaactacgcggctgtggagagtgaagagtttttagcttttcctgcatatctgctagggataaaccaggaccggttgaaagaaaagctaacaagccggcagatggatagcaagtggggaggcaaatccgaatccatccacgtgaccctcaacgtagagcaggcctgttacacccgggatgcgctcgccaaggccctgcacgcccgggtctttgatttcttggtagattccatcaataaagccatggagaaagaccatgaagaatacaacattggcgtcctagacatctatggctttgaaatattccagaaaaatggctttgaacagttttgtatcaattttgttaatgaaaaactgcagcagatttttattgaactgacattaaaggcagaacaggaagaatatgttcaagagggaataagatggacacccattgagtactttaataataaaatcgtatgtgacctcatagagaacaaagtgaaccctcctggcatcatgagcatcctggatgacgtgtgcgccacgatgcatgcggtgggtgagggggcagatcagacgctgctccagaaacttcagatgcagattgggagtcatgagcacttcaacagttggaaccaaggcttcatcattcatcattatgctgggaaggtatcctatgacatggatggcttttgtgaaaggaaccgggatgtgctttttatggatctcatcgagcttatgcagagcagcgagctgcctttcataaagtctttatttccggaaaatctgcaggctgacaagaaagggcgcccaactactgccggaagcaaaataaagaaacaagccaatgaccttgtgagcaccctgatgaaatgtacgccccactacattcgctgcatcaagccaaacgaaaccaagaagcccagagactgggaggaaagcagggtaaagcatcaagtcgaatatttgggtctgaaagagaacattcgagtgagaagagctggctatgcctatcggcgcatcttccaaaaattcctacagaggtatgccattctgaccaaagccacctggccttcttggcagggagaggagaagcaaggcgtcctgcacctgctgcagtcggtcaacatggacagcgaccagttccagctggggaggagtaaagtgttcatcaaagcccccgagtctctatttcttttagaagagatgagagagagaaagtatgatgggtatgctcgagtgatacagaaatcatggaggaaattcgtggcccggaagaaatacgttcaaatgagagaagaagcctcagacctcttattgaacaagaaggagagaaggagaaacagtattaacaggaactttataggggattatattgggatggaagagcacccagaactccagcagttcgtgggcaagagggagaagattgatttcgcagacacagtcaccaagtatgacaggaggttcaagggtgtaaagcgagacctgctccttaccccaaagtgcttgtacttaatcggacgagaaaaagtcaaacagggcccagacaagggcctggtgaaagaagtcctgaagcggaaaatcgagatagaacggatcttgtctgtgtccctcagtactatgcaggatgacatttttattctccatgagcaagagtatgacagtttgcttgaatctgtcttcaaaactgaattcctaagcctcttagcaaagcgttacgaggagaagacccagaagcaactacctctgaaattcagcaatacgcttgaactgaagttgaaaaaggaaaactggggcccctggagtgcaggggggctcccggcaagtgcagttccaccaagggtttggggacctggctgtcctcaagcccagtaacaaagtgctgcaggtcagcatcggacctggactgcccaagaactcccgtcctaccagaaggaacactacccaaaatacaggttattccagtgggactcaaaatgccaactacccagtgagagctgcccctcctcccccaggataccatcagaacggagtcatcagaaaccagtatgtgccatatccccatgctcctggaagccagaggtccaatcagaaaagcctgtacacctccatggcccgcccgcccttgcctcggcagcagtctaccagttcagaccgagtgtcacagacgccagagagcctggatttcctcaaggtcccggaccagggagctgcaggggtcaggagacaaacaaccagtcggcctcccccagcagggggcagacccaagccccagcccaagcccaagcctcaggtgccacagtgcaaggctttgtatgcctatgaatcctaaaaggtagcctcttcataggaacccaggaggacaaaaccaccatgcattaagatttatttattgtatttaaacctggtgagaggacaagtgaggtctgctcagaccttgtaggcttctatcaaaacagcaccctgcttgctcaccaggcctagagaatggctgtaggtggccgctgacaagtgcctttagttgaagagcacatttctttcatctctcttgtccatacctgatagacacattcctctctgccaccttccttcagggaggacccgccctctgcagactgggcttagcgtgagcaggcacttcccatgtacgtgccaagggtaagctggcctgctgagcccagggcgacagaggggcactggtttacatttgctttctctgggtcttcaattagaatgtggctggcccatattggtttgtgtttaaatgctgtacttactacaagaaggatcttttttcaagctgtacatttataaaaacagatcatatactgtatatataaaaatcttgagatggtagaaacatgtatgaatgtactaagtagtattccactgtactcattcataaggtaggttttcttacaaaactcacaccaggtacttaaagatgtgctctgcttttttccaactacggagtgtcactgctttctagctcagtccctgcagactcttctcaactctttccctataggaaacttactccgcgtcctgcccccacctcctaaataaataaaggaatcggcgaaca

SEQ ID NO: 314877 - DNA, 916 bp, Homo sapiens
atcttcacagcaggtggccagaagcatgaggcacaccccctgctgctttgcagggggttccagtcatcgtcatcatcattttcgtcctgtatcctaaaaggtagcctcttcataggaacccaggaggacaaaaccaccatgcattaagatttatttattgtatttaaacctggtgagaggacaagtgaggtctgctcagaccttgtaggcttctatcaaaacagcaccctgcttgctcaccaggcctagagaatggctgtaggtggccgctgacaagtgcctttagttgaagagcacatttctttcatctctcttgtccatacctgatagacacattcctctctgccaccttccttcagggaggacccgccctctgcagactgggcttagcgtgagcaggcacttcccatgtacgtgccaagggtaagctggcctgctgagcccagggcgacagaggggcactggtttacactttgccgggaccatcagggccgccaagcaggtcaggggctgggggctgggggctgggctgctggctttgctttctctgggtcttcaattagaatgtggctggcccatattggtttgtgtttaaatgctgtacttactacaagaaggatcttttttcaagctgtacatttataaaaacagatcatatactgtatatataaaaatcttgagatggtagaaacatgtatgaatgtactaagtagtattccactgtactcattcataaggtaggttttcttacaaaactcacaccaggtacttaaagatgtgctctgcttttttccaactacggagtgtcactgctttctagctcagtccctgcagactcttctcaactctttccctataggaaacttactccgcgtcctgcccccacctcctaaataaataaaggaatcggcgaaca

SEQ ID NO: 314878 - DNA, 3521 bp, Homo sapiens
cgagactcagccagaggagtacggattaaggggccgaagaaagaggagtgaggcaggggagcgaggcggacgctccgagcgcatcggactcacctgggccggcggcgagcggcgagtacgagtggactcttgccctccgcagcatgcgccccgcctgctaagtcgccgccgtctcgccctcacctagcaccgccaatcccgcctggatggagtcccctctgggttcccattggctcctgtgagtgcttgggtgtcgggagcctgtttttggcgaggggaaccaacttttgaagttcgcccagaagactgcgttccagccccagttccccggcagcgggacccggcgaagacgcgaccgcggcgcgagtcaccatgggaagcaaaggtgtctaccagtaccactggcaaagccacaatgtcaagcacagtggtgtggacgacatggtgctactgtccaagatcacagagaactccatcgtggagaatctgaagaagagatacatggatgactacatttttacatatataggatctgtattaatctcagtcaaccctttcaagcagatgccatattttggggaaaaggaaattgaaatgtaccaaggagcggcacagtatgaaaacccaccacatatctatgcccttgcagataatatgtacagaaacatgatcattgacagagagaaccagtgcgtcattatcagtggtgaaagtggtgctggaaaaacagtggctgccaaatatatcatgagctacatctccagagtgtctggaggagggaccaaagtccagcacgtgaaggacattatcctgcagtccaacccgctgctggaggccttcgggaacgccaagaccgtccggaacaacaactccagccgatttggaaaatactttgaaatccagttcagtccaggtggggaaccagatggtggaaagatctccaacttccttctggaaaaatctagggtggtgatgaggaacccaggagagcggagttttcacatattttaccagctcatcgagggcgcctctgcagagcagaaacacagccttggcatcaccagcatggactattattactacctgagcctctcgggctcatacaaggttgatgacattgacgacaggcgggagtttcaggaaactctgcacgccatgaatgtgattgggatctttgcagaagagcaaacgctggtgttgcagatagtggcgggtattctccacctgggaaacatcagcttcaaagaagttggcaactacgcggctgtggagagtgaagagtttttagcttttcctgcatatctgctagggataaaccaggaccggttgaaagaaaagctaacaagccggcagatggatagcaagtggggaggcaaatccgaatccatccacgtgaccctcaacgtagagcaggcctgttacacccgggatgcgctcgccaaggccctgcacgcccgggtctttgatttcttggtagattccatcaataaagccatggagaaagaccatgaagaatacaacattggcgtcctagacatctatggctttgaaatattccagaaaaatggctttgaacagttttgtatcaattttgttaatgaaaaactgcagcagatttttattgaactgacattaaaggcagaacaggaagaatatgttcaagagggaataagatggacacccattgagtactttaataataaaatcgtatgtgacctcatagagaacaaagtgaaccctcctggcatcatgagcatcctggatgacgtgtgcgccacgatgcatgcggtgggtgagggggcagatcagacgctgctccagaaacttcagatgcagattgggagtcatgagcacttcaacagttggaaccaaggcttcatcattcatcattatgctgggaaggtatcctatgacatggatggcttttgtgaaaggaaccgggatgtgctttttatggatctcatcgagcttatgcagagcagcgagctgcctttcataaagtctttatttccggaaaatctgcaggctgacaagaaagggcgcccaactactgccggaagcaaaataaagaaacaagccaatgaccttgtgagcaccctgatgaaatgtacgccccactacattcgctgcatcaagccaaacgaaaccaagaagcccagagactgggaggaaagcagggtaaagcatcaagtcgaatatttgggtctgaaagagaacattcgagtgagaagagctggctatgcctatcggcgcatcttccaaaaattcctacagaggtatgccattctgaccaaagccacctggccttcttggcagggagaggagaagcaaggcgtcctgcacctgctgcagtcggtcaacatggacagcgaccagttccagctggggaggagtaaagtgttcatcaaagcccccgagtctctatttcttttagaagagatgagagagagaaagtatgatgggtatgctcgagtgatacagaaatcatggaggaaattcgtggcccggaagaaatacgttcaaatgagagaagaagcctcagacctcttattgaacaagaaggagagaaggagaaacagtattaacaggaactttataggggattatattgggatggaagagcacccagaactccagcagttcgtgggcaagagggagaagattgatttcgcagacacagtcaccaagtatgacaggaggttcaagggtgtaaagcgagacctgctccttaccccaaagtgcttgtacttaatcggacgagaaaaagtcaaacagggcccagacaagggcctggtgaaagaagtcctgaagcggaaaatcgagatagaacggatcttgtctgtgtccctcagtactatgcaggatgacatttttattctccatgagcaagagtatgacagtttgcttgaatctgtcttcaaaactgaattcctaagcctcttagcaaagcgttacgaggagaagacccagaagcaactacctctgaaattcagcaatacgcttgaactgaagttgaaaaaggaaaactggggcccctggagtgcaggggggctcccggcaagtgcagttccaccaagggtttggggacctggctgtcctcaagcccagtaacaaagtgctgcaggtcagcatcggacctggactgcccaagaactcccgtcctaccagaaggaacactacccaaaatacaggttattccagtgggactcaaaatgccaactacccagtgagagctgcccctcctcccccaggataccatcagaacggagtcatcagaaaccagtatgtgccatatccccatgctcctggaagccagaggtccaatcagaaaagcctgtacacctccatggcccgcccgcccttgcctcggcagcagtctaccagttcagaccgagtgtcacagacgccagagagcctggatttcctcaaggtcccggaccagggagctgcaggagtcaggcacactaacacagccttctgtcctcaataacacagccattattgacactttgcatccagag

SEQ ID NO: 314879 - DNA, 3544 bp, Homo sapiens
cgagactcagccagaggagtacggattaaggggccgaagaaagaggagtgaggcaggggagcgaggcggacgctccgagcgcatcggactcacctgggccggcggcgagcggcgagtacgagtggactcttgccctccgcagcatgcgccccgcctgctaagtcgccgccgtctcgccctcacctagcaccgccaatcccgcctggatggagtcccctctgggttcccattggctcctgtgagtgcttgggtgtcgggagcctgtttttggcgaggggaaccaacttttgaagttcgcccagaagactgcgttccagccccagttccccggcagcgggacccggcgaagacgcgaccgcggcgcgagtcaccatgggaagcaaaggtgtctaccagtaccactggcaaagccacaatgtcaagcacagtggtgtggacgacatggtgctactgtccaagatcacagagaactccatcgtggagaatctgaagaagagatacatggatgactacatttttacatatataggatctgtattaatctcagtcaaccctttcaagcagatgccatattttggggaaaaggaaattgaaatgtaccaaggagcggcacagtatgaaaacccaccacatatctatgcccttgcagataatatgtacagaaacatgatcattgacagagagaaccagtgcgtcattatcagtggtgaaagtggtgctggaaaaacagtggctgccaaatatatcatgagctacatctccagagtgtctggaggagggaccaaagtccagcacgtgaaggacattatcctgcagtccaacccgctgctggaggccttcgggaacgccaagaccgtccggaacaacaactccagccgatttggaaaatactttgaaatccagttcagtccaggtggggaaccagatggtggaaagatctccaacttccttctggaaaaatctagggtggtgatgaggaacccaggagagcggagttttcacatattttaccagctcatcgagggcgcctctgcagagcagaaacacagccttggcatcaccagcatggactattattactacctgagcctctcgggctcatacaaggttgatgacattgacgacaggcgggagtttcaggaaactctgcacgccatgaatgtgattgggatctttgcagaagagcaaacgctggtgttgcagatagtggcgggtattctccacctgggaaacatcagcttcaaagaagttggcaactacgcggctgtggagagtgaagagtttttagcttttcctgcatatctgctagggataaaccaggaccggttgaaagaaaagctaacaagccggcagatggatagcaagtggggaggcaaatccgaatccatccacgtgaccctcaacgtagagcaggcctgttacacccgggatgcgctcgccaaggccctgcacgcccgggtctttgatttcttggtagattccatcaataaagccatggagaaagaccatgaagaatacaacattggcgtcctagacatctatggctttgaaatattccagaaaaatggctttgaacagttttgtatcaattttgttaatgaaaaactgcagcagatttttattgaactgacattaaaggcagaacaggaagaatatgttcaagagggaataagatggacacccattgagtactttaataataaaatcgtatgtgacctcatagagaacaaagtgaaccctcctggcatcatgagcatcctggatgacgtgtgcgccacgatgcatgcggtgggtgagggggcagatcagacgctgctccagaaacttcagatgcagattgggagtcatgagcacttcaacagttggaaccaaggcttcatcattcatcattatgctgggaaggtatcctatgacatggatggcttttgtgaaaggaaccgggatgtgctttttatggatctcatcgagcttatgcagagcagcgagctgcctttcataaagtctttatttccggaaaatctgcaggctgacaagaaagggcgcccaactactgccggaagcaaaataaagaaacaagccaatgaccttgtgagcaccctgatgaaatgtacgccccactacattcgctgcatcaagccaaacgaaaccaagaagcccagagactgggaggaaagcagggtaaagcatcaagtcgaatatttgggtctgaaagagaacattcgagtgagaagagctggctatgcctatcggcgcatcttccaaaaattcctacagaggtatgccattctgaccaaagccacctggccttcttggcagggagaggagaagcaaggcgtcctgcacctgctgcagtcggtcaacatggacagcgaccagttccagctggggaggagtaaagtgttcatcaaagcccccgagtctctatttcttttagaagagatgagagagagaaagtatgatgggtatgctcgagtgatacagaaatcatggaggaaattcgtggcccggaagaaatacgttcaaatgagagaagaagcctcagacctcttattgaacaagaaggagagaaggagaaacagtattaacaggaactttataggggattatattgggatggaagagcacccagaactccagcagttcgtgggcaagagggagaagattgatttcgcagacacagtcaccaagtatgacaggaggttcaagggtgtaaagcgagacctgctccttaccccaaagtgcttgtacttaatcggacgagaaaaagtcaaacagggcccagacaagggcctggtgaaagaagtcctgaagcggaaaatcgagatagaacggatcttgtctgtgtccctcaggtgagtagtggaggtgcagaggcaggactgccccttctcgcctcagcatcacggtccgctgttccaaacagccaggaggaaggccgggctgggcttcccagctgtcaaaatcatgatcaagagaatggaatttccctttgtcccaaagggaagactccctagtctcagcaagtcttgatatgtcaggaagaaggtaccaagaaaaggttgcctccggacagctcctctaatcaagggggacccagatctcttgtaaccgaaacatgttagaaatgaacccggtatatggaacacctcagagaataatttctcttgttgcagtagagccaaggattcagagccctgtcccccagtccacctcacccaggttggaggcctcacccatttccctgagcagagggtcctgaaagggaagtttctttgggacttccttagggagtgcaagttggtctccattctctgtagccctggagtcatcgtgagatgctctcttcgctccagttctcaggcagtggggagtggtgtttgcttccacaaggcctcaggaagggcccttgctcctcccggcagcaccttggcttcctctcggcagaagggctcctctgccggccgtcagcatctcctccgtcagtgggacctaggctaggggttcttagcataggaggtcttcccatgctaagaagtcctcccat

SEQ ID NO: 314880 - DNA, 2317 bp, Homo sapiens
cgagactcagccagaggagtacggattaaggggccgaagaaagaggagtgaggcaggggagcgaggcggacgctccgagcgcatcggactcacctgggccggcggcgagcggcgagtacgagtggactcttgccctccgcagcatgcgccccgcctgctaagtcgccgccgtctcgccctcacctagcaccgccaatcccgcctggatggagtcccctctgggttcccattggctcctgtgagtgcttgggtgtcgggagcctgtttttggcgaggggaaccaacttttgaagttcgcccagaagactgcgttccagccccagttccccggcagcgggacccggcgaagacgcgaccgcggcgcgagtcaccatgggaagcaaaggtgtctaccagtaccactggcaaagccacaatgtcaagcacagtggtgtggacgacatggtgctactgtccaagatcacagagaactccatcgtggagaatctgaagaagagatacatggatgactacatttttacatatataggatctgtattaatctcagtcaaccctttcaagcagatgccatattttggggaaaaggaaattgaaatgtaccaaggagcggcacagtatgaaaacccaccacatatctatgcccttgcagataatatgtacagaaacatgatcattgacagagagaaccagtgcgtcattatcagtggtgaaagtggtgctggaaaaacagtggctgccaaatatatcatgagctacatctccagagtgtctggaggagggaccaaagtccagcacgtgaaggacattatcctgcagtccaacccgctgctggaggccttcgggaacgccaagaccgtccggaacaacaactccagccgatttggaaaatactttgaaatccagttcagtccaggtggggaaccagatggtggaaagatctccaacttccttctggaaaaatctagggtggtgatgaggaacccaggagagcggagttttcacatattttaccagctcatcgagggcgcctctgcagagcagaaacacagccttggcatcaccagcatggactattattactacctgagcctctcgggctcatacaaggttgatgacattgacgacaggcgggagtttcaggaaactctgcacgccatgaatgtgattgggatctttgcagaagagcaaacgctggtgttgcagatagtggcgggtattctccacctgggaaacatcagcttcaaagaagttggcaactacgcggctgtggagagtgaagagtttttagcttttcctgcatatctgctagggataaaccaggaccggttgaaagaaaagctaacaagccggcagatggatagcaagtggggaggcaaatccgaatccatccacgtgaccctcaacgtagagcaggcctgttacacccgggatgcgctcgccaaggccctgcacgcccgggtctttgatttcttggtagatggtgtaaagcgagacctgctccttaccccaaagtgcttgtacttaatcggacgagaaaaagtcaaacagggcccagacaagggcctggtgaaagaagtcctgaagcggaaaatcgagatagaacggatcttgtctgtgtccctcaggtgagtagtggaggtgcagaggcaggactgccccttctcgcctcagcatcacggtccgctgttccaaacagccaggaggaaggccgggctgggcttcccagctgtcaaaatcatgatcaagagaatggaatttccctttgtcccaaagggaagactccctagtctcagcaagtcttgatatgtcaggaagaaggtaccaagaaaaggttgcctccggacagctcctctaatcaagggggacccagatctcttgtaaccgaaacatgttagaaatgaacccggtatatggaacacctcagagaataatttctcttgttgcagtagagccaaggattcagagccctgtcccccagtccacctcacccaggttggaggcctcacccatttccctgagcagagggtcctgaaagggaagtttctttgggacttccttagggagtgcaagttggtctccattctctgtagccctggagtcatcgtgagatgctctcttcgctccagttctcaggcagtggggagtggtgtttgcttccacaaggcctcaggaagggcccttgctcctcccggcagcaccttggcttcctctcggcagaagggctcctctgccggccgtcagcatctcctccgtcagtgggacctaggctaggggttcttagcataggaggtcttcccatgctaagaagtcctcccat

SEQ ID NO: 314881 - DNA, 290 bp, Homo sapiens
ccaagtatgacaggaggttcaaggtacgtgctaactgcctgcctctgagatcaccaaacagattccttatttttttaataacttgttattttgcttttgttgttaccaaatcagaatgtgttcgttgtagaaaaatttagagaaaatacagtaaaccaaaagataaacaggcacctatgcccagaaacattcactgttaacattctgtgtatatccatatctttcagaatgtttttatgaaaacatacatttgcgtatttagttttacaaaaaatgagatatacattaca

SEQ ID NO: 314882 - DNA, 504 bp, Homo sapiens
gtatcaattttgttaatgaaaaactgcagcagatttttattgaactgacattaaaggcagaacaggtaagcagtccctcttccttcatcctattctatttataatttattttgtttaagagggtatagatttctgtcttttgttaatagatttcggttccagtcttatattaggaaatgcatctaataaagtcaggcagaaaaaccatatgccattgtggcattttaatctatgaaatataaataccgtctgcagcatttgccttcttctttaagcaaatgatgctgtgatgttggaggtaagactggctgcttttactctactgactcattgagcacgtgggaaatgggagcctagttccagccccgactgtctgtggcaaatattgtgttccaaataaaagacttggtttcctcagatctacgccattttcaatcttccctaacaatacgtgcatttttaacaaagctggtatttgaatacttacctgaggtaacatgcctt

SEQ ID NO: 314883 - DNA, 714 bp, Homo sapiens
cacttagcaaaccctggcaaaggtgaatgtttaatagacgtaagctgcttctattatcaattcaaaaataatgactattgttactatctgcagatagctcaccctctctataagcgcctaggaacaagggttgtcttgtccttagcatccctggcatattgtgttgggtcatcattaaatgactggtgaatggaagacactggaaatgacaattacagatcctttagtgtgggttctttgtgtgaaataggttttacttcgatcatccaagatgacatttttttctaattgttaagacttcctgaaaaagcttacttggacagaaattaatggttatcatcattaaacaaacattttttgtttctactgtactcgcttttctgaatcctggtggttttccaaagtacttgactttggactgagagattgttaaagcagcaagtctcctgccttcacttgtcctctgtttcctgcaagcagtagtgtttgccgtgtagaatccagcttccctttccccagtgcatgcccgtttttagtatgaatggaaaggagttcactgccatgctgtttactttctctagtccatcaataaagccatggagaaagaccatgaagaatacaacattggcgtcctagacatctatggctttgaaatattccaggtaaggccagttttaataactaggggttgaggagggtgacgtatttcatctg

SEQ ID NO: 314884 - DNA, 4716 bp, Homo sapiens
cgagactcagccagaggagtacggattaaggggccgaagaaagaggagtgaggcaggggagcgaggcggacgctccgagcgcatcggactcacctgggccggcggcgagcggcgagtacgagtggactcttgccctccgcagcatgcgccccgcctgctaagtcgccgccgtctcgccctcacctagcaccgccaatcccgcctggatggagtcccctctgggttcccattggctcctgtgagtgcttgggtgtcgggagcctgtttttggcgaggggaaccaacttttgaagttcgcccagaagactgcgttccagccccagttccccggcagcgggacccggcgaagacgcgaccgcggcgcgagtcaccatgggaagcaaaggtgtctaccagtaccactggcaaagccacaatgtcaagcacagtggtgtggacgacatggtgctactgtccaagatcacagagaactccatcgtggagaatctgaagaagagatacatggatgactacatttttacatatataggatctgtattaatctcagtcaaccctttcaagcagatgccatattttggggaaaaggaaattgaaatgtaccaaggagcggcacagtatgaaaacccaccacatatctatgcccttgcagataatatgtacagaaacatgatcattgacagagagaaccagtgcgtcattatcagtggtgaaagtggtgctggaaaaacagtggctgccaaatatatcatgagctacatctccagagtgtctggaggagggaccaaagtccagcacgtgaaggacattatcctgcagtccaacccgctgctggaggccttcgggaacgccaagaccgtccggaacaacaactccagccgatttggaaaatactttgaaatccagttcagtccaggtggggaaccagatggtggaaagatctccaacttccttctggaaaaatctagggtggtgatgaggaacccaggagagcggagttttcacatattttaccagctcatcgagggcgcctctgcagagcagaaacacagccttggcatcaccagcatggactattattactacctgagcctctcgggctcatacaaggttgatgacattgacgacaggcgggagtttcaggaaactctgcacgccatgaatgtgattgggatctttgcagaagagcaaacgctggtgttgcagatagtggcgggtattctccacctgggaaacatcagcttcaaagaagttggcaactacgcggctgtggagagtgaagagtttttagcttttcctgcatatctgctagggataaaccaggaccggttgaaagaaaagctaacaagccggcagatggatagcaagtggggaggcaaatccgaatccatccacgtgaccctcaacgtagagcaggcctgttacacccgggatgcgctcgccaaggccctgcacgcccgggtctttgatttcttggtagattccatcaataaagccatggagaaagaccatgaagaatacaacattggcgtcctagacatctatggctttgaaatattccagaaaaatggctttgaacagttttgtatcaattttgttaatgaaaaactgcagcagatttttattgaactgacattaaaggcagaacaggaagaatatgttcaagagggaataagatggacacccattgagtactttaataataaaatcgtatgtgacctcatagagaacaaagtgaaccctcctggcatcatgagcatcctggatgacgtgtgcgccacgatgcatgcggtgggtgagggggcagatcagacgctgctccagaaacttcagatgcagattgggagtcatgagcacttcaacagttggaaccaaggcttcatcattcatcattatgctgggaaggtatcctatgacatggatggcttttgtgaaaggaaccgggatgtgctttttatggatctcatcgagcttatgcagagcagcgagctgcctttcataaagtctttatttccggaaaatctgcaggctgacaagaaagggcgcccaactactgccggaagcaaaataaagaaacaagccaatgaccttgtgagcaccctgatgaaatgtacgccccactacattcgctgcatcaagccaaacgaaaccaagaagcccagagactgggaggaaagcagggtaaagcatcaagtcgaatatttgggtctgaaagagaacattcgagtgagaagagctggctatgcctatcggcgcatcttccaaaaattcctacagaggtatgccattctgaccaaagccacctggccttcttggcagggagaggagaagcaaggcgtcctgcacctgctgcagtcggtcaacatggacagcgaccagttccagctggggaggagtaaagtgttcatcaaagcccccgagtctctatttcttttagaagagatgagagagagaaagtatgatgggtatgctcgagtgatacagaaatcatggaggaaattcgtggcccggaagaaatacgttcaaatgagagaagaagcctcagacctcttattgaacaagaaggagagaaggagaaacagtattaacaggaactttataggggattatattgggatggaagagcacccagaactccagcagttcgtgggcaagagggagaagattgatttcgcagacacagtcaccaagtatgacaggaggttcaagggtgtaaagcgagacctgctccttaccccaaagtgcttgtacttaatcggacgagaaaaagtcaaacagggcccagacaagggcctggtgaaagaagtcctgaagcggaaaatcgagatagaacggatcttgtctgtgtccctcagtactatgcaggatgacatttttattctccatgagcaagagtatgacagtttgcttgaatctgtcttcaaaactgaattcctaagcctcttagcaaagcgttacgaggagaagacccagaagcaactacctctgaaattcagcaatacgcttgaactgaagttgaaaaaggaaaactggggcccctggagtgcaggggggctcccggcaagtgcagttccaccaagggtttggggacctggctgtcctcaagcccagtaacaaagtgctgcaggtcagcatcggacctggactgcccaagaactcccgtcctaccagaaggaacactacccaaaatacaggttattccagtgggactcaaaatgccaactacccagtgagagctgcccctcctcccccaggataccatcagaacggagtcatcagaaaccagtatgtgccatatccccatgctcctggaagccagaggtccaatcagaaaagcctgtacacctccatggcccgcccgcccttgcctcggcagcagtctaccagttcagaccgagtgtcacagacgccagagagcctggatttcctcaaggtcccggaccagggagctgcaggggtcaggagacaaacaaccagtcggcctcccccagcagggggcagacccaagccccagcccaagcccaagcctcaggtgccacagtgcaaggctttgtatgcctatgacgctcaggacacagacgaactcagctttaatgccaatgacattattgatattatcaaagaagatccttctggctggtggacgggtcgactacgaggcaagcagggcctgttccccaacaactatgtgaccaagatctgaggtgcccgtgactctgacacatggggcagaggagctccaggcacagaccaggggaggggatatttaggggctccccttacaatccacaatgagcaattgcttctccaaggcctggagctattctggtaccttccccatggaggacactgaaaaggctgggttggggacagggagtatcactccataagtgatcctaaaaggtagcctcttcataggaacccaggaggacaaaaccaccatgcattaagatttatttattgtatttaaacctggtgagaggacaagtgaggtctgctcagaccttgtaggcttctatcaaaacagcaccctgcttgctcaccaggcctagagaatggctgtaggtggccgctgacaagtgcctttagttgaagagcacatttctttcatctctcttgtccatacctgatagacacattcctctctgccaccttccttcagggaggacccgccctctgcagactgggcttagcgtgagcaggcacttcccatgtacgtgccaagggtaagctggcctgctgagcccagggcgacagaggggcactggtttacactttgccgggaccatcagggccgccaagcaggtcaggggctgggggctgggggctgggctgctggctttgctttctctgggtcttcaattagaatgtggctggcccatattggtttgtgtttaaatgctgtacttactacaagaaggatcttttttcaagctgtacatttataaaaacagatcatatactgtatatataaaaatcttgagatggtagaaacatgtatgaatgtactaagtagtattccactgtactcattcataaggtaggttttcttacaaaactcacaccaggtacttaaagatgtgctctgcttttttccaactacggagtgtcactgctttctagctcagtccctgcagactcttctcaactctttccctataggaaacttactccgcgtcctgcccccacctcctaaataaataaaggaatcggcgaaca

SEQ ID NO: 314885 - DNA, 4969 bp, Homo sapiens
cagtcataaaaatgtagcctatcttttgaatatggaaagccagtattacacgtatgacagtgataagtttatgaagggaaagtaatttagatgacttgagaaattatgaccgtgtgacatagcctttgtgtgatacatattctttccatttctggattctgtcatgtagtttgcaaaacaagactagaaagtttctatgtcgttgcttattttcaccgacaaattcaacacaacagtatggttgaaggatagtctcatccgagactgtcaaccgtgtgttgtgctgtattcctgacactgtttagcacttcacacatattattttatttaatccttacagcagcgttgtgaaatgggtctgtctcccattttacaaatgagaaaagagaagtcactttgtgtcacttcagggacacatgagcttaggtagcttttccccacttaacttagtctgtaggtagcaaagctggaacttgaatcctcatcttattgattgcagaatctttctctgcactgctctttctgctacattttattttaagaatatttgggaaattaacagcattttgtctttgttactacaggggaaaacaaactatcctagtaattgtatgttttatgttcccagggaagcaaaggtgtctaccagtaccactggcaaagccacaatgtcaagcacagtggtgtggacgacatggtgctactgtccaagatcacagagaactccatcgtggagaatctgaagaagagatacatggatgactacatttttacatatataggatctgtattaatctcagtcaaccctttcaagcagatgccatattttggggaaaaggaaattgaaatgtaccaaggagcggcacagtatgaaaacccaccacatatctatgcccttgcagataatatgtacagaaacatgatcattgacagagagaaccagtgcgtcattatcagtggtgaaagtggtgctggaaaaacagtggctgccaaatatatcatgagctacatctccagagtgtctggaggagggaccaaagtccagcacgtgaaggacattatcctgcagtccaacccgctgctggaggccttcgggaacgccaagaccgtccggaacaacaactccagccgatttggaaaatactttgaaatccagttcagtccaggtggggaaccagatggtggaaagatctccaacttccttctggaaaaatctagggtggtgatgaggaacccaggagagcggagttttcacatattttaccagctcatcgagggcgcctctgcagagcagaaacacagccttggcatcaccagcatggactattattactacctgagcctctcgggctcatacaaggttgatgacattgacgacaggcgggagtttcaggaaactctgcacgccatgaatgtgattgggatctttgcagaagagcaaacgctggtgttgcagatagtggcgggtattctccacctgggaaacatcagcttcaaagaagttggcaactacgcggctgtggagagtgaagagtttttagcttttcctgcatatctgctagggataaaccaggaccggttgaaagaaaagctaacaagccggcagatggatagcaagtggggaggcaaatccgaatccatccacgtgaccctcaacgtagagcaggcctgttacacccgggatgcgctcgccaaggccctgcacgcccgggtctttgatttcttggtagattccatcaataaagccatggagaaagaccatgaagaatacaacattggcgtcctagacatctatggctttgaaatattccagaaaaatggctttgaacagttttgtatcaattttgttaatgaaaaactgcagcagatttttattgaactgacattaaaggcagaacaggaagaatatgttcaagagggaataagatggacacccattgagtactttaataataaaatcgtatgtgacctcatagagaacaaagtgaaccctcctggcatcatgagcatcctggatgacgtgtgcgccacgatgcatgcggtgggtgagggggcagatcagacgctgctccagaaacttcagatgcagattgggagtcatgagcacttcaacagttggaaccaaggcttcatcattcatcattatgctgggaaggtatcctatgacatggatggcttttgtgaaaggaaccgggatgtgctttttatggatctcatcgagcttatgcagagcagcgagctgcctttcataaagtctttatttccggaaaatctgcaggctgacaagaaagggcgcccaactactgccggaagcaaaataaagaaacaagccaatgaccttgtgagcaccctgatgaaatgtacgccccactacattcgctgcatcaagccaaacgaaaccaagaagcccagagactgggaggaaagcagggtaaagcatcaagtcgaatatttgggtctgaaagagaacattcgagtgagaagagctggctatgcctatcggcgcatcttccaaaaattcctacagaggtatgccattctgaccaaagccacctggccttcttggcagggagaggagaagcaaggcgtcctgcacctgctgcagtcggtcaacatggacagcgaccagttccagctggggaggagtaaagtgttcatcaaagcccccgagtctctatttcttttagaagagatgagagagagaaagtatgatgggtatgctcgagtgatacagaaatcatggaggaaattcgtggcccggaagaaatacgttcaaatgagagaagaagcctcagacctcttattgaacaagaaggagagaaggagaaacagtattaacaggaactttataggggattatattgggatggaagagcacccagaactccagcagttcgtgggcaagagggagaagattgatttcgcagacacagtcaccaagtatgacaggaggttcaagggtgtaaagcgagacctgctccttaccccaaagtgcttgtacttaatcggacgagaaaaagtcaaacagggcccagacaagggcctggtgaaagaagtcctgaagcggaaaatcgagatagaacggatcttgtctgtgtccctcagtactatgcaggatgacatttttattctccatgagcaagagtatgacagtttgcttgaatctgtcttcaaaactgaattcctaagcctcttagcaaagcgttacgaggagaagacccagaagcaactacctctgaaattcagcaatacgcttgaactgaagttgaaaaaggaaaactggggcccctggagtgcaggggggctcccggcaagtgcagttccaccaagggtttggggacctggctgtcctcaagcccagtaacaaagtgctgcaggtcagcatcggacctggactgcccaagaactcccgtcctaccagaaggaacactacccaaaatacaggttattccagtgggactcaaaatgccaactacccagtgagagctgcccctcctcccccaggataccatcagaacggagtcatcagaaaccagtatgtgccatatccccatgctcctggaagccagaggtccaatcagaaaagcctgtacacctccatggcccgcccgcccttgcctcggcagcagtctaccagttcagaccgagtgtcacagacgccagagagcctggatttcctcaaggtcccggaccagggagctgcaggggtcaggagacaaacaaccagtcggcctcccccagcagggggcagacccaagccccagcccaagcccaagcctcaggtgccacagtgcaaggctttgtatgcctatgacgctcaggacacagacgaactcagctttaatgccaatgacattattgatattatcaaagaagatccttctggctggtggacgggtcgactacgaggcaagcagggcctgttccccaacaactatgtgaccaagatctgaggtgcccgtgactctgacacatggggcagaggagctccaggcacagaccaggggaggggatatttaggggctccccttacaatccacaatgagcaattgcttctccaaggcctggagctattctggtaccttccccatggaggacactgaaaaggctgggttggggacagggagtatcactccataagtgatcctaaaaggtagcctcttcataggaacccaggaggacaaaaccaccatgcattaagatttatttattgtatttaaacctggtgagaggacaagtgaggtctgctcagaccttgtaggcttctatcaaaacagcaccctgcttgctcaccaggcctagagaatggctgtaggtggccgctgacaagtgcctttagttgaagagcacatttctttcatctctcttgtccatacctgatagacacattcctctctgccaccttccttcagggaggacccgccctctgcagactgggcttagcgtgagcaggcacttcccatgtacgtgccaagggtaagctggcctgctgagcccagggcgacagaggggcactggtttacactttgccgggaccatcagggccgccaagcaggtcaggggctgggggctgggggctgggctgctggctttgctttctctgggtcttcaattagaatgtggctggcccatattggtttgtgtttaaatgctgtacttactacaagaaggatcttttttcaagctgtacatttataaaaacagatcatatactgtatatataaaaatcttgagatggtagaaacatgtatgaatgtactaagtagtattccactgtactcattcataaggtaggttttcttacaaaactcacaccaggtacttaaagatgtgctctgcttttttccaactacggagtgtcactgctttctagctcagtccctgcagactcttctcaactctttccctataggaaacttactccgcgtcctgcccccacctcctaaataaataaaggaatcggcgaaca

SEQ ID NO: 314886 - DNA, 4623 bp, Homo sapiens
cgagactcagccagaggagtacggattaaggggccgaagaaagaggagtgaggcaggggagcgaggcggacgctccgagcgcatcggactcacctgggccggcggcgagcggcgagtacgagtggactcttgccctccgcagcatgcgccccgcctgctaagtcgccgccgtctcgccctcacctagcaccgccaatcccgcctggatggagtcccctctgggttcccattggctcctgtgagtgcttgggtgtcgggagcctgtttttggcgaggggaaccaacttttgaagttcgcccagaagactgcgttccagccccagttccccggcagcgggacccggcgaagacgcgaccgcggcgcgagtcaccatgggaagcaaaggtgtctaccagtaccactggcaaagccacaatgtcaagcacagtggtgtggacgacatggtgctactgtccaagatcacagagaactccatcgtggagaatctgaagaagagatacatggatgactacatttttacatatataggatctgtattaatctcagtcaaccctttcaagcagatgccatattttggggaaaaggaaattgaaatgtaccaaggagcggcacagtatgaaaacccaccacatatctatgcccttgcagataatatgtacagaaacatgatcattgacagagagaaccagtgcgtcattatcagtggtgaaagtggtgctggaaaaacagtggctgccaaatatatcatgagctacatctccagagtgtctggaggagggaccaaagtccagcacgtgaaggacattatcctgcagtccaacccgctgctggaggccttcgggaacgccaagaccgtccggaacaacaactccagccgatttggaaaatactttgaaatccagttcagtccaggtggggaaccagatggtggaaagatctccaacttccttctggaaaaatctagggtggtgatgaggaacccaggagagcggagttttcacatattttaccagctcatcgagggcgcctctgcagagcagaaacacagccttggcatcaccagcatggactattattactacctgagcctctcgggctcatacaaggttgatgacattgacgacaggcgggagtttcaggaaactctgcacgccatgaatgtgattgggatctttgcagaagagcaaacgctggtgttgcagatagtggcgggtattctccacctgggaaacatcagcttcaaagaagttggcaactacgcggctgtggagagtgaagagtttttagcttttcctgcatatctgctagggataaaccaggaccggttgaaagaaaagctaacaagccggcagatggatagcaagtggggaggcaaatccgaatccatccacgtgaccctcaacgtagagcaggcctgttacacccgggatgcgctcgccaaggccctgcacgcccgggtctttgatttcttggtagattccatcaataaagccatggagaaagaccatgaagaatacaacattggcgtcctagacatctatggctttgaaatattccagaaaaatggctttgaacagttttgtatcaattttgttaatgaaaaactgcagcagatttttattgaactgacattaaaggcagaacaggaagaatatgttcaagagggaataagatggacacccattgagtactttaataataaaatcgtatgtgacctcatagagaacaaagtgaaccctcctggcatcatgagcatcctggatgacgtgtgcgccacgatgcatgcggtgggtgagggggcagatcagacgctgctccagaaacttcagatgcagattgggagtcatgagcacttcaacagttggaaccaaggcttcatcattcatcattatgctgggaaggtatcctatgacatggatggcttttgtgaaaggaaccgggatgtgctttttatggatctcatcgagcttatgcagagcagcgagctgcctttcataaagtctttatttccggaaaatctgcaggctgacaagaaagggcgcccaactactgccggaagcaaaataaagaaacaagccaatgaccttgtgagcaccctgatgaaatgtacgccccactacattcgctgcatcaagccaaacgaaaccaagaagcccagagactgggaggaaagcagggtaaagcatcaagtcgaatatttgggtctgaaagagaacattcgagtgagaagagctggctatgcctatcggcgcatcttccaaaaattcctacagaggtatgccattctgaccaaagccacctggccttcttggcagggagaggagaagcaaggcgtcctgcacctgctgcagtcggtcaacatggacagcgaccagttccagctggggaggagtaaagtgttcatcaaagcccccgagtctctatttcttttagaagagatgagagagagaaagtatgatgggtatgctcgagtgatacagaaatcatggaggaaattcgtggcccggaagaaatacgttcaaatgagagaagaagcctcagacctcttattgaacaagaaggagagaaggagaaacagtattaacaggaactttataggggattatattgggatggaagagcacccagaactccagcagttcgtgggcaagagggagaagattgatttcgcagacacagtcaccaagtatgacaggaggttcaagggtgtaaagcgagacctgctccttaccccaaagtgcttgtacttaatcggacgagaaaaagtcaaacagggcccagacaagggcctggtgaaagaagtcctgaagcggaaaatcgagatagaacggatcttgtctgtgtccctcagtactatgcaggatgacatttttattctccatgagcaagagtatgacagtttgcttgaatctgtcttcaaaactgaattcctaagcctcttagcaaagcgttacgaggagaagacccagaagcaactacctctgaaattcagcaatacgcttgaactgaagttgaaaaaggaaaactggggcccctggagtgcaggggggctcccggcaagtgcagttccaccaagggtttggggacctggctgtcctcaagcccagtaacaaagtgctgcaggtcagcatcggacctggactgcccaagaactcccgataccatcagaacggagtcatcagaaaccagtatgtgccatatccccatgctcctggaagccagaggtccaatcagaaaagcctgtacacctccatggcccgcccgcccttgcctcggcagcagtctaccagttcagaccgagtgtcacagacgccagagagcctggatttcctcaaggtcccggaccagggagctgcaggggtcaggagacaaacaaccagtcggcctcccccagcagggggcagacccaagccccagcccaagcccaagcctcaggtgccacagtgcaaggctttgtatgcctatgacgctcaggacacagacgaactcagctttaatgccaatgacattattgatattatcaaagaagatccttctggctggtggacgggtcgactacgaggcaagcagggcctgttccccaacaactatgtgaccaagatctgaggtgcccgtgactctgacacatggggcagaggagctccaggcacagaccaggggaggggatatttaggggctccccttacaatccacaatgagcaattgcttctccaaggcctggagctattctggtaccttccccatggaggacactgaaaaggctgggttggggacagggagtatcactccataagtgatcctaaaaggtagcctcttcataggaacccaggaggacaaaaccaccatgcattaagatttatttattgtatttaaacctggtgagaggacaagtgaggtctgctcagaccttgtaggcttctatcaaaacagcaccctgcttgctcaccaggcctagagaatggctgtaggtggccgctgacaagtgcctttagttgaagagcacatttctttcatctctcttgtccatacctgatagacacattcctctctgccaccttccttcagggaggacccgccctctgcagactgggcttagcgtgagcaggcacttcccatgtacgtgccaagggtaagctggcctgctgagcccagggcgacagaggggcactggtttacactttgccgggaccatcagggccgccaagcaggtcaggggctgggggctgggggctgggctgctggctttgctttctctgggtcttcaattagaatgtggctggcccatattggtttgtgtttaaatgctgtacttactacaagaaggatcttttttcaagctgtacatttataaaaacagatcatatactgtatatataaaaatcttgagatggtagaaacatgtatgaatgtactaagtagtattccactgtactcattcataaggtaggttttcttacaaaactcacaccaggtacttaaagatgtgctctgcttttttccaactacggagtgtcactgctttctagctcagtccctgcagactcttctcaactctttccctataggaaacttactccgcgtcctgcccccacctcctaaataaataaaggaatcggcgaaca

SEQ ID NO: 314887 - DNA, 4650 bp, Homo sapiens
cgagactcagccagaggagtacggattaaggggccgaagaaagaggagtgaggcaggggagcgaggcggacgctccgagcgcatcggactcacctgggccggcggcgagcggcgagtacgagtggactcttgccctccgcagcatgcgccccgcctgctaagtcgccgccgtctcgccctcacctagcaccgccaatcccgcctggatggagtcccctctgggttcccattggctcctgtgagtgcttgggtgtcgggagcctgtttttggcgaggggaaccaacttttgaagttcgcccagaagactgcgttccagccccagttccccggcagcgggacccggcgaagacgcgaccgcggcgcgagtcaccatgggaagcaaaggtgtctaccagtaccactggcaaagccacaatgtcaagcacagtggtgtggacgacatggtgctactgtccaagatcacagagaactccatcgtggagaatctgaagaagagatacatggatgactacatttttacatatataggatctgtattaatctcagtcaaccctttcaagcagatgccatattttggggaaaaggaaattgaaatgtaccaaggagcggcacagtatgaaaacccaccacatatctatgcccttgcagataatatgtacagaaacatgatcattgacagagagaaccagtgcgtcattatcagtggtgaaagtggtgctggaaaaacagtggctgccaaatatatcatgagctacatctccagagtgtctggaggagggaccaaagtccagcacgtgaaggacattatcctgcagtccaacccgctgctggaggccttcgggaacgccaagaccgtccggaacaacaactccagccgatttggaaaatactttgaaatccagttcagtccaggtggggaaccagatggtggaaagatctccaacttccttctggaaaaatctagggtggtgatgaggaacccaggagagcggagttttcacatattttaccagctcatcgagggcgcctctgcagagcagaaacacagccttggcatcaccagcatggactattattactacctgagcctctcgggctcatacaaggttgatgacattgacgacaggcgggagtttcaggaaactctgcacgccatgaatgtgattgggatctttgcagaagagcaaacgctggtgttgcagatagtggcgggtattctccacctgggaaacatcagcttcaaagaagttggcaactacgcggctgtggagagtgaagagtttttagcttttcctgcatatctgctagggataaaccaggaccggttgaaagaaaagctaacaagccggcagatggatagcaagtggggaggcaaatccgaatccatccacgtgaccctcaacgtagagcaggcctgttacacccgggatgcgctcgccaaggccctgcacgcccgggtctttgatttcttggtagattccatcaataaagccatggagaaagaccatgaagaatacaacattggcgtcctagacatctatggctttgaaatattccagaaaaatggctttgaacagttttgtatcaattttgttaatgaaaaactgcagcagatttttattgaactgacattaaaggcagaacaggaagaatatgttcaagagggaataagatggacacccattgagtactttaataataaaatcgtatgtgacctcatagagaacaaagtgaaccctcctggcatcatgagcatcctggatgacgtgtgcgccacgatgcatgcggtgggtgagggggcagatcagacgctgctccagaaacttcagatgcagattgggagtcatgagcacttcaacagttggaaccaaggcttcatcattcatcattatgctgggaaggtatcctatgacatggatggcttttgtgaaaggaaccgggatgtgctttttatggatctcatcgagcttatgcagagcagcgagctgcctttcataaagtctttatttccggaaaatctgcaggctgacaagaaagggcgcccaactactgccggaagcaaaataaagaaacaagccaatgaccttgtgagcaccctgatgaaatgtacgccccactacattcgctgcatcaagccaaacgaaaccaagaagcccagagactgggaggaaagcagggtaaagcatcaagtcgaatatttgggtctgaaagagaacattcgagtgagaagagctggctatgcctatcggcgcatcttccaaaaattcctacagaggtatgccattctgaccaaagccacctggccttcttggcagggagaggagaagcaaggcgtcctgcacctgctgcagtcggtcaacatggacagcgaccagttccagctggggaggagtaaagtgttcatcaaagcccccgagtctctatttcttttagaagagatgagagagagaaagtatgatgggtatgctcgagtgatacagaaatcatggaggaaattcgtggcccggaagaaatacgttcaaatgagagaagaagcctcagacctcttattgaacaagaaggagagaaggagaaacagtattaacaggaactttataggggattatattgggatggaagagcacccagaactccagcagttcgtgggcaagagggagaagattgatttcgcagacacagtcaccaagtatgacaggaggttcaagggtgtaaagcgagacctgctccttaccccaaagtgcttgtacttaatcggacgagaaaaagtcaaacagggcccagacaagggcctggtgaaagaagtcctgaagcggaaaatcgagatagaacggatcttgtctgtgtccctcagtactatgcaggatgacatttttattctccatgagcaagagtatgacagtttgcttgaatctgtcttcaaaactgaattcctaagcctcttagcaaagcgttacgaggagaagacccagaagcaactacctctgaaattcagcaatacgcttgaactgaagttgaaaaaggaaaactggggcccctggagtgcaggggggctcccggcaagtgcagttccaccaagggtttggggacctggctgtcctcaagcccagtaacaaagtgctgcaggtcagcatcggacctggactgcccaagaactcccgtcctaccagaaggaacactacccaaaatacaggttattccagtgggactcaaaatgccaactacccagtgagagctgcccctcctcccccaggataccatcagaacggagtcatcagaaaccagtatgtgccatatccccatgctcctggaagccagaggtccaatcagaaaagcctgtacacctccatggcccgcccgcccttgcctcggcagcagtctaccagttcagaccgagtgtcacagacgccagagagcctggatttcctcaaggtcccggaccagggagctgcaggggtcaggagacaaacaaccagtcggcctcccccagcagggggcagacccaagccccagcccaagcccaagcctcaggtgccacagtgcaaggctttgtatgcctatgacgctcaggacacagacgaactcagctttaatgccaatgacattattgatattatcaaagaagatccttctggctggtggacgggtcgactacgaggcaagcagggcctgttccccaacaactatgtgaccaagatctgaggtgcccgtgactctgacacatggggcagaggagctccaggcacagaccaggggaggggatatttaggggctccccttacaatccacaatgagcaattgcttctccaaggcctggagctattctggtaccttccccatggaggacactgaaaaggctgggttggggacagggagtatcactccataagtgatcctaaaaggtagcctcttcataggaacccaggaggacaaaaccaccatgcattaagatttatttattgtatttaaacctggtgagaggacaagtgaggtctgctcagaccttgtaggcttctatcaaaacagcaccctgcttgctcaccaggcctagagaatggctgtaggtggccgctgacaagtgcctttagttgaagagcacatttctttcatctctcttgtccatacctgatagacacattcctctctgccaccttccttcagggaggacccgccctctgcagactgggcttagcgtgagcaggcacttcccatgtacgtgccaagggtaagctggcctgctgagcccagggcgacagaggggcactggtttacatttgctttctctgggtcttcaattagaatgtggctggcccatattggtttgtgtttaaatgctgtacttactacaagaaggatcttttttcaagctgtacatttataaaaacagatcatatactgtatatataaaaatcttgagatggtagaaacatgtatgaatgtactaagtagtattccactgtactcattcataaggtaggttttcttacaaaactcacaccaggtacttaaagatgtgctctgcttttttccaactacggagtgtcactgctttctagctcagtccctgcagactcttctcaactctttccctataggaaacttactccgcgtcctgcccccacctcctaaataaataaaggaatcggcgaaca

SEQ ID NO: 314888 - DNA, 1362 bp, Homo sapiens
gctcaggaccagatcgtactcagctttaatgccaatgacattattgatattatcaaagaagatccttctggctggtggacgggtcgactacgaggcaagcagggcctgttccccaacaactatgtgaccaagatctgaggtgcccgtgactctgacacatggggcagaggagctccaggataccatcagaacggagtcatcagaaaccagtatgtgccatatccccatgctcctggaagccagaggtccaatcagaaaagcctgtacacctccatggcccgcccgcccttgcctcggcagcagtctaccagttcagaccgagtgtcacagacgccagagagcctggatttcctcaaggtcccggaccagggagctgcaggggtcaggagacaaacaaccagtcggcctcccccagcagggggcagacccaagccccagcccaagcccaagcctcaggtgccacagtgcaaggctttgtatgcctatgagacactgaaaaggctgggttggggacagggagtatcactccataagtgatcctaaaaggtagcctcttcataggaacccaggaggacaaaaccaccatgcattaagatttatttattgtatttaaacctggtgagaggacaagtgaggtctgctcagaccttgtaggcttctatcaaaacagcaccctgcttgctcaccaggcctagagaatggctgtaggtggccgctgacaagtgcctttagttgaagagcacatttctttcatctctcttgtccatacctgatagacacattcctctctgccaccttccttcagggaggacccgccctctgcagactgggcttagcgtgagcaggcacttcccatgtacgtgccaagggtaagctggcctgctgagcccagggcgacagaggggcactggtttacactttgccgggaccatcagggccgccaagcaggtcaggggctgggggctgggggctgggctgctggctttgctttctctgggtcttcaattagaatgtggctggcccatattggtttgtgtttaaatgctgtacttactacaagaaggatcttttttcaagctgtacatttataaaaacagatcatatactgtatatataaaaatcttgagatggtagaaacatgtatgaatgtactaagtagtattccactgtactcattcataaggtaggttttcttacaaaactcacaccaggtacttaaagatgtgctctgcttttttccaactacggagtgtcactgctttctagctcagtccctgcagactcttctcaactctttccctataggaaacttactccgcgtcctgcccccacctcctaaataaataaaggaatcggcgaaca

SEQ ID NO: 314889 - DNA, 3212 bp, Homo sapiens
cgagactcagccagaggagtacggattaaggggccgaagaaagaggagtgaggcaggggagcgaggcggacgctccgagcgcatcggactcacctgggccggcggcgagcggcgagtacgagtggactcttgccctccgcagcatgcgccccgcctgctaagtcgccgccgtctcgccctcacctagcaccgccaatcccgcctggatggagtcccctctgggttcccattggctcctgtgagtgcttgggtgtcgggagcctgtttttggcgaggggaaccaacttttgaagttcgcccagaagactgcgttccagccccagttccccggcagcgggacccggcgaagacgcgaccgcggcgcgagtcaccatgggaagcaaaggtgtctaccagtaccactggcaaagccacaatgtcaagcacagtggtgtggacgacatggtgctactgtccaagatcacagagaactccatcgtggagaatctgaagaagagatacatggatgactacatttttacatatataggatctgtattaatctcagtcaaccctttcaagcagatgccatattttggggaaaaggaaattgaaatgtaccaaggagcggcacagtatgaaaacccaccacatatctatgcccttgcagataatatgtacagaaacatgatcattgacagagagaaccagtgcgtcattatcagtggtgaaagtggtgctggaaaaacagtggctgccaaatatatcatgagctacatctccagagtgtctggaggagggaccaaagtccagcacgtgaaggacattatcctgcagtccaacccgctgctggaggccttcgggaacgccaagaccgtccggaacaacaactccagccgatttggaaaatactttgaaatccagttcagtccaggtggggaaccagatggtggaaagatctccaacttccttctggaaaaatctagggtggtgatgaggaacccaggagagcggagttttcacatattttaccagctcatcgagggcgcctctgcagagcagaaacacagccttggcatcaccagcatggactattattactacctgagcctctcgggctcatacaaggttgatgacattgacgacaggcgggagtttcaggaaactctgcacgccatgaatgtgattgggatctttgcagaagagcaaacgctggtgttgcagatagtggcgggtattctccacctgggaaacatcagcttcaaagaagttggcaactacgcggctgtggagagtgaagagtttttagcttttcctgcatatctgctagggataaaccaggaccggttgaaagaaaagctaacaagccggcagatggatagcaagtggggaggcaaatccgaatccatccacgtgaccctcaacgtagagcaggcctgttacacccgggatgcgctcgccaaggccctgcacgcccgggtctttgatttcttggtagattccatcaataaagccatggagaaagaccatgaagaatacaacattggcgtcctagacatctatggctttgaaatattccagaaaaatggctttgaacagttttgtatcaattttgttaatgaaaaactgcagcagatttttattgaactgacattaaaggcagaacaggaagaatatgttcaagagggaataagatggacacccattgagtactttaataataaaatcgtatgtgacctcatagagaacaaagtgaaccctcctggcatcatgagcatcctggatgacgtgtgcgccacgatgcatgcggtgggtgagggggcagatcagacgctgctccagaaacttcagatgcagattgggagtcatgagcacttcaacagttggaaccaaggcttcatcattcatcattatgctgggaaggtatcctatgacatggatggcttttgtgaaaggaaccgggatgtgctttttatggatctcatcgagcttatgcagagcagcgagctgcctttcataaagtctttatttccggaaaatctgcaggctgacaagaaagggcgcccaactactgccggaagcaaaataaagaaacaagccaatgaccttgtgagcaccctgatgaaatgtacgccccactacattcgctgcatcaagccaaacgaaaccaagaagcccagagactgggaggaaagcagggtaaagcatcaagtcgaatatttgggtctgaaagagaacattcgagtgagaagagctggctatgcctatcggcgcatcttccaaaaattcctacagaggtaatgaactagtgactctggccttttttaaaacaggtttattgagctataattcaaatctatacaattcacccacttcaagcgtacgagtcaatggcttttaacgtattcacagagttgtgcaactatcaccaccgttaattttaggacattttcttaccctgaaaagaaatcacgcttccctttgttgtcaacctccaattctccccttgcctctgggcccagtcagtcacttatctaccttctgtctatagatttgcctatgcttttcatagcaatggaatcatatatgtgtcctctgtgactgacttctttcactgaacataagattcatccatgttgttgcatttccatgcttccttcctgttaattgcagaataatattccattgtgtggatataccacagtttacttatgcattcatcagttgataaacgtcagttgtttccacttcttggctattatgaataatgctgctatgaaaatctgtgtacaagtttttatgtggtcatatttcatttctttcgggtatatgcttcaaagtgcaattgcttggtcatatggtaactctgcatttaacctttgagaggaactgcctgattgttttctgaagtggctgcaccacttcacattttgtaccaccagcagtatttgaggcttccaatttatctaaatccttgccaacataagttattttctaaccatcctagtgagtgtggagtggtatttcatgatggttttgatttgcatttcccagatggcaaattatattgaggattttttcatgtgcctgttagccatttgtatttcctctttggagaaatgtctgtgaggccctttgccattttttaattgggtgttttgtctttttatcattgcattgtaataataattcttttactgttatttattgtagaataaatcagtagccataag

SEQ ID NO: 314890 - DNA, 1970 bp, Homo sapiens
cgagactcagccagaggagtacggattaaggggccgaagaaagaggagtgaggcaggggagcgaggcggacgctccgagcgcatcggactcacctgggccggcggcgagcggcgagtacgagtggactcttgccctccgcagcatgcgccccgcctgctaagtcgccgccgtctcgccctcacctagcaccgccaatcccgcctggatggagtcccctctgggttcccattggctcctgtgagtgcttgggtgtcgggagcctgtttttggcgaggggaaccaacttttgaagttcgcccagaagactgcgttccagccccagttccccggcagcgggacccggcgaagacgcgaccgcggcgcgagtcaccatgggaagcaaaggtgtctaccagtaccactggcaaagccacaatgtcaagcacagtggtgtggacgacatggtgctactgtccaagatcacagagaactccatcgtggagaatctgaagaagagatacatggatgactacatttttacatatataggatctgtattaatctcagtcaaccctttcaagcagatgccatattttggggaaaaggaaattgaaatgtaccaaggagcggcacagtatgaaaacccaccacatatctatgcccttgcagataatatgtacagaaacatgatcattgacagagagaaccagtgcgtcattatcagtggtgaaagtggtgctggaaaaacagtggctgccaaatatatcatgagctacatctccagagtgtctggaggagggaccaaagtccagcacgtgaaggacattatcctgcagtccaacccgctgctggaggccttcgggaacgccaagaccgtccggaacaacaactccagccgatttggaaaatactttgaaatccagttcagtccaggtggggaaccagatggtggaaagatctccaacttccttctggaaaaatctagggtggtgatgaggaacccaggagagcggagttttcacatattttaccagctcatcgagggcgcctctgcagagcagaaacacagccttggcatcaccagcatggactattattactacctgagcctctcgggctcatacaaggttgatgacattgacgacaggcgggagtttcaggaaactctgcacgccatgaatgtgattgggatctttgcagaagagcaaacgctggtgttgcagatagtggcgggtattctccacctgggaaacatcagcttcaaagaagttggcaactacgcggctgtggagagtgaagagtttttagcttttcctgcatatctgctagggataaaccaggaccggttgaaagaaaagctaacaagccggcagatggatagcaagtggggaggcaaatccgaatccatccacgtgaccctcaacgtagagcaggcctgttacacccgggatgcgctcgccaaggccctgcacgcccgggtctttgatttcttggtagattccatcaataaagccatggagaaagaccatgaagaatacaacattggcgtcctagacatctatggctttgaaatattccagaaaaatggctttgaacagttttgtatcaattttgttaatgaaaaactgcagcagatttttattgaactgacattaaaggcagaacaggaagaatatgttcaagagggaataagatggacacccattgagtactttaataataaaatcgtatgtgacctcatagagaacaaagtgaaccctcctggcatcatgagcatcctggatgacgtgtgcgccacgatgcatgcggtgggtgagggggcagatcagacgctgctccagaaacttcagatgcagattgggagtcatgagcacttcaacagttggaagctaggaatcatgagccatgagcattgtgcgataggtgacgaaatgagacgcatcggtcccttgatatgtccttgcagggggcgttcaccgaacgcgtgggg

SEQ ID NO: 314891 - DNA, 3295 bp, Homo sapiens
agcggtgtcaaaggcttgtgagaatctggtggatgctggaccttgctgctgctgctactgctgtttccaggggctgcagagcatggactgttaaatcttgcacttcttctgagtgagctgaattcttgccgccaggatggggaaacagaacagcaagctgcgcccggaggtcatgcaggacttgctggaaagcacagactttacagagcatgagatccaggaatggtataaaggcttcttgagagactgccccagtggacatttgtcaatggaagagtttaagaaaatatatgggaactttttcccttatggggatgcttccaaatttgcagagcatgtcttccgcaccttcgatgcaaatggagatgggacaatagactttagagaattcatcatcgccttgagtgtaacttcgagggggaagctggagcagaagctgaaatgggccttcagcatgtacgacctggacggaaatggctatatcagcaaggcagagatgctagagatcgtgcaggcaatctataagatggtttcctctgtaatgaaaatgcctgaagatgagtcaaccccagagaaaagaacagaaaagatcttccgccagatggacaccaatagagacggaaaactctccctggaagagttcatccgaggagccaaaagcgacccgtccattgtgcgcctcctgcagtgcgacccgagcagtgccggccagttctgagccctgcgcccaccaatcgaattgtagagctgcttgtgttcccttttgattcttctttttaacaatttttttttttttttgccaaacaatatcaatggtgatgccgtcccctgtgcggtctgatgcgccttcctccgtgacgccttcagcttcttttgtcgtggatgcttcgtgggaatgcccagagccccagtgtgcttgtggagagcatggacagacttcgtggtgttcattgtttgatgatttttaatcgttactattatttttttttattctaatgtctctgttctaaaacgtaagactcgggggttggggcaaaagaagggaaacccatccagtcctgtgattctattgcaagcttcaaggggcttttgtttgaaagacaaaactccccacctgggtctgttgtcacacgtgccgtaggggtgatggatggcaccggatgctggattccccaagaacaagttaccctctggggtgaggctattccagcgagctgggacatttccccatgggggcccactcccctctcttccccagcaggctgtagtttctaagctgtgaacatttcaagataaattaacagaggagaggaaaaagatggctcagctattttttcacaggtttacactagttgagctaatatgcgtgtctttggaaattaaacacaaatggtaacatattccaaaaccagacccatcttgttgcctattgtgataaaataaaaagacggctgtatataacatattgggtaatgcagaccaaattaagtgttttgccttgtttaaatgaaatgcatgtttagtgagcactaatacaatcttattccagaagactgtttttagtagcttattgtgaagtaagacaactataatgaatgtctgtcttgtttggaagtcatatctgtctttgcacaaatgtaccaatcgacaagtatattttatatattccataaaaatacaaagtaaccctgactagggcccaactttaattttgaatgcatttccagagtggccatgcctagagggcagatgcagagcaggtggtagtgggacaggacaattggagcacaggaatgttaacatgtatgacaggggaccagtagggtggtttccctctcaggcccagcagcccattgacagcattagactggcggcatggtgcttttctgagcagatcaatactctgcagactcgaaaaaacatcacatacattcttggaacttcccagtggtttaatctatgtgcatggttagggagccaggtctggaatattcagtttccctgcccctgttaaagaatcagaggttgggcagtcatcaaattcatcataaagacatgggcaagtgtgtctgtggtttccaaggcccccctatggagaatccaaaagtattttccattgccgtgctctttgaatgcagacttctatttccagaagtgacagcacaagtctgagttgctgtttggtctggtgacctcagacacactaatttgaattgaaagctaagagtaaaaatttgctggttacaggcgagtcatactcttgcaagtagttagcaaagggaggcccaaattctcaaggttgttgatggggaacttgccactaagagaaggcagagaggtccctagtgggtatatttgctgccaagccacttgccaaagaagaggaaccacagaaagagagacatcatgaccaggagaaaaatgtgactagacatgctaacctccaggtttttatatatgacttgagtctgctgtaattggcagcagaaatccaaatttgtatggtagaccaaaaagaaccaaatccatagggtgaaattttgagacctagactctgtaaaaataatcctagtcttcctccaggggtcagttcctcacagtggttctgtaccaaaacttgccaaattcctccatggccaagtgttaaaatctgtgtttggaaaatagcgaattaacctaagacacagaaggcagactgggtgaggagacctagcatgccctattggcagtgctcaggagctgcatcccacttttccctgctctgaatcgaagtcctagttccttcctttgattctcctttggtaggtggaatcagttaatgttttgagaaacctgcctgggctctgcccttagtcatgacatctcgctgagccagacccactctgttccttggaacctagagctggagtgaggagtagaggtctccggctattccagaaagaaaagtgagccacatgcaggctgatgaatgccgacacttccagaatgtatagaaatagtccctgtcctggcctgccactgaccctgtctgtattttctcggaggttgtttttctccttctccttcccaggaaggtctttgtatgtcgaatccagtgcactcaagtttggccaagggactccacagcacccagaagactgcatgcctcaaggtttatgtcactcctctgctgggctgttcattgtcattgctgtgttcagggacctttggaaataaaacctgttctgtcccaaataaaaccagcctgtgatgttcaagggactggaataaagtggcttacgacctgaaggattct

SEQ ID NO: 314892 - DNA, 3365 bp, Homo sapiens
  misc_feature (59)..(59): n is a, c, g, or t
gggggaggcgggcggagggaaggcgctgccgctgctgccgccgcctcgcccgaagcganacagacgctgggagcggccgaggcgagtgatttcttctgacttgagcctgcagtgtgctgtgagagatctaccactagattatctcaactttggtctcctgggaccactcgttgctgacagtcagaaactgaattcttgccgccaggatggggaaacagaacagcaagctgcgcccggaggtcatgcaggacttgctggaaagcacagactttacagagcatgagatccaggaatggtataaaggcttcttgagagactgccccagtggacatttgtcaatggaagagtttaagaaaatatatgggaactttttcccttatggggatgcttccaaatttgcagagcatgtcttccgcaccttcgatgcaaatggagatgggacaatagactttagagaattcatcatcgccttgagtgtaacttcgagggggaagctggagcagaagctgaaatgggccttcagcatgtacgacctggacggaaatggctatatcagcaaggcagagatgctagagatcgtgcaggcaatctataagatggtttcctctgtaatgaaaatgcctgaagatgagtcaaccccagagaaaagaacagaaaagatcttccgccagatggacaccaatagagacggaaaactctccctggaagagttcatccgaggagccaaaagcgacccgtccattgtgcgcctcctgcagtgcgacccgagcagtgccggccagttctgagccctgcgcccaccaatcgaattgtagagctgcttgtgttcccttttgattcttctttttaacaatttttttttttttttgccaaacaatatcaatggtgatgccgtcccctgtgcggtctgatgcgccttcctccgtgacgccttcagcttcttttgtcgtggatgcttcgtgggaatgcccagagccccagtgtgcttgtggagagcatggacagacttcgtggtgttcattgtttgatgatttttaatcgttactattatttttttttattctaatgtctctgttctaaaacgtaagactcgggggttggggcaaaagaagggaaacccatccagtcctgtgattctattgcaagcttcaaggggcttttgtttgaaagacaaaactccccacctgggtctgttgtcacacgtgccgtaggggtgatggatggcaccggatgctggattccccaagaacaagttaccctctggggtgaggctattccagcgagctgggacatttccccatgggggcccactcccctctcttccccagcaggctgtagtttctaagctgtgaacatttcaagataaattaacagaggagaggaaaaagatggctcagctattttttcacaggtttacactagttgagctaatatgcgtgtctttggaaattaaacacaaatggtaacatattccaaaaccagacccatcttgttgcctattgtgataaaataaaaagacggctgtatataacatattgggtaatgcagaccaaattaagtgttttgccttgtttaaatgaaatgcatgtttagtgagcactaatacaatcttattccagaagactgtttttagtagcttattgtgaagtaagacaactataatgaatgtctgtcttgtttggaagtcatatctgtctttgcacaaatgtaccaatcgacaagtatattttatatattccataaaaatacaaagtaaccctgactagggcccaactttaattttgaatgcatttccagagtggccatgcctagagggcagatgcagagcaggtggtagtgggacaggacaattggagcacaggaatgttaacatgtatgacaggggaccagtagggtggtttccctctcaggcccagcagcccattgacagcattagactggcggcatggtgcttttctgagcagatcaatactctgcagactcgaaaaaacatcacatacattcttggaacttcccagtggtttaatctatgtgcatggttagggagccaggtctggaatattcagtttccctgcccctgttaaagaatcagaggttgggcagtcatcaaattcatcataaagacatgggcaagtgtgtctgtggtttccaaggcccccctatggagaatccaaaagtattttccattgccgtgctctttgaatgcagacttctatttccagaagtgacagcacaagtctgagttgctgtttggtctggtgacctcagacacactaatttgaattgaaagctaagagtaaaaatttgctggttacaggcgagtcatactcttgcaagtagttagcaaagggaggcccaaattctcaaggttgttgatggggaacttgccactaagagaaggcagagaggtccctagtgggtatatttgctgccaagccacttgccaaagaagaggaaccacagaaagagagacatcatgaccaggagaaaaatgtgactagacatgctaacctccaggtttttatatatgacttgagtctgctgtaattggcagcagaaatccaaatttgtatggtagaccaaaaagaaccaaatccatagggtgaaattttgagacctagactctgtaaaaataatcctagtcttcctccaggggtcagttcctcacagtggttctgtaccaaaacttgccaaattcctccatggccaagtgttaaaatctgtgtttggaaaatagcgaattaacctaagacacagaaggcagactgggtgaggagacctagcatgccctattggcagtgctcaggagctgcatcccacttttccctgctctgaatcgaagtcctagttccttcctttgattctcctttggtaggtggaatcagttaatgttttgagaaacctgcctgggctctgcccttagtcatgacatctcgctgagccagacccactctgttccttggaacctagagctggagtgaggagtagaggtctccggctattccagaaagaaaagtgagccacatgcaggctgatgaatgccgacacttccagaatgtatagaaatagtccctgtcctggcctgccactgaccctgtctgtattttctcggaggttgtttttctccttctccttcccaggaaggtctttgtatgtcgaatccagtgcactcaagtttggccaagggactccacagcacccagaagactgcatgcctcaaggtttatgtcactcctctgctgggctgttcattgtcattgctgtgttcagggacctttggaaataaaacctgttctgtcccaaataaaaccagcctgtgatgttcaagggactggaataaagtggcttacgacctgaaggattct

SEQ ID NO: 314893 - DNA, 760 bp, Homo sapiens
agcggaaagcttggttatggccaggcccagtggctcatgtctgtaatcccagcacttgggaggtcgaggcaggaggattgcttgagcccaggagttcaaaaacagcctggccaacaagagatcctatcattattttaaaattcctcctcctccacgaagtccttcctgattccttcaaagaaatatcactcctccgaattcccagagtgatttcttctgacttgagcctgcagtgtgctgtgagagatctaccactagaagagtcatgtccttgggcttcagcttttgccttgttctaggctccaagataggcccatccaggcatggctgtgccttgactgacattggactccatgctctggagaggaccaggggctcagcatggagggtgctggccacttggtcctacctgtggatgcctgagggacagtctgaagcaggacaaacagaccacagaagttctcaggcatctctgtagcttgaggatcaggatggatatccatcgtggaaacttattgctgaacgagacccaggaaactgaacctctgaaaacatatatattgcaacaggttgtagttataatatattgctacctgtgacctattcccaaaaccaagaccaacattggaaatgattctcccagaaggagggctggctgagacgtgtctggttggcattgcctgcatggcttggtctagcacctgcggcctccaaaaccaaaggaaatgcctggtcctgctaattcctgagccatttgggg

SEQ ID NO: 314894 - DNA, 3491 bp, Homo sapiens
agcggtgtcaaaggcttgtgagaatctggtggatgctggaccttgctgctgctgctactgctgtttccaggggctgcagagcatggactgttaaatcttgcacttcttctgagtgagctgaattcttgccgccaggatggggaaacagaacagcaagctgcgcccggaggtcatgcaggacttgctggaaagcacagactttacagagcatgagatccaggaatggtataaaggcttcttgagagactgccccagtggacatttgtcaatggaagagtttaagaaaatatatgggaactttttcccttatggggatgcttccaaatttgcagagcatgtcttccgcaccttcgatgcaaatggagatgggacaatagactttagagaattcatcatcgccttgagtgtaacttcgagggggaagctggagcagaagctgaaatgggccttcagcatgtacgacctggacggaaatggctatatcagcaaggcagagatgctagagatcgtgcaggcaatctataagatggtttcctctgtaatgaaaatgcctgaagatgagtcaaccccagagaaaagaacagaaaagatcttccgccagatggacaccaatagagacggaaaactctccctggaagagttcatccgaggagccaaaagcgacccgtccattgtgcgcctcctgcagtgcgacccgagcagtgccggccagttctgagccctgcgcccaccaatcgaattgtagagctgcttgtgttcccttttgattcttctttttaacaatttttttttttttttgccaaacaatatcaatggtgatgccgtcccctgtgcggtctgatgcgccttcctccgtgacgccttcagcttcttttgtcgtggatgcttcgtgggaatgcccagagccccagtgtgcttgtggagagcatggacagacttcgtggtgttcattgtttgatgatttttaatcgttactattatttttttttattctaatgtctctgttctaaaacgtaagactcgggggttggggcaaaagaagggaaacccatccagtcctgtgattctattgcaagcttcaaggggcttttgtttgaaagacaaaactccccacctgggtctgttgtcacacgtgccgtaggggtgatggatggcaccggatgctggattccccaagaacaagttaccctctggggtgaggctattccagcgagctgggacatttccccatgggggcccactcccctctcttccccagcaggctgtagtttctaagctgtgaacatttcaagataaattaacagaggagaggaaaaagatggctcagctattttttcacaggtttacactagttgagctaatatgcgtgtctttggaaattaaacacaaatggtaacatattccaaaaccagacccatcttgttgcctattgtgataaaataaaaagacggctgtatataacatattgggtaatgcagaccaaattaagtgttttgccttgtttaaatgaaatgcatgtttagtgagcactaatacaatcttattccagaagactgtttttagtagcttattgtgaagtaagacaactataatgaatgtctgtcttgtttggaagtcatatctgtctttgcacaaatgtaccaatcgacaagtatattttatatattccataaaaatacaaagtaaccctgactagggcccaactttaattttgaatgcatttccagagtggccatgcctagagggcagatgcagagcaggtggtagtgggacaggacaattggagcacaggaatgttaacatgtatgacaggggaccagtagggtggtttccctctcaggcccagcagcccattgacagcattagactggcggcatggtgcttttctgagcagatcaatactctgcagactcgaaaaaacatcacatacattcttggaacttcccagtggtttaatctatgtgcatggttagggagccaggtctggaatattcagtttccctgcccctgttaaagaatcagaggttgggcagtcatcaaattcatcataaagacatgggcaagtgtgtctgtggtttccaaggcccccctatggagaatccaaaagtattttccattgccgtgctctttgaatgcagacttctatttccagaagtgacagcacaagtctgagttgctgtttggtctggtgacctcagacacactaatttgaattgaaagctaagagtaaaaatttgctggttacaggcgagtcatactcttgcaagtagttagcaaagggaggcccaaattctcaaggttgttgatggggaacttgccactaagagaaggcagagaggtccctagtgggtatatttgctgccaagccacttgccaaagaagaggaaccacagaaagagagacatcatgaccaggagaaaaatgtgactagacatgctaacctccaggtttttatatatgacttgagtctgctgtaattggcagcagaaatccaaatttgtatggtagaccaaaaagaaccaaatccatagggtgaaattttgagacctagactctgtaaaaataatcctagtcttcctccaggggtcagttcctcacagtggttctgtaccaaaacttgccaaattcctccatggccaagtgttaaaatctgtgtttggaaaatagcgaattaacctaagacacagaaggcagactgggtgaggagacctagcatgccctattggcagtgctcaggagctgcatcccacttttccctgctctgaatcgaagtcctagttccttcctttgattctcctttggtaggtggaatcagttaatgttttgagaaacctgcctgggctctgcccttagtcatgacatctcgctgagccagacccactctgttccttggaacctagagctggagtgaggagtagaggtctccggctattccagaaagaaaagtgagccacatgcaggctgatgaatgccgacacttccagaatgtatagaaatagtccctgtcctggcctgccactgaccctgtctgtattttctcggaggttgtttttctccttctccttcccaggaaggtctttgtatgtcgaatccagtgcactcaagtttggccaagggactccacagcacccagaagactgcatgcctcaaggtttatgtcactcctctgctgggctgttcattgtcattgctgtgttcagggacctttggaaataaaacctgttctgtcccaaataaaaccagcctgtgatgttcaagggactggaataaagtggcttacgacctgaaggattctacagagtgctcaactgttcatacatcattcagagtgggagggagctgggggtgctgtcccatcccatctgtatgcccacggtggatttaataatatataatttataaatcatagcctatggagtggcccgtaaatcagttgactgtgtagctcttgcctggcattaaagcatgtttttggtttaacatgaaaaaca

SEQ ID NO: 314895 - DNA, 3825 bp, Homo sapiens
agcggaaagcttggttatggccaggcccagtggctcatgtctgtaatcccagcacttgggaggtcgaggcaggaggattgcttgagcccaggagttcaaaaacagcctggccaacaagagatcctatcattattttaaaattcctcctcctccacgaagtccttcctgattccttcaaagaaatatcactcctccgaattcccagagtgatttcttctgacttgagcctgcagtgtgctgtgagagatctaccactagattatctcaactttggtctcctgggaccactcgttgctgacagtcagaaattgcaaggcatctgatctcctggtgttaaaatctgtcgtgataccgaggaaggccccgagatcccaggcactgagtgactgcatactaagaaaaagaactctgaaatgaaattgaggatttgaacttcacacagctgtttgaactgaattcttgccgccaggatggggaaacagaacagcaagctgcgcccggaggtcatgcaggacttgctggaaagcacagactttacagagcatgagatccaggaatggtataaaggcttcttgagagactgccccagtggacatttgtcaatggaagagtttaagaaaatatatgggaactttttcccttatggggatgcttccaaatttgcagagcatgtcttccgcaccttcgatgcaaatggagatgggacaatagactttagagaattcatcatcgccttgagtgtaacttcgagggggaagctggagcagaagctgaaatgggccttcagcatgtacgacctggacggaaatggctatatcagcaaggcagagatgctagagatcgtgcaggcaatctataagatggtttcctctgtaatgaaaatgcctgaagatgagtcaaccccagagaaaagaacagaaaagatcttccgccagatggacaccaatagagacggaaaactctccctggaagagttcatccgaggagccaaaagcgacccgtccattgtgcgcctcctgcagtgcgacccgagcagtgccggccagttctgagccctgcgcccaccaatcgaattgtagagctgcttgtgttcccttttgattcttctttttaacaatttttttttttttttgccaaacaatatcaatggtgatgccgtcccctgtgcggtctgatgcgccttcctccgtgacgccttcagcttcttttgtcgtggatgcttcgtgggaatgcccagagccccagtgtgcttgtggagagcatggacagacttcgtggtgttcattgtttgatgatttttaatcgttactattatttttttttattctaatgtctctgttctaaaacgtaagactcgggggttggggcaaaagaagggaaacccatccagtcctgtgattctattgcaagcttcaaggggcttttgtttgaaagacaaaactccccacctgggtctgttgtcacacgtgccgtaggggtgatggatggcaccggatgctggattccccaagaacaagttaccctctggggtgaggctattccagcgagctgggacatttccccatgggggcccactcccctctcttccccagcaggctgtagtttctaagctgtgaacatttcaagataaattaacagaggagaggaaaaagatggctcagctattttttcacaggtttacactagttgagctaatatgcgtgtctttggaaattaaacacaaatggtaacatattccaaaaccagacccatcttgttgcctattgtgataaaataaaaagacggctgtatataacatattgggtaatgcagaccaaattaagtgttttgccttgtttaaatgaaatgcatgtttagtgagcactaatacaatcttattccagaagactgtttttagtagcttattgtgaagtaagacaactataatgaatgtctgtcttgtttggaagtcatatctgtctttgcacaaatgtaccaatcgacaagtatattttatatattccataaaaatacaaagtaaccctgactagggcccaactttaattttgaatgcatttccagagtggccatgcctagagggcagatgcagagcaggtggtagtgggacaggacaattggagcacaggaatgttaacatgtatgacaggggaccagtagggtggtttccctctcaggcccagcagcccattgacagcattagactggcggcatggtgcttttctgagcagatcaatactctgcagactcgaaaaaacatcacatacattcttggaacttcccagtggtttaatctatgtgcatggttagggagccaggtctggaatattcagtttccctgcccctgttaaagaatcagaggttgggcagtcatcaaattcatcataaagacatgggcaagtgtgtctgtggtttccaaggcccccctatggagaatccaaaagtattttccattgccgtgctctttgaatgcagacttctatttccagaagtgacagcacaagtctgagttgctgtttggtctggtgacctcagacacactaatttgaattgaaagctaagagtaaaaatttgctggttacaggcgagtcatactcttgcaagtagttagcaaagggaggcccaaattctcaaggttgttgatggggaacttgccactaagagaaggcagagaggtccctagtgggtatatttgctgccaagccacttgccaaagaagaggaaccacagaaagagagacatcatgaccaggagaaaaatgtgactagacatgctaacctccaggtttttatatatgacttgagtctgctgtaattggcagcagaaatccaaatttgtatggtagaccaaaaagaaccaaatccatagggtgaaattttgagacctagactctgtaaaaataatcctagtcttcctccaggggtcagttcctcacagtggttctgtaccaaaacttgccaaattcctccatggccaagtgttaaaatctgtgtttggaaaatagcgaattaacctaagacacagaaggcagactgggtgaggagacctagcatgccctattggcagtgctcaggagctgcatcccacttttccctgctctgaatcgaagtcctagttccttcctttgattctcctttggtaggtggaatcagttaatgttttgagaaacctgcctgggctctgcccttagtcatgacatctcgctgagccagacccactctgttccttggaacctagagctggagtgaggagtagaggtctccggctattccagaaagaaaagtgagccacatgcaggctgatgaatgccgacacttccagaatgtatagaaatagtccctgtcctggcctgccactgaccctgtctgtattttctcggaggttgtttttctccttctccttcccaggaaggtctttgtatgtcgaatccagtgcactcaagtttggccaagggactccacagcacccagaagactgcatgcctcaaggtttatgtcactcctctgctgggctgttcattgtcattgctgtgttcagggacctttggaaataaaacctgttctgtcccaaataaaaccagcctgtgatgttcaagggactggaataaagtggcttacgacctgaaggattctacagagtgctcaactgttcatacatcattcagagtgggagggagctgggggtgctgtcccatcccatctgtatgcccacggtggatttaataatatataatttataaatcatagcctatggagtggcccgtaaatcagttgactgtgtagctcttgcctggcattaaagcatgtttttggtttaacatgaaaaaca

SEQ ID NO: 314896 - DNA, 3244 bp, Homo sapiens
agcggtgtcaaaggcttgtgagaatctggtggatgctggaccttgctgctgctgctactgctgtttccaggggctgcagagcatggactgttaaatcttgcacttcttctgagtgagctgaattcttgccgccaggatggggaaacagaacagcaagctgcgcccggaggtcatgcaggacttgctggaaagcacagactttacagagcatgagatccaggaatggtataaaggcttcttgagagactgccccagtggacatttgtcaatggaagagtttaagaaaatatatgggaactttttcccttatggggatgcttccaaatttgcagagcatgtcttccgcaccttcgatgcaaatggagatgggacaatagactttagagaattcatcatcgccttgagtgtaacttcgagggggaagctggagcagaagctgaaatgggccttcagcatgtacgacctggacggaaatggctatatcagcaaggcagagatgctagagatcgtgcaggcaatctataagatggtttcctctgtaatgaaaatgcctgaagatgagtcaaccccagagaaaagaacagaaaagatcttccgccagatggacaccaatagagacggaaaactctccctggaagagttcatccgaggagccaaaagcgacccgtccattgtgcgcctcctgcagtgcgacccgagcagtgccggccagttctgagccctgcgcccaccaatcgaattgtagagctgcttgtgttcccttttgattcttctttttaacaatttttttttttttttgccaaacaatatcaatggtgatgccgtcccctgtgcggtctgatgcgccttcctccgtgacgccttcagcttcttttgtcgtggatgcttcgtgggaatgcccagagccccagtgtgcttgtggagagcatggacagacttcgtggtgttcattgtttgatgatttttaatcgttactattatttttttttattctaatgtctctgttctaaaacgtaagactcgggggttggggcaaaagaagggaaacccatccagtcctgtgattctattgcaagcttcaaggggcttttgtttgaaagacaaaactccccacctgggtctgttgtcacacgtgccgtaggggtgatggatggcaccggatgctggattccccaagaacaagttaccctctggggtgaggctattccagcgagctgggacatttccccatgggggcccactcccctctcttccccagcaggctgtagtttctaagctgtgaacatttcaagataaattaacagaggagaggaaaaagatggctcagctattttttcacaggtttacactagttgagctaatatgcgtgtctttggaaattaaacacaaatggtaacatattccaaaaccagacccatcttgttgcctattgtgataaaataaaaagacggctgtatataacatattgggtaatgcagaccaaattaagtgttttgccttgtttaaatgaaatgcatgtttagtgagcactaatacaatcttattccagaagactgtttttagtagcttattgtgaagtaagacaactataatgaatgtctgtcttgtttggaagtcatatctgtctttgcacaaatgtaccaatcgacaagtatattttatatattccataaaaatacaaagtaaccctgactagggcccaactttaattttgaatgcatttccagagtggccatgcctagagggcagatgcagagcaggtggtagtgggacaggacaattggagcacaggaatgttaacatgtatgacaggggaccagtagggtggtttccctctcaggcccagcagcccattgacagcattagactggcggcatggtgcttttctgagcagatcaatactctgcagactcgaaaaaacatcacatacattcttggaacttcccagtggtttaatctatgtgcatggttagggagccaggtctggaatattcagtttccctgcccctgttaaagaatcagaggttgggcagtcatcaaattcatcataaagacatgggcaagtgtgtctgtggtttccaaggcccccctatggagaatccaaaagtattttccattgccgtgctctttgaatgcagacttctatttccagaagtgacagcacaagtctgagttgctgtttggtctggtgacctcagacacactaatttgaattgaaagctaagagtaaaaatttgctggttacaggcgagtcatactcttgcaagtagttagcaaagggaggcccaaattctcaaggttgttgatggggaacttgccactaagagaaggcagagaggtccctagtgggtatatttgctgccaagccacttgccaaagaagaggaaccacagaaagagagacatcatgaccaggagaaaaatgtgactagacatgctaacctccaggtttttatatatgacttgagtctgctgtaattggcagcagaaatccaaatttgtatggtagaccaaaaagaaccaaatccatagggtgaaattttgagacctagactctgtaaaaataatcctagtcttcctccaggggtcagttcctcacagtggttctgtaccaaaacttgccaaattcctccatggccaagtgttaaaatctgtgtttggaaaatagcgaattaacctaagacacagaaggcagactgggtgaggagacctagcatgccctattggcagtgctcaggagctgcatcccacttttccctgctctgaatcgaagtcctagttccttcctttgattctcctttggtaggtggaatcagttaatgttttgagaaacctgcctgggctctgcccttagtcatgacatctcgctgagccagacccactctgttccttggaacctagagctggagtgaggagtagaggtctccggctattccagaaagaaaagtgagccacatgcaggctgatgaatgccgacacttccagaatgtatagaaatagtccctgtcctggcctgccactgaccctgtctgtattttctcggaggttgtttttctccttctccttcccaggaaggtctttgtatgtcgaatccagtgcactcaagtttggccaagggactccacagcacccagaagactgcatgcctcaaggtttatgtcactcctctgctgggctgttcattgtcattgctgtgttcagggacctttggaaataaaacctgttctgtcccaaataaaaccagc

SEQ ID NO: 314897 - DNA, 3443 bp, Homo sapiens
agcggtgtcaaaggcttgtgagaatctggtggatgctggaccttgctgctgctgctactgctgtttccaggggctgcagagcatggactgttaaatcttgcacttcttctgagtgagctgaattcttgccgccaggatggggaaacagaacagcaagctgcgcccggaggtcatgcaggacttgctggaaagcacagactttacagagcatgagatccaggaatggtataaaggcttcttgagagactgccccagtggacatttgtcaatggaagagtttaagaaaatatatgggaactttttcccttatggggatgcttccaaatttgcagagcatgtcttccgcaccttcgatgcaaatggagatgggacaatagactttagagaattcatcatcgccttgagtgtaacttcgagggggaagctggagcagaagctgaaatgggccttcagcatgtacgacctggacggaaatggctatatcagcaaggcagagatgctagagatcgtgcaggcaatctataagatggtttcctctgtaatgaaaatgcctgaagatgagtcaaccccagagaaaagaacagaaaagatcttccgccagatggacaccaatagagacggaaaactctccctggaagagttcatccgaggagccaaaagcgacccgtccattgtgcgcctcctgcagtgcgacccgagcagtgccggccagttctgagccctgcgcccaccaatcgaattgtagagctgcttgtgttcccttttgattcttctttttaacaatttttttttttttttgccaaacaatatcaatggtgatgccgtcccctgtgcggtctgatgcgccttcctccgtgacgccttcagcttcttttgtcgtggatgcttcgtgggaatgcccagagccccagtgtgcttgtggagagcatggacagacttcgtggtgttcattgtttgatgatttttaatcgttactattatttttttttattctaatgtctctgttctaaaacgtaagactcgggggttggggcaaaagaagggaaacccatccagtcctgtgattctattgcaagcttcaaggggcttttgtttgaaagacaaaactccccacctgggtctgttgtcacacgtgccgtaggggtgatggatggcaccggatgctggattccccaagaacaagttaccctctggggtgaggctattccagcgagctgggacatttccccatgggggcccactcccctctcttccccagcaggctgtagtttctaagctgtgaacatttcaagataaattaacagaggagaggaaaaagatggctcagctattttttcacaggtttacactagttgagctaatatgcgtgtctttggaaattaaacacaaatggtaacatattccaaaaccagacccatcttgttgcctattgtgataaaataaaaagacggctgtatataacatattgggtaatgcagaccaaattaagtgttttgccttgtttaaatgaaatgcatgtttagtgagcactaatacaatcttattccagaagactgtttttagtagcttattgtgaagtaagacaactataatgaatgtctgtcttgtttggaagtcatatctgtctttgcacaaatgtaccaatcgacaagtatattttatatattccataaaaatacaaagtaaccctgactagggcccaactttaattttgaatgcatttccagagtggccatgcctagagggcagatgcagagcaggtggtagtgggacaggacaattggagcacaggaatgttaacatgtatgacaggggaccagtagggtggtttccctctcaggcccagcagcccattgacagcattagactggcggcatggtgcttttctgagcagatcaatactctgcagactcgaaaaaacatcacatacattcttggaacttcccagtggtttaatctatgtgcatggttagggagccaggtctggaatattcagtttccctgcccctgttaaagaatcagaggttgggcagtcatcaaattcatcataaagacatgggcaagtgtgtctgtggtttccaaggcccccctatggagaatccaaaagtattttccattgccgtgctctttgaatgcagacttctatttccagaagtgacagcacaagtctgagttgctgtttggtctggtgacctcagacacactaatttgaattgaaagctaagagtaaaaatttgctggttacaggcgagtcatactcttgcaagtagttagcaaagggaggcccaaattctcaaggttgttgatggggaacttgccactaagagaaggcagagaggtccctagtgggtatatttgctgccaagccacttgccaaagaagaggaaccacagaaagagagacatcatgaccaggagaaaaatgtgactagacatgctaacctccaggtttttatatatgacttgagtctgctgtaattggcagcagaaatccaaatttgtatggtagaccaaaaagaaccaaatccatagggtgaaattttgagacctagactctgtaaaaataatcctagtcttcctccaggggtcagttcctcacagtggttctgtaccaaaacttgccaaattcctccatggccaagtgttaaaatctgtgtttggaaaatagcgaattaacctaagacacagaaggcagactgggtgaggagacctagcatgccctattggcagtgctcaggagctgcatcccacttttccctgctctgaatcgaagtcctagttccttcctttgattctcctttggtaggtggaatcagttaatgttttgagaaacctgcctgggctctgcccttagtcatgacatctcgctgagccagacccactctgttccttggaacctagagctggagtgaggagtagaggtctccggctattccagaaagaaaagtgagccacatgcaggctgatgaatgccgacacttccagaatgtatagaaatagtccctgtcctggcctgccactgaccctgtctgtattttctcggaggttgtttttctccttctccttcccaggaaggtctttgtatgtcgaatccagtgcactcaagtttggccaagggactccacagcacccagaagactgcatgcctcaaggtttatgtcactcctctgctgggctgttcattgtcattgctgtgttcagggacctttggaaataaaacctgttctgtcccaaataaaaccagcctgtgatgttcaagggactggaataaagtggcttacgacctgaaggattctacagagtgctcaactgttcatacatcattcagagtgggagggagctgggggtgctgtcccatcccatctgtatgcccacggtggatttaataatatataatttataaatcatagcctatggagtaaatgcagggacctctagaacacc

SEQ ID NO: 314898 - DNA, 695 bp, Homo sapiens
  misc_feature (24)..(24): n is a, c, g, or t
gggtggcgttctagaggatcccgncatttactccatggcagtgttaaaatctgtgtttggaaaatagcgaattaacctaagacacagaaggcagactgggtgaggagacctagcatgccctattggcagtgctcaggagctgcatcccacttttccctgctctgaatcgaagtcctagttccttcctttgattctcctttggtaggtggaatcagttaatgttttgagaaacctgcctgggctctgcccttagtcatgacatctcgctgagccagacccactctgttccttggaacctagagctggagtgaggagtagaggtctccggctattccagaaagaaaagtgagccacatgcaggctgatgaatgccgacacttccagaatgtatagaaatagtccctgtcctggcctgccactgaccctgtctgtattttctcggaggttgtttttctccttctccttcccaggaaggtctttgtatgtcgaatccagtgcactcaagtttggccaagggactccacagcacccagaagactgcatgcctcaaggtttatgtcactcctctgctgggctgttcattgtcattgctgtgttcagggacctttggaaataaaacctgttctgtcccaaataaaaccagcctgtgatgttcaagggactggaataaagtggcttacgacctgaaggattct

SEQ ID NO: 314899 - DNA, 2450 bp, Homo sapiens
agcggtgtcaaaggcttgtgagaatctggtggatgctggaccttgctgctgctgctactgctgtttccaggggctgcagagcatggactgttaaatcttgcacttcttctgagtgagctgaattcttgccgccaggatggggaaacagaacagcaagctgcgcccggaggtcatgcaggacttgctggaaagcacagactttacagagcatgagatccaggaatggtataaaggcttcttgagagactgccccagtggacatttgtcaatggaagagtttaagaaaatatatgggaactttttcccttatggggatgcttccaaatttgcagagcatgtcttccgcaccttcgatgcaaatggagatgggacaatagactttagagaattcatcatcgccttgagtgtaacttcgagggggaagctggagcagaagctgaaatgggccttcagcatgtacgacctggacggaaatggctatatcagcaaggcagagatgctagagatcgtgcaggcaatctataagatggtttcctctgtaatgaaaatgcctgaagatgagtcaaccccagagaaaagaacagaaaagatcttccgccagatggacaccaatagagacggaaaactctccctggaagagttcatccgaggagccaaaagcgacccgtccattgtgcgcctcctgcagtgcgacccgagcagtgccggccagttctgagccctgcgcccaccaatcgaattgtagagctgcttgtgttcccttttgattcttctttttaacaatttttttttttttttgccaaacaatatcaatggtgatgccgtcccctgtgcggtctgatgcgccttcctccgtgacgccttcagcttcttttgtcgtggatgcttcgtgggaatgcccagagccccagtgtgcttgtggagagcatggacagacttcgtggtgttcattgtttgatgatttttaatcgttactattatttttttttattctaatgtctctgttctaaaacgtaagactcgggggttggggcaaaagaagggaaacccatccagtcctgtgattctattgcaagcttcaaggggcttttgtttgaaagacaaaactccccacctgggtctgttgtcacacgtgccgtaggggtgatggatggcaccggatgctggattccccaagaacaagttaccctctggggtgaggctattccagcgagctgggacatttccccatgggggcccactcccctctcttccccagcaggctgtagtttctaagctgtgaacatttcaagataaattaacagaggagaggaaaaagatggctcagctattttttcacaggtttacactagttgagctaatatgcgtgtctttggaaattaaacacaaatggtaacatattccaaaaccagacccatcttgttgcctattgtgataaaataaaaagacggctgtatataacatattgggtaatgcagaccaaattaagtgttttgccttgtttaaatgaaatgcatgtttagtgagcactaatacaatcttattccagaagactgtttttagtagcttattgtgaagtaagacaactataatgaatgtctgtcttgtttggaagtcatatctgtctttgcacaaatgtaccaatcgacaagtatattttatatattccataaaaatacaaagtaaccctgactagggcccaactttaattttgaatgcatttccagagtggccatgcctagagggcagatgcagagcaggtggtagtgggacaggacaattggagcacaggaatgttaacatgtatgacaggggaccagtagggtggtttccctctcaggcccagcagcccattgacagcattagactggcggcatggtgcttttctgagcagatcaatactctgcagactcgaaaaaacatcacatacattcttggaacttcccagtggtttaatctatgtgcatggttagggagccaggtctggaatattcagtttccctgcccctgttaaagaatcagaggttgggcagtcatcaaattcatcataaagacatgggcaagtgtgtctgtggtttccaaggcccccctatggagaatccaaaagtattttccattgccgtgctctttgaatgcagaaatgtatagaaatagtccctgtcctggcctgccactgaccctgtctgtattttctcggaggttgtttttctccttctccttcccaggaaggtctttgtatgtcgaatccagtgcactcaagtttggccaagggactccacagcacccagaagactgcatgcctcaaggtttatgtcactcctctgctgggctgttcattgtcattgctgtgttcagggacctttggaaataaaacctgttctgtcccaaataaaaccagcctgtgatgttcaagggactggaataaagtggcttacgacctgaaggattct

SEQ ID NO: 314900 - DNA, 1305 bp, Homo sapiens
agcggtgtcaaaggcttgtgagaatctggtggatgctggaccttgctgctgctgctactgctgtttccaggggctgcagagcatggactgttaaatcttgcacttcttctgagtgagctgaattcttgccgccaggatggggaaacagaacagcaagctgcgcccggaggtcatgcaggacttgctggaaagcacagactttacagagcatgagatccaggaatggtataaaggcttcttgagagactgccccagtggacatttgtcaatggaagagtttaagaaaatatatgggaactttttcccttatggggatgcttccaaatttgcagagcatgtcttccgcaccttcgatgcaaatggagatgggacaatagactttagagaattcatcatcgccttgagtgtaacttcgagggggaagctggagcagaagctgaaatgggccttcagcatgtacgacctggacggaaatggctatatcagcaaggcagagatgctagagatcgtgcaggcaatctataagatggtttcctctgtaatgaaaatgcctgaagatgagtcaaccccagagaaaagaacagaaaagatcttccgccagatggacaccaatagagacggaaaactctccctggaagagttcatccgaggagccaaaagcgacccgtccattgtgcgcctcctgcagtgcgacccgagcagtgccggccagttctgagccctgcgcccaccaatcgaattgtagagctgcttgtgttcccttttgattcttctttttaacaatttttttttttttttgccaaacaatatcaatggtgatgccgtcccctgtgcggtctgatgcgccttcctccgtgacgccttcagcttcttttgtcgtggatgcttcgtgggaatgcccagagccccagtgtgcttgtggagagcatggacagacttcgtggtgttcattgtttgatgatttttaatcgttactattatttttttttattctaatgtctctgttctaaaacgtaagactcgggggttggggcaaaagaagggaaacccatccagtcctgtgatgttcaagggactggaataaagtggcttacgacctgaaggattctacagagtgctcaactgttcatacatcattcagagtgggagggagctgggggtgctgtcccatcccatctgtatgcccacggtggatttaataatatataatttataaatcatagcctatggagtggcccgtaaatcagttgactgtgtagctcttgcctggcattaaagcatgtttttggtttaacatgaaaaaca

SEQ ID NO: 314901 - DNA, 1845 bp, Homo sapiens
gagctggttgccgtggtcaatgaacaccctcatggacctgttgacacccttcaggtactgtgtgcggtagaggtgctggcggtctttgtcccaggccactgcatgctctggccgggccccaggacaggagatgatgagtccatggcccagtctctgctggtggaactgaatgggcacctggggcacccagggccggctgcccactttggacacatagttaatgatggccagcacgccctcccggatggtctttgtcttctcacagggtactaagcagctccgaaccagcacctcaggcgtgtggtccctggccttggtccgcagcttccttggcacagcccttgagccacaagacaccacatcgggcacggccttgaggtagcgtggggagaggtctgggctctgcaggtagcagaggccgatgcgccactgctccccacgcactccgcagcggtcacagggggtccattcccagaaggtggtgaagacatggaggtgcccatagtattcatctgcaaagggctcctggcccttgtcctggaaagtggccaccattccctcactgttctggatgtccacatcgtaggcgtaaaagtagtcccccttgcgggtgccgcagaagtacaggcctgagtcctcagactgagccctgaaaaccaacaagctgaacatgcggatgctgaagcgggtcagcatgtcgctgcccacacgtacctgggctgcctccgtcagcacccgcccatcaaagtccgtcagcactttggtgtggctgctacctaggtgcttttggtagaaccagactacagctggcacctcttcgggtttgcagtgacagggaagctcaaagctcatgtcggccaggtaggctgcattttcaaacatcaggaaagcagggcagggggtcctctgaaaaatgttttccttctccacaatttcaaaggcctggagcccccatgcccacaggagcacagtggtgagggccaggtgcatacctgaaggaggcaggggtcagaggggcagggcaaaaccagggcattaaaggctcatagggctcctagaaagctctgctaagcggaagcctctagatgaggaaaggattatgcagccaggaaaagcagcaacaatctgcagaggaagccgccaagtgcaaggcaatttattcccagtggatgtacaagatgcccttctaacattccagacctgatctcagggtagggggggaaagccattctagaacctggcctttactcccctttctagaacactggcgctcacccaagaatgggtcaaaggaaaccggaatgagaagggcgggccgaggtgctcgggcagggagatctctgcctcagtgctccaggccctgccctgccagcctggtggaaaagtctttcatcaacctgggggatgaaggaaacccaccctcctgcatatctggccatccgggaggctggctggacctgagctgatggcttgggactttcccaggcccaacctgcacaagaactgagtctctaggggaaaattcaacacctcaaatgatgtagtatttgatcatttgttgattacatgtccattcattggtttggggctataaacattcttgttaagagctgtggagatcagtgtttgtttaccataaagattttgctttttcccttttatgagtggaggctgtaactggtatagccagcatttggttgggcacacactcatctctcaaggccagtgggctagaggcttggcagactctaaggctttggaaataaaacctgttctgtcccaaataaaaccagcctgtgatgttcaagggactggaataaagtggcttacgacctgaaggattct

SEQ ID NO: 314902 - DNA, 3437 bp, Homo sapiens
agcggtgtcaaaggcttgtgagaatctggtggatgctggaccttgctgctgctgctactgctgtttccaggggctgcagagcatggactgttaaatcttgcacttcttctgagtgagctgaattcttgccgccaggatggggaaacagaacagcaagctgcgcccggaggtcatgcaggacttgctggaaagcacagactttacagagcatgagatccaggaatggtataaaggcttcttgagagactgccccagtggacatttgtcaatggaagagtttaagaaaatatatgggaactttttcccttatggggatgcttccaaatttgcagagcatgtcttccgcaccttcgatgcaaatggagatgggacaatagactttagagaattcatcatcgccttgagtgtaacttcgagggggaagctggagcagaagctgaaatgggccttcagcatgtacgacctggacggaaatggctatatcagcaaggcagagatgctagagatcgtgcaggcaatctataagatggtttcctctgtaatgaaaatgcctgaagatgagtcaaccccagagaaaagaacagaaaagatcttccgccagatggacaccaatagagacggaaaactctccctggaagagttcatccgaggagccaaaagcgacccgtccattgtgcgcctcctgcagtgcgacccgagcagtgccggccagttctgagccctgcgcccaccaatcgaattgtagagctgcttgtgttcccttttgattcttctttttaacaatttttttttttttttgccaaacaatatcaatggtgatgccgtcccctgtgcggtctgatgcgccttcctccgtgacgccttcagcttcttttgtcgtggatgcttcgtgggaatgcccagagccccagtgtgcttgtggagagcatggacagacttcgtggtgttcattgtttgatgatttttaatcgttactattatttttttttattctaatgtctctgttctaaaacgtaagactcgggggttggggcaaaagaagggaaacccatccagtcctgtgattctattgcaagcttcaaggggcttttgtttgaaagacacggatgctggattccccaagaacaagttaccctctggggtgaggctattccagcgagctgggacatttccccatgggggcccactcccctctcttccccagcaggctgtagtttctaagctgtgaacatttcaagataaattaacagaggagaggaaaaagatggctcagctattttttcacaggtttacactagttgagctaatatgcgtgtctttggaaattaaacacaaatggtaacatattccaaaaccagacccatcttgttgcctattgtgataaaataaaaagacggctgtatataacatattgggtaatgcagaccaaattaagtgttttgccttgtttaaatgaaatgcatgtttagtgagcactaatacaatcttattccagaagactgtttttagtagcttattgtgaagtaagacaactataatgaatgtctgtcttgtttggaagtcatatctgtctttgcacaaatgtaccaatcgacaagtatattttatatattccataaaaatacaaagtaaccctgactagggcccaactttaattttgaatgcatttccagagtggccatgcctagagggcagatgcagagcaggtggtagtgggacaggacaattggagcacaggaatgttaacatgtatgacaggggaccagtagggtggtttccctctcaggcccagcagcccattgacagcattagactggcggcatggtgcttttctgagcagatcaatactctgcagactcgaaaaaacatcacatacattcttggaacttcccagtggtttaatctatgtgcatggttagggagccaggtctggaatattcagtttccctgcccctgttaaagaatcagaggttgggcagtcatcaaattcatcataaagacatgggcaagtgtgtctgtggtttccaaggcccccctatggagaatccaaaagtattttccattgccgtgctctttgaatgcagacttctatttccagaagtgacagcacaagtctgagttgctgtttggtctggtgacctcagacacactaatttgaattgaaagctaagagtaaaaatttgctggttacaggcgagtcatactcttgcaagtagttagcaaagggaggcccaaattctcaaggttgttgatggggaacttgccactaagagaaggcagagaggtccctagtgggtatatttgctgccaagccacttgccaaagaagaggaaccacagaaagagagacatcatgaccaggagaaaaatgtgactagacatgctaacctccaggtttttatatatgacttgagtctgctgtaattggcagcagaaatccaaatttgtatggtagaccaaaaagaaccaaatccatagggtgaaattttgagacctagactctgtaaaaataatcctagtcttcctccaggggtcagttcctcacagtggttctgtaccaaaacttgccaaattcctccatggccaagtgttaaaatctgtgtttggaaaatagcgaattaacctaagacacagaaggcagactgggtgaggagacctagcatgccctattggcagtgctcaggagctgcatcccacttttccctgctctgaatcgaagtcctagttccttcctttgattctcctttggtaggtggaatcagttaatgttttgagaaacctgcctgggctctgcccttagtcatgacatctcgctgagccagacccactctgttccttggaacctagagctggagtgaggagtagaggtctccggctattccagaaagaaaagtgagccacatgcaggctgatgaatgccgacacttccagaatgtatagaaatagtccctgtcctggcctgccactgaccctgtctgtattttctcggaggttgtttttctccttctccttcccaggaaggtctttgtatgtcgaatccagtgcactcaagtttggccaagggactccacagcacccagaagactgcatgcctcaaggtttatgtcactcctctgctgggctgttcattgtcattgctgtgttcagggacctttggaaataaaacctgttctgtcccaaataaaaccagcctgtgatgttcaagggactggaataaagtggcttacgacctgaaggattctacagagtgctcaactgttcatacatcattcagagtgggagggagctgggggtgctgtcccatcccatctgtatgcccacggtggatttaataatatataatttataaatcatagcctatggagtggcccgtaaatcagttgactgtgtagctcttgcctggcattaaagcatgtttttggtttaacatgaaaaaca

SEQ ID NO: 314903 - DNA, 3648 bp, Homo sapiens
  misc_feature (59)..(59): n is a, c, g, or t
gggggaggcgggcggagggaaggcgctgccgctgctgccgccgcctcgcccgaagcganacagacgctgggagcggccgaggcgagatcctatcattattttaaaattcctcctcctccacgaagtccttcctgattccttcaaagaaatatcactcctccgaattcccagagtgatttcttctgacttgagcctgcagtgtgctgtgagagatctaccactagattatctcaactttggtctcctgggaccactcgttgctgacagtcagaaactgaattcttgccgccaggatggggaaacagaacagcaagctgcgcccggaggtcatgcaggacttgctggaaagcacagactttacagagcatgagatccaggaatggtataaaggcttcttgagagactgccccagtggacatttgtcaatggaagagtttaagaaaatatatgggaactttttcccttatggggatgcttccaaatttgcagagcatgtcttccgcaccttcgatgcaaatggagatgggacaatagactttagagaattcatcatcgccttgagtgtaacttcgagggggaagctggagcagaagctgaaatgggccttcagcatgtacgacctggacggaaatggctatatcagcaaggcagagatgctagagatcgtgcaggcaatctataagatggtttcctctgtaatgaaaatgcctgaagatgagtcaaccccagagaaaagaacagaaaagatcttccgccagatggacaccaatagagacggaaaactctccctggaagagttcatccgaggagccaaaagcgacccgtccattgtgcgcctcctgcagtgcgacccgagcagtgccggccagttctgagccctgcgcccaccaatcgaattgtagagctgcttgtgttcccttttgattcttctttttaacaatttttttttttttttgccaaacaatatcaatggtgatgccgtcccctgtgcggtctgatgcgccttcctccgtgacgccttcagcttcttttgtcgtggatgcttcgtgggaatgcccagagccccagtgtgcttgtggagagcatggacagacttcgtggtgttcattgtttgatgatttttaatcgttactattatttttttttattctaatgtctctgttctaaaacgtaagactcgggggttggggcaaaagaagggaaacccatccagtcctgtgattctattgcaagcttcaaggggcttttgtttgaaagacaaaactccccacctgggtctgttgtcacacgtgccgtaggggtgatggatggcaccggatgctggattccccaagaacaagttaccctctggggtgaggctattccagcgagctgggacatttccccatgggggcccactcccctctcttccccagcaggctgtagtttctaagctgtgaacatttcaagataaattaacagaggagaggaaaaagatggctcagctattttttcacaggtttacactagttgagctaatatgcgtgtctttggaaattaaacacaaatggtaacatattccaaaaccagacccatcttgttgcctattgtgataaaataaaaagacggctgtatataacatattgggtaatgcagaccaaattaagtgttttgccttgtttaaatgaaatgcatgtttagtgagcactaatacaatcttattccagaagactgtttttagtagcttattgtgaagtaagacaactataatgaatgtctgtcttgtttggaagtcatatctgtctttgcacaaatgtaccaatcgacaagtatattttatatattccataaaaatacaaagtaaccctgactagggcccaactttaattttgaatgcatttccagagtggccatgcctagagggcagatgcagagcaggtggtagtgggacaggacaattggagcacaggaatgttaacatgtatgacaggggaccagtagggtggtttccctctcaggcccagcagcccattgacagcattagactggcggcatggtgcttttctgagcagatcaatactctgcagactcgaaaaaacatcacatacattcttggaacttcccagtggtttaatctatgtgcatggttagggagccaggtctggaatattcagtttccctgcccctgttaaagaatcagaggttgggcagtcatcaaattcatcataaagacatgggcaagtgtgtctgtggtttccaaggcccccctatggagaatccaaaagtattttccattgccgtgctctttgaatgcagacttctatttccagaagtgacagcacaagtctgagttgctgtttggtctggtgacctcagacacactaatttgaattgaaagctaagagtaaaaatttgctggttacaggcgagtcatactcttgcaagtagttagcaaagggaggcccaaattctcaaggttgttgatggggaacttgccactaagagaaggcagagaggtccctagtgggtatatttgctgccaagccacttgccaaagaagaggaaccacagaaagagagacatcatgaccaggagaaaaatgtgactagacatgctaacctccaggtttttatatatgacttgagtctgctgtaattggcagcagaaatccaaatttgtatggtagaccaaaaagaaccaaatccatagggtgaaattttgagacctagactctgtaaaaataatcctagtcttcctccaggggtcagttcctcacagtggttctgtaccaaaacttgccaaattcctccatggccaagtgttaaaatctgtgtttggaaaatagcgaattaacctaagacacagaaggcagactgggtgaggagacctagcatgccctattggcagtgctcaggagctgcatcccacttttccctgctctgaatcgaagtcctagttccttcctttgattctcctttggtaggtggaatcagttaatgttttgagaaacctgcctgggctctgcccttagtcatgacatctcgctgagccagacccactctgttccttggaacctagagctggagtgaggagtagaggtctccggctattccagaaagaaaagtgagccacatgcaggctgatgaatgccgacacttccagaatgtatagaaatagtccctgtcctggcctgccactgaccctgtctgtattttctcggaggttgtttttctccttctccttcccaggaaggtctttgtatgtcgaatccagtgcactcaagtttggccaagggactccacagcacccagaagactgcatgcctcaaggtttatgtcactcctctgctgggctgttcattgtcattgctgtgttcagggacctttggaaataaaacctgttctgtcccaaataaaaccagcctgtgatgttcaagggactggaataaagtggcttacgacctgaaggattctacagagtgctcaactgttcatacatcattcagagtgggagggagctgggggtgctgtcccatcccatctgtatgcccacggtggatttaataatatataatttataaatcatagcctatggagtggcccgtaaatcagttgactgtgtagctcttgcctggcattaaagcatgtttttggtttaacatgaaaaaca

SEQ ID NO: 314904 - DNA, 2764 bp, Homo sapiens
agcggtgtcaaaggcttgtgagaatctggtggatgctggaccttgctgctgctgctactgctgtttccaggggctgcagagcatggactgttaaatcttgcacttcttctgagtgagctgaattcttgccgccaggatggggaaacagaacagcaagctgcgcccggaggtcatgcaggacttgctggaaagcacagactttacagagcatgagatccaggaatggtataaaggcttcttgagagactgccccagtggacatttgtcaatggaagagtttaagaaaatatatgggaactttttcccttatggggatgcttccaaatttgcagagcatgtcttccgcaccttcgatgcaaatggagatgggacaatagactttagagaattcatcatcgccttgagtgtaacttcgagggggaagctggagcagaagctgaaatgggccttcagcatgtacgacctggacggaaatggctatatcagcaaggcagagatgctagagatcgtgcaggcaatctataagatggtttcctcttagtttctaagctgtgaacatttcaagataaattaacagaggagaggaaaaagatggctcagctattttttcacaggtttacactagttgagctaatatgcgtgtctttggaaattaaacacaaatggtaacatattccaaaaccagacccatcttgttgcctattgtgataaaataaaaagacggctgtatataacatattgggtaatgcagaccaaattaagtgttttgccttgtttaaatgaaatgcatgtttagtgagcactaatacaatcttattccagaagactgtttttagtagcttattgtgaagtaagacaactataatgaatgtctgtcttgtttggaagtcatatctgtctttgcacaaatgtaccaatcgacaagtatattttatatattccataaaaatacaaagtaaccctgactagggcccaactttaattttgaatgcatttccagagtggccatgcctagagggcagatgcagagcaggtggtagtgggacaggacaattggagcacaggaatgttaacatgtatgacaggggaccagtagggtggtttccctctcaggcccagcagcccattgacagcattagactggcggcatggtgcttttctgagcagatcaatactctgcagactcgaaaaaacatcacatacattcttggaacttcccagtggtttaatctatgtgcatggttagggagccaggtctggaatattcagtttccctgcccctgttaaagaatcagaggttgggcagtcatcaaattcatcataaagacatgggcaagtgtgtctgtggtttccaaggcccccctatggagaatccaaaagtattttccattgccgtgctctttgaatgcagacttctatttccagaagtgacagcacaagtctgagttgctgtttggtctggtgacctcagacacactaatttgaattgaaagctaagagtaaaaatttgctggttacaggcgagtcatactcttgcaagtagttagcaaagggaggcccaaattctcaaggttgttgatggggaacttgccactaagagaaggcagagaggtccctagtgggtatatttgctgccaagccacttgccaaagaagaggaaccacagaaagagagacatcatgaccaggagaaaaatgtgactagacatgctaacctccaggtttttatatatgacttgagtctgctgtaattggcagcagaaatccaaatttgtatggtagaccaaaaagaaccaaatccatagggtgaaattttgagacctagactctgtaaaaataatcctagtcttcctccaggggtcagttcctcacagtggttctgtaccaaaacttgccaaattcctccatggccaagtgttaaaatctgtgtttggaaaatagcgaattaacctaagacacagaaggcagactgggtgaggagacctagcatgccctattggcagtgctcaggagctgcatcccacttttccctgctctgaatcgaagtcctagttccttcctttgattctcctttggtaggtggaatcagttaatgttttgagaaacctgcctgggctctgcccttagtcatgacatctcgctgagccagacccactctgttccttggaacctagagctggagtgaggagtagaggtctccggctattccagaaagaaaagtgagccacatgcaggctgatgaatgccgacacttccagaatgtatagaaatagtccctgtcctggcctgccactgaccctgtctgtattttctcggaggttgtttttctccttctccttcccaggaaggtctttgtatgtcgaatccagtgcactcaagtttggccaagggactccacagcacccagaagactgcatgcctcaaggtttatgtcactcctctgctgggctgttcattgtcattgctgtgttcagggacctttggaaataaaacctgttctgtcccaaataaaaccagcctgtgatgttcaagggactggaataaagtggcttacgacctgaaggattctacagagtgctcaactgttcatacatcattcagagtgggagggagctgggggtgctgtcccatcccatctgtatgcccacggtggatttaataatatataatttataaatcatagcctatggagtggcccgtaaatcagttgactgtgtagctcttgcctggcattaaagcatgtttttggtttaacatgaaaaaca

SEQ ID NO: 314905 - DNA, 2334 bp, Homo sapiens
agcggtgtcaaaggcttgtgagaatctggtggatgctggaccttgctgctgctgctactgctgtttccaggggctgcagagcatggactgttaaatcttgcacttcttctgagtgagctgaattcttgccgccaggatggggaaacagaacagcaagctgcgcccggaggtcatgcaggacttgctggaaagcacagactttacagagcatgagatccaggaatggtataaaggcttcttgagagactgccccagtggacatttgtcaatggaagagtttaagaaaatatatgggaactttttcccttatggggatgcttccaaatttgcagagcatgtcttccgcaccttcgatgcaaatggagatgggacaatagactttagagaattcatcatcgccttgagtgtaacttcgagggggaagctggagcagaagctgaaatgggccttcagcatgtacgacctggacggaaatggctatatcagcaaggcagagatgctagagatcgtgcaggcaatctataagatggtttcctctgtaatgaaaatgcctgaagatgagtcaaccccagagaaaagaacagaaaagatcttccgccagatggacaccaatagagacggaaaactctccctggaagagttcatccgaggagccaaaagcgacccgtccattgtgcgcctcctgcagtgcgacccgagcagtgccggccagttctgagccctgcgcccaccaatcgaattgtagagctgcttgtgttcccttttgattcttctttttaacaatttttttttttttttgccaaacaatatcaatggtgatgccgtcccctgtgcggtctgatgcgccttcctccgtgacgccttcagcttcttttgtcgtggatgcttcgtgggaatgcccagagccccagtgtgcttgtggagagcatggacagacttcgtggtgttcattgtttgatgatttttaatcgttactattatttttttttattctaatgtctctgttctaaaacgtaagactcgggggttggggcaaaagaagggaaacccatccagtcctgtgattctattgcaagcttcaaggggcttttgtttgaaagacaaaactccccacctgggtctgttgtcacacgtgccgtaggggtgatggatggcaccggatgctggattccccaagaacaagttaccctctggggtgaggctattccagcgagctgggacatttccccatgggggcccactcccctctcttccccagcaggctgtagtttctaagctgtgaacatttcaagataaattaacagaggagaggaaaaagatggctcagctattttttcacaggtttacactagttgagctaatatgcgtgtctttggaaattaaacacaaatggtaacatattccaaaaccagacccatcttgttgcctattgtgataaaataaaaagacggctgtatataacatattgggtaatgcagaccaaattaagtgttttgccttgtttaaatgaaatgcatgtttagtgagcactaatacaatcttattccagaagactgtttttagtagcttattgtgaagtaagacaactataatgaatgtctgtcttgtttggaagtcatatctgtctttgcacaaatgtaccaatcgacaagtatattttatatattccataaaaatacaaagtaaccctgactagggcccaactttaattttgaatgcatttccagagtggccatgcctagagggcagatgcagagcaggtggtagtgggacaggacaattggagcacaggaatgttaacatgtatgacaggggaccagtagggtggtttccctctcaggcccagcagcccattgacagcattagactggcggcatggtgcttttctgagcagatcaatactctgcagactcgaaaaaacatcacatacattcttggaacttcccagtggtttaatctatgtgcatggttagggaaaagaaaagtgagccacatgcaggctgatgaatgccgacacttccagaatgtatagaaatagtccctgtcctggcctgccactgaccctgtctgtattttctcggaggttgtttttctccttctccttcccaggaaggtctttgtatgtcgaatccagtgcactcaagtttggccaagggactccacagcacccagaagactgcatgcctcaaggtttatgtcactcctctgctgggctgttcattgtcattgctgtgttcagggacctttggaaataaaacctgttctgtcccaaataaaaccagcctgtgatgttcaagggactggaataaagtggcttacgacctgaaggattct

SEQ ID NO: 314906 - DNA, 671 bp, Homo sapiens
aaggatgtgtttactgggttaaagggcataaatatttctctggttcatggtacaagttgtaacagtttttgccagcaggggtatgtcagtgaagtatttttactacaacttcaccagcattgcatcccccccacaaattctttctaagttaatagacattaaatggtattacagggtaactttagtttgtgtttcttccattaatggtggggataaacattttttcatcatcggatgtttatatttccttttgaatgatttgcttatatatgtcctttgcctgtgtgtttattgggttcatgtttttcttattaatttatataatttcttcataaattatacctaataatacttttaaaatattttgtgtacttttaggctgggcgcggtggctcatgcctgtaatcccagcgctttgggaggccgaggtgggtggatcacgaggtcaggagtttgagaccggcctggccaacatggtgaaccccatctctactaaaaatacaaaaattagccaggcatggtggcgcgcgtctgtaatcccagctactcgggaggctgaggcaggagaattgcttgaacccaggaggcaggggttgcagtgagccgagatcatgctactgcactccagcctgggtaacagagtgagactctgtctcaaaataaataaataa

SEQ ID NO: 314907 - DNA, 355 bp, Homo sapiens
ccgccgcggcggggggtgggaaaagagaagcagagggaggagttgttgctgccgccgccgcagccgcagctactgtgacttctccgattgtgtgagctttgttggagcctgcgtacgtggatttatcgctgccacggtctgcgtagctccagaggtttaaccataggatagagaaaccagacccttcttcagcatcttccctgggcattgctgtgagtttaggccggcccgttttgagcaggagcagcagcggaacagtagacctgctggaggaagtggggctgcagatcagagacacagcattttcgtcaaccaaactttcttgaagccatatctacagtatcagctcaagtgg

SEQ ID NO: 314908 - DNA, 7591 bp, Homo sapiens
cggtctctttgcaaatgtcaatgtatttttttccttcaatatactgtatctattcctctattattaagttctgagcttgctttaccttgtccgctatttaaaacattctgatttgaaagtatcaccaacagcttatgtgattttccaaatttctcaaaatacagttgtcaccattagtcacatgaagtctgctgccgccgccgcagccgcagctactgtgacttctccgattgtgtgagctttgttggagcctgcgtacgtggatttatcgctgccacggtctgcgtagctccagaggtttaaccataggatagagaaaccaggaatgtaatgaggaaatcaaaatggatccaagtatgggtgtgaattctgttaccatttctgttgagggtatgacttgcaattcctgtgtttggaccattgagcagcagattggaaaagtgaatggtgtgcatcacattaaggtatcactggaagaaaaaaatgcaactattatttatgaccctaaactacagactccaaagaccctacaggaagctattgatgacatgggctttgatgctgttatccataatcctgaccctctccctgttttaactgacaccttgtttctgactgttacggcgtcactgactttgccatgggaccatatccaaagcacattgctgaagaccaagggtgtgacagacattaaaatttaccctcagaaaagaactgtagcagtgacaataatcccttctatagtgaatgccaatcagataaaagagctggttccagaactcagtttagatactgggacactggagaaaaagtcaggagcttgtgaagatcatagtatggctcaagctggtgaagtcgtgctgaagatgaaagtggaagggatgacctgccattcatgtactagcactattgaaggaaaaattgggaaactgcaaggtgttcagcgaattaaagtctccctggacaatcaagaagctactattgtttatcaacctcatcttatctcagtagaggaaatgaaaaagcagattgaagctatgggctttccagcatttgtcaaaaagcagcccaagtacctcaaattgggagctattgatgtagaacgtctaaagaacacaccagttaaatcctcagaagggtcacagcaaaggagtccatcatataccaatgattcaacagccactttcatcattgatggcatgcattgtaaatcatgtgtgtcaaatattgaaagtactttatctgcactccaatatgtaagcagcatagtagtttctttagagaataggtctgccattgtgaagtataatgcaagctcagtcactccagaatccctgagaaaagcaatagaggctgtatcaccggggctatatagagttagtatcacaagtgaagttgagagtacctcaaactctccctccagctcatctcttcagaagattcctttgaatgtagttagccagcctctgacacaagaaactgtgataaacattgatggcatgacttgtaattcctgtgtgcagtctattgagggtgtcatatcaaaaaagccaggtgtaaaatccatacgagtctcccttgcaaatagcaatgggactgttgagtatgatcctctactaacctctccagaaacgttgagaggagcaatagaagacatgggatttgatgctaccttgtcagacacgaatgagccgttggtagtaatagctcagccttcatcggaaatgccgcttttgacttcaactaatgaattttatactaaagggatgacaccagttcaagacaaggaggaaggaaagaattcatctaagtgttacatacaggtcactggcatgacttgcgcttcctgtgtagcaaacattgaacggaatttaaggcgggaagaaggaatatattctatacttgtggccctgatggctggcaaggcagaagtaaggtataatcctgctgttatacaacccccaatgatagcagagttcatccgagaacttggatttggagccactgtgatagaaaatgctgatgaaggagatggtgttttggaacttgttgtgaggggaatgacgtgtgcctcctgcgtacataaaatagagtctagtctcacaaaacacagagggatcctatactgctccgtggccctggcaaccaacaaagcacatattaaatatgacccagaaattattggtcctagagatattatccatacaattgaaagcttaggttttgaagcttctttggtcaagaaggatcggtcagcaagtcacttagatcataaacgagaaataagacaatggagacggtcttttcttgtgagtctgtttttctgtattcctgtaatggggctgatgacatatatgatggttatggaccaccactttgcaactcttcaccataatcaaaacatgagtaaagaagaaatgatcaaccttcattcttctatgttcctggagcgccagattcttccaggattgtctgttatgaatttgctgtcctttttattgtgtgtacctgtacagtttttcggaggctggtacttctacattcaggcttataaagcactgaagcataagacagcaaatatggacgtactgattgtgctggcaaccaccattgcatttgcctactctttgattattcttctagttgcaatgtatgagagagccaaagtgaaccctattactttctttgacacaccccctatgctgtttgtgtttattgcactaggccgatggctggaacatatagcaaagggcaaaacatcagaggctcttgcaaagttaatttcactacaagctacagaagcaactattgtaactcttgattctgataatatcctcctcagtgaagaacaagtggatgtggaacttgtacaacgtggagatatcattaaagtagttccaggaggcaaatttccagtggatggtcgtgttattgaaggacattctatggtagatgagtccctcatcacaggggaggcaatgcctgtggctaagaaacctggcagcacagtgattgctggttccattaaccagaacgggtcactgcttatctgcgcaacacatgttggagcagacacaaccctttctcaaattgtcaaacttgtggaagaggcacaaacatcaaaggctcctatccagcagtttgcagacaaactcagtggctattttgttccttttattgtttttgtttccattgccaccctcttggtatggattgtaattggatttctgaattttgaaattgtggaaacctactttcctggctacaatagaagtatctcccgaacagaaacgataatacgatttgctttccaagcctctatcacagttctgtgtattgcatgtccctgttcactgggactggccactccaactgctgtgatggtgggtacaggagtaggtgctcaaaatggcatactaataaaaggtggagagccattggagatggctcataaggtaaaggtagtggtatttgataagactggaaccattactcacggaaccccagtggtgaatcaagtaaaggttctaactgaaagtaacagaatatcacaccataaaatcttggccattgtgggaactgctgaaagtaacagtgaacaccctctaggaacagccataaccaaatattgcaaacaggagctggacactgaaaccttgggtacctgcatagatttccaggttgtgccaggctgtggtattagctgtaaagtcaccaatattgaaggcttgctacataagaataactggaatatagaggacaataatattaaaaatgcatccctggttcaaattgatgccagtaatgaacagtcatcaacttcgtcttccatgattattgatgcccagatctcaaatgctcttaatgctcagcagtataaagtcctcattggtaaccgggagtggatgattagaaatggtcttgtcattaataacgatgtaaatgatttcatgactgaacatgagagaaaaggtcggactgctgtattagtagcagttgatgatgagctgtgtggcttgatagccattgcagacacagtgaagcctgaagcagaactggctatccatattctgaaatctatgggcttagaagtagttctgatgactggagacaacagtaaaacagctagatctattgcttctcaggttggcattactaaggtgtttgctgaagttctaccttctcacaaggttgctaaagtgaagcaacttcaagaggaggggaaacgggtagcaatggtgggagatggaatcaatgactccccagctctggcaatggctaatgtgggaattgctattggcacaggcacagatgtagccattgaagcagctgatgtggttttgataaggaatgatcttctggatgtagtggcaagtattgacttatcaagaaagacagtcaagaggattcggataaattttgtctttgctctaatttataatctggttggaattcccatagctgctggagtttttatgcccattggtttggttttgcagccctggatgggatctgcagcaatggctgcttcatctgtttctgtagtactttcttctctcttccttaaactttacaggaaaccaacttacgagagttatgaactgcctgcccggagccagataggacagaagagtccttcagaaatcagcgttcatgttggaatagatgatacctcaaggaattctcctaaactgggtttgctggaccggattgttaattatagcagagcctctataaactcactactgtctgataaacgctccctaaacagtgttgttaccagtgaacctgacaagcactcactcctggtgggagacttcagggaagatgatgacactgcattataaaaggccatggagagtgctgccagtttaacttgtcatgcactgacacagcattcatgatgttaccttcacttttcaaaatattgtagaaggatttttctcatgctcttatattagggattctatttgagttgcgtttatctgttggcaaaaatatctttttcaaggcatcagctctgaacctagctttatttaaactgaatttccagtatatttttgttttcactaacaacagataaggtagagcagtgaggtttacaacaagccctacaattagagattgctgaactgctgctaaagtgattttttttttatttgaccaaaaaaaaaaaggcccaagaagaagaaaatgaaaaatttgaagatttgagagcatgaagatattcatgcttttgaactcaaaatattgaagatactctcaagcctgtatccctgccccactggggagcaatgactttcaaagcactgtgtataaaacatctagttttagaagggaaacagttgaaactgtttaaaaatagatgtgccttatttattgcaggctttctttcccccattctccctgcatccttgtccttgcaggtgcttttttagatgctccaatatgtcttcttttgttattttctttcgagctaaccagtttagggtggtttttcattgattaaaaataactgacaactgttctaatattttgctcctttttaaattttgtagctcaaaagaccttaaaggtctgtagggttccctgcctcccatctttccactgttgtaaaaagtatatcaaattattccttcaagtttcctagctctgtgctcagtttcagttcactcctgccaagttggactctaagttattcttcatgtagtctgctgatctcagtctggaaacttaacattatgagccttttctgctcaaaaaattttcaaagattaaaactattatacatatacaggtcatataaaattacctggattcactaaatttgtttgttgttgttgttgttgttgttgttgttgttgagacagagtcttgttttgcagcccaggctggagtgcagtggcaccatcttggctcactgcaacctctgcctaccggattcaaggaattctccctgcctcagcctcctgagtagctaggattacaggtgcctgccaccacacccggctaattttcatatttttcagtagagacggggtttcgccatgttggctagcctggtcttaaactcctaacctcaggtgatccacccgccttggcctcccaaagtgctgggattacaggtgtgagcctccatgcccagcctaaatttgtattttttgaattgagtataacactttgctagtatatataatttaatagattttatttatctttttagtgtttcagataacctctcaaaaagactttaaaataatgctattacacaaaagctgcatttaccaaaaaatacaagtaaaatcataatacagaaactaaaatttccctaggttatgacgctttttagctaaatatatactcttctctagtttaaaacatttgaacttgcctagttagtgtggttggcaaatttaggagcttgttcccattgccaaatggatttagaaattcccttgtgagtgcctggtagctaatacactggtcagagatctggtacttgtaagactatttaaatttctttgttagttgcaagatggatttcatatgcagaatatgtaaatgaagaggactcataagtaaattcctaacattttgttcccattaccagaagcaaagctgctgctaacccaacatctggcacataggatttgtactcggtaaatgttagttcttttctccccttgaggtcagtaataaatacaaaaaaatcatttttctagagcagagtcttaaaatcaggtgggggtaggggatggagttcttcctttcctaccccttttctcttttatcctttcatatatacacatgcaaagtttacaaccttattccatgctgtctttcagatttagaaaagatctaatttctgtctcagctgtcttaaagagagaactgaagcttttgatgaaggtgctattaatctagaaaggcaaacccatttcactgaaatatcaatgggtttgcatatctaggccctttttttagaccaatgcctatgccatcctccatgctttcagtttgagttttattatttattattttaattccagtggcccatcttataatacaacttgtttcttctagaagacagagctgatagggtaaatgttgaaaaaagaagcatgcctccttctccctcccacccacctcaagcagttgaacacagccagttattcttccattattatgtgtaccttggagtcatcctcttggtcttgtattcatattgtgggacagtgggaatagcagcttgtagtattgaaataatcaaagagataatttcagctcttacaacaagaacagaaaacatgctaattagaaaaagtcctgctttaagtaatatgtagccacatttgaatcctctaccacaagtcttttttgcaatcttgaactttcattagcttcaaagagaagctgtatttacaggagaaagaggtgattatggagggaatcaaaaatactgctttcagttagtagctagctttaagtcaggagttagtaatgagaaattttataaatgtgtatttctgtgtattcaccatcctattttttatcccccccatttttttgtccattccccttacattccttt

SEQ ID NO: 314909 - DNA, 708 bp, Homo sapiens
caaaaattagccaggcatggtggcgcgcgtctgtaatcccagctactcgggaggctgaggcaggagaattgcttgaacccaggaggcaggggttgcagtgagccgagatcatgctactgcactccagcctgggtaacagagtgagactctgtctcaaaataaataaataaataaataaataataaaatattttgtgtacttcgtctttctgaagtgaaacattttctagtgaaacattttgaagtgaaacattcaaacattttgaagtgaaacattttcatattaatttttaaacaaattaatattcctaaagctgtcttttgggtaaatgctaaagattgtatttttattttagttaagacctgaactttttcttccttagcattttcaatgtgtttgttttaatttatagggcaaaacatcagaggctcttgcaaagttaatttcactacaagctacagaagcaactattgtaactcttgattctgataatatcctcctcaggtatttatcttcactcttccctcttctctttttttaacttcttaagaaaaatttcaaatatatacagaagtagaaaaaggactatcatgaattcacataatctgtctcccagatataaaaattatccacattttgccatacttcatctatccattttgtctgtctttcttgttgcagtagtattaaaccaaatttcagtcatat

SEQ ID NO: 314910 - DNA, 8679 bp, Homo sapiens
cggtctctttgcaaatgtcaatgtatttttttccttcaatatactgtatctattcctctattattaagttctgagcttgctttaccttgtccgctatttaaaacattctgatttgaaagtatcaccaacagcttatgtgattttccaaatttctcaaaatacagttgtcaccattagtcacatgaagtctgctgccgccgccgcagccgcagctactgtgacttctccgattgtgtgagctttgttggagcctgcgtacgtggatttatcgctgccacggtctgcgtagctccagaggtttaaccataggatagagaaaccaggaatgtaatgaggaaatcaaaatggatccaagtatgggtgtgaattctgttaccatttctgttgagggtatgacttgcaattcctgtgtttggaccattgagcagcagattggaaaagtgaatggtgtgcatcacattaaggtatcactggaagaaaaaaatgcaactattatttatgaccctaaactacagactccaaagaccctacaggaagctattgatgacatgggctttgatgctgttatccataatcctgaccctctccctgttttaactgacaccttgtttctgactgttacggcgtcactgactttgccatgggaccatatccaaagcacattgctgaagaccaagggtgtgacagacattaaaatttaccctcagaaaagaactgtagcagtgacaataatcccttctatagtgaatgccaatcagataaaagagctggttccagaactcagtttagatactgggacactggagaaaaagtcaggagcttgtgaagatcatagtatggctcaagctggtgaagtcgtgctgaagatgaaagtggaagggatgacctgccattcatgtactagcactattgaaggaaaaattgggaaactgcaaggtgttcagcgaattaaagtctccctggacaatcaagaagctactattgtttatcaacctcatcttatctcagtagaggaaatgaaaaagcagattgaagctatgggctttccagcatttgtcaaaaagcagcccaagtacctcaaattgggagctattgatgtagaacgtctaaagaacacaccagttaaatcctcagaagggtcacagcaaaggagtccatcatataccaatgattcaacagccactttcatcattgatggcatgcattgtaaatcatgtgtgtcaaatattgaaagtactttatctgcactccaatatgtaagcagcatagtagtttctttagagaataggtctgccattgtgaagtataatgcaagctcagtcactccagaatccctgagaaaagcaatagaggctgtatcaccggggctatatagagttagtatcacaagtgaagttgagagtacctcaaactctccctccagctcatctcttcagaagattcctttgaatgtagttagccagcctctgacacaagaaactgtgataaacattgatggcatgacttgtaattcctgtgtgcagtctattgagggtgtcatatcaaaaaagccaggtgtaaaatccatacgagtctcccttgcaaatagcaatgggactgttgagtatgatcctctactaacctctccagaaacgttgagaggagcaatagaagacatgggatttgatgctaccttgtcagacacgaatgagccgttggtagtaatagctcagccttcatcggaaatgccgcttttgacttcaactaatgaattttatactaaagggatgacaccagttcaagacaaggaggaaggaaagaattcatctaagtgttacatacaggtcactggcatgacttgcgcttcctgtgtagcaaacattgaacggaatttaaggcgggaagaaggaatatattctatacttgtggccctgatggctggcaaggcagaagtaaggtataatcctgctgttatacaacccccaatgatagcagagttcatccgagaacttggatttggagccactgtgatagaaaatgctgatgaaggagatggtgttttggaacttgttgtgaggggaatgacgtgtgcctcctgcgtacataaaatagagtctagtctcacaaaacacagagggatcctatactgctccgtggccctggcaaccaacaaagcacatattaaatatgacccagaaattattggtcctagagatattatccatacaattgaaagcttaggttttgaagcttctttggtcaagaaggatcggtcagcaagtcacttagatcataaacgagaaataagacaatggagacggtcttttcttgtgagtctgtttttctgtattcctgtaatggggctgatgacatatatgatggttatggaccaccactttgcaactcttcaccataatcaaaacatgagtaaagaagaaatgatcaaccttcattcttctatgttcctggagcgccagattcttccaggattgtctgttatgaatttgctgtcctttttattgtgtgtacctgtacagtttttcggaggctggtacttctacattcaggcttataaagcactgaagcataagacagcaaatatggacgtactgattgtgctggcaaccaccattgcatttgcctactctttgattattcttctagttgcaatgtatgagagagccaaagtgaaccctattactttctttgacacaccccctatgctgtttgtgtttattgcactaggccgatggctggaacatatagcaaagggcaaaacatcagaggctcttgcaaagttaatttcactacaagctacagaagcaactattgtaactcttgattctgataatatcctcctcagtgaagaacaagtggatgtggaacttgtacaacgtggagatatcattaaagtagttccaggaggcaaatttccagtggatggtcgtgttattgaaggacattctatggtagatgagtccctcatcacaggggaggcaatgcctgtggctaagaaacctggcagcacagtgattgctggttccattaaccagaacgggtcactgcttatctgcgcaacacatgttggagcagacacaaccctttctcaaattgtcaaacttgtggaagaggcacaaacatcaaaggctcctatccagcagtttgcagacaaactcagtggctattttgttccttttattgtttttgtttccattgccaccctcttggtatggattgtaattggatttctgaattttgaaattgtggaaacctactttcctggctacaatagaagtatctcccgaacagaaacgataatacgatttgctttccaagcctctatcacagttctgtgtattgcatgtccctgttcactgggactggccactccaactgctgtgatggtgggtacaggagtaggtgctcaaaatggcatactaataaaaggtggagagccattggagatggctcataaggtaaaggtagtggtatttgataagactggaaccattactcacggaaccccagtggtgaatcaagtaaaggttctaactgaaagtaacagaatatcacaccataaaatcttggccattgtgggaactgctgaaagtaacagtgaacaccctctaggaacagccataaccaaatattgcaaacaggagctggacactgaaaccttgggtacctgcatagatttccaggttgtgccaggctgtggtattagctgtaaagtcaccaatattgaaggcttgctacataagaataactggaatatagaggacaataatattaaaaatgcatccctggttcaaattgatgccagtaatgaacagtcatcaacttcgtcttccatgattattgatgcccagatctcaaatgctcttaatgctcagcagtataaagtcctcattggtaaccgggagtggatgattagaaatggtcttgtcattaataacgatgtaaatgatttcatgactgaacatgagagaaaaggtcggactgctgtattagtagcagttgatgatgagctgtgtggcttgatagccattgcagacacagtgaagcctgaagcagaactggctatccatattctgaaatctatgggcttagaagtagttctgatgactggagacaacagtaaaacagctagatctattgcttctcaggttggcattactaaggtgtttgctgaagttctaccttctcacaaggttgctaaagtgaagcaacttcaagaggaggggaaacgggtagcaatggtgggagatggaatcaatgactccccagctctggcaatggctaatgtgggaattgctattggcacaggcacagatgtagccattgaagcagctgatgtggttttgataaggaatgatcttctggatgtagtggcaagtattgacttatcaagaaagacagtcaagaggattcggataaattttgtctttgctctaatttataatctggttggaattcccatagctgctggagtttttatgcccattggtttggttttgcagccctggatgggatctgcagcaatggctgcttcatctgtttctgtagtactttcttctctcttccttaaactttacaggaaaccaacttacgagagttatgaactgcctgcccggagccagataggacagaagagtccttcagaaatcagcgttcatgttggaatagatgatacctcaaggaattctcctaaactgggtttgctggaccggattgttaattatagcagagcctctataaactcactactgtctgataaacgctccctaaacagtgttgttaccagtgaacctgacaagcactcactcctggtgggagacttcagggaagatgatgacactgcattataaaaggccatggagagtgctgccagtttaacttgtcatgcactgacacagcattcatgatgttaccttcacttttcaaaatattgtagaaggatttttctcatgctcttatattagggattctatttgagttgcgtttatctgttggcaaaaatatctttttcaaggcatcagctctgaacctagctttatttaaactgaatttccagtatatttttgttttcactaacaacagataaggtagagcagtgaggtttacaacaagccctacaattagagattgctgaactgctgctaaagtgattttttttttatttgaccaaaaaaaaaaaggcccaagaagaagaaaatgaaaaatttgaagatttgagagcatgaagatattcatgcttttgaactcaaaatattgaagatactctcaagcctgtatccctgccccactggggagcaatgactttcaaagcactgtgtataaaacatctagttttagaagggaaacagttgaaactgtttaaaaatagatgtgccttatttattgcaggctttctttcccccattctccctgcatccttgtccttgcaggtgcttttttagatgctccaatatgtcttcttttgttattttctttcgagctaaccagtttagggtggtttttcattgattaaaaataactgacaactgttctaatattttgctcctttttaaattttgtagctcaaaagaccttaaaggtctgtagggttccctgcctcccatctttccactgttgtaaaaagtatatcaaattattccttcaagtttcctagctctgtgctcagtttcagttcactcctgccaagttggactctaagttattcttcatgtagtctgctgatctcagtctggaaacttaacattatgagccttttctgctcaaaaaattttcaaagattaaaactattatacatatacaggtcatataaaattacctggattcactaaatttgtttgttgttgttgttgttgttgttgttgttgttgagacagagtcttgttttgcagcccaggctggagtgcagtggcaccatcttggctcactgcaacctctgcctaccggattcaaggaattctccctgcctcagcctcctgagtagctaggattacaggtgcctgccaccacacccggctaattttcatatttttcagtagagacggggtttcgccatgttggctagcctggtcttaaactcctaacctcaggtgatccacccgccttggcctcccaaagtgctgggattacaggtgtgagcctccatgcccagcctaaatttgtattttttgaattgagtataacactttgctagtatatataatttaatagattttatttatctttttagtgtttcagataacctctcaaaaagactttaaaataatgctattacacaaaagctgcatttaccaaaaaatacaagtaaaatcataatacagaaactaaaatttccctaggttatgacgctttttagctaaatatatactcttctctagtttaaaacatttgaacttgcctagttagtgtggttggcaaatttaggagcttgttcccattgccaaatggatttagaaattcccttgtgagtgcctggtagctaatacactggtcagagatctggtacttgtaagactatttaaatttctttgttagttgcaagatggatttcatatgcagaatatgtaaatgaagaggactcataagtaaattcctaacattttgttcccattaccagaagcaaagctgctgctaacccaacatctggcacataggatttgtactcggtaaatgttagttcttttctccccttgaggtcagtaataaatacaaaaaaatcatttttctagagcagagtcttaaaatcaggtgggggtaggggatggagttcttcctttcctaccccttttctcttttatcctttcatatatacacatgcaaagtttacaaccttattccatgctgtctttcagatttagaaaagatctaatttctgtctcagctgtcttaaagagagaactgaagcttttgatgaaggtgctattaatctagaaaggcaaacccatttcactgaaatatcaatgggtttgcatatctaggccctttttttagaccaatgcctatgccatcctccatgctttcagtttgagttttattatttattattttaattccagtggcccatcttataatacaacttgtttcttctagaagacagagctgatagggtaaatgttgaaaaaagaagcatgcctccttctccctcccacccacctcaagcagttgaacacagccagttattcttccattattatgtgtaccttggagtcatcctcttggtcttgtattcatattgtgggacagtgggaatagcagcttgtagtattgaaataatcaaagagataatttcagctcttacaacaagaacagaaaacatgctaattagaaaaagtcctgctttaagtaatatgtagccacatttgaatcctctaccacaagtcttttttgcaatcttgaactttcattagcttcaaagagaagctgtatttacaggagaaagaggtgattatggagggaatcaaaaatactgctttcagttagtagctagctttaagtcaggagttagtaatgagaaattttataaatgtgtatttctgtgtattcacatacatatatatatacacacatatatatgtacatacacatacatacatattaccatactgaagggaaatggatttatatttgaatttgatatttgaatatttgaagttctctatttatatttcatttatcactcttctgtattcactcagcaaccatgcccttagtctgaagataacaaggatactttaatatccagtgccggttcagactcacctatgtggcaccttaaacttaaatatccaaagatgccttttgaatttcaaagattaaaacacagctagagtagtagtattgtagtctcaagatgtatggtgtgtcatttgtgaaaatagaaacgttatttttcctagtttagtatcaacattttagaatgtcaaatttgatgccttgtgaacaagtaattttatattgtgctttaattttttaaaaagtattctttattcatatgtatagaatgcttaaaatagcactgtagacaagatgtttccaaaactttaagtgcgcatatcttttctgtatacagcttaaaatcaaaaatgtatgttaagagaattttttctattacttatggatcatgctttaaaatgatttttcttgatatttattttactccattttgtttttttctctgggtgaggcatctggttactggttattttaaaaagaataaagacattcctggaatcactccttttgggtttttgtttgttttgtttcttttctacatttttaagtattattttacaaaatagaaaaaatatagattcatgccaaattattacctatttttacactaactttctgcagtccctccatctggtatgagtaaccagatagagcacaaagcatgagttcttgttcttcagttaaaagagcttctttcacagtgttgataacaaatgccttttgtagccaaaaccaggcgtctcaaccttacgtttttagttaaagaaatgtttagctaaacgttgttgaacattgattgtttggtaccgaaaacagcagtggacgatgttgtgcaatatccatctactgtagttaagatattcagtagtttgtttttcataagcatgtaattgatcatatttctgccaaggatgtgccttcaactttataattatagtgttgtaaaataaaaat

SEQ ID NO: 314911 - DNA, 1211 bp, Homo sapiens
cacaccaaacttacaaaacttacaacagtagttacctgtggggaggaagattaggtcccctgtcctcctttgagtaacaataaaagaaaaaaaccttgaaaaaatgacctcttgacttgtggaactgttattttcatagttagtaggagtttaaccttgctctggtctcaccttctcatccccagataaaagctgaggatgaccagcccctcccgggagtcctcttatccctgagtggtggcctgtttcgttccaacctcttgacccaggacaacggcattctgacattctcaaacctggtaacgtgttctgcaatttaccacctgcctgtcttccctgagagagagccaggatgcagcatgcgaggacttatgtgttgcttgacaacgtgagaagagaaggccaatgtggagtggtttcagtttcttgggggcccacggtcattagagtattgctcttactcgaacttaatgctgctgattcatgttcccttccacacgcgcttcttgttttctgatcacccgcttgtcactaagacagtgtaattaatttccctggccacaacggctgctctcttaggcgtcttctcgttttgccacggaatcatgcttatgatgctgagtcttgtttggtggttagcttgcgtttcttctgaaaagacattccacttggtgggaagagagcagcagtttttctttcaagatgcagtcggaggccctgactggtggggattcaggaagtgtgtgttagttggtcatcttgtcagtcatggtgacaaagtggctgtggtggggctactggagaccgggcagcgggggcatctgaagacaccactttgcagtgatgcagactgctccttacttgctgtgtcctatcaggcaagttactttgcctctctgagcctcagtttctttattcattaaattcaaatatgagccaggtatggtggcccacgcctgtaatcccaccgctttgggagggtgaggcagtaggatcgcttgagcttgggagtttgagaccagcaacataggaagaccccatctctacaaaaaataaaaaaattagctgggcatggtggtgcatgcctgtggtcccaggtactcaggaggccgaggtgggagatttgcttgagcccagaaggttgagactacggtgtgctgtgatcgtgcactccatcctgggggacagagtcaggccctgtctcagaaaaa

SEQ ID NO: 314912 - DNA, 2279 bp, Homo sapiens
  misc_feature (29)..(29): n is a, c, g, or t
  misc_feature (115)..(115): n is a, c, g, or t
  misc_feature (146)..(146): n is a, c, g, or t
  misc_feature (419)..(419): n is a, c, g, or t
  misc_feature (502)..(502): n is a, c, g, or t
  misc_feature (947)..(947): n is a, c, g, or t
aaatgggttgggttctaagagatgtccanagatacaggagtaggcagttgttgatggaaatctgttcctgcccttattctttcatttatgaaagggcatcccaggtacagcggcncccacagtcactctctagcccagcagttctnggatgggttggttgcaggacccctttatactgttaaaaattattgaggattttaaagagtttgagtttgcatggattatctctgtgtatatttatcatattagtaattaaaaccgagatgttgaaaacgcaagaactcacaagctacacattccgttagctgtgggcgtgatgacatcagggtgcgtagtctctggaaaagtccactgtgtgcttgcgaatgaaagagggcggaaaaggcacatcacatcttactattggcaaatgctgtctncccagcaaaagggagggcacaccacttccctagggtccagccagggtgtggcacttaccgcttctgttcctgtaccattggcnaaaatttagttccagggctgcgcctgctgcagggaaggctggaaaaggtgatctatattgtcggtggcccagataaaagttgggggttctattgggagaaagggagaatggccacagggatgctagtagcagtgcctgctttgcttcctcactagaccgtactggctgggaatagctgcccatcactgtgtgccctgggtctagaactgtaggttcttgatacatccttgtaggactaagtccctgcatgttgctgggactcaacaaactgagacccagttgcttttcaaccaccaagactctctgatagctgcatctcttcatttcctcagttgggaggagggtccagaggctgaggaatgccttgtcattggaatctctttgtccctgagtttcagaagcaaatagtgaagctttgggcagaagaggattcatgggaaaatanatccaaatcactttggttccttcctttggatagaaggaatttggatcatgagggcccctgggtgtcctcaagtggccactttggaaggctgggtgggtggtggctgtggcattgtggatgatggacaagcttgtggccttggtgaggagtgatggggctctcggtgtttgcagaggaagctgcctgaacaggacatcgcacaaggatcctacattgccctgccattgacgctgctggttctgctggccggttacaaccatgacaaggtaggaaatccagaggcctcaggagatggcgggcatgtcagggagagcgagtcctcacagctgcaggagtgatagcagagggatgtccagggtcacagaaatcacatttccgggtcgggagggcccgtgaaggcctcaagtccagacttaggtctcctttcaaggctgtaaacttctgtaacatctcctaatccttaacctggaacacctctagggacatattaggcccggagagaggccagcccatccctggggactcattagtaagaggcctgcctcgtttgaactgaaacccacccattagcacgtggcagctgctgatcatgtctgaagaaggtgtgttgagaagtgaggctccgctgttcatctggcaaaagcctcctctttgtacccctctctctcacactttctctcttttctagctcattcctttgctgctgcagttgacaagccggctacagggagtcggcgcgctcggccaggcagcctctgacaatagcggcccagaagatgcaaagagacaagccaagaaacagaagacaaggcggacgtgaggaggaaggggacagttgcagtctcacttgggacaggccacagccaggggtccggccactacccgcccgtgggataaaagccaaaagcatgcgtcagctaacttcagcctgtgctgctgggcccgcaccccatgtcccttgtcactgtggcatcctgcacccatcctcacccctccgtagagcccctcgtgcaatgcaatgaatggaccctcctgtcactctgctgaacagaatttattttctgagtcaaatataatttattattatttttgtcaaagaagtatttaagctgtgctgtggtgtgagaatgtcattcttgatcttcagccttcgtttgcaagaagagttccagttgatgtggtgtttggttccatggcggggtaccctagggattcatctgttttcttcacttccctttgcatctgagatcctgctggaaaccacggcaacctgtatccactattaggaggtaaaaatcaataaaatggcccattcatttgtgttgtagctca

SEQ ID NO: 314913 - DNA, 281 bp, Homo sapiens
tgatgtggtgtttggttccacatcaactggaactcttcttgcaaacgaaggctgaagatcaagaatgacattctcacaccacagcacagcttaaatccttcgtttgcaagaagagttccagttgatgtggtgtttggttccatggcggggtaccctagggattcatctgttttcttcacttccctttgcatctgagatcctgctggaaaccacggcaacctgtatccactattaggaggtaaaaatcaataaaatggcccattcatttgtgttgtagctca

SEQ ID NO: 314914 - DNA, 674 bp, Homo sapiens
  misc_feature (29)..(29): n is a, c, g, or t
  misc_feature (115)..(115): n is a, c, g, or t
  misc_feature (146)..(146): n is a, c, g, or t
aaatgggttgggttctaagagatgtccanagatacaggagtaggcagttgttgatggaaatctgttcctgcccttattctttcatttatgaaagggcatcccaggtacagcggcncccacagtcactctctagcccagcagttctnggatgggttggttgcaggacccctttatactgttaaaaattattgaggattttaaagagtttgagtttgcatggattatctctgtgtatatttatcatattagtaattaaaaccgagatgttgaaaacgcaagaactcacaagctacacattccgttagctgtgggcgtgatgacatcagggtgcgtagtctctggaaaagtccactgtgtgcttgcgaatgaaagagggcggaaaaggcacatcacatcttactattggctgaaaatagctgtggcctcgggaacctctgcgagaggagtcccggtatcctacactgagaacactgctctggctcattaacttgtttttatcattattgggaagttctccttccaatgggatataggttcacttgatgctttagaacccagcatttcaggggctttagcaagatggaaatgtctgtctcatgtcaagtgtccaggagtgaccagtgcagagatagtctggtagctccaaggcgtcaggggacccaggccccttctgt

SEQ ID NO: 314915 - DNA, 396 bp, Homo sapiens
aatgctatcatgcagggaactttttaatatccggtttctttcactcaacattatgaactttatctgtatcatttgtagctttagttcattctctttgctgttgagaattctgatgcataaatataaaattatttatattttataaaatacttatattttattttatttttttcttttttttgagactgagtctcgctctgttgcccaggctggagtgtgatctcagttcactgcaacttctgcccgggttcaagcaattcttgtgcatgcctgtggtcccaggtactcaggaggccgaggtgggagatttgcttgagcccagaaggttgagactacggtgtgctgtgatcgtgcactccatcctgggggacagagtcaggccctgtctcagaaaaa

SEQ ID NO: 314916 - DNA, 3880 bp, Homo sapiens
agccgacgaccgtggagctccatgtggatggagtcagtgacatctgcacaaagggtggggacatcaactttgtcttcactgggttctctgtgaatggcaaggtcctcagcaaagggcagcccctgggtcctgcgggagttcaggtgtctctgagaaacactgggaccgaagcaaagatccagtccacagttacacagcctggcggaaagtttgcattttttaaagttctgcctggagattatgaaatcctcgcaactcatccaacctgggcgttgaaagaggcaagcaccacagtgcgtgtaaccaactccaatgccaatgcggccagtcccctcatagttgctggctacaatgtgtctggctctgtccgaagtgatggggagcccatgaaaggcgtgaagtttcttctcttttcttctttagtaactaaagaggatgtcctgggctgcaatgtctcaccagtgcctgggttccagccccaagacgagagtctggtgtatttgtgctacacggtctccagagaagatggctcgttctctttctattccttgccaagtgggggctacactgtgattccgttctatcgaggggagaggattacctttgatgtggcgccttccagacttgacttcacagtggagcatgacagcttgaaaatcgagcccgtgttccacgtcatgggattctccgtcaccgggagggtcttgaacggacccgaaggagatggtgttccagaagcagtagtcaccctgaataaccaaatcaaagttaaaacaaaagctgatggctcattccgccttgagaacataaccacagggacatacaccatccatgctcagaaagagcacctctactttgaaacggtcaccatcaaaattgcaccaaacacacctcagctggctgacattgttgcaacagggttcagtgtctgtggtcagatatcaatcattcgcttccccgacaccgtcaagcagatgaataaatacaaagttgtcctgtcatctcaagacaaggacaagtctttggtcaccgtggagacagatgctcatggatcattttgttttaaagcaaacccagggacttacaaagtgcaggtgatggttcctgaggcagaaaccagagcagggctgacgttgaaaccccagacatttcctcttactgtgaccgacaggcctgtgatggatgtggcctttgtacagttcttggcatcagtttctgggaaagtctcttgtttggacacctgtggtgacttgctggtgactctacagtccctgagccgccagggtgagaagcggagcctccagctctccggcaaggtcaacgccatgactttcacctttgacaacgtgctccctggaaaatacaaaataagcatcatgcatgaggattggtgctggaagaacaagagcctggaggtggaagtgctggaggatgacgtgtctgcagttgagttcaggcagacgggctacatgctgagatgttccctgtctcacgccatcactctggaattttatcaggatggaaatgggcgtgagaatgtggggatttataacctctccaaaggagtcaaccgattctgcctgtccaagcctggtgtgtacaaagtgacccctcgctcctgccaccggtttgagcaagcgttctacacctatgacacgtcttcacctagtatcttgacattgacagccattcgccaccatgtccttggaactatcaccaccgacaaaatgatggatgtcactgtgactatcaagtcttccatcgacagtgaacccgccttggtcttaggccctctgaagtctgtgcaggagctgcggagggagcagcagctggctgagatcgaggcccgcaggcaggagagggagaaaaacggcaatgaggaaggtgaagaaagaatgaccaagcctcccgtgcaggagatggtagatgagttacaaggccccttctcgtatgatttctcttactgggcgcggtctggagagaaaatcactgttacaccgtcatctaaagagctgctcttttatcccccttcaatggaagccgttgtcagtggagaaagctgcccagggaagctgatcgagatccacgggaaggcaggcctgtttttagaaggccagatccaccccgagttggaaggagtcgagattgtcatcagtgaaaagggggcaagttcaccgctgatcacagtctttactgatgacaaaggtgcctacagtgttggccccctgcacagtgacctggagtacacggtgacctcacagaaggagggctatgttctgactgcagtggaaggaaccatcggagacttcaaggcctatgccctggcaggcgtaagctttgagataaaagctgaggatgaccagcccctcccgggagtcctcttatccctgagtggtggcctgtttcgttccaacctcttgacccaggacaacggcattctgacattctcaaacctgagccctggccagtattacttcaaacccatgatgaaggagttccggtttgagccatcctcacagatgatcgaggtgcaggaaggccagaacctgaagatcaccatcacggggtaccgaaccgcttacagttgctatggcacagtgtcttccttaaacggagagcccgaacaaggggttgccatggaagcggtgggccagaacgactgcagcatttacggagaagacaccgtgacagacgaagagggcaagttcagattacgtggattgctgccgggatgtgtgtaccacgttcagctcaaggcagaaggcaacgaccacattgagcgggcgctcccccaccatagggtgattgaggttgggaataatgacatcgatgatgtaaacatcatagttttccggcagattaatcaatttgatttaagtggaaatgtgatcacttcctctgaataccttcctacgttatgggtcaagctttacaaaagcgaaaacctcgacaatccaatccagacagtttcccttggccagtccctgttcttccatttccccccactgctcagagatggcgagaactatgttgtgcttctggactccacactccccagatcccagtatgactacatcttgcctcaagtttctttcaccgcagtgggctaccataaacacatcaccttgatttttaatcccacgaggaagctgcctgaacaggacatcgcacaaggatcctacattgccctgccattgacgctgctggttctgctggccggttacaaccatgacaagctcattcctttgctgctgcagttgacaagccggctacagggagtcggcgcgctcggccaggcagcctctgacaatagcggcccagaagatgcaaagagacaagccaagaaacagaagacaaggcggacgtgaggaggaaggggacagttgcagtctcacttgggacaggccacagccaggggtccggccactacccgcccgtgggataaaagccaaaagcatgcgtcagctaacttcagcctgtgctgctgggcccgcaccccatgtcccttgtcactgtggcatcctgcacccatcctcacccctccgtagagcccctcgtgcaatgcaatgaatggaccctcctgtcactctgctgaacagaatttattttctgagtcaaatataatttattattatttttgtcaaagaagtatttaagctgtgctgtggtgtgagaatgtcattcttgatcttcagccttcgtttgcaagaagagttccagttgatgtggtgtttggttccatggcggggtaccctagggattcatctgttttcttcacttccctttgcatctgagatcctgctggaaaccacggcaacctgtatccactattaggaggtaaaaatcaataaaatggcccattcatttgtgttgtagctca

SEQ ID NO: 314917 - DNA, 3046 bp, Homo sapiens
  misc_feature (18)..(18): n is a, c, g, or t
aaggctaggtacaggctngtgttaatcggccgagcatcaaaattgcaccaaacacacctcagctggctgacattgttgcaacagggttcagtgtctgtggtcagatatcaatcattcgcttccccgacaccgtcaagcagatgaataaatacaaagttgtcctgtcatctcaagacaaggacaagtctttggtcaccgtggagacagatgctcatggatcattttgttttaaagcaaacccagggacttacaaagtgcaggtgatggttcctgaggcagaaaccagagcagggctgacgttgaaaccccagacatttcctcttactgtgaccgacaggcctgtgatggatgtggcctttgtacagttcttggcatcagtttctgggaaagtctcttgtttggacacctgtggtgacttgctggtgactctacagtccctgagccgccagggtgagaagcggagcctccagctctccggcaaggtcaacgccatgactttcacctttgacaacgtgctccctggaaaatacaaaataagcatcatgcatgaggattggtgctggaagaacaagagcctggaggtggaagtgctggaggatgacgtgtctgcagttgagttcaggcagacgggctacatgctgagatgttccctgtctcacgccatcactctggaattttatcaggatggaaatgggcgtgagaatgtggggatttataacctctccaaaggagtcaaccgattctgcctgtccaagcctggtgtgtacaaagtgacccctcgctcctgccaccggtttgagcaagcgttctacacctatgacacgtcttcacctagtatcttgacattgacagccattcgccaccatgtccttggaactatcaccaccgacaaaatgatggatgtcactgtgactatcaagtcttccatcgacagtgaacccgccttggtcttaggccctctgaagtctgtgcaggagctgcggagggagcagcagctggctgagatcgaggcccgcaggcaggagagggagaaaaacggcaatgaggaaggtgaagaaagaatgaccaagcctcccgtgcaggagatggtagatgagttacaaggccccttctcgtatgatttctcttactgggcgcggtctggagagaaaatcactgttacaccgtcatctaaagagctgctcttttatcccccttcaatggaagccgttgtcagtggagaaagctgcccagggaagctgatcgagatccacgggaaggcaggcctgtttttagaaggccagatccaccccgagttggaaggagtcgagattgtcatcagtgaaaagggggcaagttcaccgctgatcacagtctttactgatgacaaaggtgcctacagtgttggccccctgcacagtgacctggagtacacggtgacctcacagaaggagggctatgttctgactgcagtggaaggaaccatcggagacttcaaggcctatgccctggcaggcgtaagctttgagataaaagctgaggatgaccagcccctcccgggagtcctcttatccctgagtggtggcctgtttcgttccaacctcttgacccaggacaacggcattctgacattctcaaacctgagccctggccagtattacttcaaacccatgatgaaggagttccggtttgagccatcctcacagatgatcgaggtgcaggaaggccagaacctgaagatcaccatcacggggtaccgaaccgcttacagttgctatggcacagtgtcttccttaaacggagagcccgaacaaggggttgccatggaagcggtgggccagaacgactgcagcatttacggagaagacaccgtgacagacgaagagggcaagttcagattacgtggattgctgccgggatgtgtgtaccacgttcagctcaaggcagaaggcaacgaccacattgagcgggcgctcccccaccatagggtgattgaggttgggaataatgacatcgatgatgtaaacatcatagttttccggcagattaatcaatttgatttaagtggaaatgtgatcacttcctctgaataccttcctacgttatgggtcaagctttacaaaagcgaaaacctcgacaatccaatccagacagtttcccttggccagtccctgttcttccatttccccccactgctcagagatggcgagaactatgttgtgcttctggactccacactccccagatcccagtatgactacatcttgcctcaagtttctttcaccgcagtgggctaccataaacacatcaccttgatttttaatcccacgaggaagctgcctgaacaggacatcgcacaaggatcctacattgccctgccattgacgctgctggttctgctggccggttacaaccatgacaagctcattcctttgctgctgcagttgacaagccggctacagggagtcggcgcgctcggccaggcagcctctgacaatagcggcccagaagatgcaaagagacaagccaagaaacagaagacaaggcggacgtgaggaggaaggggacagttgcagtctcacttgggacaggccacagccaggggtccggccactacccgcccgtgggataaaagccaaaagcatgcgtcagctaacttcagcctgtgctgctgggcccgcaccccatgtcccttgtcactgtggcatcctgcacccatcctcacccctccgtagagcccctcgtgcaatgcaatgaatggaccctcctgtcactctgctgaacagaatttattttctgagtcaaatataatttattattatttttgtcaaagaagtatttaagctgtgctgtggtgtgagaatgtcattcttgatcttcagccttcgtttgcaagaagagttccagttgatgtggtgtttggttccatggcggggtaccctagggattcatctgttttcttcacttccctttgcatctgagatcctgctggaaaccacggcaacctgtatccactattaggaggtaaaaatcaataaaatggcccattcatttgtgttgtagctca

SEQ ID NO: 314918 - DNA, 2432 bp, Homo sapiens
  misc_feature (18)..(18): n is a, c, g, or t
aaggctaggtacaggctngtgttaatcggccgaggccgctctcacgccatcactctggaattttatcaggatggaaatgggcgtgagaatgtggggatttataacctctccaaaggagtcaaccgattctgcctgtccaagcctggtgtgtacaaagtgacccctcgctcctgccaccggtttgagcaagcgttctacacctatgacacgtcttcacctagtatcttgacattgacagccattcgccaccatgtccttggaactatcaccaccgacaaaatgatggatgtcactgtgactatcaagtcttccatcgacagtgaacccgccttggtcttaggccctctgaagtctgtgcaggagctgcggagggagcagcagctggctgagatcgaggcccgcaggcaggagagggagaaaaacggcaatgaggaaggtgaagaaagaatgaccaagcctcccgtgcaggagatggtagatgagttacaaggccccttctcgtatgatttctcttactgggcgcggtctggagagaaaatcactgttacaccgtcatctaaagagctgctcttttatcccccttcaatggaagccgttgtcagtggagaaagctgcccagggaagctgatcgagatccacgggaaggcaggcctgtttttagaaggccagatccaccccgagttggaaggagtcgagattgtcatcagtgaaaagggggcaagttcaccgctgatcacagtctttactgatgacaaaggtgcctacagtgttggccccctgcacagtgacctggagtacacggtgacctcacagaaggagggctatgttctgactgcagtggaaggaaccatcggagacttcaaggcctatgccctggcaggcgtaagctttgagataaaagctgaggatgaccagcccctcccgggagtcctcttatccctgagtggtggcctgtttcgttccaacctcttgacccaggacaacggcattctgacattctcaaacctgagccctggccagtattacttcaaacccatgatgaaggagttccggtttgagccatcctcacagatgatcgaggtgcaggaaggccagaacctgaagatcaccatcacggggtaccgaaccgcttacagttgctatggcacagtgtcttccttaaacggagagcccgaacaaggggttgccatggaagcggtgggccagaacgactgcagcatttacggagaagacaccgtgacagacgaagagggcaagttcagattacgtggattgctgccgggatgtgtgtaccacgttcagctcaaggcagaaggcaacgaccacattgagcgggcgctcccccaccatagggtgattgaggttgggaataatgacatcgatgatgtaaacatcatagttttccggcagattaatcaatttgatttaagtggaaatgtgatcacttcctctgaataccttcctacgttatgggtcaagctttacaaaagcgaaaacctcgacaatccaatccagacagtttcccttggccagtccctgttcttccatttccccccactgctcagagatggcgagaactatgttgtgcttctggactccacactccccagatcccagtatgactacatcttgcctcaagtttctttcaccgcagtgggctaccataaacacatcaccttgatttttaatcccacgaggaagctgcctgaacaggacatcgcacaaggatcctacattgccctgccattgacgctgctggttctgctggccggttacaaccatgacaagctcattcctttgctgctgcagttgacaagccggctacagggagtcggcgcgctcggccaggcagcctctgacaatagcggcccagaagatgcaaagagacaagccaagaaacagaagacaaggcggacgtgaggaggaaggggacagttgcagtctcacttgggacaggccacagccaggggtccggccactacccgcccgtgggataaaagccaaaagcatgcgtcagctaacttcagcctgtgctgctgggcccgcaccccatgtcccttgtcactgtggcatcctgcacccatcctcacccctccgtagagcccctcgtgcaatgcaatgaatggaccctcctgtcactctgctgaacagaatttattttctgagtcaaatataatttattattatttttgtcaaagaagtatttaagctgtgctgtggtgtgagaatgtcattcttgatcttcagccttcgtttgcaagaagagttccagttgatgtggtgtttggttccatggcggggtaccctagggattcatctgttttcttcacttccctttgcatctgagatcctgctggaaaccacggcaacctgtatccactattaggaggtaaaaatcaataaaatggcccattcatttgtgttgtagctca

SEQ ID NO: 314919 - DNA, 2301 bp, Homo sapiens
cagctatgtagaggcgataccggatgtttatgttcatacgagggcgtgtgtgaacaagcgttctacctggacgacagcgtcttcacctagtatcttgacattgacagccattcgccaccatgtccttggaactatcaccaccgacaaaatgatggatgtcactgtgactatcaagtcttccatcgacagtgaacccgccttggtcttaggccctctgaagtctgtgcaggagctgcggagggagcagcagctggctgagatcgaggcccgcaggcaggagagggagaaaaacggcaatgaggaaggtgaagaaagaatgaccaagcctcccgtgcaggagatggtagatgagttacaaggccccttctcgtatgatttctcttactgggcgcggtctggagagaaaatcactgttacaccgtcatctaaagagctgctcttttatcccccttcaatggaagccgttgtcagtggagaaagctgcccagggaagctgatcgagatccacgggaaggcaggcctgtttttagaaggccagatccaccccgagttggaaggagtcgagattgtcatcagtgaaaagggggcaagttcaccgctgatcacagtctttactgatgacaaaggtgcctacagtgttggccccctgcacagtgacctggagtacacggtgacctcacagaaggagggctatgttctgactgcagtggaaggaaccatcggagacttcaaggcctatgccctggcaggcgtaagctttgagataaaagctgaggatgaccagcccctcccgggagtcctcttatccctgagtggtggcctgtttcgttccaacctcttgacccaggacaacggcattctgacattctcaaacctgagccctggccagtattacttcaaacccatgatgaaggagttccggtttgagccatcctcacagatgatcgaggtgcaggaaggccagaacctgaagatcaccatcacggggtaccgaaccgcttacagttgctatggcacagtgtcttccttaaacggagagcccgaacaaggggttgccatggaagcggtgggccagaacgactgcagcatttacggagaagacaccgtgacagacgaagagggcaagttcagattacgtggattgctgccgggatgtgtgtaccacgttcagctcaaggcagaaggcaacgaccacattgagcgggcgctcccccaccatagggtgattgaggttgggaataatgacatcgatgatgtaaacatcatagttttccggcagattaatcaatttgatttaagtggaaatgtgatcacttcctctgaataccttcctacgttatgggtcaagctttacaaaagcgaaaacctcgacaatccaatccagacagtttcccttggccagtccctgttcttccatttccccccactgctcagagatggcgagaactatgttgtgcttctggactccacactccccagatcccagtatgactacatcttgcctcaagtttctttcaccgcagtgggctaccataaacacatcaccttgatttttaatcccacgaggaagctgcctgaacaggacatcgcacaaggatcctacattgccctgccattgacgctgctggttctgctggccggttacaaccatgacaagctcattcctttgctgctgcagttgacaagccggctacagggagtcggcgcgctcggccaggcagcctctgacaatagcggcccagaagatgcaaagagacaagccaagaaacagaagacaaggcggacgtgaggaggaaggggacagttgcagtctcacttgggacaggccacagccaggggtccggccactacccgcccgtgggataaaagccaaaagcatgcgtcagctaacttcagcctgtgctgctgggcccgcaccccatgtcccttgtcactgtggcatcctgcacccatcctcacccctccgtagagcccctcgtgcaatgcaatgaatggaccctcctgtcactctgctgaacagaatttattttctgagtcaaatataatttattattatttttgtcaaagaagtatttaagctgtgctgtggtgtgagaatgtcattcttgatcttcagccttcgtttgcaagaagagttccagttgatgtggtgtttggttccatggcggggtaccctagggattcatctgttttcttcacttccctttgcatctgagatcctgctggaaaccacggcaacctgtatccactattaggaggtaaaaatcaataaaatggcccattcatttgtgttgtagctca

SEQ ID NO: 314920 - DNA, 4669 bp, Homo sapiens
  misc_feature (3901)..(3901): n is a, c, g, or t
  misc_feature (3914)..(3914): n is a, c, g, or t
  misc_feature (3924)..(3924): n is a, c, g, or t
  misc_feature (3926)..(3926): n is a, c, g, or t
  misc_feature (3937)..(3937): n is a, c, g, or t
agccgacgaccgtggagctccatgtggatggagtcagtgacatctgcacaaagggtggggacatcaactttgtcttcactgggttctctgtgaatggcaaggtcctcagcaaagggcagcccctgggtcctgcgggagttcaggtgtctctgagaaacactgggaccgaagcaaagatccagtccacagttacacagcctggcggaaagtttgcattttttaaagttctgcctggagattatgaaatcctcgcaactcatccaacctgggcgttgaaagaggcaagcaccacagtgcgtgtaaccaactccaatgccaatgcggccagtcccctcatagttgctggctacaatgtgtctggctctgtccgaagtgatggggagcccatgaaaggcgtgaagtttcttctcttttcttctttagtaactaaagaggatgtcctgggctgcaatgtctcaccagtgcctgggttccagccccaagacgagagtctggtgtatttgtgctacacggtctccagagaagatggctcgttctctttctattccttgccaagtgggggctacactgtgattccgttctatcgaggggagaggattacctttgatgtggcgccttccagacttgacttcacagtggagcatgacagcttgaaaatcgagcccgtgttccacgtcatgggattctccgtcaccgggagggtcttgaacggacccgaaggagatggtgttccagaagcagtagtcaccctgaataaccaaatcaaagttaaaacaaaagctgatggctcattccgccttgagaacataaccacagggacatacaccatccatgctcagaaagagcacctctactttgaaacggtcaccatcaaaattgcaccaaacacacctcagctggctgacattgttgcaacagggttcagtgtctgtggtcagatatcaatcattcgcttccccgacaccgtcaagcagatgaataaatacaaagttgtcctgtcatctcaagacaaggacaagtctttggtcaccgtggagacagatgctcatggatcattttgttttaaagcaaacccagggacttacaaagtgcaggtgatggttcctgaggcagaaaccagagcagggctgacgttgaaaccccagacatttcctcttactgtgaccgacaggcctgtgatggatgtggcctttgtacagttcttggcatcagtttctgggaaagtctcttgtttggacacctgtggtgacttgctggtgactctacagtccctgagccgccagggtgagaagcggagcctccagctctccggcaaggtcaacgccatgactttcacctttgacaacgtgctccctggaaaatacaaaataagcatcatgcatgaggattggtgctggaagaacaagagcctggaggtggaagtgctggaggatgacgtgtctgcagttgagttcaggcagacgggctacatgctgagatgttccctgtctcacgccatcactctggaattttatcaggatggaaatgggcgtgagaatgtggggatttataacctctccaaaggagtcaaccgattctgcctgtccaagcctggtgtgtacaaagtgacccctcgctcctgccaccggtttgagcaagcgttctacacctatgacacgtcttcacctagtatcttgacattgacagccattcgccaccatgtccttggaactatcaccaccgacaaaatgatggatgtcactgtgactatcaagtcttccatcgacagtgaacccgccttggtcttaggccctctgaagtctgtgcaggagctgcggagggagcagcagctggctgagatcgaggcccgcaggcaggagagggagaaaaacggcaatgaggaaggtgaagaaagaatgaccaagcctcccgtgcaggagatggtagatgagttacaaggccccttctcgtatgatttctcttactgggcgcggtctggagagaaaatcactgttacaccgtcatctaaagagctgctcttttatcccccttcaatggaagccgttgtcagtggagaaagctgcccagggaagctgatcgagatccacgggaaggcaggcctgtttttagaaggccagatccaccccgagttggaaggagtcgagattgtcatcagtgaaaagggggcaagttcaccgctgatcacagtctttactgatgacaaaggtgcctacagtgttggccccctgcacagtgacctggagtacacggtgacctcacagaaggagggctatgttctgactgcagtggaaggaaccatcggagacttcaaggcctatgccctggcaggcgtaagctttgagataaaagctgaggatgaccagcccctcccgggagtcctcttatccctgagtggtggcctgtttcgttccaacctcttgacccaggacaacggcattctgacattctcaaacctgagccctggccagtattacttcaaacccatgatgaaggagttccggtttgagccatcctcacagatgatcgaggtgcaggaaggccagaacctgaagatcaccatcacggggtaccgaaccgcttacagttgctatggcacagtgtcttccttaaacggagagcccgaacaaggggttgccatggaagcggtgggccagaacgactgcagcatttacggagaagacaccgtgacagacgaagagggcaagttcagattacgtggattgctgccgggatgtgtgtaccacgttcagctcaaggcagaaggcaacgaccacattgagcgggcgctcccccaccatagggtgattgaggttgggaataatgacatcgatgatgtaaacatcatagttttccggcagattaatcaatttgatttaagtggaaatgtgatcacttcctctgaataccttcctacgttatgggtcaagctttacaaaagcgaaaacctcgacaatccaatccagacagtttcccttggccagtccctgttcttccatttccccccactgctcagagatggcgagaactatgttgtgcttctggactccacactccccagatcccagtatgactacatcttgcctcaagtttctttcaccgcagtgggctaccataaacacatcaccttgatttttaatcccacgaggaagctgcctgaacaggacatcgcacaaggatcctacattgccctgccattgacgctgctggttctgctggccggttacaaccatgacaagctcattcctttgctgctgcagttgacaagccggctacagggagtcggcgcgctcggccaggcagcctctgacaatagcggcccagaagatgcaaagagacaagccaagaaacagaagacaaggcggacgtgaggaggaaggggacagttgcagtctcacttgggacaggccacagccaggggtccggccactacccgcccgtgggataaaagccaaaagcatgcgtcagctaacttcagcctgtgctgctgggcccgcaccccatgtcccttgtcactgtggcatcctgcacccatcctcacccctccgtagagcccctcgtgcaatgcaatgaatggaccctcctgtcactctgctgaacagaatttattttctgagtcaaatataatttattattatttttgtcaaagaagtatttaagctgtgctgtggtgtgagaatgtcattcttgatcttcagccttcgtttgcaagaagagttccagttgatgtggtgtttggttccatggcggggtaccctagggattcatctgttttcttcacttccctttgcatctgagatcctgctggaaaccacggcaacctgtatccactattaggaggtaaaaatcaataaaatggcccattcatttgtgttgtagctcaaaaaaaaaaaaaaaaaaaaanaaaaaaaaaaaanaaaaaaaaananaaaaaaaaaanaaaaaaaaagaggggggggggggatgaacgattcacgctcctccaaggggggcagcgtgaaagcaccgacaccgagccattcaagtggtaaagcagggggccaacaaagggcagggtagaattagaccatagaaagcaggacgagggcgcaaattaaacacacgggtaatgagccggcaagaaatagtgaactagcacagcgacagacatcaagaagaagaaacaccacacgatataagccagggaggggaaccagaaacaagaggggaacgcacgcatacagagcaaaaataacacaagccaacagtggggcgacataaaaataacaaagtataaaaccggatgcaatagcgtggcaaaacgaacagacaagagatacacaagggcccaagagcgcacaagagacagaatgatgcgcagacagcctgacgatccagtaagatagttccagacaagacgcatattaacccacagggcgggacacagatgtggaattacattaagcagggaacccaagaaccaagcacaggcaagagcaggagggactggatacaatccaacacaaacacagacgccacaacgacgcacaacaggcgacggacaggacagacatgcggagagaaggccacaccccagacgatcatgcggaccccaaaacaagcctcgacgaaagggccaacacagcgaacatcatcacactgcacggtacatcagcctggaccaacccaccaa

SEQ ID NO: 314921 - DNA, 4302 bp, Homo sapiens
agccgacgaccgtggagctccatgtggatggagtcagtgacatctgcacaaagggtggggacatcaactttgtcttcactgggttctctgtgaatggcaaggtcctcagcaaagggcagcccctgggtcctgcgggagttcaggtgtctctgagaaacactgggaccgaagcaaagatccagtccacagttacacagcctggcggaaagtttgcattttttaaagttctgcctggagattatgaaatcctcgcaactcatccaacctgggcgttgaaagaggcaagcaccacagtgcgtgtaaccaactccaatgccaatgcggccagtcccctcatagttgctggctacaatgtgtctggctctgtccgaagtgatggggagcccatgaaaggcgtgaagtttcttctcttttcttctttagtaactaaagaggatgtcctgggctgcaatgtctcaccagtgcctgggttccagccccaagacgagagtctggtgtatttgtgctacacggtctccagagaagatggctcgttctctttctattccttgccaagtgggggctacactgtgattccgttctatcgaggggagaggattacctttgatgtggcgccttccagacttgacttcacagtggagcatgacagcttgaaaatcgagcccgtgttccacgtcatgggattctccgtcaccgggagggtcttgaacggacccgaaggagatggtgttccagaagcagtagtcaccctgaataaccaaatcaaagttaaaacaaaagctgatggctcattccgccttgagaacataaccacagggacatacaccatccatgctcagaaagagcacctctactttgaaacggtcaccatcaaaattgcaccaaacacacctcagctggctgacattgttgcaacagggttcagtgtctgtggtcagatatcaatcattcgcttccccgacaccgtcaagcagatgaataaatacaaagttgtcctgtcatctcaagacaaggacaagtctttggtcaccgtggagacagatgctcatggatcattttgttttaaagcaaacccagggacttacaaagtgcaggtgatggttcctgaggcagaaaccagagcagggctgacgttgaaaccccagacatttcctcttactgtgaccgacaggcctgtgatggatgtggcctttgtacagttcttggcatcagtttctgggaaagtctcttgtttggacacctgtggtgacttgctggtgactctacagtccctgagccgccagggtgagaagcggagcctccagctctccggcaaggtcaacgccatgactttcacctttgacaacgtgctccctggaaaatacaaaataagcatcatgcatgaggattggtgctggaagaacaagagcctggaggtggaagtgctggaggatgacgtgtctgcagttgagttcaggcagacgggctacatgctgagatgttccctgtctcacgccatcactctggaattttatcaggatggaaatgggcgtgagaatgtggggatttataacctctccaaaggagtcaaccgattctgcctgtccaagcctggtgtgtacaaagtgacccctcgctcctgccaccggtttgagcaagcgttctacacctatgacacgtcttcacctagtatcttgacattgacagccattcgccaccatgtccttggaactatcaccaccgacaaaatgatggatgtcactgtgactatcaagtcttccatcgacagtgaacccgccttggtcttaggccctctgaagtctgtgcaggagctgcggagggagcagcagctggctgagatcgaggcccgcaggcaggagagggagaaaaacggcaatgaggaaggtgaagaaagaatgaccaagcctcccgtgcaggagatggtagatgagttacaaggccccttctcgtatgatttctcttactgggcgcggtctggagagaaaatcactgttacaccgtcatctaaagagctgctcttttatcccccttcaatggaagccgttgtcagtggagaaagctgcccagggaagctgatcgagatccacgggaaggcaggcctgtttttagaaggccagatccaccccgagttggaaggagtcgagattgtcatcagtgaaaagggggcaagttcaccgctgatcacagtctttactgatgacaaaggtgcctacagtgttggccccctgcacagtgacctggagtacacggtgacctcacagaaggagggctatgttctgactgcagtggaaggaaccatcggagacttcaaggcctatgccctggcaggcgtaagctttgagataaaagctgaggatgaccagcccctcccgggagtcctcttatccctgagtggtggcctgtttcgttccaacctcttgacccaggacaacggcattctgacattctcaaacctgagccctggccagtattacttcaaacccatgatgaaggagttccggtttgagccatcctcacagatgatcgaggtgcaggaaggccagaacctgaagatcaccatcacggggtaccgaaccgcttacagttgctatggcacagtgtcttccttaaacggagagcccgaacaaggggttgccatggaagcggtgggccagaacgactgcagcatttacggagaagacaccgtgacagacgaagagggcaagttcagattacgtggattgctgccgggatgtgtgtaccacgttcagctcaaggcagaaggcaacgaccacattgagcgggcgctcccccaccatagggtgattgaggttgggaataatgacatcgatgatgtaaacatcatagttttccggcagattaatcaatttgatttaagtggaaatgtgatcacttcctctgaataccttcctacgttatgggtcaagctttacaaaagcgaaaacctcgacaatccaatccagacagtttcccttggccagtccctgttcttccatttccccccactgctcagagatggcgagaactatgttgtgcttctggactccacactccccagatcccagtatgactacatcttgcctcaagtttctttcaccgcagtgggctaccataaacacatcaccttgatttttaatcccacgaggaagctgcctgaacaggacatcgcacaaggatcctacattgccctgccattgacgctgctggttctgctggccggttacaaccatgacaaggtaggaaatccagaggcctcaggagatggcgggcatgtcagggagagcgagtcctcacagctgcaggagtgatagcagagggatgtccagggtcacagaaatcacatttccgggtcgggagggcccgtgaaggcctcaagtccagacttaggtctcctttcaaggctgtaaacttctgtaacatctcctaatccttaacctggaacacctctagggacatattaggcccggagagaggccagcccatccctggggactcattagtaagaggcctgcctcgtttgaactgaaacccacccattagcacgtggcagctgctgatcatgtctgaagaaggtgtgttgagaagtgaggctccgctgttcatctggcaaaagcctcctctttgtacccctctctctcacactttctctcttttctagctcattcctttgctgctgcagttgacaagccggctacagggagtcggcgcgctcggccaggcagcctctgacaatagcggcccagaagatgcaaagagacaagccaagaaacagaagacaaggcggacgtgaggaggaaggggacagttgcagtctcacttgggacaggccacagccaggggtccggccactacccgcccgtgggataaaagccaaaagcatgcgtcagctaacttcagcctgtgctgctgggcccgcaccccatgtcccttgtcactgtggcatcctgcacccatcctcacccctccgtagagcccctcgtgcaatgcaatgaatggaccctcctgtcactctgctgaacagaatttattttctgagtcaaatataatttattattatttttgtcaaagaagtatttaagctgtgctgtggtgtgagaatgtcattcttgatcttcagccttcgtttgcaagaagagttccagttgatgtggtgtttggttccatggcggggtaccctagggattcatctgttttcttcacttccctttgcatctgagatcctgctggaaaccacggcaacctgtatccactattaggaggtaaaaatcaataaaatggcccattcatttgtgttgtagctca

SEQ ID NO: 314922 - DNA, 1734 bp, Homo sapiens
  misc_feature (7)..(7): n is a, c, g, or t
  misc_feature (10)..(11): n is a, c, g, or t
  misc_feature (13)..(13): n is a, c, g, or t
ttcgggnagnngngtgagtctcaagccagtggacagtgaggggtgagggcacgtcctccgaaggagcagtgttggccccctgcacagtgacctggagtacacggtgacctcacagaaggagggctatgttctgactgcagtggaaggaaccatcggagacttcaaggcctatgccctggcaggcgtaagctttgagataaaagctgaggatgaccagcccctcccgggagtcctcttatccctgagtggtggcctgtttcgttccaacctcttgacccaggacaacggcattctgacattctcaaacctgagccctggccagtattacttcaaacccatgatgaaggagttccggtttgagccatcctcacagatgatcgaggtgcaggaaggccagaacctgaagatcaccatcacggggtaccgaaccgcttacagttgctatggcacagtgtcttccttaaacggagagcccgaacaaggggttgccatggaagcggtgggccagaacgactgcagcatttacggagaagacaccgtgacagacgaagagggcaagttcagattacgtggattgctgccgggatgtgtgtaccacgttcagctcaaggcagaaggcaacgaccacattgagcgggcgctcccccaccatagggtgattgaggttgggaataatgacatcgatgatgtaaacatcatagttttccggcagattaatcaatttgatttaagtggaaatgtgatcacttcctctgaataccttcctacgttatgggtcaagctttacaaaagcgaaaacctcgacaatccaatccagacagtttcccttggccagtccctgttcttccatttccccccactgctcagagatggcgagaactatgttgtgcttctggactccacactccccagatcccagtatgactacatcttgcctcaagtttctttcaccgcagtgggctaccataaacacatcaccttgatttttaatcccacgaggaagctgcctgaacaggacatcgcacaaggatcctacattgccctgccattgacgctgctggttctgctggccggttacaaccatgacaagctcattcctttgctgctgcagttgacaagccggctacagggagtcggcgcgctcggccaggcagcctctgacaatagcggcccagaagatgcaaagagacaagccaagaaacagaagacaaggcggacgtgaggaggaaggggacagttgcagtctcacttgggacaggccacagccaggggtccggccactacccgcccgtgggataaaagccaaaagcatgcgtcagctaacttcagcctgtgctgctgggcccgcaccccatgtcccttgtcactgtggcatcctgcacccatcctcacccctccgtagagcccctcgtgcaatgcaatgaatggaccctcctgtcactctgctgaacagaatttattttctgagtcaaatataatttattattatttttgtcaaagaagtatttaagctgtgctgtggtgtgagaatgtcattcttgatcttcagccttcgtttgcaagaagagttccagttgatgtggtgtttggttccatggcggggtaccctagggattcatctgttttcttcacttccctttgcatctgagatcctgctggaaaccacggcaacctgtatccactattaggaggtaaaaatcaataaaatggcccattcatttgtgttgtagctca

SEQ ID NO: 314923 - DNA, 1604 bp, Homo sapiens
agttgtgattgccattacctgactgtgagtggtgattatagagagagggttactatttttggctgccagggaagccatggcgctcccctggtgtaattctggtccatcgtgacattcgcccctcacttttaagccatgcctagatgtggctgctgaggctcagtgtgattatcttggcagagccctggccagtattacttcaaacccatgatgaaggagttccggtttgagccatcctcacagatgatcgaggtgcaggaaggccagaacctgaagatcaccatcacggggtaccgaaccgcttacagttgctatggcacagtgtcttccttaaacggagagcccgaacaaggggttgccatggaagcggtgggccagaacgactgcagcatttacggagaagacaccgtgacagacgaagagggcaagttcagattacgtggattgctgccgggatgtgtgtaccacgttcagctcaaggcagaaggcaacgaccacattgagcgggcgctcccccaccatagggtgattgaggttgggaataatgacatcgatgatgtaaacatcatagttttccggcagattaatcaatttgatttaagtggaaatgtgatcacttcctctgaataccttcctacgttatgggtcaagctttacaaaagcgaaaacctcgacaatccaatccagacagtttcccttggccagtccctgttcttccatttccccccactgctcagagatggcgagaactatgttgtgcttctggactccacactccccagatcccagtatgactacatcttgcctcaagtttctttcaccgcagtgggctaccataaacacatcaccttgatttttaatcccacgaggaagctgcctgaacaggacatcgcacaaggatcctacattgccctgccattgacgctgctggttctgctggccggttacaaccatgacaagctcattcctttgctgctgcagttgacaagccggctacagggagtcggcgcgctcggccaggcagcctctgacaatagcggcccagaagatgcaaagagacaagccaagaaacagaagacaaggcggacgtgaggaggaaggggacagttgcagtctcacttgggacaggccacagccaggggtccggccactacccgcccgtgggataaaagccaaaagcatgcgtcagctaacttcagcctgtgctgctgggcccgcaccccatgtcccttgtcactgtggcatcctgcacccatcctcacccctccgtagagcccctcgtgcaatgcaatgaatggaccctcctgtcactctgctgaacagaatttattttctgagtcaaatataatttattattatttttgtcaaagaagtatttaagctgtgctgtggtgtgagaatgtcattcttgatcttcagccttcgtttgcaagaagagttccagttgatgtggtgtttggttccatggcggggtaccctagggattcatctgttttcttcacttccctttgcatctgagatcctgctggaaaccacggcaacctgtatccactattaggaggtaaaaatcaataaaatggcccattcatttgtgttgtagctca

SEQ ID NO: 314924 - DNA, 3999 bp, Homo sapiens
agccgacgaccgtggagctccatgtggatggagtcagtgacatctgcacaaagggtggggacatcaactttgtcttcactgggttctctgtgaatggcaaggtcctcagcaaagggcagcccctgggtcctgcgggagttcaggtgtctctgagaaacactgggaccgaagcaaagatccagtccacagttacacagcctggcggaaagtttgcattttttaaagttctgcctggagattatgaaatcctcgcaactcatccaacctgggcgttgaaagaggcaagcaccacagtgcgtgtaaccaactccaatgccaatgcggccagtcccctcatagttgctggctacaatgtgtctggctctgtccgaagtgatggggagcccatgaaaggcgtgaagtttcttctcttttcttctttagtaactaaagaggatgtcctgggctgcaatgtctcaccagtgcctgggttccagccccaagacgagagtctggtgtatttgtgctacacggtctccagagaagatggctcgttctctttctattccttgccaagtgggggctacactgtgattccgttctatcgaggggagaggattacctttgatgtggcgccttccagacttgacttcacagtggagcatgacagcttgaaaatcgagcccgtgttccacgtcatgggattctccgtcaccgggagggtcttgaacggacccgaaggagatggtgttccagaagcagtagtcaccctgaataaccaaatcaaagttaaaacaaaagctgatggctcattccgccttgagaacataaccacagggacatacaccatccatgctcagaaagagcacctctactttgaaacggtcaccatcaaaattgcaccaaacacacctcagctggctgacattgttgcaacagggttcagtgtctgtggtcagatatcaatcattcgcttccccgacaccgtcaagcagatgaataaatacaaagttgtcctgtcatctcaagacaaggacaagtctttggtcaccgtggagacagatgctcatggatcattttgttttaaagcaaacccagggacttacaaagtgcaggtgatggttcctgaggcagaaaccagagcagggctgacgttgaaaccccagacatttcctcttactgtgaccgacaggcctgtgatggatgtggcctttgtacagttcttggcatcagtttctgggaaagtctcttgtttggacacctgtggtgacttgctggtgactctacagtccctgagccgccagggtgagaagcggagcctccagctctccggcaaggtcaacgccatgactttcacctttgacaacgtgctccctggaaaatacaaaataagcatcatgcatgaggattggtgctggaagaacaagagcctggaggtggaagtgctggaggatgacgtgtctgcagttgagttcaggcagacgggctacatgctgagatgttccctgtctcacgccatcactctggaattttatcaggatggaaatgggcgtgagaatgtggggatttataacctctccaaaggagtcaaccgattctgcctgtccaagcctggtgtgtacaaagtgacccctcgctcctgccaccggtttgagcaagcgttctacacctatgacacgtcttcacctagtatcttgacattgacagccattcgccaccatgtccttggaactatcaccaccgacaaaatgatggatgtcactgtgactatcaagtcttccatcgacagtgaacccgccttggtcttaggccctctgaagtctgtgcaggagctgcggagggagcagcagctggctgagatcgaggcccgcaggcaggagagggagaaaaacggcaatgaggaaggtgaagaaagaatgaccaagcctcccgtgcaggagatggtagatgagttacaaggccccttctcgtatgatttctcttactgggcgcggtctggagagaaaatcactgttacaccgtcatctaaagagctgctcttttatcccccttcaatggaagccgttgtcagtggagaaagctgcccagggaagctgatcgagatccacgggaaggcaggcctgtttttagaaggccagatccaccccgagttggaaggagtcgagattgtcatcagtgaaaagggggcaagttcaccgctgatcacagtctttactgatgacaaaggtgcctacagtgttggccccctgcacagtgacctggagtacacggtgacctcacagaaggagggctatgttctgactgcagtggaaggaaccatcggagacttcaaggcctatgccctggcaggcgtaagctttgagataaaagctgaggatgaccagcccctcccgggagtcctcttatccctgagtggtggcctgtttcgttccaacctcttgacccaggacaacggcattctgacattctcaaacctgagccctggccagtattacttcaaacccatgatgaaggagttccggtttgagccatcctcacagatgatcgaggtgcaggaaggccagaacctgaagatcaccatcacggggtaccgaaccgcttacagttgctatggcacagtgtcttccttaaacggagagcccgaacaaggggttgccatggaagcggtgggccagaacgactgcagcatttacggagaagacaccgtgacagacgaagagggcaagttcagattacgtggattgctgccgggatgtgtgtaccacgttcagctcaaggcagaaggcaacgaccacattgagcgggcgctcccccaccatagggtgattgaggttgggaataatgacatcgatgatgtaaacatcatagttttccggcagattaatcaatttgatttaagtggaaatgtgatcacttcctctgaataccttcctacgttatgggtcaagctttacaaaagcgaaaacctcgacaatccaatccagacagtttcccttggccagtccctgttcttccatttccccccactgctcagagatggcgagaactatgttgtgcttctggactccacactccccagatcccagtatgactacatcttgcctcaagtttctttcaccgcagtgggctaccataaacacatcaccttgatttttaatcccacgaggaagctgcctgaacaggacatcgcacaaggatcctacattgccctgccattgacgctgctggttctgctggccggttacaaccatgacaagctcattcctttgctgctgcagttgacaagccggctacagggagtcggcgcgctcggccaggcagcctctgacaatagcggcccagaagatgcaaagagacaagccaagaaacagaagacaaggcggacgtgaggaggaaggggacagttgcagtctcacttgggacaggccacagccaggggtccggccactacccgcccgtgggataaaagccaaaagcatgcgtcagctaacttcagcctgtgctgctgggcccgcaccccatgtcccttgtcactgtggcatcctgcacccatcctcacccctccgtagagcccctcgtgcaatgcaatgaatggaccctcctgtcactctgctgaacagaatttattttctgagtcaaatataatttattattatttttgtcaaagaagtatttaagctgtgctgtggtgtgagaatgtcattcttgatcttcagccttcgtttgcaagaagagttccagttgatgtggtgtttggttccatggcggggtaccctagggattcatctgttttcttcacttccctttgcatctgagatcctgctggaaaccacggcaacctgtatccactattaggagatgggttcttgttctgttccccaggctggagtacaatggcaccatcacagctcactgcagccttgatctcccagggtcaagggatcatcgtgcctcagcctgctgagtagctgggactacaggagtgcaccaccacacctggctaatttttttaaaaaaaat

SEQ ID NO: 314925 - DNA, 3647 bp, Homo sapiens
agccgacgaccgtggagctccatgtggatggagtcagtgacatctgcacaaagggtggggacatcaactttgtcttcactgggttctctgtgaatggcaaggtcctcagcaaagggcagcccctgggtcctgcgggagttcaggtgtctctgagaaacactgggaccgaagcaaagatccagtccacagttacacagcctggcggaaagtttgcattttttaaagttctgcctggagattatgaaatcctcgcaactcatccaacctgggcgttgaaagaggcaagcaccacagtgcgtgtaaccaactccaatgccaatgcggccagtcccctcatagttgctggctacaatgtgtctggctctgtccgaagtgatggggagcccatgaaaggcgtgaagtttcttctcttttcttctttagtaactaaagaggatgtcctgggctgcaatgtctcaccagtgcctgggttccagccccaagacgagagtctggtgtatttgtgctacacggtctccagagaagatggctcgttctctttctattccttgccaagtgggggctacactgtgattccgttctatcgaggggagaggattacctttgatgtggcgccttccagacttgacttcacagtggagcatgacagcttgaaaatcgagcccgtgttccacgtcatgggattctccgtcaccgggagggtcttgaacggacccgaaggagatggtgttccagaagcagtagtcaccctgaataaccaaatcaaagttaaaacaaaagctgatggctcattccgccttgagaacataaccacagggacatacaccatccatgctcagaaagagcacctctactttgaaacggtcaccatcaaaattgcaccaaacacacctcagctggctgacattgttgcaacagggttcagtgtctgtggtcagatatcaatcattcgcttccccgacaccgtcaagcagatgaataaatacaaagttgtcctgtcatctcaagacaaggacaagtctttggtcaccgtggagacagatgctcatggatcattttgttttaaagcaaacccagggacttacaaagtgcaggtgatggttcctgaggcagaaaccagagcagggctgacgttgaaaccccagacatttcctcttactgtgaccgacaggcctgtgatggatgtggcctttgtacagttcttggcatcagtttctgggaaagtctcttgtttggacacctgtggtgacttgctggtgactctacagtccctgagccgccagggtgagaagcggagcctccagctctccggcaaggtcaacgccatgactttcacctttgacaacgtgctccctggaaaatacaaaataagcatcatgcatgaggattggtgctggaagaacaagagcctggaggtggaagtgctggaggatgacgtgtctgcagttgagttcaggcagacgggctacatgctgagatgttccctgtctcacgccatcactctggaattttatcaggatggaaatgggcgtgagaatgtggggatttataacctctccaaaggagtcaaccgattctgcctgtccaagcctggtgtgtacaaagtgacccctcgctcctgccaccggtttgagcaagcgttctacacctatgacacgtcttcacctagtatcttgacattgacagccattcgccaccatgtccttggaactatcaccaccgacaaaatgatggatgtcactgtgactatcaagtcttccatcgacagtgaacccgccttggtcttaggccctctgaagtctgtgcaggagctgcggagggagcagcagctggctgagatcgaggcccgcaggcaggagagggagaaaaacggcaatgaggaaggtgaagaaagaatgaccaagcctcccgtgcaggagatggtagatgagttacaaggccccttctcgtatgatttctcttactgggcgcggtctggagagaaaatcactgttacaccgtcatctaaagagctgctcttttatcccccttcaatggaagccgttgtcagtggagaaagctgcccagggaagctgatcgagatccacgggaaggcaggcctgtttttagaaggccagatccaccccgagttggaaggagtcgagattgtcatcagtgaaaagggggcaagttcaccgctgatcacagtctttactgatgacaaaggtgcctacagtgttggccccctgcacagtgacctggagtacacggtgacctcacagaaggagggctatgttctgactgcagtggaaggaaccatcggagacttcaaggcctatgccctggcaggcgtaagctttgagataaaagctgaggatgaccagcccctcccgggagtcctcttatccctgagtggtggcctgtttcgttccaacctcttgacccaggacaacggcattctgacattctcaaacctgagccctggccagtattacttcaaacccatgatgaaggagttccggtttgagccatcctcacagatgatcgaggtgcaggaaggccagaacctgaagatcaccatcacggggtaccgaaccgcttacagttgctatggcacagtgtcttccttaaacggagagcccgaacaaggggttgccatggaagcggtgggccagaacgactgcagcatttacggagaagacaccgtgacagacgaagagggcaagttcagattacgtggattgctgccgggatgtgtgtaccacgttcagctcaaggcagaaggcaacgaccacattgagcgggcgctcccccaccatagggtgattgaggttgggaataatgacatcgatgatgtaaacatcatagttttccggcagattaatcaatttgatttaagtggaaatgtgatcacttcctctgaataccttcctacgttatgggtcaagctttacaaaagcgaaaacctcgacaatccaatccagacagtttcccttggccagtccctgttcttccatttccccccactgctcagagatggcgagaactatgttgtgcttctggactccacactccccagatcccagtatgactacatcttgcctcaagtttctttcaccgcagtgggctaccataaacacatcaccttgatttttaatcccacgaggaagctgcctgaacaggacatcgcacaaggatcctacattgccctgccattgacgctgctggttctgctggccggttacaaccatgacaagctcattcctttgctgctgcagttgacaagccggctacagggagtcggcgcgctcggccaggcagcctctgacaatagcggcccagaagatgcaaagagacaagccaagaaacagaagacaaggcggacgtgaggaggaaggggacagttgcagtctcacttgggacaggccacagccaggggtccggccactacccgcccgtgggataaaagccaaaagcatgcgtcagctaacttcagcctgtgctgctgggcccgcaccccatgtcccttgtcactgtggcatcctgcacccatcctcacccctccgtagagcccctcgtgcaatgcaatgaatggaccctcctgtcactctgctgaacagaatttattttctgagtcaaatataatttattattatttttgtcaaaga

SEQ ID NO: 314926 - DNA, 5091 bp, Homo sapiens
  misc_feature (4323)..(4323): n is a, c, g, or t
  misc_feature (4336)..(4336): n is a, c, g, or t
  misc_feature (4346)..(4346): n is a, c, g, or t
  misc_feature (4348)..(4348): n is a, c, g, or t
  misc_feature (4359)..(4359): n is a, c, g, or t
agccgacgaccgtggagctccatgtggatggagtcagtgacatctgcacaaagggtggggacatcaactttgtcttcactgggttctctgtgaatggcaaggtcctcagcaaagggcagcccctgggtcctgcgggagttcaggtgtctctgagaaacactgggaccgaagcaaagatccagtccacagttacacagcctggcggaaagtttgcattttttaaagttctgcctggagattatgaaatcctcgcaactcatccaacctgggcgttgaaagaggcaagcaccacagtgcgtgtaaccaactccaatgccaatgcggccagtcccctcatagttgctggctacaatgtgtctggctctgtccgaagtgatggggagcccatgaaaggcgtgaagtttcttctcttttcttctttagtaactaaagaggatgtcctgggctgcaatgtctcaccagtgcctgggttccagccccaagacgagagtctggtgtatttgtgctacacggtctccagagaagatggctcgttctctttctattccttgccaagtgggggctacactgtgattccgttctatcgaggggagaggattacctttgatgtggcgccttccagacttgacttcacagtggagcatgacagcttgaaaatcgagcccgtgttccacgtcatgggattctccgtcaccgggagggtcttgaacggacccgaaggagatggtgttccagaagcagtagtcaccctgaataaccaaatcaaagttaaaacaaaagctgatggctcattccgccttgagaacataaccacagggacatacaccatccatgctcagaaagagcacctctactttgaaacggtcaccatcaaaattgcaccaaacacacctcagctggctgacattgttgcaacagggttcagtgtctgtggtcagatatcaatcattcgcttccccgacaccgtcaagcagatgaataaatacaaagttgtcctgtcatctcaagacaaggacaagtctttggtcaccgtggagacagatgctcatggatcattttgttttaaagcaaacccagggacttacaaagtgcaggtgatggttcctgaggcagaaaccagagcagggctgacgttgaaaccccagacatttcctcttactgtgaccgacaggcctgtgatggatgtggcctttgtacagttcttggcatcagtttctgggaaagtctcttgtttggacacctgtggtgacttgctggtgactctacagtccctgagccgccagggtgagaagcggagcctccagctctccggcaaggtcaacgccatgactttcacctttgacaacgtgctccctggaaaatacaaaataagcatcatgcatgaggattggtgctggaagaacaagagcctggaggtggaagtgctggaggatgacgtgtctgcagttgagttcaggcagacgggctacatgctgagatgttccctgtctcacgccatcactctggaattttatcaggatggaaatgggcgtgagaatgtggggatttataacctctccaaaggagtcaaccgattctgcctgtccaagcctggtgtgtacaaagtgacccctcgctcctgccaccggtttgagcaagcgttctacacctatgacacgtcttcacctagtatcttgacattgacagccattcgccaccatgtccttggaactatcaccaccgacaaaatgatggatgtcactgtgactatcaagtcttccatcgacagtgaacccgccttggtcttaggccctctgaagtctgtgcaggagctgcggagggagcagcagctggctgagatcgaggcccgcaggcaggagagggagaaaaacggcaatgaggaaggtgaagaaagaatgaccaagcctcccgtgcaggagatggtagatgagttacaaggccccttctcgtatgatttctcttactgggcgcggtctggagagaaaatcactgttacaccgtcatctaaagagctgctcttttatcccccttcaatggaagccgttgtcagtggagaaagctgcccagggaagctgatcgagatccacgggaaggcaggcctgtttttagaaggccagatccaccccgagttggaaggagtcgagattgtcatcagtgaaaagggggcaagttcaccgctgatcacagtctttactgatgacaaaggtgcctacagtgttggccccctgcacagtgacctggagtacacggtgacctcacagaaggagggctatgttctgactgcagtggaaggaaccatcggagacttcaaggcctatgccctggcaggcgtaagctttgagataaaagctgaggatgaccagcccctcccgggagtcctcttatccctgagtggtggcctgtttcgttccaacctcttgacccaggacaacggcattctgacattctcaaacctgagccctggccagtattacttcaaacccatgatgaaggagttccggtttgagccatcctcacagatgatcgaggtgcaggaaggccagaacctgaagatcaccatcacggggtaccgaaccgcttacagttgctatggcacagtgtcttccttaaacggagagcccgaacaaggggttgccatggaagcggtgggccagaacgactgcagcatttacggagaagacaccgtgacagacgaagagggcaagttcagattacgtggattgctgccgggatgtgtgtaccacgttcagctcaaggcagaaggcaacgaccacattgagcgggcgctcccccaccatagggtgattgaggttgggaataatgacatcgatgatgtaaacatcatagttttccggcagattaatcaatttgatttaagtggaaatgtgatcacttcctctgaataccttcctacgttatgggtcaagctttacaaaagcgaaaacctcgacaatccaatccagacagtttcccttggccagtccctgttcttccatttccccccactgctcagagatggcgagaactatgttgtgcttctggactccacactccccagatcccagtatgactacatcttgcctcaagtttctttcaccgcagtgggctaccataaacacatcaccttgatttttaatcccacgaggaagctgcctgaacaggacatcgcacaaggatcctacattgccctgccattgacgctgctggttctgctggccggttacaaccatgacaaggtaggaaatccagaggcctcaggagatggcgggcatgtcagggagagcgagtcctcacagctgcaggagtgatagcagagggatgtccagggtcacagaaatcacatttccgggtcgggagggcccgtgaaggcctcaagtccagacttaggtctcctttcaaggctgtaaacttctgtaacatctcctaatccttaacctggaacacctctagggacatattaggcccggagagaggccagcccatccctggggactcattagtaagaggcctgcctcgtttgaactgaaacccacccattagcacgtggcagctgctgatcatgtctgaagaaggtgtgttgagaagtgaggctccgctgttcatctggcaaaagcctcctctttgtacccctctctctcacactttctctcttttctagctcattcctttgctgctgcagttgacaagccggctacagggagtcggcgcgctcggccaggcagcctctgacaatagcggcccagaagatgcaaagagacaagccaagaaacagaagacaaggcggacgtgaggaggaaggggacagttgcagtctcacttgggacaggccacagccaggggtccggccactacccgcccgtgggataaaagccaaaagcatgcgtcagctaacttcagcctgtgctgctgggcccgcaccccatgtcccttgtcactgtggcatcctgcacccatcctcacccctccgtagagcccctcgtgcaatgcaatgaatggaccctcctgtcactctgctgaacagaatttattttctgagtcaaatataatttattattatttttgtcaaagaagtatttaagctgtgctgtggtgtgagaatgtcattcttgatcttcagccttcgtttgcaagaagagttccagttgatgtggtgtttggttccatggcggggtaccctagggattcatctgttttcttcacttccctttgcatctgagatcctgctggaaaccacggcaacctgtatccactattaggaggtaaaaatcaataaaatggcccattcatttgtgttgtagctcaaaaaaaaaaaaaaaaaaaaanaaaaaaaaaaaanaaaaaaaaananaaaaaaaaaanaaaaaaaaagaggggggggggggatgaacgattcacgctcctccaaggggggcagcgtgaaagcaccgacaccgagccattcaagtggtaaagcagggggccaacaaagggcagggtagaattagaccatagaaagcaggacgagggcgcaaattaaacacacgggtaatgagccggcaagaaatagtgaactagcacagcgacagacatcaagaagaagaaacaccacacgatataagccagggaggggaaccagaaacaagaggggaacgcacgcatacagagcaaaaataacacaagccaacagtggggcgacataaaaataacaaagtataaaaccggatgcaatagcgtggcaaaacgaacagacaagagatacacaagggcccaagagcgcacaagagacagaatgatgcgcagacagcctgacgatccagtaagatagttccagacaagacgcatattaacccacagggcgggacacagatgtggaattacattaagcagggaacccaagaaccaagcacaggcaagagcaggagggactggatacaatccaacacaaacacagacgccacaacgacgcacaacaggcgacggacaggacagacatgcggagagaaggccacaccccagacgatcatgcggaccccaaaacaagcctcgacgaaagggccaacacagcgaacatcatcacactgcacggtacatcagcctggaccaacccaccaa

SEQ ID NO: 314927 - DNA, 1139 bp, Homo sapiens
  misc_feature (1)..(1): n is a, c, g, or t
  misc_feature (15)..(15): n is a, c, g, or t
ntgccggctcccagngcatgtgccgctcccaacgcatgtgccggctccccccaccatagggtgattgaggttgggaataatgacatcgatgatgtaaacatcatagttttccggcagattaatcaatttgatttaagtggaaatgtgatcacttcctctgaataccttcctacgttatgggtcaagctttacaaaagcgaaaacctcgacaatccaatccagacagtttcccttggccagtccctgttcttccatttccccccactgctcagagatggcgagaactatgttgtgcttctggactccacactccccagatcccagtatgactacatcttgcctcaagtttctttcaccgcagtgggctaccataaacacatcaccttgatttttaatcccacgaggaagctgcctgaacaggacatcgcacaaggatcctacattgccctgccattgacgctgctggttctgctggccggttacaaccatgacaagctcattcctttgctgctgcagttgacaagccggctacagggagtcggcgcgctcggccaggcagcctctgacaatagcggcccagaagatgcaaagagacaagccaagaaacagaagacaaggcggacgtgaggaggaaggggacagttgcagtctcacttgggacaggccacagccaggggtccggccactacccgcccgtgggataaaagccaaaagcatgcgtcagctaacttcagcctgtgctgctgggcccgcaccccatgtcccttgtcactgtggcatcctgcacccatcctcacccctccgtagagcccctcgtgcaatgcaatgaatggaccctcctgtcactctgctgaacagaatttattttctgagtcaaatataatttattattatttttgtcaaagaagtatttaagctgtgctgtggtgtgagaatgtcattcttgatcttcagccttcgtttgcaagaagagttccagttgatgtggtgtttggttccatggcggggtaccctagggattcatctgttttcttcacttccctttgcatctgagatcctgctggaaaccacggcaacctgtatccactattaggaggtaaaaatcaataaaatggcccattcatttgtgttgtagctca

SEQ ID NO: 314928 - DNA, 1140 bp, Homo sapiens
agtcagacggtcgtggtctaaagggtccccacgtatgttgatgtggctccccatcgatagggtgattgaggttgggaataatgacatcgatgatgtaaacatcatagttttccggcagattaatcaatttgatttaagtggaaatgtgatcacttcctctgaataccttcctacgttatgggtcaagctttacaaaagcgaaaacctcgacaatccaatccagacagtttcccttggccagtccctgttcttccatttccccccactgctcagagatggcgagaactatgttgtgcttctggactccacactccccagatcccagtatgactacatcttgcctcaagtttctttcaccgcagtgggctaccataaacacatcaccttgatttttaatcccacgaggaagctgcctgaacaggacatcgcacaaggatcctacattgccctgccattgacgctgctggttctgctggccggttacaaccatgacaagctcattcctttgctgctgcagttgacaagccggctacagggagtcggcgcgctcggccaggcagcctctgacaatagcggcccagaagatgcaaagagacaagccaagaaacagaagacaaggcggacgtgaggaggaaggggacagttgcagtctcacttgggacaggccacagccaggggtccggccactacccgcccgtgggataaaagccaaaagcatgcgtcagctaacttcagcctgtgctgctgggcccgcaccccatgtcccttgtcactgtggcatcctgcacccatcctcacccctccgtagagcccctcgtgcaatgcaatgaatggaccctcctgtcactctgctgaacagaatttattttctgagtcaaatataatttattattatttttgtcaaagaagtatttaagctgtgctgtggtgtgagaatgtcattcttgatcttcagccttcgtttgcaagaagagttccagttgatgtggtgtttggttccatggcggggtaccctagggattcatctgttttcttcacttccctttgcatctgagatcctgctggaaaccacggcaacctgtatccactattaggaggtaaaaatcaataaaatggcccattcatttgtgttgtagctca

SEQ ID NO: 314929 - DNA, 1679 bp, Homo sapiens
ctagagggtgacgtttcctctcctggctccttaccacctgccgtgaagatgatctactctggcctttctctgtggctccaggggtgttgaaatagtcacttcctacagcgatgcggaaacatcttgggctttggggtcacacttcccctgagttcagagccttcatagatgtgtggcagccttcttagctgagtgaccttgggcaagttactcttagtctcttcgtgcttgactttcctcgtctataagacggggtgatgatcccgaccttgccagtggtagaaagcaaagcagccgcgggcctcatgcaatgtgcatggtgcctggcagctggtcggtgctcagcacacagagctgtggctgcccctggtgccgttccagggatgctgtatttttaggatttgccagcttacgagcctctcaagcatcgtcccttagaagtcagccccgttgtggatcctcagttgtatcacgtacctccctcatcagaattggctcataataattttttgtgtttcataaagtcagatcctcagaggaccgtaattgtcaaggttgggtactcataaaaaggctgcaggctctgacagccttatcagaagccacagtctcagagacactggggacacatgcccgccactgatggaatagcccgctgaggttgatactttgaaggcagcaaccttggtttggatgtgtagtcttggggatttctttaaaaacataaagttctttacatcacagccatacgttaggttttagttttcatttgctttgccagagctgtccttataaaaataacttcttcccatgtgtgcacagaactatgttgtgcttctggactccacactccccagatcccagtatgactacatcttgcctcaagtttctttcaccgcagtgggctaccataaacacatcaccttgatttttaatcccacgaggaagctgcctgaacaggacatcgcacaaggatcctacattgccctgccattgacgctgctggttctgctggccggttacaaccatgacaagctcattcctttgctgctgcagttgacaagccggctacagggagtcggcgcgctcggccaggcagcctctgacaatagcggcccagaagatgcaaagagacaagccaagaaacagaagacaaggcggacgtgaggaggaaggggacagttgcagtctcacttgggacaggccacagccaggggtccggccactacccgcccgtgggataaaagccaaaagcatgcgtcagctaacttcagcctgtgctgctgggcccgcaccccatgtcccttgtcactgtggcatcctgcacccatcctcacccctccgtagagcccctcgtgcaatgcaatgaatggaccctcctgtcactctgctgaacagaatttattttctgagtcaaatataatttattattatttttgtcaaagaagtatttaagctgtgctgtggtgtgagaatgtcattcttgatcttcagccttcgtttgcaagaagagttccagttgatgtggtgtttggttccatggcggggtaccctagggattcatctgttttcttcacttccctttgcatctgagatcctgctggaaaccacggcaacctgtatccactattaggaggtaaaaatcaataaaatggcccattcatttgtgttgtagctca

SEQ ID NO: 314930 - DNA, 3205 bp, Homo sapiens
  misc_feature (3157)..(3157): n is a, c, g, or t
  misc_feature (3159)..(3159): n is a, c, g, or t
  misc_feature (3184)..(3184): n is a, c, g, or t
agccgacgaccgtggagctccatgtggatggagtcagtgacatctgcacaaagggtggggacatcaactttgtcttcactgggttctctgtgaatggcaaggtcctcagcaaagggcagcccctgggtcctgcgggagttcaggtgtctctgagaaacactgggaccgaagcaaagatccagtccacagttacacagcctggcggaaagtttgcattttttaaagttctgcctggagattatgaaatcctcgcaactcatccaacctgggcgttgaaagaggcaagcaccacagtgcgtgtaaccaactccaatgccaatgcggccagtcccctcatagttgctggctacaatgtgtctggctctgtccgaagtgatggggagcccatgaaaggcgtgaagtttcttctcttttcttctttagtaactaaagaggatgtcctgggctgcaatgtctcaccagtgcctgggttccagccccaagacgagagtctggtgtatttgtgctacacggtctccagagaagatggctcgttctctttctattccttgccaagtgggggctacactgtgattccgttctatcgaggggagaggattacctttgatgtggcgccttccagacttgacttcacagtggagcatgacagcttgaaaatcgagcccgtgttccacgtcatgggattctccgtcaccgggagggtcttgaacggacccgaaggagatggtgttccagaagcagtagtcaccctgaataaccaaatcaaagttaaaacaaaagctgatggctcattccgccttgagaacataaccacagggacatacaccatccatgctcagaaagagcacctctactttgaaacggtcaccatcaaaattgcaccaaacacacctcagctggctgacattgttgcaacagggttcagtgtctgtggtcagatatcaatcattcgcttccccgacaccgtcaagcagatgaataaatacaaagttgtcctgtcatctcaagacaaggacaagtctttggtcaccgtggagacagatgctcatggatcattttgttttaaagcaaacccagggacttacaaagtgcaggtgatggttcctgaggcagaaaccagagcagggctgacgttgaaaccccagacatttcctcttactgtgaccgacaggcctgtgatggatgtggcctttgtacagttcttggcatcagtttctgggaaagtctcttgtttggacacctgtggtgacttgctggtgactctacagtccctgagccgccagggtgagaagcggagcctccagctctccggcaaggtcaacgccatgactttcacctttgacaacgtgctccctggaaaatacaaaataagcatcatgcatgaggattggtgctggaagaacaagagcctggaggtggaagtgctggaggatgacgtgtctgcagttgagttcaggcagacgggctacatgctgagatgttccctgtctcacgccatcactctggaattttatcaggatggaaatgggcgtgagaatgtggggatttataacctctccaaaggagtcaaccgattctgcctgtccaagcctggtgtgtacaaagtgacccctcgctcctgccaccggtttgagcaagcgttctacacctatgacacgtcttcacctagtatcttgacattgacagccattcgccaccatgtccttggaactatcaccaccgacaaaatgatggatgtcactgtgactatcaagtcttccatcgacagtgaacccgccttggtcttaggccctctgaagtctgtgcaggagctgcggagggagcagcagctggctgagatcgaggcccgcaggcaggagagggagaaaaacggcaatgaggaaggtgaagaaagaatgaccaagcctcccgtgcaggagatggtagatgagttacaaggccccttctcgtatgatttctcttactgggcgcggtctggagagaaaatcactgttacaccgtcatctaaagagctgctcttttatcccccttcaatggaagccgttgtcagtggagaaagctgcccagggaagctgatcgagatccacgggaaggcaggcctgtttttagaaggccagatccaccccgagttggaaggagtcgagattgtcatcagtgaaaagggggcaagttcaccgctgatcacagtctttactgatgacaaaggtgcctacagtgttggccccctgcacagtgacctggagtacacggtgacctcacagaaggagggctatgttctgactgcagtggaaggaaccatcggagacttcaaggcctatgccctggcaggcgtaagctttgagataaaagctgaggatgaccagcccctcccgggagtcctcttatccctgagtggtggcctgtttcgttccaacctcttgacccaggacaacggcattctgacattctcaaacctgagccctggccagtattacttcaaacccatgatgaaggagttccggtttgagccatcctcacagatgatcgaggtgcaggaaggccagaacctgaagatcaccatcacggggtaccgaaccgcttacagttgctatggcacagtgtcttccttaaacggagagcccgaacaaggggttgccatggaagcggtgggccagaacgactgcagcatttacggagaagacaccgtgacagacgaagagggcaagttcagattacgtggattgctgccgggatgtgtgtaccacgttcagctcaaggcagaaggcaacgaccacattgagcgggcgctcccccaccatagggtgattgaggttgggaataatgacatcgatgatgtaaacatcatagttttccggcagattaatcaatttgatttaagtggaaatgtgatcacttcctctgaataccttcctacgttatgggtcaagctttacaaaagcgaaaacctcgacaatccaatccagacagtttcccttggccagtccctgttcttccatttccccccactgctcagagatggcgagaactatgttgtgcttctggactccacactccccagatcccagtatgactacatcttgcctcaagtttctttcaccgcagtgggctaccataaacacatcaccttgatttttaatcccacgagggaacttgcttnanaggaaattggacaagggacttaaantggtttcggattaacccggcc

SEQ ID NO: 314931 - DNA, 1096 bp, Homo sapiens
catttcctgtgttttcacccagcctcaacacttcctcgttacccctctttatcccttggcttacaacgtcctatgccccaggaattaccccctttttttaaaatataaaaagaatagtagatactttaagcaatatttgggaaatggtggttttaattcacgtcatttatttacttgtaataatggatattgataagtgaataaatagcgtagtaaatagagttaagaggtaatgtgctatgatgtggggatgatgaggctattgttttttgtgatcccagtatgactacatcttgcctcaagtttctttcaccgcagtgggctaccataaacacatcaccttgatttttaatcccacgaggaagctgcctgaacaggacatcgcacaaggatcctacattgccctgccattgacgctgctggttctgctggccggttacaaccatgacaagctcattcctttgctgctgcagttgacaagccggctacagggagtcggcgcgctcggccaggcagcctctgacaatagcggcccagaagatgcaaagagacaagccaagaaacagaagacaaggcggacgtgaggaggaaggggacagttgcagtctcacttgggacaggccacagccaggggtccggccactacccgcccgtgggataaaagccaaaagcatgcgtcagctaacttcagcctgtgctgctgggcccgcaccccatgtcccttgtcactgtggcatcctgcacccatcctcacccctccgtagagcccctcgtgcaatgcaatgaatggaccctcctgtcactctgctgaacagaatttattttctgagtcaaatataatttattattatttttgtcaaagaagtatttaagctgtgctgtggtgtgagaatgtcattcttgatcttcagccttcgtttgcaagaagagttccagttgatgtggtgtttggttccatggcggggtaccctagggattcatctgttttcttcacttccctttgcatctgagatcctgctggaaaccacggcaacctgtatccactattaggaggtaaaaatcaataaaatggcccattcatttgtgttgtagctca

SEQ ID NO: 314932 - DNA, 3153 bp, Homo sapiens
agccgacgaccgtggagctccatgtggatggagtcagtgacatctgcacaaagggtggggacatcaactttgtcttcactgggttctctgtgaatggcaaggtcctcagcaaagggcagcccctgggtcctgcgggagttcaggtgtctctgagaaacactgggaccgaagcaaagatccagtccacagttacacagcctggcggaaagtttgcattttttaaagttctgcctggagattatgaaatcctcgcaactcatccaacctgggcgttgaaagaggcaagcaccacagtgcgtgtaaccaactccaatgccaatgcggccagtcccctcatagttgctggctacaatgtgtctggctctgtccgaagtgatggggagcccatgaaaggcgtgaagtttcttctcttttcttctttagtaactaaagaggatgtcctgggctgcaatgtctcaccagtgcctgggttccagccccaagacgagagtctggtgtatttgtgctacacggtctccagagaagatggctcgttctctttctattccttgccaagtgggggctacactgtgattccgttctatcgaggggagaggattacctttgatgtggcgccttccagacttgacttcacagtggagcatgacagcttgaaaatcgagcccgtgttccacgtcatgggattctccgtcaccgggagggtcttgaacggacccgaaggagatggtgttccagaagcagtagtcaccctgaataaccaaatcaaagttaaaacaaaagctgatggctcattccgccttgagaacataaccacagggacatacaccatccatgctcagaaagagcacctctactttgaaacggtcaccatcaaaattgcaccaaacacacctcagctggctgacattgttgcaacagggttcagtgtctgtggtcagatatcaatcattcgcttccccgacaccgtcaagcagatgaataaatacaaagttgtcctgtcatctcaagacaaggacaagtctttggtcaccgtggagacagatgctcatggatcattttgttttaaagcaaacccagggacttacaaagtgcaggtgatggttcctgaggcagaaaccagagcagggctgacgttgaaaccccagacatttcctcttactgtgaccgacaggcctgtgatggatgtggcctttgtacagttcttggcatcagtttctgggaaagtctcttgtttggacacctgtggtgacttgctggtgactctacagtccctgagccgccagggtgagaagcggagcctccagctctccggcaaggtcaacgccatgactttcacctttgacaacgtgctccctggaaaatacaaaataagcatcatgcatgaggattggtgctggaagaacaagagcctggaggtggaagtgctggaggatgacgtgtctgcagttgagttcaggcagacgggctacatgctgagatgttccctgtctcacgccatcactctggaattttatcaggatggaaatgggcgtgagaatgtggggatttataacctctccaaaggagtcaaccgattctgcctgtccaagcctggtgtgtacaaagtgacccctcgctcctgccaccggtttgagcaagcgttctacacctatgacacgtcttcacctagtatcttgacattgacagccattcgccaccatgtccttggaactatcaccaccgacaaaatgatggatgtcactgtgactatcaagtcttccatcgacagtgaacccgccttggtcttaggccctctgaagtctgtgcaggagctgcggagggagcagcagctggctgagatcgaggcccgcaggcaggagagggagaaaaacggcaatgaggaaggtgaagaaagaatgaccaagcctcccgtgcaggagatggtagatgagttacaaggccccttctcgtatgatttctcttactgggcgcggtctggagagaaaatcactgttacaccgtcatctaaagagctgctcttttatcccccttcaatggaagccgttgtcagtggagaaagctgcccagggaagctgatcgagatccacgggaaggcaggcctgtttttagaaggccagatccaccccgagttggaaggagtcgagattgtcatcagtgaaaagggggcaagttcaccgctgatcacagtctttactgatgacaaaggtgcctacagtgttggccccctgcacagtgacctggagtacacggtgacctcacagaaggagggctatgttctgactgcagtggaaggaaccatcggagacttcaaggcctatgccctggcaggcgtaagctttgagataaaagctgaggatgaccagcccctcccgggagtcctcttatccctgagtggtggcctgtttcgttccaacctcttgacccaggacaacggcattctgacattctcaaacctgagccctggccagtattacttcaaacccatgatgaaggagttccggtttgagccatcctcacagatgatcgaggtgcaggaaggccagaacctgaagatcaccatcacggggtaccgaaccgcttacagttgctatggcacagtgtcttccttaaacggagagcccgaacaaggggttgccatggaagcggtgggccagaacgactgcagcatttacggagaagacaccgtgacagacgaagagggcaagttcagattacgtggattgctgccgggatgtgtgtaccacgttcagctcaaggcagaaggcaacgaccacattgagcgggcgctcccccaccatagggtgattgaggttgggaataatgacatcgatgatgtaaacatcatagttttccggcagattaatcaatttgatttaagtggaaatgtgatcacttcctctgaataccttcctacgttatgggtcaagctttacaaaagcgaaaacctcgacaatccaatccagacagtttcccttggccagtccctgttcttccatttccccccactgctcagagatggcgagaactatgtttcgcttctggacttcacacttcccatatcgcattatgattacatactggtcaagtcttgttcactgataacggattcacttccatcactctttacaaactgtcgtactgggattgctggat

SEQ ID NO: 314933 - DNA, 3333 bp, Homo sapiens
agccgacgaccgtggagctccatgtggatggagtcagtgacatctgcacaaagggtggggacatcaactttgtcttcactgggttctctgtgaatggcaaggtcctcagcaaagggcagcccctgggtcctgcgggagttcaggtgtctctgagaaacactgggaccgaagcaaagatccagtccacagttacacagcctggcggaaagtttgcattttttaaagttctgcctggagattatgaaatcctcgcaactcatccaacctgggcgttgaaagaggcaagcaccacagtgcgtgtaaccaactccaatgccaatgcggccagtcccctcatagttgctggctacaatgtgtctggctctgtccgaagtgatggggagcccatgaaaggcgtgaagtttcttctcttttcttctttagtaactaaagaggatgtcctgggctgcaatgtctcaccagtgcctgggttccagccccaagacgagagtctggtgtatttgtgctacacggtctccagagaagatggctcgttctctttctattccttgccaagtgggggctacactgtgattccgttctatcgaggggagaggattacctttgatgtggcgccttccagacttgacttcacagtggagcatgacagcttgaaaatcgagcccgtgttccacgtcatgggattctccgtcaccgggagggtcttgaacggacccgaaggagatggtgttccagaagcagtagtcaccctgaataaccaaatcaaagttaaaacaaaagctgatggctcattccgccttgagaacataaccacagggacatacaccatccatgctcagaaagagcacctctactttgaaacggtcaccatcaaaattgcaccaaacacacctcagctggctgacattgttgcaacagggttcagtgtctgtggtcagatatcaatcattcgcttccccgacaccgtcaagcagatgaataaatacaaagttgtcctgtcatctcaagacaaggacaagtctttggtcaccgtggagacagatgctcatggatcattttgttttaaagcaaacccagggacttacaaagtgcaggtgatggttcctgaggcagaaaccagagcagggctgacgttgaaaccccagacatttcctcttactgtgaccgacaggcctgtgatggatgtggcctttgtacagttcttggcatcagtttctgggaaagtctcttgtttggacacctgtggtgacttgctggtgactctacagtccctgagccgccagggtgagaagcggagcctccagctctccggcaaggtcaacgccatgactttcacctttgacaacgtgctccctggaaaatacaaaataagcatcatgcatgaggattggtgctggaagaacaagagcctggaggtggaagtgctggaggatgacgtgtctgcagttgagttcaggcagacgggctacatgctgagatgttccctgtctcacgccatcactctggaattttatcaggatggaaatgggcgtgagaatgtggggatttataacctctccaaaggagtcaaccgattctgcctgtccaagcctggtgtgtacaaagtgacccctcgctcctgccaccggtttgagcaagcgttctacacctatgacacgtcttcacctagtatcttgacattgacagccattcgccaccatgtccttggaactatcaccaccgacaaaatgatggatgtcactgtgactatcaagtcttccatcgacagtgaacccgccttggtcttaggccctctgaagtctgtgcaggagctgcggagggagcagcagctggctgagatcgaggcccgcaggcaggagagggagaaaaacggcaatgaggaaggtgaagaaagaatgaccaagcctcccgtgcaggagatggtagatgagttacaaggccccttctcgtatgatttctcttactgggcgcggtctggagagaaaatcactgttacaccgtcatctaaagagctgctcttttatcccccttcaatggaagccgttgtcagtggagaaagctgcccagggaagctgatcgagatccacgggaaggcaggcctgtttttagaaggccagatccaccccgagttggaaggagtcgagattgtcatcagtgaaaagggggcaagttcaccgctgatcacagtctttactgatgacaaaggtgcctacagtgttggccccctgcacagtgacctggagtacacggtgacctcacagaaggagggctatgttctgactgcagtggaaggaaccatcggagacttcaaggcctatgccctggcaggcgtaagctttgagataaaagctgaggatgaccagcccctcccgggagtcctcttatccctgagtggtggcctgtttcgttccaacctcttgacccaggacaacggcattctgacattctcaaacctgagccctggccagtattacttcaaacccatgatgaaggagttccggtttgagccatcctcacagatgatcgaggtgcaggaaggccagaacctgaagatcaccatcacggggtaccgaaccgcttacagttgctatggcacagtgtcttccttaaacggagagcccgaacaaggggttgccatggaagcggtgggccagaacgactgcagcatttacggagaagacaccgtgacagacgaagagggcaagttcagattacgtggattgctgccgggatgtgtgtaccacgttcagctcaaggcagaaggcaacgaccacattgagcgggcgctcccccaccatagggtgattgaggttgggaataatgacatcgatgatgtaaacatcatagttttccggcagattaatcaatttgatttaagtggaaatgtgatcacttcctctgaataccttcctacgttatgggtcaagctttacaaaagcgaaaacctcgacaatccaatccagacagtttcccttggccagtccctgttcttccatttccccccactgctcagagatggcgagaactatgttgtgcttctggactccacactccccagaatccagtatgactacatcttgcctcaagattctttcaccgcagtggggtaccataagacgttcacttgatttttaatcccccgaggaactgcctgacagggaatgccaaggtccaattgccgcaatgaggcgcggatgggcgggtgacccgcaagcaactagggggggtcggaaggagaagaccggccagcctttaataggcgagagaaggccaacagggcacaaacggtgggcgcaccaaatgggcagccaccaacctgtggccgcgcctcgg

SEQ ID NO: 314934 - DNA, 1148 bp, Homo sapiens
  misc_feature (238)..(238): n is a, c, g, or t
agcggaggtcctctctgggaaccttcagaaacctgatttctggtcctccccaaccagctccctgtccctgcttctgggcgctccttccttcctgagctcccagggttcctcaaggtcacttttggcgacaaaacataaaaaacaaatgatggcaggatggcaggaagaatctctttgtccctgagtttcagaagcaaatagtgaagctttgggcagaagaggattcatgggaaaatanatccaaatcactttggttccttcctttggatagaaggaatttggatcatgagggcccctgggtgtcctcaagtggccactttggaaggctgggtgggtggtggctgtggcattgtggatgatggacaagcttgtggccttggtgaggagtgatggggctctcggtgtttgcagaggaagctgcctgaacaggacatcgcacaaggatcctacattgccctgccattgacgctgctggttctgctggccggttacaaccatgacaagctcattcctttgctgctgcagttgacaagccggctacagggagtcggcgcgctcggccaggcagcctctgacaatagcggcccagaagatgcaaagagacaagccaagaaacagaagacaaggcggacgtgaggaggaaggggacagttgcagtctcacttgggacaggccacagccaggggtccggccactacccgcccgtgggataaaagccaaaagcatgcgtcagctaacttcagcctgtgctgctgggcccgcaccccatgtcccttgtcactgtggcatcctgcacccatcctcacccctccgtagagcccctcgtgcaatgcaatgaatggaccctcctgtcactctgctgaacagaatttattttctgagtcaaatataatttattattatttttgtcaaagaagtatttaagctgtgctgtggtgtgagaatgtcattcttgatcttcagccttcgtttgcaagaagagttccagttgatgtggtgtttggttccatggcggggtaccctagggattcatctgttttcttcacttccctttgcatctgagatcctgctggaaaccacggcaacctgtatccactattaggaggtaaaaatcaataaaatggcccattcatttgtgttgtagctca

SEQ ID NO: 314935 - DNA, 1857 bp, Homo sapiens
  misc_feature (29)..(29): n is a, c, g, or t
  misc_feature (115)..(115): n is a, c, g, or t
  misc_feature (146)..(146): n is a, c, g, or t
  misc_feature (419)..(419): n is a, c, g, or t
  misc_feature (502)..(502): n is a, c, g, or t
  misc_feature (947)..(947): n is a, c, g, or t
aaatgggttgggttctaagagatgtccanagatacaggagtaggcagttgttgatggaaatctgttcctgcccttattctttcatttatgaaagggcatcccaggtacagcggcncccacagtcactctctagcccagcagttctnggatgggttggttgcaggacccctttatactgttaaaaattattgaggattttaaagagtttgagtttgcatggattatctctgtgtatatttatcatattagtaattaaaaccgagatgttgaaaacgcaagaactcacaagctacacattccgttagctgtgggcgtgatgacatcagggtgcgtagtctctggaaaagtccactgtgtgcttgcgaatgaaagagggcggaaaaggcacatcacatcttactattggcaaatgctgtctncccagcaaaagggagggcacaccacttccctagggtccagccagggtgtggcacttaccgcttctgttcctgtaccattggcnaaaatttagttccagggctgcgcctgctgcagggaaggctggaaaaggtgatctatattgtcggtggcccagataaaagttgggggttctattgggagaaagggagaatggccacagggatgctagtagcagtgcctgctttgcttcctcactagaccgtactggctgggaatagctgcccatcactgtgtgccctgggtctagaactgtaggttcttgatacatccttgtaggactaagtccctgcatgttgctgggactcaacaaactgagacccagttgcttttcaaccaccaagactctctgatagctgcatctcttcatttcctcagttgggaggagggtccagaggctgaggaatgccttgtcattggaatctctttgtccctgagtttcagaagcaaatagtgaagctttgggcagaagaggattcatgggaaaatanatccaaatcactttggttccttcctttggatagaaggaatttggatcatgagggcccctgggtgtcctcaagtggccactttggaaggctgggtgggtggtggctgtggcattgtggatgatggacaagcttgtggccttggtgaggagtgatggggctctcggtgtttgcagaggaagctgcctgaacaggacatcgcacaaggatcctacattgccctgccattgacgctgctggttctgctggccggttacaaccatgacaagctcattcctttgctgctgcagttgacaagccggctacagggagtcggcgcgctcggccaggcagcctctgacaatagcggcccagaagatgcaaagagacaagccaagaaacagaagacaaggcggacgtgaggaggaaggggacagttgcagtctcacttgggacaggccacagccaggggtccggccactacccgcccgtgggataaaagccaaaagcatgcgtcagctaacttcagcctgtgctgctgggcccgcaccccatgtcccttgtcactgtggcatcctgcacccatcctcacccctccgtagagcccctcgtgcaatgcaatgaatggaccctcctgtcactctgctgaacagaatttattttctgagtcaaatataatttattattatttttgtcaaagaagtatttaagctgtgctgtggtgtgagaatgtcattcttgatcttcagccttcgtttgcaagaagagttccagttgatgtggtgtttggttccatggcggggtaccctagggattcatctgttttcttcacttccctttgcatctgagatcctgctggaaaccacggcaacctgtatccactattaggaggtaaaaatcaataaaatggcccattcatttgtgttgtagctca

SEQ ID NO: 314936 - DNA, 3347 bp, Homo sapiens
agccgacgaccgtggagctccatgtggatggagtcagtgacatctgcacaaagggtggggacatcaactttgtcttcactgggttctctgtgaatggcaaggtcctcagcaaagggcagcccctgggtcctgcgggagttcaggtgtctctgagaaacactgggaccgaagcaaagatccagtccacagttacacagcctggcggaaagtttgcattttttaaagttctgcctggagattatgaaatcctcgcaactcatccaacctgggcgttgaaagaggcaagcaccacagtgcgtgtaaccaactccaatgccaatgcggccagtcccctcatagttgctggctacaatgtgtctggctctgtccgaagtgatggggagcccatgaaaggcgtgaagtttcttctcttttcttctttagtaactaaagaggatgtcctgggctgcaatgtctcaccagtgcctgggttccagccccaagacgagagtctggtgtatttgtgctacacggtctccagagaagatggctcgttctctttctattccttgccaagtgggggctacactgtgattccgttctatcgaggggagaggattacctttgatgtggcgccttccagacttgacttcacagtggagcatgacagcttgaaaatcgagcccgtgttccacgtcatgggattctccgtcaccgggagggtcttgaacggacccgaaggagatggtgttccagaagcagtagtcaccctgaataaccaaatcaaagttaaaacaaaagctgatggctcattccgccttgagaacataaccacagggacatacaccatccatgctcagaaagagcacctctactttgaaacggtcaccatcaaaattgcaccaaacacacctcagctggctgacattgttgcaacagggttcagtgtctgtggtcagatatcaatcattcgcttccccgacaccgtcaagcagatgaataaatacaaagttgtcctgtcatctcaagacaaggacaagtctttggtcaccgtggagacagatgctcatggatcattttgttttaaagcaaacccagggacttacaaagtgcaggtgatggttcctgaggcagaaaccagagcagggctgacgttgaaaccccagacatttcctcttactgtgaccgacaggcctgtgatggatgtggcctttgtacagttcttggcatcagtttctgggaaagtctcttgtttggacacctgtggtgacttgctggtgactctacagtccctgagccgccagggtgagaagcggagcctccagctctccggcaaggtcaacgccatgactttcacctttgacaacgtgctccctggaaaatacaaaataagcatcatgcatgaggattggtgctggaagaacaagagcctggaggtggaagtgctggaggatgacgtgtctgcagttgagttcaggcagacgggctacatgctgagatgttccctgtctcacgccatcactctggaattttatcaggatggaaatgggcgtgagaatgtggggatttataacctctccaaaggagtcaaccgattctgcctgtccaagcctggtgtgtacaaagtgacccctcgctcctgccaccggtttgagcaagcgttctacacctatgacacgtcttcacctagtatcttgacattgacagccattcgccaccatgtccttggaactatcaccaccgacaaaatgatggatgtcactgtgactatcaagtcttccatcgacagtgaacccgccttggtcttaggccctctgaagtctgtgcaggagctgcggagggagcagcagctggctgagatcgaggcccgcaggcaggagagggagaaaaacggcaatgaggaaggtgaagaaagaatgaccaagcctcccgtgcaggagatggtagatgagttacaaggccccttctcgtatgatttctcttactgggcgcggtctggagagaaaatcactgttacaccgtcatctaaagagctgctcttttatcccccttcaatggaagccgttgtcagtggagaaagctgcccagggaagctgatcgagatccacgggaaggcaggcctgtttttagaaggccagatccaccccgagttggaaggagtcgagattgtcatcagtgaaaagggggcaagttcaccgctgatcacagtctttactgatgacaaaggtgcctacagtgttggccccctgcacagtgacctggagtacacggtgacctcacagaaggagggctatgttctgactgcagtggaaggaaccatcggagacttcaaggcctatgccctggcaggcgtaagctttgagataaaagctgaggatgaccagcccctcccgggagtcctcttatccctgagtggtggcctgtttcgttccaacctcttgacccaggacaacggcattctgacattctcaaacctgagccctggccagtattacttcaaacccatgatgaaggagttccggtttgagccatcctcacagatgatcgaggtgcaggaaggccagaacctgaagatcaccatcacggggtaccgaaccgcttacagttgctatggcacagtgtcttccttaaacggagagcccgaacaaggggttgccatggaagcggtgggccagaacgactgcagcatttacggagaagacaccgtgacagacgaagagggcaagttcagattacgtggattgctgccgggatgtgtgtaccacgttcagctcaaggcagaaggcaacgaccacattgagcgggcgctcccccaccatagggtgattgaggttgggaataatgacatcgatgatgtaaacatcatagttttccggcagattaatcaatttgatttaagtggaaatgtgatcacttcctctgaataccttcctacgttatgggtcaagctttacaaaagcgaaaacctcgacaagccaagaaacagaagacaaggcggacgtgaggaggaaggggacagttgcagtctcacttgggacaggccacagccaggggtccgaactatgttgtgcttctggactccacactccccagaatccagtatgactacatcttgcctcaagattctttcaccgcagtggggtaccataagacgttcacttgatttttaatcccccgaggaactgcctgacagggaatgccaaggtccaattgccgcaatgaggcgcggatgggcgggtgacccgcaagcaactagggggggtcggaaggagaagaccggccagcctttaataggcgagagaaggccaacagggcacaaacggtgggcgcaccaaatgggcagccaccaacctgtggccgcgcctcgg

SEQ ID NO: 314937 - DNA, 3368 bp, Homo sapiens
agccgacgaccgtggagctccatgtggatggagtcagtgacatctgcacaaagggtggggacatcaactttgtcttcactgggttctctgtgaatggcaaggtcctcagcaaagggcagcccctgggtcctgcgggagttcaggtgtctctgagaaacactgggaccgaagcaaagatccagtccacagttacacagcctggcggaaagtttgcattttttaaagttctgcctggagattatgaaatcctcgcaactcatccaacctgggcgttgaaagaggcaagcaccacagtgcgtgtaaccaactccaatgccaatgcggccagtcccctcatagttgctggctacaatgtgtctggctctgtccgaagtgatggggagcccatgaaaggcgtgaagtttcttctcttttcttctttagtaactaaagaggatgtcctgggctgcaatgtctcaccagtgcctgggttccagccccaagacgagagtctggtgtatttgtgctacacggtctccagagaagatggctcgttctctttctattccttgccaagtgggggctacactgtgattccgttctatcgaggggagaggattacctttgatgtggcgccttccagacttgacttcacagtggagcatgacagcttgaaaatcgagcccgtgttccacgtcatgggattctccgtcaccgggagggtcttgaacggacccgaaggagatggtgttccagaagcagtagtcaccctgaataaccaaatcaaagttaaaacaaaagctgatggctcattccgccttgagaacataaccacagggacatacaccatccatgctcagaaagagcacctctactttgaaacggtcaccatcaaaattgcaccaaacacacctcagctggctgacattgttgcaacagggttcagtgtctgtggtcagatatcaatcattcgcttccccgacaccgtcaagcagatgaataaatacaaagttgtcctgtcatctcaagacaaggacaagtctttggtcaccgtggagacagatgctcatggatcattttgttttaaagcaaacccagggacttacaaagtgcaggtgatggttcctgaggcagaaaccagagcagggctgacgttgaaaccccagacatttcctcttactgtgaccgacaggcctgtgatggatgtggcctttgtacagttcttggcatcagtttctgggaaagtctcttgtttggacacctgtggtgacttgctggtgactctacagtccctgagccgccagggtgagaagcggagcctccagctctccggcaaggtcaacgccatgactttcacctttgacaacgtgctccctggaaaatacaaaataagcatcatgcatgaggattggtgctggaagaacaagagcctggaggtggaagtgctggaggatgacgtgtctgcagttgagttcaggcagacgggctacatgctgagatgttccctgtctcacgccatcactctggaattttatcaggatggaaatgggcgtgagaatgtggggatttataacctctccaaaggagtcaaccgattctgcctgtccaagcctggtgtgtacaaagtgacccctcgctcctgccaccggtttgagcaagcgttctacacctatgacacgtcttcacctagtatcttgacattgacagccattcgccaccatgtccttggaactatcaccaccgacaaaatgatggatgtcactgtgactatcaagtcttccatcgacagtgaacccgccttggtcttaggccctctgaagtctgtgcaggagctgcggagggagcagcagctggctgagatcgaggcccgcaggcaggagagggagaaaaacggcaatgaggaaggtgaagaaagaatgaccaagcctcccgtgcaggagatggtagatgagttacaaggccccttctcgtatgatttctcttactgggcgcggtctggagagaaaatcactgttacaccgtcatctaaagagctgctcttttatcccccttcaatggaagccgttgtcagtggagaaagctgcccagggaagctgatcgagatccacgggaaggcaggcctgtttttagaaggccagatccaccccgagttggaaggagtcgagattgtcatcagtgaaaagggggcaagttcaccgctgatcacagtctttactgatgacaaaggtgcctacagtgttggccccctgcacagtgacctggagtacacggtgacctcacagaaggagggctatgttctgactgcagtggaaggaaccatcggagacttcaaggcctatgccctggcaggcgtaagctttgagataaaagctgaggatgaccagcccctcccgggagtcctcttatccctgagtggtggcctgtttcgttccaacctcttgacccaggacaacggcattctgacattctcaaacctggtaacgtgttctgcaatttaccacctgcctgtcttccctgagagagagccaggatgcagcatgcgaggacttatgtgttgcttgacaacgtgagaagagaaggccaatgtggagtggtttcagtttcttgggggcccacggtcattagagtattgctcttactcgaacttaatgctgctgattcatgttcccttccacacgcgcttcttgttttctgatcacccgcttgtcactaagacagtgtaattaatttccctggccacaacggctgctctcttaggcgtcttctcgttttgccacggaatcatgcttatgatgctgagtcttgtttggtggttagcttgcgtttcttctgaaaagacattccacttggtgggaagagagcagcagtttttctttcaagatgcagtcggaggccctgactggtggggattcaggaagtgtgtgttagttggtcatcttgtcagtcatggtgacaaagtggctgtggtggggctactggagaccgggcagcgggggcatctgaagacaccactttgcagtgatgcagactgctccttacttgctgtgtcctatcaggcaagttactttgcctctctgagcctcagtttctttattcattaaattcaaatatgagccaggtatggtggcccacgcctgtaatcccaccgctttgggagggtgaggcagtaggatcgcttgagcttgggagtttgagaccagcaacataggaagaccccatctctacaaaaaataaaaaaattagctgggcatggtggtgcatgcctgtggtcccaggtactcaggaggccgaggtgggagatttgcttgagcccagaaggttgagactacggtgtgctgtgatcgtgcactccatcctgggggacagagtcaggccctgtctcagaaaaa

SEQ ID NO: 314938 - DNA, 2469 bp, Homo sapiens
agccgacgaccgtggagctccatgtggatggagtcagtgacatctgcacaaagggtggggacatcaactttgtcttcactgggttctctgtgaatggcaaggtcctcagcaaagggcagcccctgggtcctgcgggagttcaggtgtctctgagaaacactgggaccgaagcaaagatccagtccacagttacacagcctggcggaaagtttgcattttttaaagttctgcctggagattatgaaatcctcgcaactcatccaacctgggcgttgaaagaggcaagcaccacagtgcgtgtaaccaactccaatgccaatgcggccagtcccctcatagttgctggctacaatgtgtctggctctgtccgaagtgatggggagcccatgaaaggcgtgaagtttcttctcttttcttctttagtaactaaagaggatgtcctgggctgcaatgtctcaccagtgcctgggttccagccccaagacgagagtctggtgtatttgtgctacacggtctccagagaagatggctcgttctctttctattccttgccaagtgggggctacactgtgattccgttctatcgaggggagaggattacctttgatgtggcgccttccagacttgacttcacagtggagcatgacagcttgaaaatcgagcccgtgttccacgtcatgggattctccgtcaccgggagggtcttgaacggacccgaaggagatggtgttccagaagcagtagtcaccctgaataaccaaatcaaagttaaaacaaaagctgatggctcattccgccttgagaacataaccacagggacatacaccatccatgctcagaaagagcacctctactttgaaacggtcaccatcaaaattgcaccaaacacacctcagctggctgacattgttgcaacagggttcagtgtctgtggtcagatatcaatcattcgcttccccgacaccgtcaagcagatgaataaatacaaagttgtcctgtcatctcaagacaaggacaagtctttggtcaccgtggagacagatgctcatggatcattttgttttaaagcaaacccagggacttacaaagtgcaggtgatggttcctgaggcagaaaccagagcagggctgacgttgaaaccccagacatttcctcttactgtgaccgacaggcctgtgatggatgtggcctttgtacagttcttggcatcagtttctgggaaagtctcttgtttggacacctgtggtgacttgctggtgactctacagtccctgagccgccagggtgagaagcggagcctccagctctccggcaaggtcaacgccatgactttcacctttgacaacgtgctccctggaaaatacaaaataagcatcatgcatgaggattggtgctggaagaacaagagcctggaggtggaagtgctggaggatgacgtgtctgcagttgagttcaggcagacgggctacatgctgagatgttccctgtctcacgccatcactctggaattttatcaggatggaaatgggcgtgagaatgtggggatttataacctctccaaaggagtcaaccgattctgcctgtccaagcctggtgtgtacaaagtgacccctcgctcctgccaccggtttgagcaagcgttctacacctatgacacgtcttcacctagtatcttgacattgacagccattcgccaccatgtccttggaactatcaccaccgacaaaatgatggatgtcactgtgactatcaagtcttccatcgacagtgaacccgccttggtcttaggccctctgaagtctgtgcaggagctgcggagggagcagcagctggctgagatcgaggcccgcaggcaggagagggagaaaaacggcaatgaggaaggtgaagaaagaatgaccaagcctcccgtgcaggagatggtagatgagttacaaggccccttctcgtatgatttctcttactgggcgcggtctggagagaaaatcactgttacaccgtcatctaaagagctgctcttttatcccccttcaatggaagccgttgtcagtggagaaagctgcccagggaagctgatcgagatccacgggaaggcaggcctgtttttagaaggccagatccaccccgagttggaaggagtcgagattgtcatcagtgaaaagggggcaagttcaccgctgatcacagtctttactgatgacaaaggtgcctacagtgttggccccctgcacagtgacctggagtacacggtgacctcacagaaggagggctatgttctgactgcagtggaaggaaccatcggagacttcaaggcctatgccctggcaggcgtaagctttgagataaaagctgaacgtggtgaagacaggccgagtgatgcttgggggagaccaatccagcagattcaaagccaggcaccattcgtggggacttctgcattcaggttggcaggaacatcattcatggcat

SEQ ID NO: 314939 - DNA, 1905 bp, Homo sapiens
agccgacgaccgtggagctccatgtggatggagtcagtgacatctgcacaaagggtggggacatcaactttgtcttcactgggttctctgtgaatggcaaggtcctcagcaaagggcagcccctgggtcctgcgggagttcaggtgtctctgagaaacactgggaccgaagcaaagatccagtccacagttacacagcctggcggaaagtttgcattttttaaagttctgcctggagattatgaaatcctcgcaactcatccaacctgggcgttgaaagaggcaagcaccacagtgcgtgtaaccaactccaatgccaatgcggccagtcccctcatagttgctggctacaatgtgtctggctctgtccgaagtgatggggagcccatgaaaggcgtgaagtttcttctcttttcttctttagtaactaaagaggatgtcctgggctgcaatgtctcaccagtgcctgggttccagccccaagacgagagtctggtgtatttgtgctacacggtctccagagaagatggctcgttctctttctattccttgccaagtgggggctacactgtgattccgttctatcgaggggagaggattacctttgatgtggcgccttccagacttgacttcacagtggagcatgacagcttgaaaatcgagcccgtgttccacgtcatgggattctccgtcaccgggagggtcttgaacggacccgaaggagatggtgttccagaagcagtagtcaccctgaataaccaaatcaaagttaaaacaaaagctgatggctcattccgccttgagaacataaccacagggacatacaccatccatgctcagaaagagcacctctactttgaaacggtcaccatcaaaattgcaccaaacacacctcagctggctgacattgttgcaacagggttcagtgtctgtggtcagatatcaatcattcgcttccccgacaccgtcaagcagatgaataaatacaaagttgtcctgtcatctcaagacaaggacaagtctttggtcaccgtggagacagatgctcatggatcattttgttttaaagcaaacccagggacttacaaagtgcaggtgatggttcctgaggcagaaaccagagcagggctgacgttgaaaccccagacatttcctcttactgtgaccgacaggcctgtgatggatgtggcctttgtacagttcttggcatcagtttctgggaaagtctcttgtttggacacctgtggtgacttgctggtgactctacagtccctgagccgccagggtgagaagcggagcctccagctctccggcaaggtcaacgccatgactttcacctttgacaacgtgctccctggaaaatacaaaataagcatcatgcatgaggattggtgctggaagaacaagagcctggaggtggaagtgctggaggatgacgtgtctgcagttgagttcaggcagacgggctacatgctgagatgttccctgtctcacgccatcactctggaattttatcaggatggaaatgggcgtgagaatgtggggatttataacctctccaaaggagtcaaccgattctgcctgtccaagcctggtgtgtacaaagtgacccctcgctcctgccaccggtttgagcaagcgttctacacctatgacacgtttcacctagtatctgtgaattgagagcagttcgccacatgtcccttggagtatacacaggagaaatgatggctgtccatggtgacatatcaaggtttccatggacagggaacccgcttgggcttaagcttcggagttgggcggattggatggaaagagatggtggaatgagacgaaggaggaggagacaggtatatgatgtggaaatgcaccggggtataaggtaagagaagtaaaaaagggaaga

SEQ ID NO: 314940 - DNA, 1259 bp, Homo sapiens
ctagagggtgacgtttcctctcctggctccttaccacctgccgtgaagatgatctactctggcctttctctgtggctccaggggtgttgaaatagtcacttcctacagcgatgcggaaacatcttgggctttggggtcacacttcccctgagttcagagccttcatagatgtgtggcagccttcttagctgagtgaccttgggcaagttactcttagtctcttcgtgcttgactttcctcgtctataagacggggtgatgatcccgaccttgccagtggtagaaagcaaagcagccgcgggcctcatgcaatgtgcatggtgcctggcagctggtcggtgctcagcacacagagctgtggctgcccctggtgccgttccagggatgctgtatttttaggatttgccagcttacgagcctctcaagcatcgtcccttagaagtcagccccgttgtggatcctcagttgtatcacgtacctccctcatcagaattggctcataataattttttgtgtttcataaagtcagatcctcagaggaccgtaattgtcaaggttgggtactcataaaaaggctgcaggctctgacagccttatcagaagccacagtctcagagacactggggacacatgcccgccactgatggaatagcccgctgaggttgatactttgaaggcagcaaccttggtttggatgtgtagtcttggggatttctttaaaaacataaagttctttacatcacagccatacgttaggttttagttttcatttgctttgccagagctgtccttataaaaataacttcttcccatgtgtgcacagaactatgttgtgcttctggactccacactccccagatcccagtatgactacatcttgcctcaagtttctttcaccgcagtgggctaccataaacacatcaccttgatttttaatcccacggtaagtaaaagagggagttaaaaaaaaatccatgggctgggtttggtggctcacgcctgtaatcccagcactttgggaggccaaggctggtggatctcttgagcccgggagtttcagaccagcctaggcaatacggtaaaaccccaactctacaaaaaatacaaaaattaaccgggcgtggtggaacgcacctatagtcccggctactcgggaggctgaggtgggaggatcacttgagcctgggaggttgaggcctcgatgagccatgatcatgcccctgcactccagcttgggtaacagagtgagaccctttctcc

SEQ ID NO: 314941 - DNA, 875 bp, Homo sapiens
  misc_feature (238)..(238): n is a, c, g, or t
agcggaggtcctctctgggaaccttcagaaacctgatttctggtcctccccaaccagctccctgtccctgcttctgggcgctccttccttcctgagctcccagggttcctcaaggtcacttttggcgacaaaacataaaaaacaaatgatggcaggatggcaggaagaatctctttgtccctgagtttcagaagcaaatagtgaagctttgggcagaagaggattcatgggaaaatanatccaaatcactttggttccttcctttggatagaaggaatttggatcatgagggcccctgggtgtcctcaagtggccactttggaaggctgggtgggtggtggctgtggcattgtggatgatggacaagcttgtggccttggtgaggagtgatggggctctcggtgtttgcagaggaagctgcctgaacaggacatcgcacaaggatcctacattgccctgccattgacgctgctggttctgctggccggttacaaccatgacaagctcattcctttgctgctgcagttgacaagccggctacagggagtcggcgcgctcggccaggcagcctctgacaatagcggcccagaagatgcaaagagacaagccaagaaacagaagacaaggcggacgtgaggaggaaggggacagttgcagtctcacttgggacaggccacagccaggggtccgccttcgtttgcaagaagagttccagttgatgtggtgtttggttccatggcggggtaccctagggattcatctgttttcttcacttccctttgcatctgagatcctgctggaaaccacggcaacctgtatccactattaggaggtaaaaatcaataaaatggcccattcatttgtgttgtagctca

SEQ ID NO: 314942 - DNA, 348 bp, Homo sapiens
cctccttggaactgggaagttttcagccattattctggccgtcatttactgattataaagtgcttattatcaattctatttggacagagctaacttgtagttggtgtggggagtgcaaactttgcaaagaatttggttcttttctggtggtcttagcctgaggatgtcaagtgtgagcctagagggtgacgtttcctctcctggctccttaccacctgccgtgaagatgatctactctggcctttctctgtggaaaatggctgcgaaataatgaaacaggctgtcacggaattttctcctcctctttctccaggggtgttgaaatagtcacttcctacagcgatgcgg

SEQ ID NO: 314943 - DNA, 632 bp, Homo sapiens
gtttcaaagaagtcagccggtaggagtgggatttgggaaactttttgttttgcctttgttgtttgctactgatcacctgcgtgcgagggaggcttcttggagtcaggtgggtacatcttaacttgaaagaagcgctccgtctgcctccggccactgcctcttaggagctcagcagtagcaagaagctattacatagggttaggattcgaacctgtgctgaagccttataaggggtcacatggagccctcccttcttttccctgcagacacctgtggtgacttgctggtgactctacagtccctgagccgccagggtgagaagcggagcctccagctctccggcaaggtcaacgccatgactttcacctttgacaacgtgctccctggaaaatacaaaagtaagaattggaatgcaacatcctgtggccctcacacacttcttgtctttgtaaactttctaaaactcaggtctcaaattgtatcacgaccatgtacctttccttgttttaagtcgtctttgcctcgtgaccttgactgcattatttagcgttggacaagcatggaggagtccaggccctgagctgaccaccaccttgtctgcacagcccactggcggcttctgttaagggagg

SEQ ID NO: 314944 - DNA, 353 bp, Homo sapiens
ctcgtatgatttctcttactgggcgcggtaagctctcttgtgcgtttccctacagtgtcctctgttttgtggggacaggacccgccaaactgaagtatattaattattttaggtctggagagaaaatcactgttacaccgtcatctaaagagctgctcttttatcccccttcaatggaagccgttgtcagtggaggtaaatgtcaactcagcgagtgaatgtcacacacacctttgcagttgttcccttgcctgcatttacaagtagatttgtgatgttatagtgaagccatctttgtaagccaccttacatcctctctggcacacagatgttactgttggttggatggatgg

SEQ ID NO: 314945 - DNA, 1456 bp, Homo sapiens
cctcgatcatctgtgaggatggctcaaaccggaactccttcatcatgggtttgaagtaatactggccagggttccggtttgagccatcctcacagatgatcgaggtgcaggaaggccagaacctgaagatcaccatcacggggtaccgaaccgcttacagttgctatggcacagtgtcttccttaaacggagagcccgaacaaggggttgccatggaagcggtgggccagaacgactgcagcatttacggagaagacaccgtgacagacgaagagggcaagttcagattacgtggattgctgccgggatgtgtgtaccacgttcagctcaaggcagaaggcaacgaccacattgagcgggcgctcccccaccatagggtgattgaggttgggaataatgacatcgatgatgtaaacatcatagttttccggcagattaatcaatttgatttaagtggaaatgtgatcacttcctctgaataccttcctacgttatgggtcaagctttacaaaagcgaaaacctcgacaatccaatccagacagtttcccttggccagtccctgttcttccatttccccccactgctcagagatggcgagaactatgttgtgcttctggactccacactccccagatcccagtatgactacatcttgcctcaagtttctttcaccgcagtgggctaccataaacacatcaccttgatttttaatcccacgaggaagctgcctgaacaggacatcgcacaaggatcctacattgccctgccattgacgctgctggttctgctggccggttacaaccatgacaagctcattcctttgctgctgcagttgacaagccggctacagggagtcggcgcgctcggccaggcagcctctgacaatagcggcccagaagatgcaaagagacaagccaagaaacagaagacaaggcggacgtgaggaggaaggggacagttgcagtctcacttgggacaggccacagccaggggtccggccactacccgcccgtgggataaaagccaaaagcatgcgtcagctaacttcagcctgtgctgctgggcccgcaccccatgtcccttgtcactgtggcatcctgcacccatcctcacccctccgtagagcccctcgtgcaatgcaatgaatggaccctcctgtcactctgctgaacagaatttattttctgagtcaaatataatttattattatttttgtcaaagaagtatttaagctgtgctgtggtgtgagaatgtcattcttgatcttcagccttcgtttgcaagaagagttccagttgatgtggtgtttggttccatggcggggtaccctagggattcatctgttttcttcacttccctttgcatctgagatcctgctggaaaccacggcaacctgtatccactattaggaggtaaaaatcaataaaatggcccattcatttgtgttgtagctca

SEQ ID NO: 314946 - DNA, 2670 bp, Homo sapiens
tcaggactgtagagtcaccagcaagtcaccacaggtgtccaaacaagagactttccagtccctgagccgccagggtgagaagcggagcctccagctctccggcaaggtcaacgccatgactttcacctttgacaacgtgctccctggaaaatacaaaataagcatcatgcatgaggattggtgctggaagaacaagagcctggaggtggaagtgctggaggatgacgtgtctgcagttgagttcaggcagacgggctacatgctgagatgttccctgtctcacgccatcactctggaattttatcaggatggaaatgggcgtgagaatgtggggatttataacctctccaaaggagtcaaccgattctgcctgtccaagcctggtgtgtacaaagtgacccctcgctcctgccaccggtttgagcaagcgttctacacctatgacacgtcttcacctagtatcttgacattgacagccattcgccaccatgtccttggaactatcaccaccgacaaaatgatggatgtcactgtgactatcaagtcttccatcgacagtgaacccgccttggtcttaggccctctgaagtctgtgcaggagctgcggagggagcagcagctggctgagatcgaggcccgcaggcaggagagggagaaaaacggcaatgaggaaggtgaagaaagaatgaccaagcctcccgtgcaggagatggtagatgagttacaaggccccttctcgtatgatttctcttactgggcgcggtctggagagaaaatcactgttacaccgtcatctaaagagctgctcttttatcccccttcaatggaagccgttgtcagtggagaaagctgcccagggaagctgatcgagatccacgggaaggcaggcctgtttttagaaggccagatccaccccgagttggaaggagtcgagattgtcatcagtgaaaagggggcaagttcaccgctgatcacagtctttactgatgacaaaggtgcctacagtgttggccccctgcacagtgacctggagtacacggtgacctcacagaaggagggctatgttctgactgcagtggaaggaaccatcggagacttcaaggcctatgccctggcaggcgtaagctttgagataaaagctgaggatgaccagcccctcccgggagtcctcttatccctgagtggtggcctgtttcgttccaacctcttgacccaggacaacggcattctgacattctcaaacctgagccctggccagtattacttcaaacccatgatgaaggagttccggtttgagccatcctcacagatgatcgaggtgcaggaaggccagaacctgaagatcaccatcacggggtaccgaaccgcttacagttgctatggcacagtgtcttccttaaacggagagcccgaacaaggggttgccatggaagcggtgggccagaacgactgcagcatttacggagaagacaccgtgacagacgaagagggcaagttcagattacgtggattgctgccgggatgtgtgtaccacgttcagctcaaggcagaaggcaacgaccacattgagcgggcgctcccccaccatagggtgattgaggttgggaataatgacatcgatgatgtaaacatcatagttttccggcagattaatcaatttgatttaagtggaaatgtgatcacttcctctgaataccttcctacgttatgggtcaagctttacaaaagcgaaaacctcgacaatccaatccagacagtttcccttggccagtccctgttcttccatttccccccactgctcagagatggcgagaactatgttgtgcttctggactccacactccccagatcccagtatgactacatcttgcctcaagtttctttcaccgcagtgggctaccataaacacatcaccttgatttttaatcccacgaggaagctgcctgaacaggacatcgcacaaggatcctacattgccctgccattgacgctgctggttctgctggccggttacaaccatgacaagctcattcctttgctgctgcagttgacaagccggctacagggagtcggcgcgctcggccaggcagcctctgacaatagcggcccagaagatgcaaagagacaagccaagaaacagaagacaaggcggacgtgaggaggaaggggacagttgcagtctcacttgggacaggccacagccaggggtccggccactacccgcccgtgggataaaagccaaaagcatgcgtcagctaacttcagcctgtgctgctgggcccgcaccccatgtcccttgtcactgtggcatcctgcacccatcctcacccctccgtagagcccctcgtgcaatgcaatgaatggaccctcctgtcactctgctgaacagaatttattttctgagtcaaatataatttattattatttttgtcaaagaagtatttaagctgtgctgtggtgtgagaatgtcattcttgatcttcagccttcgtttgcaagaagagttccagttgatgtggtgtttggttccatggcggggtaccctagggattcatctgttttcttcacttccctttgcatctgagatcctgctggaaaccacggcaacctgtatccactattaggaggtaaaaatcaataaaatggcccattcatttgtgttgtagctca

SEQ ID NO: 314947 - DNA, 2379 bp, Homo sapiens
acgtcttcacctagtatcttgacataggtgtagaacgcttgctcaaaccggtggcaggagcgaggggtcactttgtacacaccaggcttggacaggcagaatcggttgactcctttggagaggttataaatccccacattctcacgcccatgacacgtcttcacctagtatcttgacattgacagccattcgccaccatgtccttggaactatcaccaccgacaaaatgatggatgtcactgtgactatcaagtcttccatcgacagtgaacccgccttggtcttaggccctctgaagtctgtgcaggagctgcggagggagcagcagctggctgagatcgaggcccgcaggcaggagagggagaaaaacggcaatgaggaaggtgaagaaagaatgaccaagcctcccgtgcaggagatggtagatgagttacaaggccccttctcgtatgatttctcttactgggcgcggtctggagagaaaatcactgttacaccgtcatctaaagagctgctcttttatcccccttcaatggaagccgttgtcagtggagaaagctgcccagggaagctgatcgagatccacgggaaggcaggcctgtttttagaaggccagatccaccccgagttggaaggagtcgagattgtcatcagtgaaaagggggcaagttcaccgctgatcacagtctttactgatgacaaaggtgcctacagtgttggccccctgcacagtgacctggagtacacggtgacctcacagaaggagggctatgttctgactgcagtggaaggaaccatcggagacttcaaggcctatgccctggcaggcgtaagctttgagataaaagctgaggatgaccagcccctcccgggagtcctcttatccctgagtggtggcctgtttcgttccaacctcttgacccaggacaacggcattctgacattctcaaacctgagccctggccagtattacttcaaacccatgatgaaggagttccggtttgagccatcctcacagatgatcgaggtgcaggaaggccagaacctgaagatcaccatcacggggtaccgaaccgcttacagttgctatggcacagtgtcttccttaaacggagagcccgaacaaggggttgccatggaagcggtgggccagaacgactgcagcatttacggagaagacaccgtgacagacgaagagggcaagttcagattacgtggattgctgccgggatgtgtgtaccacgttcagctcaaggcagaaggcaacgaccacattgagcgggcgctcccccaccatagggtgattgaggttgggaataatgacatcgatgatgtaaacatcatagttttccggcagattaatcaatttgatttaagtggaaatgtgatcacttcctctgaataccttcctacgttatgggtcaagctttacaaaagcgaaaacctcgacaatccaatccagacagtttcccttggccagtccctgttcttccatttccccccactgctcagagatggcgagaactatgttgtgcttctggactccacactccccagatcccagtatgactacatcttgcctcaagtttctttcaccgcagtgggctaccataaacacatcaccttgatttttaatcccacgaggaagctgcctgaacaggacatcgcacaaggatcctacattgccctgccattgacgctgctggttctgctggccggttacaaccatgacaagctcattcctttgctgctgcagttgacaagccggctacagggagtcggcgcgctcggccaggcagcctctgacaatagcggcccagaagatgcaaagagacaagccaagaaacagaagacaaggcggacgtgaggaggaaggggacagttgcagtctcacttgggacaggccacagccaggggtccggccactacccgcccgtgggataaaagccaaaagcatgcgtcagctaacttcagcctgtgctgctgggcccgcaccccatgtcccttgtcactgtggcatcctgcacccatcctcacccctccgtagagcccctcgtgcaatgcaatgaatggaccctcctgtcactctgctgaacagaatttattttctgagtcaaatataatttattattatttttgtcaaagaagtatttaagctgtgctgtggtgtgagaatgtcattcttgatcttcagccttcgtttgcaagaagagttccagttgatgtggtgtttggttccatggcggggtaccctagggattcatctgttttcttcacttccctttgcatctgagatcctgctggaaaccacggcaacctgtatccactattaggaggtaaaaatcaataaaatggcccattcatttgtgttgtagctca

SEQ ID NO: 314948 - DNA, 4377 bp, Homo sapiens
  misc_feature (3901)..(3901): n is a, c, g, or t
  misc_feature (3914)..(3914): n is a, c, g, or t
  misc_feature (3924)..(3924): n is a, c, g, or t
  misc_feature (3926)..(3926): n is a, c, g, or t
  misc_feature (3937)..(3937): n is a, c, g, or t
  misc_feature (3951)..(3951): n is a, c, g, or t
  misc_feature (3955)..(3955): n is a, c, g, or t
  misc_feature (3959)..(3959): n is a, c, g, or t
agccgacgaccgtggagctccatgtggatggagtcagtgacatctgcacaaagggtggggacatcaactttgtcttcactgggttctctgtgaatggcaaggtcctcagcaaagggcagcccctgggtcctgcgggagttcaggtgtctctgagaaacactgggaccgaagcaaagatccagtccacagttacacagcctggcggaaagtttgcattttttaaagttctgcctggagattatgaaatcctcgcaactcatccaacctgggcgttgaaagaggcaagcaccacagtgcgtgtaaccaactccaatgccaatgcggccagtcccctcatagttgctggctacaatgtgtctggctctgtccgaagtgatggggagcccatgaaaggcgtgaagtttcttctcttttcttctttagtaactaaagaggatgtcctgggctgcaatgtctcaccagtgcctgggttccagccccaagacgagagtctggtgtatttgtgctacacggtctccagagaagatggctcgttctctttctattccttgccaagtgggggctacactgtgattccgttctatcgaggggagaggattacctttgatgtggcgccttccagacttgacttcacagtggagcatgacagcttgaaaatcgagcccgtgttccacgtcatgggattctccgtcaccgggagggtcttgaacggacccgaaggagatggtgttccagaagcagtagtcaccctgaataaccaaatcaaagttaaaacaaaagctgatggctcattccgccttgagaacataaccacagggacatacaccatccatgctcagaaagagcacctctactttgaaacggtcaccatcaaaattgcaccaaacacacctcagctggctgacattgttgcaacagggttcagtgtctgtggtcagatatcaatcattcgcttccccgacaccgtcaagcagatgaataaatacaaagttgtcctgtcatctcaagacaaggacaagtctttggtcaccgtggagacagatgctcatggatcattttgttttaaagcaaacccagggacttacaaagtgcaggtgatggttcctgaggcagaaaccagagcagggctgacgttgaaaccccagacatttcctcttactgtgaccgacaggcctgtgatggatgtggcctttgtacagttcttggcatcagtttctgggaaagtctcttgtttggacacctgtggtgacttgctggtgactctacagtccctgagccgccagggtgagaagcggagcctccagctctccggcaaggtcaacgccatgactttcacctttgacaacgtgctccctggaaaatacaaaataagcatcatgcatgaggattggtgctggaagaacaagagcctggaggtggaagtgctggaggatgacgtgtctgcagttgagttcaggcagacgggctacatgctgagatgttccctgtctcacgccatcactctggaattttatcaggatggaaatgggcgtgagaatgtggggatttataacctctccaaaggagtcaaccgattctgcctgtccaagcctggtgtgtacaaagtgacccctcgctcctgccaccggtttgagcaagcgttctacacctatgacacgtcttcacctagtatcttgacattgacagccattcgccaccatgtccttggaactatcaccaccgacaaaatgatggatgtcactgtgactatcaagtcttccatcgacagtgaacccgccttggtcttaggccctctgaagtctgtgcaggagctgcggagggagcagcagctggctgagatcgaggcccgcaggcaggagagggagaaaaacggcaatgaggaaggtgaagaaagaatgaccaagcctcccgtgcaggagatggtagatgagttacaaggccccttctcgtatgatttctcttactgggcgcggtctggagagaaaatcactgttacaccgtcatctaaagagctgctcttttatcccccttcaatggaagccgttgtcagtggagaaagctgcccagggaagctgatcgagatccacgggaaggcaggcctgtttttagaaggccagatccaccccgagttggaaggagtcgagattgtcatcagtgaaaagggggcaagttcaccgctgatcacagtctttactgatgacaaaggtgcctacagtgttggccccctgcacagtgacctggagtacacggtgacctcacagaaggagggctatgttctgactgcagtggaaggaaccatcggagacttcaaggcctatgccctggcaggcgtaagctttgagataaaagctgaggatgaccagcccctcccgggagtcctcttatccctgagtggtggcctgtttcgttccaacctcttgacccaggacaacggcattctgacattctcaaacctgagccctggccagtattacttcaaacccatgatgaaggagttccggtttgagccatcctcacagatgatcgaggtgcaggaaggccagaacctgaagatcaccatcacggggtaccgaaccgcttacagttgctatggcacagtgtcttccttaaacggagagcccgaacaaggggttgccatggaagcggtgggccagaacgactgcagcatttacggagaagacaccgtgacagacgaagagggcaagttcagattacgtggattgctgccgggatgtgtgtaccacgttcagctcaaggcagaaggcaacgaccacattgagcgggcgctcccccaccatagggtgattgaggttgggaataatgacatcgatgatgtaaacatcatagttttccggcagattaatcaatttgatttaagtggaaatgtgatcacttcctctgaataccttcctacgttatgggtcaagctttacaaaagcgaaaacctcgacaatccaatccagacagtttcccttggccagtccctgttcttccatttccccccactgctcagagatggcgagaactatgttgtgcttctggactccacactccccagatcccagtatgactacatcttgcctcaagtttctttcaccgcagtgggctaccataaacacatcaccttgatttttaatcccacgaggaagctgcctgaacaggacatcgcacaaggatcctacattgccctgccattgacgctgctggttctgctggccggttacaaccatgacaagctcattcctttgctgctgcagttgacaagccggctacagggagtcggcgcgctcggccaggcagcctctgacaatagcggcccagaagatgcaaagagacaagccaagaaacagaagacaaggcggacgtgaggaggaaggggacagttgcagtctcacttgggacaggccacagccaggggtccggccactacccgcccgtgggataaaagccaaaagcatgcgtcagctaacttcagcctgtgctgctgggcccgcaccccatgtcccttgtcactgtggcatcctgcacccatcctcacccctccgtagagcccctcgtgcaatgcaatgaatggaccctcctgtcactctgctgaacagaatttattttctgagtcaaatataatttattattatttttgtcaaagaagtatttaagctgtgctgtggtgtgagaatgtcattcttgatcttcagccttcgtttgcaagaagagttccagttgatgtggtgtttggttccatggcggggtaccctagggattcatctgttttcttcacttccctttgcatctgagatcctgctggaaaccacggcaacctgtatccactattaggaggtaaaaatcaataaaatggcccattcatttgtgttgtagctcaaaaaaaaaaaaaaaaaaaaanaaaaaaaaaaaanaaaaaaaaananaaaaaaaaaanaaaaaaaaaaaaanaaanaaanaaaaaaaaaaaaaaaaaaaaaaaaaaaccgggggcccaaattgggggggggggaacaaaaggggtcagaaagggcgcggggcaaaaggggttccggtcaccccagcattttgttgccccacagggggtacaatagcggcgggggaccccccatataggtggagggcgacaataaaatcacgaaaacagcccgggttagccctggctttcggatcttcttccgctactacgcagagacagcacacaagagcacgaaatgacgagccagccagacagagcagccgcgcagacaataccaatagccgacgtcagcaagagcggagagacagcaacaaaggacacaacaccagacacaagcgaagctgtagacgaacaccaagacatgaaccaacgcgactacgtacaacacgcaccagagg

SEQ ID NO: 314949 - DNA, 4002 bp, Homo sapiens
agccgacgaccgtggagctccatgtggatggagtcagtgacatctgcacaaagggtggggacatcaactttgtcttcactgggttctctgtgaatggcaaggtcctcagcaaagggcagcccctgggtcctgcgggagttcaggtgtctctgagaaacactgggaccgaagcaaagatccagtccacagttacacagcctggcggaaagtttgcattttttaaagttctgcctggagattatgaaatcctcgcaactcatccaacctgggcgttgaaagaggcaagcaccacagtgcgtgtaaccaactccaatgccaatgcggccagtcccctcatagttgctggctacaatgtgtctggctctgtccgaagtgatggggagcccatgaaaggcgtgaagtttcttctcttttcttctttagtaactaaagaggatgtcctgggctgcaatgtctcaccagtgcctgggttccagccccaagacgagagtctggtgtatttgtgctacacggtctccagagaagatggctcgttctctttctattccttgccaagtgggggctacactgtgattccgttctatcgaggggagaggattacctttgatgtggcgccttccagacttgacttcacagtggagcatgacagcttgaaaatcgagcccgtgttccacgtcatgggattctccgtcaccgggagggtcttgaacggacccgaaggagatggtgttccagaagcagtagtcaccctgaataaccaaatcaaagttaaaacaaaagctgatggctcattccgccttgagaacataaccacagggacatacaccatccatgctcagaaagagcacctctactttgaaacggtcaccatcaaaattgcaccaaacacacctcagctggctgacattgttgcaacagggttcagtgtctgtggtcagatatcaatcattcgcttccccgacaccgtcaagcagatgaataaatacaaagttgtcctgtcatctcaagacaaggacaagtctttggtcaccgtggagacagatgctcatggatcattttgttttaaagcaaacccagggacttacaaagtgcaggtgatggttcctgaggcagaaaccagagcagggctgacgttgaaaccccagacatttcctcttactgtgaccgacaggcctgtgatggatgtggcctttgtacagttcttggcatcagtttctgggaaagtctcttgtttggacacctgtggtgacttgctggtgactctacagtccctgagccgccagggtgagaagcggagcctccagctctccggcaaggtcaacgccatgactttcacctttgacaacgtgctccctggaaaatacaaaataagcatcatgcatgaggattggtgctggaagaacaagagcctggaggtggaagtgctggaggatgacgtgtctgcagttgagttcaggcagacgggctacatgctgagatgttccctgtctcacgccatcactctggaattttatcaggatggaaatgggcgtgagaatgtggggatttataacctctccaaaggagtcaaccgattctgcctgtccaagcctggtgtgtacaaagtgacccctcgctcctgccaccggtttgagcaagcgttctacacctatgacacgtcttcacctagtatcttgacattgacagccattcgccaccatgtccttggaactatcaccaccgacaaaatgatggatgtcactgtgactatcaagtcttccatcgacagtgaacccgccttggtcttaggccctctgaagtctgtgcaggagctgcggagggagcagcagctggctgagatcgaggcccgcaggcaggagagggagaaaaacggcaatgaggaaggtgaagaaagaatgaccaagcctcccgtgcaggagatggtagatgagttacaaggccccttctcgtatgatttctcttactgggcgcggtctggagagaaaatcactgttacaccgtcatctaaagagctgctcttttatcccccttcaatggaagccgttgtcagtggagaaagctgcccagggaagctgatcgagatccacgggaaggcaggcctgtttttagaaggccagatccaccccgagttggaaggagtcgagattgtcatcagtgaaaagggggcaagttcaccgctgatcacagtctttactgatgacaaaggtgcctacagtgttggccccctgcacagtgacctggagtacacggtgacctcacagaaggagggctatgttctgactgcagtggaaggaaccatcggagacttcaaggcctatgccctggcaggcgtaagctttgagataaaagctgaggatgaccagcccctcccgggagtcctcttatccctgagtggtggcctgtttcgttccaacctcttgacccaggacaacggcattctgacattctcaaacctgagccctggccagtattacttcaaacccatgatgaaggagttccggtttgagccatcctcacagatgatcgaggtgcaggaaggccagaacctgaagatcaccatcacggggtaccgaaccgcttacagttgctatggcacagtgtcttccttaaacggagagcccgaacaaggggttgccatggaagcggtgggccagaacgactgcagcatttacggagaagacaccgtgacagacgaagagggcaagttcagattacgtggattgctgccgggatgtgtgtaccacgttcagctcaaggcagaaggcaacgaccacattgagcgggcgctcccccaccatagggtgattgaggttgggaataatgacatcgatgatgtaaacatcatagttttccggcagattaatcaatttgatttaagtggaaatgtgatcacttcctctgaataccttcctacgttatgggtcaagctttacaaaagcgaaaacctcgacaatccaatccagacagtttcccttggccagtccctgttcttccatttccccccactgctcagagatggcgagaactatgttgtgcttctggactccacactccccagatcccagtatgactacatcttgcctcaagtttctttcaccgcagtgggctaccataaacacatcaccttgatttttaatcccacgaggaagctgcctgaacaggacatcgcacaaggatcctacattgccctgccattgacgctgctggttctgctggccggttacaaccatgacaagggacatattaggcccggagagaggccagcccatccctggggactcattagtaagaggcctgcctcgtttgaactgaaacccacccattagcacgtggcagctgctgatcatgtctgaagaagctcattcctttgctgctgcagttgacaagccggctacagggagtcggcgcgctcggccaggcagcctctgacaatagcggcccagaagatgcaaagagacaagccaagaaacagaagacaaggcggacgtgaggaggaaggggacagttgcagtctcacttgggacaggccacagccaggggtccggccactacccgcccgtgggataaaagccaaaagcatgcgtcagctaacttcagcctgtgctgctgggcccgcaccccatgtcccttgtcactgtggcatcctgcacccatcctcacccctccgtagagcccctcgtgcaatgcaatgaatggaccctcctgtcactctgctgaacagaatttattttctgagtcaaatataatttattattatttttgtcaaagaagtatttaagctgtgctgtggtgtgagaatgtcattcttgatcttcagccttcgtttgcaagaagagttccagttgatgtggtgtttggttccatggcggggtaccctagggattcatctgttttcttcacttccctttgcatctgagatcctgctggaaaccacggcaacctgtatccactattaggaggtaaaaatcaataaaatggcccattcatttgtgttgtagctca

SEQ ID NO: 314950 - DNA, 4311 bp, Homo sapiens
  misc_feature (3885)..(3885): n is a, c, g, or t
  misc_feature (3889)..(3889): n is a, c, g, or t
  misc_feature (3893)..(3893): n is a, c, g, or t
agccgacgaccgtggagctccatgtggatggagtcagtgacatctgcacaaagggtggggacatcaactttgtcttcactgggttctctgtgaatggcaaggtcctcagcaaagggcagcccctgggtcctgcgggagttcaggtgtctctgagaaacactgggaccgaagcaaagatccagtccacagttacacagcctggcggaaagtttgcattttttaaagttctgcctggagattatgaaatcctcgcaactcatccaacctgggcgttgaaagaggcaagcaccacagtgcgtgtaaccaactccaatgccaatgcggccagtcccctcatagttgctggctacaatgtgtctggctctgtccgaagtgatggggagcccatgaaaggcgtgaagtttcttctcttttcttctttagtaactaaagaggatgtcctgggctgcaatgtctcaccagtgcctgggttccagccccaagacgagagtctggtgtatttgtgctacacggtctccagagaagatggctcgttctctttctattccttgccaagtgggggctacactgtgattccgttctatcgaggggagaggattacctttgatgtggcgccttccagacttgacttcacagtggagcatgacagcttgaaaatcgagcccgtgttccacgtcatgggattctccgtcaccgggagggtcttgaacggacccgaaggagatggtgttccagaagcagtagtcaccctgaataaccaaatcaaagttaaaacaaaagctgatggctcattccgccttgagaacataaccacagggacatacaccatccatgctcagaaagagcacctctactttgaaacggtcaccatcaaaattgcaccaaacacacctcagctggctgacattgttgcaacagggttcagtgtctgtggtcagatatcaatcattcgcttccccgacaccgtcaagcagatgaataaatacaaagttgtcctgtcatctcaagacaaggacaagtctttggtcaccgtggagacagatgctcatggatcattttgttttaaagcaaacccagggacttacaaagtgcaggtgatggttcctgaggcagaaaccagagcagggctgacgttgaaaccccagacatttcctcttactgtgaccgacaggcctgtgatggatgtggcctttgtacagttcttggcatcagtttctgggaaagtctcttgtttggacacctgtggtgacttgctggtgactctacagtccctgagccgccagggtgagaagcggagcctccagctctccggcaaggtcaacgccatgactttcacctttgacaacgtgctccctggaaaatacaaaataagcatcatgcatgaggattggtgctggaagaacaagagcctggaggtggaagtgctggaggatgacgtgtctgcagttgagttcaggcagacgggctacatgctgagatgttccctgtctcacgccatcactctggaattttatcaggatggaaatgggcgtgagaatgtggggatttataacctctccaaaggagtcaaccgattctgcctgtccaagcctggtgtgtacaaagtgacccctcgctcctgccaccggtttgagcaagcgttctacacctatgacacgtcttcacctagtatcttgacattgacagccattcgccaccatgtccttggaactatcaccaccgacaaaatgatggatgtcactgtgactatcaagtcttccatcgacagtgaacccgccttggtcttaggccctctgaagtctgtgcaggagctgcggagggagcagcagctggctgagatcgaggcccgcaggcaggagagggagaaaaacggcaatgaggaaggtgaagaaagaatgaccaagcctcccgtgcaggagatggtagatgagttacaaggccccttctcgtatgatttctcttactgggcgcggtctggagagaaaatcactgttacaccgtcatctaaagagctgctcttttatcccccttcaatggaagccgttgtcagtggagaaagctgcccagggaagctgatcgagatccacgggaaggcaggcctgtttttagaaggccagatccaccccgagttggaaggagtcgagattgtcatcagtgaaaagggggcaagttcaccgctgatcacagtctttactgatgacaaaggtgcctacagtgttggccccctgcacagtgacctggagtacacggtgacctcacagaaggagggctatgttctgactgcagtggaaggaaccatcggagacttcaaggcctatgccctggcaggcgtaagctttgagataaaagctgaggatgaccagcccctcccgggagtcctcttatccctgagtggtggcctgtttcgttccaacctcttgacccaggacaacggcattctgacattctcaaacctgagccctggccagtattacttcaaacccatgatgaaggagttccggtttgagccatcctcacagatgatcgaggtgcaggaaggccagaacctgaagatcaccatcacggggtaccgaaccgcttacagttgctatggcacagtgtcttccttaaacggagagcccgaacaaggggttgccatggaagcggtgggccagaacgactgcagcatttacggagaagacaccgtgacagacgaagagggcaagttcagattacgtggattgctgccgggatgtgtgtaccacgttcagctcaaggcagaaggcaacgaccacattgagcgggcgctcccccaccatagggtgattgaggttgggaataatgacatcgatgatgtaaacatcatagttttccggcagattaatcaatttgatttaagtggaaatgtgatcacttcctctgaataccttcctacgttatgggtcaagctttacaaaagcgaaaacctcgacaatccaatccagacagtttcccttggccagtccctgttcttccatttccccccactgctcagagatggcgagaactatgttgtgcttctggactccacactccccagatcccagtatgactacatcttgcctcaagtttctttcaccgcagtgggctaccataaacacatcaccttgatttttaatcccacgaggaagctgcctgaacaggacatcgcacaaggatcctacattgccctgccattgacgctgctggttctgctggccggttacaaccatgacaagctcattcctttgctgctgcagttgacaagccggctacagggagtcggcgcgctcggccaggcagcctctgacaatagcggcccagaagatgcaaagagacaagccaagaaacagaagacaaggcggacgtgaggaggaaggggacagttgcagtctcacttgggacaggccacagccaggggtccggccactacccgcccgtgggataaaagccaaaagcatgcgtcagctaacttcagcctgtgctgctgggcccgcaccccatgtcccttgtcactgtggcatcctgcacccatcctcacccctccgtagagcccctcgtgcaatgcaatgaatggaccctcctgtcactctgctgaacagaatttattttctgagtcaaatataatttattattatttttgtcaaagaagtatttaagctgtgctgtggtgtgagaatgtcattcttgatcttcagccttcgtttgcaagaagagttccagttgatgtggtgtttggttccatggcggggtaccctagggattcatctgttttcttcacttccctttgcatctgagatcctgctggaaaccacggcaacctgtatccactattaggaggtaaaaatcaataaaatggcccattcatttgtgttgtagctcaaaaanaaanaaanaaaaaaaaaaaaaaaaaaaaaaaaaaaccgggggcccaaattgggggggggggaacaaaaggggtcagaaagggcgcggggcaaaaggggttccggtcaccccagcattttgttgccccacagggggtacaatagcggcgggggaccccccatataggtggagggcgacaataaaatcacgaaaacagcccgggttagccctggctttcggatcttcttccgctactacgcagagacagcacacaagagcacgaaatgacgagccagccagacagagcagccgcgcagacaataccaatagccgacgtcagcaagagcggagagacagcaacaaaggacacaacaccagacacaagcgaagctgtagacgaacaccaagacatgaaccaacgcgactacgtacaacacgcaccagagg

SEQ ID NO: 314951 - DNA, 3891 bp, Homo sapiens
agccgacgaccgtggagctccatgtggatggagtcagtgacatctgcacaaagggtggggacatcaactttgtcttcactgggttctctgtgaatggcaaggtcctcagcaaagggcagcccctgggtcctgcgggagttcaggtgtctctgagaaacactgggaccgaagcaaagatccagtccacagttacacagcctggcggaaagtttgcattttttaaagttctgcctggagattatgaaatcctcgcaactcatccaacctgggcgttgaaagaggcaagcaccacagtgcgtgtaaccaactccaatgccaatgcggccagtcccctcatagttgctggctacaatgtgtctggctctgtccgaagtgatggggagcccatgaaaggcgtgaagtttcttctcttttcttctttagtaactaaagaggatgtcctgggctgcaatgtctcaccagtgcctgggttccagccccaagacgagagtctggtgtatttgtgctacacggtctccagagaagatggctcgttctctttctattccttgccaagtgggggctacactgtgattccgttctatcgaggggagaggattacctttgatgtggcgccttccagacttgacttcacagtggagcatgacagcttgaaaatcgagcccgtgttccacgtcatgggattctccgtcaccgggagggtcttgaacggacccgaaggagatggtgttccagaagcagtagtcaccctgaataaccaaatcaaagttaaaacaaaagctgatggctcattccgccttgagaacataaccacagggacatacaccatccatgctcagaaagagcacctctactttgaaacggtcaccatcaaaattgcaccaaacacacctcagctggctgacattgttgcaacagggttcagtgtctgtggtcagatatcaatcattcgcttccccgacaccgtcaagcagatgaataaatacaaagttgtcctgtcatctcaagacaaggacaagtctttggtcaccgtggagacagatgctcatggatcattttgttttaaagcaaacccagggacttacaaagtgcaggtgatggttcctgaggcagaaaccagagcagggctgacgttgaaaccccagacatttcctcttactgtgaccgacaggcctgtgatggatgtggcctttgtacagttcttggcatcagtttctgggaaagtctcttgtttggacacctgtggtgacttgctggtgactctacagtccctgagccgccagggtgagaagcggagcctccagctctccggcaaggtcaacgccatgactttcacctttgacaacgtgctccctggaaaatacaaaataagcatcatgcatgaggattggtgctggaagaacaagagcctggaggtggaagtgctggaggatgacgtgtctgcagttgagttcaggcagacgggctacatgctgagatgttccctgtctcacgccatcactctggaattttatcaggatggaaatgggcgtgagaatgtggggatttataacctctccaaaggagtcaaccgattctgcctgtccaagcctggtgtgtacaaagtgacccctcgctcctgccaccggtttgagcaagcgttctacacctatgacacgtcttcacctagtatcttgacattgacagccattcgccaccatgtccttggaactatcaccaccgacaaaatgatggatgtcactgtgactatcaagtcttccatcgacagtgaacccgccttggtcttaggccctctgaagtctgtgcaggagctgcggagggagcagcagctggctgagatcgaggcccgcaggcaggagagggagaaaaacggcaatgaggaaggtgaagaaagaatgaccaagcctcccgtgcaggagatggtagatgagttacaaggccccttctcgtatgatttctcttactgggcgcggtctggagagaaaatcactgttacaccgtcatctaaagagctgctcttttatcccccttcaatggaagccgttgtcagtggagaaagctgcccagggaagctgatcgagatccacgggaaggcaggcctgtttttagaaggccagatccaccccgagttggaaggagtcgagattgtcatcagtgaaaagggggcaagttcaccgctgatcacagtctttactgatgacaaaggtgcctacagtgttggccccctgcacagtgacctggagtacacggtgacctcacagaaggagggctatgttctgactgcagtggaaggaaccatcggagacttcaaggcctatgccctggcaggcgtaagctttgagataaaagctgaggatgaccagcccctcccgggagtcctcttatccctgagtggtggcctgtttcgttccaacctcttgacccaggacaacggcattctgacattctcaaacctgagccctggccagtattacttcaaacccatgatgaaggagttccggtttgagccatcctcacagatgatcgaggtgcaggaaggccagaacctgaagatcaccatcacggggtaccgaaccgcttacagttgctatggcacagtgtcttccttaaacggagagcccgaacaaggggttgccatggaagcggtgggccagaacgactgcagcatttacggagaagacaccgtgacagacgaagagggcaagttcagattacgtggattgctgccgggatgtgtgtaccacgttcagctcaaggcagaaggcaacgaccacattgagcgggcgctcccccaccatagggtgattgaggttgggaataatgacatcgatgatgtaaacatcatagttttccggcagattaatcaatttgatttaagtggaaatgtgatcacttcctctgaataccttcctacgttatgggtcaagctttacaaaagcgaaaacctcgacaatccaatccagacagtttcccttggccagtccctgttcttccatttccccccactgctcagagatggcgagaactatgttgtgcttctggactccacactccccagatcccagtatgactacatcttgcctcaagtttctttcaccgcagtgggctaccataaacacatcaccttgatttttaatcccacgaggaagctgcctgaacaggacatcgcacaaggatcctacattgccctgccattgacgctgctggttctgctggccggttacaaccatgacaagctcattcctttgctgctgcagttgacaagccggctacagggagtcggcgcgctcggccaggcagcctctgacaatagcggcccagaagatgcaaagagacaagccaagaaacagaagacaaggcggacgtgaggaggaaggggacagttgcagtctcacttgggacaggccacagccaggggtccggccactacccgcccgtgggataaaagccaaaagcatgcgtcagctaacttcagcctgtgctgctgggcccgcaccccatgtcccttgtcactgtggcatcctgcacccatcctcacccctccgtagagcccctcgtgcaatgcaatgaatggaccctcctgtcactctgctgaacagaatttattttctgagtcaaatataatttattattatttttgtcaaagaagtatttaagctgtgctgtggtgtgagaatgtcattcttgatcttcagccttcgtttgcaagaagagttccagttgatgtggtgtttggttccatggcggggtaccctagggattcatctgttttcttcacttccctctccctacacccctcccacccccctccctttcttaagcaagtattttaactttctttctggcacaggtacaaagaagacttcctgttaccagatcaacgctgtagag

SEQ ID NO: 314952 - DNA, 1180 bp, Homo sapiens
gaactgactcctgagtttttttgcagccgggatgtgtgtaccacgttcagctcaaggcagaaggcaacgaccacattgagcgggcgctcccccaccatagggtgattgaggttgggaataatgacatcgatgatgtaaacatcatagttttccggcagattaatcaatttgatttaagtggaaatgtgatcacttcctctgaataccttcctacgttatgggtcaagctttacaaaagcgaaaacctcgacaatccaatccagacagtttcccttggccagtccctgttcttccatttccccccactgctcagagatggcgagaactatgttgtgcttctggactccacactccccagatcccagtatgactacatcttgcctcaagtttctttcaccgcagtgggctaccataaacacatcaccttgatttttaatcccacgaggaagctgcctgaacaggacatcgcacaaggatcctacattgccctgccattgacgctgctggttctgctggccggttacaaccatgacaagctcattcctttgctgctgcagttgacaagccggctacagggagtcggcgcgctcggccaggcagcctctgacaatagcggcccagaagatgcaaagagacaagccaagaaacagaagacaaggcggacgtgaggaggaaggggacagttgcagtctcacttgggacaggccacagccaggggtccggccactacccgcccgtgggataaaagccaaaagcatgcgtcagctaacttcagcctgtgctgctgggcccgcaccccatgtcccttgtcactgtggcatcctgcacccatcctcacccctccgtagagcccctcgtgcaatgcaatgaatggaccctcctgtcactctgctgaacagaatttattttctgagtcaaatataatttattattatttttgtcaaagaagtatttaagctgtgctgtggtgtgagaatgtcattcttgatcttcagccttcgtttgcaagaagagttccagttgatgtggtgtttggttccatggcggggtaccctagggattcatctgttttcttcacttccctttgcatctgagatcctgctggaaaccacggcaacctgtatccactattaggaggtaaaaatcaataaaatggcccattcatttgtgttgtagctca

SEQ ID NO: 314953 - DNA, 3549 bp, Homo sapiens
agccgacgaccgtggagctccatgtggatggagtcagtgacatctgcacaaagggtggggacatcaactttgtcttcactgggttctctgtgaatggcaaggtcctcagcaaagggcagcccctgggtcctgcgggagttcaggtgtctctgagaaacactgggaccgaagcaaagatccagtccacagttacacagcctggcggaaagtttgcattttttaaagttctgcctggagattatgaaatcctcgcaactcatccaacctgggcgttgaaagaggcaagcaccacagtgcgtgtaaccaactccaatgccaatgcggccagtcccctcatagttgctggctacaatgtgtctggctctgtccgaagtgatggggagcccatgaaaggcgtgaagtttcttctcttttcttctttagtaactaaagaggatgtcctgggctgcaatgtctcaccagtgcctgggttccagccccaagacgagagtctggtgtatttgtgctacacggtctccagagaagatggctcgttctctttctattccttgccaagtgggggctacactgtgattccgttctatcgaggggagaggattacctttgatgtggcgccttccagacttgacttcacagtggagcatgacagcttgaaaatcgagcccgtgttccacgtcatgggattctccgtcaccgggagggtcttgaacggacccgaaggagatggtgttccagaagcagtagtcaccctgaataaccaaatcaaagttaaaacaaaagctgatggctcattccgccttgagaacataaccacagggacatacaccatccatgctcagaaagagcacctctactttgaaacggtcaccatcaaaattgcaccaaacacacctcagctggctgacattgttgcaacagggttcagtgtctgtggtcagatatcaatcattcgcttccccgacaccgtcaagcagatgaataaatacaaagttgtcctgtcatctcaagacaaggacaagtctttggtcaccgtggagacagatgctcatggatcattttgttttaaagcaaacccagggacttacaaagtgcaggtgatggttcctgaggcagaaaccagagcagggctgacgttgaaaccccagacatttcctcttactgtgaccgacaggcctgtgatggatgtggcctttgtacagttcttggcatcagtttctgggaaagtctcttgtttggacacctgtggtgacttgctggtgactctacagtccctgagccgccagggtgagaagcggagcctccagctctccggcaaggtcaacgccatgactttcacctttgacaacgtgctccctggaaaatacaaaataagcatcatgcatgaggattggtgctggaagaacaagagcctggaggtggaagtgctggaggatgacgtgtctgcagttgagttcaggcagacgggctacatgctgagatgttccctgtctcacgccatcactctggaattttatcaggatggaaatgggcgtgagaatgtggggatttataacctctccaaaggagtcaaccgattctgcctgtccaagcctggtgtgtacaaagtgacccctcgctcctgccaccggtttgagcaagcgttctacacctatgacacgtcttcacctagtatcttgacattgacagccattcgccaccatgtccttggaactatcaccaccgacaaaatgatggatgtcactgtgactatcaagtcttccatcgacagtgaacccgccttggtcttaggccctctgaagtctgtgcaggagctgcggagggagcagcagctggctgagatcgaggcccgcaggcaggagagggagaaaaacggcaatgaggaaggtgaagaaagaatgaccaagcctcccgtgcaggagatggtagatgagttacaaggccccttctcgtatgatttctcttactgggcgcggtctggagagaaaatcactgttacaccgtcatctaaagagctgctcttttatcccccttcaatggaagccgttgtcagtggagaaagctgcccagggaagctgatcgagatccacgggaaggcaggcctgtttttagaaggccagatccaccccgagttggaaggagtcgagattgtcatcagtgaaaagggggcaagttcaccgctgatcacagtctttactgatgacaaaggtgcctacagtgttggccccctgcacagtgacctggagtacacggtgacctcacagaaggagggctatgttctgactgcagtggaaggaaccatcggagacttcaaggcctatgccctggcaggcgtaagctttgagataaaagctgaggatgaccagcccctcccgggagtcctcttatccctgagtggtggcctgtttcgttccaacctcttgacccaggacaacggcattctgacattctcaaacctgagccctggccagtattacttcaaacccatgatgaaggagttccggtttgagccatcctcacagatgatcgaggtgcaggaaggccagaacctgaagatcaccatcacggggtaccgaaccgcttacagttgctatggcacagtgtcttccttaaacggagagcccgaacaaggggttgccatggaagcggtgggccagaacgactgcagcatttacggagaagacaccgtgacagacgaagagggcaagttcagattacgtggattgctgccgggatgtgtgtaccacgttcagctcaaggcagaaggcaacgaccacattgagcgggcgctcccccaccatagggtgattgaggttgggaataatgacatcgatgatgtaaacatcatagttttccggcagattaatcaatttgatttaagtggaaatgtgatcacttcctctgaataccttcctacgttatgggtcaagctttacaaaagcgaaaacctcgacaatccaatccagacagtttcccttggccagtccctgttcttccatttccccccactgctcagagatggcgagaactatgttgtgcttctggactccacactccccagatcccagtatgactacatcttgcctcaagtttctttcaccgcagtgggctaccataaacacatcaccttgatttttaatcccacgaggaagctgcctgaacaggacatcgcacaaggatcctacattgccctgccattgacgctgctggttctgctggccggttacaaccatgacaagctcattcctttgctgctgcagttgacaagccggctacagggagtcggcgcgctcggccaggcagcctctgacaatagcggcccagaagatgcaaagagacaagccaagaaacagaagacaaggcggacccttcgtttgcaagaagagttccagttgatgtggtgtttggttccatggcggggtaccctagggattcatctgttttcttcacttccctttgcatctgagatcctgctggaaaccacggcaacctgtatccactattaggaggtaaaaatcaataaaatggcccattcatttgtgttgtagctca

SEQ ID NO: 314954 - DNA, 3319 bp, Homo sapiens
agccgacgaccgtggagctccatgtggatggagtcagtgacatctgcacaaagggtggggacatcaactttgtcttcactgggttctctgtgaatggcaaggtcctcagcaaagggcagcccctgggtcctgcgggagttcaggtgtctctgagaaacactgggaccgaagcaaagatccagtccacagttacacagcctggcggaaagtttgcattttttaaagttctgcctggagattatgaaatcctcgcaactcatccaacctgggcgttgaaagaggcaagcaccacagtgcgtgtaaccaactccaatgccaatgcggccagtcccctcatagttgctggctacaatgtgtctggctctgtccgaagtgatggggagcccatgaaaggcgtgaagtttcttctcttttcttctttagtaactaaagaggatgtcctgggctgcaatgtctcaccagtgcctgggttccagccccaagacgagagtctggtgtatttgtgctacacggtctccagagaagatggctcgttctctttctattccttgccaagtgggggctacactgtgattccgttctatcgaggggagaggattacctttgatgtggcgccttccagacttgacttcacagtggagcatgacagcttgaaaatcgagcccgtgttccacgtcatgggattctccgtcaccgggagggtcttgaacggacccgaaggagatggtgttccagaagcagtagtcaccctgaataaccaaatcaaagttaaaacaaaagctgatggctcattccgccttgagaacataaccacagggacatacaccatccatgctcagaaagagcacctctactttgaaacggtcaccatcaaaattgcaccaaacacacctcagctggctgacattgttgcaacagggttcagtgtctgtggtcagatatcaatcattcgcttccccgacaccgtcaagcagatgaataaatacaaagttgtcctgtcatctcaagacaaggacaagtctttggtcaccgtggagacagatgctcatggatcattttgttttaaagcaaacccagggacttacaaagtgcaggtgatggttcctgaggcagaaaccagagcagggctgacgttgaaaccccagacatttcctcttactgtgaccgacaggcctgtgatggatgtggcctttgtacagttcttggcatcagtttctgggaaagtctcttgtttggacacctgtggtgacttgctggtgactctacagtccctgagccgccagggtgagaagcggagcctccagctctccggcaaggtcaacgccatgactttcacctttgacaacgtgctccctggaaaatacaaaataagcatcatgcatgaggattggtgctggaagaacaagagcctggaggtggaagtgctggaggatgacgtgtctgcagttgagttcaggcagacgggctacatgctgagatgttccctgtctcacgccatcactctggaattttatcaggatggaaatgggcgtgagaatgtggggatttataacctctccaaaggagtcaaccgattctgcctgtccaagcctggtgtgtacaaagtgacccctcgctcctgccaccggtttgagcaagcgttctacacctatgacacgtcttcacctagtatcttgacattgacagccattcgccaccatgtccttggaactatcaccaccgacaaaatgatggatgtcactgtgactatcaagtcttccatcgacagtgaacccgccttggtcttaggccctctgaagtctgtgcaggagctgcggagggagcagcagctggctgagatcgaggcccgcaggcaggagagggagaaaaacggcaatgaggaaggtgaagaaagaatgaccaagcctcccgtgcaggagatggtagatgagttacaaggccccttctcgtatgatttctcttactgggcgcggtctggagagaaaatcactgttacaccgtcatctaaagagctgctcttttatcccccttcaatggaagccgttgtcagtggagaaagctgcccagggaagctgatcgagatccacgggaaggcaggcctgtttttagaaggccagatccaccccgagttggaaggagtcgagattgtcatcagtgaaaagggggcaagttcaccgctgatcacagtctttactgatgacaaaggtgcctacagtgttggccccctgcacagtgacctggagtacacggtgacctcacagaaggagggctatgttctgactgcagtggaaggaaccatcggagacttcaaggcctatgccctggcaggcgtaagctttgagataaaagctgaggatgaccagcccctcccgggagtcctcttatccctgagtggtggcctgtttcgttccaacctcttgacccaggacaacggcattctgacattctcaaacctgagccctggccagtattacttcaaacccatgatgaaggagttccggtttgagccatcctcacagatgatcgaggtgcaggaaggccagaacctgaagatcaccatcacggggtaccgaaccgcttacagttgctatggcacagtgtcttccttaaacggagagcccgaacaaggggttgccatggaagcggtgggccagaacgactgcagcatttacggagaagacaccgtgacagacgaagagggcaagttcagattacgtggattgctgccgggatgtgtgtaccacgttcagctcaaggcagaaggcaacgaccacattgagcgggcgctcccccaccatagggtgattgaggttgggaataatgacatcgatgatgtaaacatcatagttttccggcagattaatcaatttgatttaagtggaaatgtgatcacttcctctgaataccttcctacgttatgggtcaagctttacaaaagcgaaaacctcgacaatccaatccagacagtttcccttggccagtccctgttcttccatttccccccactgctcagagatggcgagaactatgttgtgcttctggactccacactccccagatcccagtatgactacatcttgcctcaagtttctttcaccgcagtgggctaccataaacacatcaccttgatttttaatcccacgaggaagctgcctgaacaggacatcgcacaaggatcctacattgccctgccattgacgctgctggttctgctggccggttacaaccatgacaagctattgtcagaggctgcctggccgagcgcgcggactccctgtagccggcttgtcaactgcagcagcaaaggatgggccggtca

SEQ ID NO: 314955 - DNA, 1742 bp, Homo sapiens
ctagagggtgacgtttcctctcctggctccttaccacctgccgtgaagatgatctactctggcctttctctgtggctccaggggtgttgaaatagtcacttcctacagcgatgcggaaacatcttgggctttggggtcacacttcccctgagttcagagccttcatagatgtgtggcagccttcttagctgagtgaccttgggcaagttactcttagtctcttcgtgcttgactttcctcgtctataagacggggtgatgatcccgaccttgccagtggtagaaagcaaagcagccgcgggcctcatgcaatgtgcatggtgcctggcagctggtcggtgctcagcacacagagctgtgacgggcctcatgcaatgtgcatggtgcctggcagctggtcggtgctcagcacacagagctgtggctgcccctggtgccgttccagggatgctgtatttttaggatttgccagcttacgagcctctcaagcatcgtcccttagaagtcagccccgttgtggatcctcagttgtatcacgtacctccctcatcagaattggctcataataattttttgtgtttcataaagtcagatcctcagaggaccgtaattgtcaaggttgggtactcataaaaaggctgcaggctctgacagccttatcagaagccacagtctcagagacactggggacacatgcccgccactgatggaatagcccgctgaggttgatactttgaaggcagcaaccttggtttggatgtgtagtcttggggatttctttaaaaacataaagttctttacatcacagccatacgttaggttttagttttcatttgctttgccagagctgtccttataaaaataacttcttcccatgtgtgcacagaactatgttgtgcttctggactccacactccccagatcccagtatgactacatcttgcctcaagtttctttcaccgcagtgggctaccataaacacatcaccttgatttttaatcccacgaggaagctgcctgaacaggacatcgcacaaggatcctacattgccctgccattgacgctgctggttctgctggccggttacaaccatgacaagctcattcctttgctgctgcagttgacaagccggctacagggagtcggcgcgctcggccaggcagcctctgacaatagcggcccagaagatgcaaagagacaagccaagaaacagaagacaaggcggacgtgaggaggaaggggacagttgcagtctcacttgggacaggccacagccaggggtccggccactacccgcccgtgggataaaagccaaaagcatgcgtcagctaacttcagcctgtgctgctgggcccgcaccccatgtcccttgtcactgtggcatcctgcacccatcctcacccctccgtagagcccctcgtgcaatgcaatgaatggaccctcctgtcactctgctgaacagaatttattttctgagtcaaatataatttattattatttttgtcaaagaagtatttaagctgtgctgtggtgtgagaatgtcattcttgatcttcagccttcgtttgcaagaagagttccagttgatgtggtgtttggttccatggcggggtaccctagggattcatctgttttcttcacttccctttgcatctgagatcctgctggaaaccacggcaacctgtatccactattaggaggtaaaaatcaataaaatggcccattcatttgtgttgtagctca

SEQ ID NO: 314956 - DNA, 869 bp, Homo sapiens
cctcttcagcatctcaagtgtagtcacctggatttccattaacagggcctcctaattttcccccacaaagcatgtttggatttcaccgcagtgggctaccataaacacatcaccttgatttttaatcccacgaggaagctgcctgaacaggacatcgcacaaggatcctacattgccctgccattgacgctgctggttctgctggccggttacaaccatgacaagctcattcctttgctgctgcagttgacaagccggctacagggagtcggcgcgctcggccaggcagcctctgacaatagcggcccagaagatgcaaagagacaagccaagaaacagaagacaaggcggacgtgaggaggaaggggacagttgcagtctcacttgggacaggccacagccaggggtccggccactacccgcccgtgggataaaagccaaaagcatgcgtcagctaacttcagcctgtgctgctgggcccgcaccccatgtcccttgtcactgtggcatcctgcacccatcctcacccctccgtagagcccctcgtgcaatgcaatgaatggaccctcctgtcactctgctgaacagaatttattttctgagtcaaatataatttattattatttttgtcaaagaagtatttaagctgtgctgtggtgtgagaatgtcattcttgatcttcagccttcgtttgcaagaagagttccagttgatgtggtgtttggttccatggcggggtaccctagggattcatctgttttcttcacttccctttgcatctgagatcctgctggaaaccacggcaacctgtatccactattaggaggtaaaaatcaataaaatggcccattcatttgtgttgtagctca

SEQ ID NO: 314957 - DNA, 3071 bp, Homo sapiens
agccgacgaccgtggagctccatgtggatggagtcagtgacatctgcacaaagggtggggacatcaactttgtcttcactgggttctctgtgaatggcaaggtcctcagcaaagggcagcccctgggtcctgcgggagttcaggtgtctctgagaaacactgggaccgaagcaaagatccagtccacagttacacagcctggcggaaagtttgcattttttaaagttctgcctggagattatgaaatcctcgcaactcatccaacctgggcgttgaaagaggcaagcaccacagtgcgtgtaaccaactccaatgccaatgcggccagtcccctcatagttgctggctacaatgtgtctggctctgtccgaagtgatggggagcccatgaaaggcgtgaagtttcttctcttttcttctttagtaactaaagaggatgtcctgggctgcaatgtctcaccagtgcctgggttccagccccaagacgagagtctggtgtatttgtgctacacggtctccagagaagatggctcgttctctttctattccttgccaagtgggggctacactgtgattccgttctatcgaggggagaggattacctttgatgtggcgccttccagacttgacttcacagtggagcatgacagcttgaaaatcgagcccgtgttccacgtcatgggattctccgtcaccgggagggtcttgaacggacccgaaggagatggtgttccagaagcagtagtcaccctgaataaccaaatcaaagttaaaacaaaagctgatggctcattccgccttgagaacataaccacagggacatacaccatccatgctcagaaagagcacctctactttgaaacggtcaccatcaaaattgcaccaaacacacctcagctggctgacattgttgcaacagggttcagtgtctgtggtcagatatcaatcattcgcttccccgacaccgtcaagcagatgaataaatacaaagttgtcctgtcatctcaagacaaggacaagtctttggtcaccgtggagacagatgctcatggatcattttgttttaaagcaaacccagggacttacaaagtgcaggtgatggttcctgaggcagaaaccagagcagggctgacgttgaaaccccagacatttcctcttactgtgaccgacaggcctgtgatggatgtggcctttgtacagttcttggcatcagtttctgggaaagtctcttgtttggacacctgtggtgacttgctggtgactctacagtccctgagccgccagggtgagaagcggagcctccagctctccggcaaggtcaacgccatgactttcacctttgacaacgtgctccctggaaaatacaaaataagcatcatgcatgaggattggtgctggaagaacaagagcctggaggtggaagtgctggaggatgacgtgtctgcagttgagttcaggcagacgggctacatgctgagatgttccctgtctcacgccatcactctggaattttatcaggatggaaatgggcgtgagaatgtggggatttataacctctccaaaggagtcaaccgattctgcctgtccaagcctggtgtgtacaaagtgacccctcgctcctgccaccggtttgagcaagcgttctacacctatgacacgtcttcacctagtatcttgacattgacagccattcgccaccatgtccttggaactatcaccaccgacaaaatgatggatgtcactgtgactatcaagtcttccatcgacagtgaacccgccttggtcttaggccctctgaagtctgtgcaggagctgcggagggagcagcagctggctgagatcgaggcccgcaggcaggagagggagaaaaacggcaatgaggaaggtgaagaaagaatgaccaagcctcccgtgcaggagatggtagatgagttacaaggccccttctcgtatgatttctcttactgggcgcggtctggagagaaaatcactgttacaccgtcatctaaagagctgctcttttatcccccttcaatggaagccgttgtcagtggagaaagctgcccagggaagctgatcgagatccacgggaaggcaggcctgtttttagaaggccagatccaccccgagttggaaggagtcgagattgtcatcagtgaaaagggggcaagttcaccgctgatcacagtctttactgatgacaaaggtgcctacagtgttggccccctgcacagtgacctggagtacacggtgacctcacagaaggagggctatgttctgactgcagtggaaggaaccatcggagacttcaaggcctatgccctggcaggcgtaagctttgagataaaagctgaggatgaccagcccctcccgggagtcctcttatccctgagtggtggcctgtttcgttccaacctcttgacccaggacaacggcattctgacattctcaaacctgagccctggccagtattacttcaaacccatgatgaaggagttccggtttgagccatcctcacagatgatcgaggtgcaggaaggccagaacctgaagatcaccatcacggggtaccgaaccgcttacagttgctatggcacagtgtcttccttaaacggagagcccgaacaaggggttgccatggaagcggtgggccagaacgactgcagcatttacggagaagacaccgtgacagacgaagagggcaagttcagattacgtggattgctgccgggatgtgtgtaccacgttcagctcaaggcagaaggcaacgaccacattgagcgggcgctcccccaccatagggtgattgaggttgggaataatgacatcgatgatgtaaacatcatagttttccggcagattaatcaatttgatttaagtggaaatgtgatcacttcctctgaataccttcctacgttatgggtcaagctttacaaaagcgaaaacctcgacaatccaatccagacagttttccctttgcatctgagatcctgctggaaaccacggcaacctgtatccactattaggaggtaaaaatcaataaaatggcccattcatttgtgttgtagctca

SEQ ID NO: 314958 - DNA, 2867 bp, Homo sapiens
agccgacgaccgtggagctccatgtggatggagtcagtgacatctgcacaaagggtggggacatcaactttgtcttcactgggttctctgtgaatggcaaggtcctcagcaaagggcagcccctgggtcctgcgggagttcaggtgtctctgagaaacactgggaccgaagcaaagatccagtccacagttacacagcctggcggaaagtttgcattttttaaagttctgcctggagattatgaaatcctcgcaactcatccaacctgggcgttgaaagaggcaagcaccacagtgcgtgtaaccaactccaatgccaatgcggccagtcccctcatagttgctggctacaatgtgtctggctctgtccgaagtgatggggagcccatgaaaggcgtgaagtttcttctcttttcttctttagtaactaaagaggatgtcctgggctgcaatgtctcaccagtgcctgggttccagccccaagacgagagtctggtgtatttgtgctacacggtctccagagaagatggctcgttctctttctattccttgccaagtgggggctacactgtgattccgttctatcgaggggagaggattacctttgatgtggcgccttccagacttgacttcacagtggagcatgacagcttgaaaatcgagcccgtgttccacgtcatgggattctccgtcaccgggagggtcttgaacggacccgaaggagatggtgttccagaagcagtagtcaccctgaataaccaaatcaaagttaaaacaaaagctgatggctcattccgccttgagaacataaccacagggacatacaccatccatgctcagaaagagcacctctactttgaaacggtcaccatcaaaattgcaccaaacacacctcagctggctgacattgttgcaacagggttcagtgtctgtggtcagatatcaatcattcgcttccccgacaccgtcaagcagatgaataaatacaaagttgtcctgtcatctcaagacaaggacaagtctttggtcaccgtggagacagatgctcatggatcattttgttttaaagcaaacccagggacttacaaagtgcaggtgatggttcctgaggcagaaaccagagcagggctgacgttgaaaccccagacatttcctcttactgtgaccgacaggcctgtgatggatgtggcctttgtacagttcttggcatcagtttctgggaaagtctcttgtttggacacctgtggtgacttgctggtgactctacagtccctgagccgccagggtgagaagcggagcctccagctctccggcaaggtcaacgccatgactttcacctttgacaacgtgctccctggaaaatacaaaataagcatcatgcatgaggattggtgctggaagaacaagagcctggaggtggaagtgctggaggatgacgtgtctgcagttgagttcaggcagacgggctacatgctgagatgttccctgtctcacgccatcactctggaattttatcaggatggaaatgggcgtgagaatgtggggatttataacctctccaaaggagtcaaccgattctgcctgtccaagcctggtgtgtacaaagtgacccctcgctcctgccaccggtttgagcaagcgttctacacctatgacacgtcttcacctagtatcttgacattgacagccattcgccaccatgtccttggaactatcaccaccgacaaaatgatggatgtcactgtgactatcaagtcttccatcgacagtgaacccgccttggtcttaggccctctgaagtctgtgcaggagctgcggagggagcagcagctggctgagatcgaggcccgcaggcaggagagggagaaaaacggcaatgaggaaggtgaagaaagaatgaccaagcctcccgtgcaggagatggtagatgagttacaaggccccttctcgtatgatttctcttactgggcgcggtctggagagaaaatcactgttacaccgtcatctaaagagctgctcttttatcccccttcaatggaagccgttgtcagtggagaaagctgcccagggaagctgatcgagatccacgggaaggcaggcctgtttttagaaggccagatccaccccgagttggaaggagtcgagattgtcatcagtgaaaagggggcaagttcaccgctgatcacagtctttactgatgacaaaggtgcctacagtgttggccccctgcacagtgacctggagtacacggtgacctcacagaaggagggctatgttctgactgcagtggaaggaaccatcggagacttcaaggcctatgccctggcaggcgtaagctttgagataaaagctgaggatgaccagcccctcccgggagtcctcttatccctgagtggtggcctgtttcgttccaacctcttgacccaggacaacggcattctgacattctcaaacctgagccctggccagtattacttcaaacccatgatgaaggagttccggtttgagccatcctcacagatgatcgaggtgcaggaaggccagaacctgaagatcaccatcacggggtaccgaaccgcttacagttgctatggcacagtgtcttccttaaacggagagcccgaacaaggggttgccatggaagcggtgggccagaacgactgcagcatttacggagaagacaccgtgacagacgaagagggcaagttcagattacgtggattgctgccgggatgtgtgtaccacgttcagctcaaggcagaaggcaacgaccacattgagcgggcgctcccccaccatagggtgattgagccagtagtgggtcagccagtagtgggtcagccagtagtgggtcagccagtagtgggt

SEQ ID NO: 314959 - DNA, 3052 bp, Homo sapiens
agccgacgaccgtggagctccatgtggatggagtcagtgacatctgcacaaagggtggggacatcaactttgtcttcactgggttctctgtgaatggcaaggtcctcagcaaagggcagcccctgggtcctgcgggagttcaggtgtctctgagaaacactgggaccgaagcaaagatccagtccacagttacacagcctggcggaaagtttgcattttttaaagttctgcctggagattatgaaatcctcgcaactcatccaacctgggcgttgaaagaggcaagcaccacagtgcgtgtaaccaactccaatgccaatgcggccagtcccctcatagttgctggctacaatgtgtctggctctgtccgaagtgatggggagcccatgaaaggcgtgaagtttcttctcttttcttctttagtaactaaagaggatgtcctgggctgcaatgtctcaccagtgcctgggttccagccccaagacgagagtctggtgtatttgtgctacacggtctccagagaagatggctcgttctctttctattccttgccaagtgggggctacactgtgattccgttctatcgaggggagaggattacctttgatgtggcgccttccagacttgacttcacagtggagcatgacagcttgaaaatcgagcccgtgttccacgtcatgggattctccgtcaccgggagggtcttgaacggacccgaaggagatggtgttccagaagcagtagtcaccctgaataaccaaatcaaagttaaaacaaaagctgatggctcattccgccttgagaacataaccacagggacatacaccatccatgctcagaaagagcacctctactttgaaacggtcaccatcaaaattgcaccaaacacacctcagctggctgacattgttgcaacagggttcagtgtctgtggtcagatatcaatcattcgcttccccgacaccgtcaagcagatgaataaatacaaagttgtcctgtcatctcaagacaaggacaagtctttggtcaccgtggagacagatgctcatggatcattttgttttaaagcaaacccagggacttacaaagtgcaggtgatggttcctgaggcagaaaccagagcagggctgacgttgaaaccccagacatttcctcttactgtgaccgacaggcctgtgatggatgtggcctttgtacagttcttggcatcagtttctgggaaagtctcttgtttggacacctgtggtgacttgctggtgactctacagtccctgagccgccagggtgagaagcggagcctccagctctccggcaaggtcaacgccatgactttcacctttgacaacgtgctccctggaaaatacaaaataagcatcatgcatgaggattggtgctggaagaacaagagcctggaggtggaagtgctggaggatgacgtgtctgcagttgagttcaggcagacgggctacatgctgagatgttccctgtctcacgccatcactctggaattttatcaggatggaaatgggcgtgagaatgtggggatttataacctctccaaaggagtcaaccgattctgcctgtccaagcctggtgtgtacaaagtgacccctcgctcctgccaccggtttgagcaagcgttctacacctatgacacgtcttcacctagtatcttgacattgacagccattcgccaccatgtccttggaactatcaccaccgacaaaatgatggatgtcactgtgactatcaagtcttccatcgacagtgaacccgccttggtcttaggccctctgaagtctgtgcaggagctgcggagggagcagcagctggctgagatcgaggcccgcaggcaggagagggagaaaaacggcaatgaggaaggtgaagaaagaatgaccaagcctcccgtgcaggagatggtagatgagttacaaggccccttctcgtatgatttctcttactgggcgcggtctggagagaaaatcactgttacaccgtcatctaaagagctgctcttttatcccccttcaatggaagccgttgtcagtggagaaagctgcccagggaagctgatcgagatccacgggaaggcaggcctgtttttagaaggccagatccaccccgagttggaaggagtcgagattgtcatcagtgaaaagggggcaagttcaccgctgatcacagtctttactgatgacaaaggtgcctacagtgttggccccctgcacagtgacctggagtacacggtgacctcacagaaggagggctatgttctgactgcagtggaaggaaccatcggagacttcaaggcctatgccctggcaggcgtaagctttgagataaaagctgaggatgaccagcccctcccgggagtcctcttatccctgagtggtggcctgtttcgttccaacctcttgacccaggacaacggcattctgacattctcaaacctgagcccttgttcgggctctcgttccgccccccatgcccgcccggcagtcccgggctccccaccccactccctcgccagccagcaccgccggccgcccagcacagcgccagcacacctgcacacacccccccaccacccgcccaccgcaacccccccccacccaccccccccgccccccaccgccctccccctcccccgcgcacacccccgcaccccccggcccccgcccacgcccccacccccccccccccacaccgcacccggcaccgcccccccacacggcagcacacaccacccgcacgcaccacgcacccgcaagcagcgcgccaagcgtccaaccactaacccgcgcgccacccgccctcgccccgcgcgaccgcctgcggccacccacagatcccacgcctcccaacgccacccacaccccaacgcaccaccccccgcaagcagcagacgcacccccccccagcccaaacccgcagcacccgaccgccacggacgcaccctgcccgcaccatcaaaacccccgcgcccaaccccaccacccccccccccgcggacacacccacccccacccccccccccacccccgcgccc

SEQ ID NO: 314960 - DNA, 1606 bp, Homo sapiens
agccgacgaccgtggagctccatgtggatggagtcagtgacatctgcacaaagggtggggacatcaactttgtcttcactgggttctctgtgaatggcaaggtcctcagcaaagggcagcccctgggtcctgcgggagttcaggtgtctctgagaaacactgggaccgaagcaaagatccagtccacagttacacagcctggcggaaagtttgcattttttaaagttctgcctggagattatgaaatcctcgcaactcatccaacctgggcgttgaaagaggcaagcaccacagtgcgtgtaaccaactccaatgccaatgcggccagtcccctcatagttgctggctacaatgtgtctggctctgtccgaagtgatggggagcccatgaaaggcgtgaagtttcttctcttttcttctttagtaactaaagaggatgtcctgggctgcaatgtctcaccagtgcctgggttccagccccaagacgagagtctggtgtatttgtgctacacggtctccagagaagatggctcgttctctttctattccttgccaagtgggggctacactgtgattccgttctatcgaggggagaggattacctttgatgtggcgccttccagacttgacttcacagtggagcatgacagcttgaaaatcgagcccgtgttccacgtcatgggattctccgtcaccgggagggtcttgaacggacccgaaggagatggtgttccagaagcagtagtcaccctgaataaccaaatcaaagttaaaacaaaagctgatggctcattccgccttgagaacataaccacagggacatacaccatccatgctcagaaagagcacctctactttgaaacggtcaccatcaaaattgcaccaaacacacctcagctggctgacattgttgcaacagggttcagtgtctgtggtcagatatcaatcattcgcttccccgacaccgtcaagcagatgaataaatacaaagttgtcctgtcatctcaagacaaggacaagtctttggtcaccgtggagacagatgctcatggatcattttgttttaaagcaaacccagggacttacaaagtgcaggtgcgatgcattgttttaaatttaaaatgttttgagaaaaagcagtgatttttagaagggttattaggtcgaatggggttagagaaggagcattccagtttccaacttcttgtttttaagtctttacaatcctgcaccagtagaggagagtcagataggcatccagctaaaaaataatgccatctgcctctcttttttccagtcttgatggttattagtatcaggctgccagtcactcctctaccttcaggcttctggctgctgtagaatgtcgatgagtccaagaggacaccaaaaatgaactctactaatggccgctcaaaaatggccatagtgcgtggcttctgggaccccaggccaaaatggagcttcccatttcctgctttgccttgacttcaagatggctaggcagggaccacgcgacttatccattcaacagcagacgacgtctgctgtgtcatcatcaccatgtgtcacagaacagactcgtcatccatgggggtcctctaata

SEQ ID NO: 314961 - DNA, 929 bp, Homo sapiens
catttgcagctgcagtggaaagcatttgtgctcactatattgcaaaggaggtgactgaaataagctcccgtgaagcatcacagtcattacactggagcagttctctggttccacgtttcaattcgtcctatcttcctgcgagatattgactttttcctttctctaatgtgttgaaatatgaacattttaataagaatggaaaagaatatggatatttaaaataggccatctaggttgtaagaatgaatactttttacattggactcagtaaaatgtaatcattttgaagaagggaaacatgtggctagaaacctgtttaatttatttattgtcccttacttaatataatgtgatctgcagtgacctcgagtgcccttcacaatatattttcctcattaacatttagtggttctgggaagctggcctgtaactcagaagttaggaatcatttctttaatggttgccgaacgtacaatctaatccattcaaataggcaggggaaactactaccaaatatttctaaaatcagaatggcagaaagaacacaaatgattataaaagaaaatgtcacagaaaaaacacatgaccaagtgaaaaaaatgaagaatacttatcaactctaaaaaaaaagaaattttgtgcaaaattttcagagaaaactgccattatgaacagtatgtaactacagtgatctcaagaaaacaaaacacaaatgggttgttaacggttgacaatcagagttgcatgaatgatgtgtgaaggcctgaagatgttatttgtttattaaaaggaagcagttatccatcgtgtatatgcttgggttacgagtccacccctcatcttcttggtcatttgtttacatagcccacctgtgtgggcttcactattctaatatggatttgtttttcagagtcattaagctgtttata

SEQ ID NO: 314962 - DNA, 254 bp, Homo sapiens
tgaaaaggaaaagaatgtggagacctcaaattataaaccagccaggctttaaaccgtgctgctgaactccgcaagatttcttgaaggaattaatgagcagatagttttacacatgtttagaaaggaaggcagtgaaagcaagcttggcttcatcaagaacaagacatgtcagactaatcttaatcattttctgaaagtattacttggttggcagatatgaaaaatgctctagacatagttaatttgattttaag

SEQ ID NO: 314963 - DNA, 439 bp, Homo sapiens
tctcacttttctctctactagacagatggccagctaaatgcagaaggatcatgaactttacaaacaagtgaaagagtctggttccctgggttaccacatggaagtctacctgccagatccctgcaatgaactgtgaaacaagcaagaaatacattttgttacattattcagatgcatcggttctttattatctcattagcctactttgtcaaaacattccataatctcttctccaatcttcttttctcccaactccagcataaagagagagtttatggcccccaaacataaattatggtttccatcttcgttaaatatacctctttccaatctctcacaaccccacccccatcattaacccctatcaaaatcctgcttcattcaaggtcaatttcaagccccttctcacctgtgaagtcttctagagccttcagttcct

SEQ ID NO: 314964 - DNA, 605 bp, Homo sapiens
gaaggaaagagtggggacagttggctgcctgtgcaactctccagactagaaagagaccattacacatgttgtaaagcccagaggaatagttttctgcacatcttgcctggcaagtgctcttctacaatgtaaaacaaacttctctgaagtacagaacttggtaatagctaaaccccgcttgaaagtagaaaacgaagttccagaaatagaagaagggcttggaaacaagtataaagtgccaaaaaagaggtatcatcagcaggaagagggtgaggacgcacctggaagccacacacattggaggacacaggttcttcactgcaagtctgtgaagcccaataaaagaagctttggtgaaaaaggtagcctgttcaggacacagcagaatgtgatttttcacttctgaagaaaagggaaatttggacacagaaccagagaggacagtgctgtggacacgcagacacagggaagaagccaggcgaaggcagaggcagaggctggaggcaagcatctacaagccaacggacggcaaggatttccagccaccaccagaagctggggaagaagccgacaacagattctctcagagcctccagttagaacca

SEQ ID NO: 314965 - DNA, 4482 bp, Homo sapiens
gcccctctccgcgcggccggcccccagtgcaggcggagccgcgccgcgctcccaccccggccgggagctaggagccagcggccagccccgcgcagcgcagcgcagcccgcagaagcccggtcagcgcacgtgcccgcgagacctgcaaacttgtgccaccggctctgcccgtccccggggagcccgaacgccccgcagccctcacccctcccgccagtctccagccatgggctgctttgaatgctgcatcaagtgtctgggaggagtcccctacgcctccctggtggccaccatcctctgcttctccggggtggccttattctgcggctgtgggcatgtggctctcgcaggcaccgtggcgattcttgagcaacacttctccaccaacgccagtgaccatgccttgctgagcgaggtgatacaactgatgcagtatgtcatctatggaattgcgtcctttttcttcttgtatgggatcattctgttggcagaaggcttttacaccacaagtgcagtgaaagaactgcacggtgagtttaaaacaaccgcttgtggccgatgcatcagtggaatgttcgttttcctcacctatgtgcttggagtggcctggctgggtgtgtttggtttctcagcggtgcccgtgtttatgttctacaacatatggtcaacttgtgaagtcatcaagtcaccgcagaccaacgggaccacgggtgtggagcagatctgtgtggatatccgacaatacggtatcattccttggaatgctttccccggaaaaatatgtggctctgccctggagaacatctgcaacacaaacgagttctacatgtcctatcacctgttcattgtggcctgtgcaggagctggtgccaccgtcattgccctgctgatctacatgatggctactacatataactatgcggttttgaagtttaagagtcgggaagattgctgcactaaattctaaattgcataaggagttttagagagctatgctctgtagcatgaaatatcactgacactccagactaaagcagagtctaggtttctgcaattttgttacagtaatttgtaaatagctttagtaaactcaccttgcatggtagattaataagatgacttactgtacatgaattacacaataatgagatctggtggctatttccacattttgaaaaggattcagttatttactgacagtggtgagcatcctttttaaaataatgttctcatacttaaacattagagagcagtatctttaaatgaattattaacactttggaatacttacattttctgttatttttgattgcctgataaccagtttcaatgatgaaaatgaaaacaagtgctgaagatgaaatggaagagaaccgttttaatctggattttgttttgtcacacctggaaaatactttgcaaatatgttctaaattgaaaacaatttttttatgatcacatggttcactaccaaatgaccctcaaataagccagatgaaaatttgaagaaaaaggtcacccagttctctggaaaaaaaaaaaaaaaaaaaaaaaaaaaggatttatatgtgggtagttttttttttggtacaacacaatcattctgttagagcccacaaaattggtaaccttaaattgtgtgttttggtaagtaataactaactgtttcctcatagctagttctcaagctgcatgtaagattttaacgggaagagaaaataggcctggacctgaaggtctcaaatatgttgagaagaaagtatgaactataaggaacttgagatgtagatttattttgcaggaaatacgaggaaaataggaaagaagtgtttgccgcatcaagtgtaaagaatgatactgaggatttttacattttatgaaatgaaataatggcatttacaaaatgaaaaatgtagtttcacaactaagttttgttaacagagactgcatgctttgcttatagttcttaattttggttttgacattcatttaattttttccatgttaaatatgtagtttaattatttactcaaaataaacattgttcatgcttttaggcctttgggggaattgatttttatccacaggtagaaaatggtctttgcacacactacacttatttcaaatatacaatgtgctcccgaactttcgcattagtctttaaaattactctcaaaatggtattaaaaaaaaaaaaaaaagcaccctctcgtatttcattttggctttttcttaacaataccttgggccatttttttccagttcactatgttggtatactaacttttcttcagccttttaatgcgaagccaactagtagagcatgctttcaggatctgacagctctgctagtagagcgagtatttattaatacagaattaaccttcgcccctttaaagtcaagtctgtctaatctaactagcgcctcgctttgccttctcacaatgctcactagccatcatgctcacccttctcttccagatccacttcctcatgatactgtcttctaactgggcttacttaaaggatgcgagcaaaatgcaggcttaccaggatatcaaagcaaaggaagaacaggaactgcaagatatccagtctcggtcaaaagaacaactcaattcttacacataaatgtttgccagagtgtttcggccgacgtatttacagctctgacaaatcatcagacagctgctctgcagtacagatgtgtatcccaccaaactaatgtagatgtacaaacacttcactgtctgtctcaagctgctgggatgtatctctaggaaaaccttccagtgggtaaatctttttctttagaacaaatattggaggtttcatgttagccattttaaaaggcaacactttgacaaaatgatcgttcatactttgggaatttgtggcatgttcacatttattgctagggcaattctaccaagacactcaatggaatatgtcacactccttaatagggacctgtgactccttaataaggacctgtgacatgcccagcatcaagggataagaccgtaaattcacatatatgccatctgtcctcaagtgttatctacataggaaataaaatggaattgatgtaaagttccatttctgacagctgacatttattaaactttggatcaaagataatgtgattcttatgattgatttctcaaactagcttttccctcccaagtccaggacccattaatttcctgagccaatcagaaatatatttttcaataatgctaaaattagctacaattctgctgaccctactattaaagaatctggatgctggactcactgacaagctttccagaagcaattttataacagatttcattttaacaaaatactgatccaattttcattattcttgagaaatgtcagctttgccttaatgagtatttgctttaaatttctaagaatttatatcataactagagacccaaatatctttcacagaattttgttccataaatgtttttcttaattattaagaagtgttaccttattaaaatgaccaccattctaaaccatttttcagtggtctggatacgaagtttacagtttcataccaactatctaaaacctaattgcaaattgaccacagacctctaacctcctacttttatagacttgaatacttaagtaatttaaattagggttggtatttcatttttttcttatctaaatcttagtttcctggaataataaagtttgatgttcagcaagagaactgcttgagtttaagccattttcaaaagaaacttgccttttacattattgtgttccagaacattaagtgactgtaggtactgggtattagtgatggtaaactttgtgttgctctttatgaaatgatccatataactgttgggtgcatcagtgcttttcaaaggggctgcttactatagggttaactatgtatattcattgttaagagttaacttgtggtttggctgtttcctggattttataacatacatgtgcagaaatgtattcaaatgaaaggaagcatacctttatcaagatgctattaaaattgaacatcaagtataatatttcatttggattctcttttttggttaatgcctaaaaatgcctatttgggattttttttttttttaaattaagagaagctctcttctgtgtagaacagttgttccaaaatagcttagtgttttgttttcctgttgcatgacagatttaactattctttccagcagtggaggtgctgtcagagtccagtgttctagaagaggcagtgtctaaagcctaattttacttttctaattctggtagctattaccaggaatttttgaaagttttgtttaagtagtctaatattttttatgtaaagagcattaaattttgctatgtataaatttttgtaacctaacagtgaatcaatattttctatcagtgccaagggcttcctgtagttctattcaagtgttacaataaatatttgtagataatagtcaa

SEQ ID NO: 314966 - DNA, 4908 bp, Homo sapiens
gcccctctccgcgcggccggcccccagtgcaggcggagccgcgccgcgctcccaccccggccgggagctaggagccagcggccagccccgcgcagcgcagcgcagcccgcagaagcccggtcagcgcacgtgcccgcgagacctgcaaacttgtgccaccggctctgcccgtccccggggagcccgaacgccccgcagccctcacccctcccgccagtctccagccatgggctgctttgaatgctgcatcaagtgtctgggaggagtcccctacgcctccctggtggccaccatcctctgcttctccggggtggccttattctgcggctgtgggcatgtggctctcgcaggcaccgtggcgattcttgagcaacacttctccaccaacgccagtgaccatgccttgctgagcgaggtgatacaactgatgcagtatgtcatctatggaattgcgtcctttttcttcttgtatgggatcattctgttggcagaaggcttttacaccacaagtgcagtgaaagaactgcacggtgagtttaaaacaaccgcttgtggccgatgcatcagtggaatgttcgttttcctcacctatgtgcttggagtggcctggctgggtgtgtttggtttctcagcggtgcccgtgtttatgttctacaacatatggtcaacttgtgaagtcatcaagtcaccgcagaccaacgggaccacgggtgtggagcagatctgtgtggatatccgacaatacggtatcattccttggaatgctttccccggaaaaatatgtggctctgccctggagaacatctgcaacacaaacgagttctacatgtcctatcacctgttcattgtggcctgtgcaggagctggtgccaccgtcattgccctgctgatctacatgatggctactacatataactatgcggttttgaagtttaagagtcgggaagattgctgcactaaattctaaattgcataaggagttttagagagctatgctctgtagcatgaaatatcactgacactccagactaaagcagagtctaggtttctgcaattttgttacagtaatttgtaaatagctttagtaaactcaccttgcatggtagattaataagatgacttactgtacatgaattacacaataatgagatctggtggctatttccacattttgaaaaggattcagttatttactgacagtggtgagcatcctttttaaaataatgttctcatacttaaacattagagagcagtatctttaaatgaattattaacactttggaatacttacattttctgttatttttgattgcctgataaccagtttcaatgatgaaaatgaaaacaagtgctgaagatgaaatggaagagaaccgttttaatctggattttgttttgtcacacctggaaaatactttgcaaatatgttctaaattgaaaacaatttttttatgatcacatggttcactaccaaatgaccctcaaataagccagatgaaaatttgaagaaaaaggtcacccagttctctggaaaaaaaaaaaaaaaaaaaaaaaaaaaggatttatatgtgggtagttttttttttggtacaacacaatcattctgttagagcccacaaaattggtaaccttaaattgtgtgttttggtaagtaataactaactgtttcctcatagctagttctcaagctgcatgtaagattttaacgggaagagaaaataggcctggacctgaaggtctcaaatatgttgagaagaaagtatgaactataaggaacttgagatgtagatttattttgcaggaaatacgaggaaaataggaaagaagtgtttgccgcatcaagtgtaaagaatgatactgaggatttttacattttatgaaatgaaataatggcatttacaaaatgaaaaatgtagtttcacaactaagttttgttaacagagactgcatgctttgcttatagttcttaattttggttttgacattcatttaattttttccatgttaaatatgtagtttaattatttactcaaaataaacattgttcatgcttttaggcctttgggggaattgatttttatccacaggtagaaaatggtctttgcacacactacacttatttcaaatatacaatgtgctcccgaactttcgcattagtctttaaaattactctcaaaatggtattaaaaaaaaaaaaaaaagcaccctctcgtatttcattttggctttttcttaacaataccttgggccatttttttccagttcactatgttggtatactaacttttcttcagccttttaatgcgaagccaactagtagagcatgctttcaggatctgacagctctgctagtagagcgagtatttattaatacagaattaaccttcgcccctttaaagtcaagtctgtctaatctaactagcgcctcgctttgccttctcacaatgctcactagccatcatgctcacccttctcttccagatccacttcctcatgatactgtcttctaactgggcttacttaaaggatgcgagcaaaatgcaggcttaccaggatatcaaagcaaaggaagaacaggaactgcaagatatccagtctcggtcaaaagaacaactcaattcttacacataaatgtttgccagagtgtttcggccgacgtatttacagctctgacaaatcatcagacagctgctctgcagtacagatgtgtatcccaccaaactaatgtagatgtacaaacacttcactgtctgtctcaagctgctgggatgtatctctaggaaaaccttccagtgggtaaatctttttctttagaacaaatattggaggtttcatgttagccattttaaaaggcaacactttgacaaaatgatcgttcatactttgggaatttgtggcatgttcacatttattgctagggcaattctaccaagacactcaatggaatatgtcacactccttaatagggacctgtgactccttaataaggacctgtgacatgcccagcatcaagggataagaccgtaaattcacatatatgccatctgtcctcaagtgttatctacataggaaataaaatggaattgatgtaaagttccatttctgacagctgacatttattaaactttggatcaaagataatgtgattcttatgattgatttctcaaactagcttttccctcccaagtccaggacccattaatttcctgagccaatcagaaatatatttttcaataatgctaaaattagctacaattctgctgaccctactattaaagaatctggatgctggactcactgacaagctttccagaagcaattttataacagatttcattttaacaaaatactgatccaattttcattattcttgagaaatgtcagctttgccttaatgagtatttgctttaaatttctaagaatttatatcataactagagacccaaatatctttcacagaattttgttccataaatgtttttcttaattattaagaagtgttaccttattaaaatgaccaccattctaaaccatttttcagtggtctggatacgaagtttacagtttcataccaactatctaaaacctaattgcaaattgaccacagacctctaacctcctacttttatagacttgaatacttaagtaatttaaattagggttggtatttcatttttttcttatctaaatcttagtttcctggaataataaagtttgatgttcagcaagagaactgcttgagtttaagccattttcaaaagaaacttgccttttacattattgtgttccagaacattaagtgactgtaggtactgggtattagtgatggtaaactttgtgttgctctttatgaaatgatccatataactgttgggtgcatcagtgcttttcaaaggggctgcttactatagggttaactatgtatattcattgttaagagttaacttgtggtttggctgtttcctggattttataacatacatgtgcagaaatgtattcaaatgaaaggaagcatacctttatcaagatgctattaaaattgaacatcaagtataatatttcatttggattctcttttttggttaatgcctaaaaatgcctatttgggattttttttttttttaaattaagagaagctctcttctgtgtagaacagttgttccaaaatagcttagtgttttgttttcctgttgcatgacagatttaactattctttccagcagtggaggtgctgtcagagtccagtgttctagaagaggcagtgtctaaagcctaattttacttttctaattctggtagctattaccaggaatttttgaaagttttgtttaagtagtctaatattttttatgtaaagagcattaaattttgctatgtataaatttttgtaacctaacagtgaatcaatattttctatcagtgccaagggcttcctgtagttctattcaagtgttacaataaatatttgtagataatagtcaaaaaaaaaaaaaaaaaaaaaaaaaaaaaaaaaaaaaaaaaaaaaaaaaaaaaaaaaaaaaaaaaaaaaagccgcaacaaaaaaaacaaaacacaagaagcaacagaccaaaaaagagcaaccaccacacacaagaacataaacagaaagtagcacggtcgagtcgggcgcaccaaaaaagacacgagaggcgggactaaaacaacccaaccaccagcacaaacagaggaccggaccagaacataccgtggcagcagaccacaccgaagaggggccccacaaaataggaagcagacaaacacagaaaaaaagtagcgacacggaggaaaacacacagaaaaggtagtaggaggacaacaccgcgacctaacgaggagaaaagcaacaccaaggaaagagacgagaacattacagcaaaacacaaaagc

SEQ ID NO: 314967 - DNA, 4055 bp, Homo sapiens
gcccctctccgcgcggccggcccccagtgcaggcggagccgcgccgcgctcccaccccggccgggagctaggagccagcggccagccccgcgcagcgcagcgcagcccgcagaagcccggtcagcgcacgtgcccgcgagacctgcaaacttgtgccaccggctctgcccgtccccggggagcccgaacgccccgcagccctcacccctcccgccagtctccagccatgggctgctttgaatgctgcatcaagtgtctgggaggagtcccctacgcctccctggtggccaccatcctctgcttctccggggtggccttattctgcggctgtgggcatgtggctctcgcaggcaccgtggcgattcttgagcaacacttctccaccaacgccagtgaccatgccttgctgagcgaggtgatacaactgatgcagtatgtcatctatggaattgcgtcctttttcttcttgtatgggatcattctgttggcagaaggcttttacaccacaagtgcagtgaaagaactgcacggtgagtttaaaacaaccgcttgtggccgatgcatcagtggaatgttcgttttcctcacctatgtgcttggagtggcctggctgggtgtgtttggtttctcagcggtgcccgtgtttatgttctacaacatatggtcaacttgtgaagtcatcaagtcaccgcagaccaacgggaccacgggtgtggagcagatctgtgtggatatccgacaatacggtatcattccttggaatgctttccccggaaaaatatgtggctctgccctggagaacatctgcaacacaaacgagttctacatgtcctatcacctgttcattgtggcctgtgcaggagctggtgccaccgtcattgccctgctgatctacatgatggctactacatataactatgcggttttgaagtttaagagtcgggaagattgctgcactaaattctaaattgcataaggagttttagagagctatgctctgtagcatgaaatatcactgacactccagactaaagcagagtctaggtttctgcaattttgttacagtaatttgtaaatagctttagtaaactcaccttgcatggtagattaataagatgacttactgtacatgaattacacaataatgagatctggtggctatttccacattttgaaaaggattcagttatttactgacagtggtgagcatcctttttaaaataatgttctcatacttaaacattagagagcagtatctttaaatgaattattaacactttggaatacttacattttctgttatttttgattgcctgataaccagtttcaatgatgaaaatgaaaacaagtgctgaagatgaaatggaagagaaccgttttaatctggattttgttttgtcacacctggaaaatactttgcaaatatgttctaaattgaaaacaatttttttatgatcacatggttcactaccaaatgaccctcaaataagccagatgaaaatttgaagaaaaaggtcacccagttctctggaaaaaaaaaaaaaaaaaaaaaaaaaaaggatttatatgtgggtagttttttttttggtacaacacaatcattctgttagagcccacaaaattggtaaccttaaattgtgtgttttggtaagtaataactaactgtttcctcatagctagttctcaagctgcatgtaagattttaacgggaagagaaaataggcctggacctgaaggtctcaaatatgttgagaagaaagtatgaactataaggaacttgagatgtagatttattttgcaggaaatacgaggaaaataggaaagaagtgtttgccgcatcaagtgtaaagaatgatactgaggatttttacattttatgaaatgaaataatggcatttacaaaatgaaaaatgtagtttcacaactaagttttgttaacagagactgcatgctttgcttatagttcttaattttggttttgacattcatttaattttttccatgttaaatatgtagtttaattatttactcaaaataaacattgttcatgcttttaggcctttgggggaattgatttttatccacaggtagaaaatggtctttgcacacactacacttatttcaaatatacaatgtgctcccgaactttcgcattagtctttaaaattactctcaaaatggtattaaaaaaaaaaaaaaaagcaccctctcgtatttcattttggctttttcttaacaataccttgggccatttttttccagttcactatgttggtatactaacttttcttcagccttttaatgcgaagccaactagtagagcatgctttcaggatctgacagctctgctagtagagcgagtatttattaatacagaattaaccttcgcccctttaaagtcaagtctgtctaatctaactagcgcctcgctttgccttctcacaatgctcactagccatcatgctcacccttctcttccagatccacttcctcatgatactgtcttctaactgggcttacttaaaggatgcgagcaaaatgcaggcttaccaggatatcaaagcaaaggaagaacaggaactgcaagatatccagtctcggtcaaaagaacaactcaattcttacacataaatgtttgccagagtgtttcggccgacgtatttacagctctgacaaatcatcagacagctgctctgcagtacagatgtgtatcccaccaaactaatgtagatgtacaaacacttcactgtctgtctcaagctgctgggatgtatctctaggaaaaccttccagtgggtaaatctttttctttagaacaaatattggaggtttcatgttagccattttaaaaggcaacactttgacaaaatgatcgttcatactttgggaatttgtggcatgttcacatttattgctagggcaattctaccaagacactcaatggaatatgtcacactccttaatagggacctgtgactccttaataaggacctgtgacatgcccagcatcaagggataagaccgtaaattcacatatatgccatctgtcctcaagtgttatctacataggaaataaaatggaattgatgtaaagttccatttctgacagctgacatttattaaactttggatcaaagataatgtgattcttatgattgatttctcaaactagcttttccctcccaagtccaggacccattaatttcctgagccaatcagaaatatatttttcaataatgctaaaattagctacaattctgctgaccctactattaaagaatctggatgctggactcactgacaagctttccagaagcaattttataacagatttcattttaacaaaatactgatccaattttcattattcttgagaaatgtcagctttgccttaatgagtatttgctttaaatttctaagaatttatatcataactagagacccaaatatctttcacagaattttgttccataaatgtttttcttaattattaagaagtgttaccttattaaaatgaccaccattctaaaccatttttcagtggtctggatacgaagtttacagtttcataccaactatctaaaacctaattgcaaattgaccacagacctctaacctcctacttttatagacttgaatacttaagtaatttaaattagggttggtatttcatttttttcttatctaaatcttagtttcctggaataataaagtttgatgttcagcaagagaactgcttgagtttaagccattttcaaaagaaacttgccttttacattattgtgttccagaacattaagtgactgtaggtactgggtattagtgatggtaaactttgtgttgctctttatgaaatgatccatataactgttgggtgcatcagtgcttttcaaaggggctgcttactatagggttaactatgtatattcattgttaagagttaacttgtggtttggctgtttcctggattttataacatacatgtgcagaaatgtattcaaatgaaaggaagcatacctttatcaagatgctattaaaattgaacatcaagtata

SEQ ID NO: 314968 - DNA, 4698 bp, Homo sapiens
agcggggctagaagaaatgaggtggggagaaagagagagagagagagagatcgagattgagatcttaagaaagagagcaaggaggaagagcccgactgtaggcaccaccgggcgccgaatggctgttttctaactgggatcctcggtgacgtatggctgcctgccccttggcagctgtctttatggaccagtaggcagagcgaaattgacgctgacaagacttttgcatcttggaagggactgtaatctactgtagtgaagaacagagcctctcaatcagacgggtgtaaataagagacggaggggagtccagaagaaaaggaagaggaggaaaaacaagtgtgtgttggggggaacagggggaaaagcatttttggtggatggtatgaagccagccatggaaactgcagccgaggaaaatactgaacaaagccaagagagaaaaggctgctttgaatgctgcatcaagtgtctgggaggagtcccctacgcctccctggtggccaccatcctctgcttctccggggtggccttattctgcggctgtgggcatgtggctctcgcaggcaccgtggcgattcttgagcaacacttctccaccaacgccagtgaccatgccttgctgagcgaggtgatacaactgatgcagtatgtcatctatggaattgcgtcctttttcttcttgtatgggatcattctgttggcagaaggcttttacaccacaagtgcagtgaaagaactgcacggtgagtttaaaacaaccgcttgtggccgatgcatcagtggaatgttcgttttcctcacctatgtgcttggagtggcctggctgggtgtgtttggtttctcagcggtgcccgtgtttatgttctacaacatatggtcaacttgtgaagtcatcaagtcaccgcagaccaacgggaccacgggtgtggagcagatctgtgtggatatccgacaatacggtatcattccttggaatgctttccccggaaaaatatgtggctctgccctggagaacatctgcaacacaaacgagttctacatgtcctatcacctgttcattgtggcctgtgcaggagctggtgccaccgtcattgccctgctgatctacatgatggctactacatataactatgcggttttgaagtttaagagtcgggaagattgctgcactaaattctaaattgcataaggagttttagagagctatgctctgtagcatgaaatatcactgacactccagactaaagcagagtctaggtttctgcaattttgttacagtaatttgtaaatagctttagtaaactcaccttgcatggtagattaataagatgacttactgtacatgaattacacaataatgagatctggtggctatttccacattttgaaaaggattcagttatttactgacagtggtgagcatcctttttaaaataatgttctcatacttaaacattagagagcagtatctttaaatgaattattaacactttggaatacttacattttctgttatttttgattgcctgataaccagtttcaatgatgaaaatgaaaacaagtgctgaagatgaaatggaagagaaccgttttaatctggattttgttttgtcacacctggaaaatactttgcaaatatgttctaaattgaaaacaatttttttatgatcacatggttcactaccaaatgaccctcaaataagccagatgaaaatttgaagaaaaaggtcacccagttctctggaaaaaaaaaaaaaaaaaaaaaaaaaaaggatttatatgtgggtagttttttttttggtacaacacaatcattctgttagagcccacaaaattggtaaccttaaattgtgtgttttggtaagtaataactaactgtttcctcatagctagttctcaagctgcatgtaagattttaacgggaagagaaaataggcctggacctgaaggtctcaaatatgttgagaagaaagtatgaactataaggaacttgagatgtagatttattttgcaggaaatacgaggaaaataggaaagaagtgtttgccgcatcaagtgtaaagaatgatactgaggatttttacattttatgaaatgaaataatggcatttacaaaatgaaaaatgtagtttcacaactaagttttgttaacagagactgcatgctttgcttatagttcttaattttggttttgacattcatttaattttttccatgttaaatatgtagtttaattatttactcaaaataaacattgttcatgcttttaggcctttgggggaattgatttttatccacaggtagaaaatggtctttgcacacactacacttatttcaaatatacaatgtgctcccgaactttcgcattagtctttaaaattactctcaaaatggtattaaaaaaaaaaaaaaaagcaccctctcgtatttcattttggctttttcttaacaataccttgggccatttttttccagttcactatgttggtatactaacttttcttcagccttttaatgcgaagccaactagtagagcatgctttcaggatctgacagctctgctagtagagcgagtatttattaatacagaattaaccttcgcccctttaaagtcaagtctgtctaatctaactagcgcctcgctttgccttctcacaatgctcactagccatcatgctcacccttctcttccagatccacttcctcatgatactgtcttctaactgggcttacttaaaggatgcgagcaaaatgcaggcttaccaggatatcaaagcaaaggaagaacaggaactgcaagatatccagtctcggtcaaaagaacaactcaattcttacacataaatgtttgccagagtgtttcggccgacgtatttacagctctgacaaatcatcagacagctgctctgcagtacagatgtgtatcccaccaaactaatgtagatgtacaaacacttcactgtctgtctcaagctgctgggatgtatctctaggaaaaccttccagtgggtaaatctttttctttagaacaaatattggaggtttcatgttagccattttaaaaggcaacactttgacaaaatgatcgttcatactttgggaatttgtggcatgttcacatttattgctagggcaattctaccaagacactcaatggaatatgtcacactccttaatagggacctgtgactccttaataaggacctgtgacatgcccagcatcaagggataagaccgtaaattcacatatatgccatctgtcctcaagtgttatctacataggaaataaaatggaattgatgtaaagttccatttctgacagctgacatttattaaactttggatcaaagataatgtgattcttatgattgatttctcaaactagcttttccctcccaagtccaggacccattaatttcctgagccaatcagaaatatatttttcaataatgctaaaattagctacaattctgctgaccctactattaaagaatctggatgctggactcactgacaagctttccagaagcaattttataacagatttcattttaacaaaatactgatccaattttcattattcttgagaaatgtcagctttgccttaatgagtatttgctttaaatttctaagaatttatatcataactagagacccaaatatctttcacagaattttgttccataaatgtttttcttaattattaagaagtgttaccttattaaaatgaccaccattctaaaccatttttcagtggtctggatacgaagtttacagtttcataccaactatctaaaacctaattgcaaattgaccacagacctctaacctcctacttttatagacttgaatacttaagtaatttaaattagggttggtatttcatttttttcttatctaaatcttagtttcctggaataataaagtttgatgttcagcaagagaactgcttgagtttaagccattttcaaaagaaacttgccttttacattattgtgttccagaacattaagtgactgtaggtactgggtattagtgatggtaaactttgtgttgctctttatgaaatgatccatataactgttgggtgcatcagtgcttttcaaaggggctgcttactatagggttaactatgtatattcattgttaagagttaacttgtggtttggctgtttcctggattttataacatacatgtgcagaaatgtattcaaatgaaaggaagcatacctttatcaagatgctattaaaattgaacatcaagtataatatttcatttggattctcttttttggttaatgcctaaaaatgcctatttgggattttttttttttttaaattaagagaagctctcttctgtgtagaacagttgttccaaaatagcttagtgttttgttttcctgttgcatgacagatttaactattctttccagcagtggaggtgctgtcagagtccagtgttctagaagaggcagtgtctaaagcctaattttacttttctaattctggtagctattaccaggaatttttgaaagttttgtttaagtagtctaatattttttatgtaaagagcattaaattttgctatgtataaatttttgtaacctaacagtgaatcaatattttctatcagtgccaagggcttcctgtagttctattcaagtgttacaataaatatttgtagataatagtcaa

SEQ ID NO: 314969 - DNA, 2887 bp, Homo sapiens
gcccctctccgcgcggccggcccccagtgcaggcggagccgcgccgcgctcccaccccggccgggagctaggagccagcggccagccccgcgcagcgcagcgcagcccgcagaagcccggtcagcgcacgtgcccgcgagacctgcaaacttgtgccaccggctctgcccgtccccggggagcccgaacgccccgcagccctcacccctcccgccagtctccagccatgggctgctttgaatgctgcatcaagtgtctgggaggagtcccctacgcctccctggtggccaccatcctctgcttctccggggtggccttattctgcggctgtgggcatgtggctctcgcaggcaccgtggcgattcttgagcaacacttctccaccaacgccagtgaccatgccttgctgagcgaggtgatacaactgatgcagtatgtcatctatggaattgcgtcctttttcttcttgtatgggatcattctgttggcagaaggcttttacaccacaagtgcagtgaaagaactgcacggtgagtttaaaacaaccgcttgtggccgatgcatcagtggaatgttcgttttcctcacctatgtgcttggagtggcctggctgggtgtgtttggtttctcagcggtgcccgtgtttatgttctacaacatatggtcaacttgtgaagtcatcaagtcaccgcagaccaacgggaccacgggtgtggagcagatctgtgtggatatccgacaatacggtatcattccttggaatgctttccccggaaaaatatgtggctctgccctggagaacatctgcaacacaaacgagttctacatgtcctatcacctgttcattgtggcctgtgcaggagctggtgccaccgtcattgccctgatccacttcctcatgatactgtcttctaactgggcttacttaaaggatgcgagcaaaatgcaggcttaccaggatatcaaagcaaaggaagaacaggaactgcaagatatccagtctcggtcaaaagaacaactcaattcttacacataaatgtttgccagagtgtttcggccgacgtatttacagctctgacaaatcatcagacagctgctctgcagtacagatgtgtatcccaccaaactaatgtagatgtacaaacacttcactgtctgtctcaagctgctgggatgtatctctaggaaaaccttccagtgggtaaatctttttctttagaacaaatattggaggtttcatgttagccattttaaaaggcaacactttgacaaaatgatcgttcatactttgggaatttgtggcatgttcacatttattgctagggcaattctaccaagacactcaatggaatatgtcacactccttaatagggacctgtgactccttaataaggacctgtgacatgcccagcatcaagggataagaccgtaaattcacatatatgccatctgtcctcaagtgttatctacataggaaataaaatggaattgatgtaaagttccatttctgacagctgacatttattaaactttggatcaaagataatgtgattcttatgattgatttctcaaactagcttttccctcccaagtccaggacccattaatttcctgagccaatcagaaatatatttttcaataatgctaaaattagctacaattctgctgaccctactattaaagaatctggatgctggactcactgacaagctttccagaagcaattttataacagatttcattttaacaaaatactgatccaattttcattattcttgagaaatgtcagctttgccttaatgagtatttgctttaaatttctaagaatttatatcataactagagacccaaatatctttcacagaattttgttccataaatgtttttcttaattattaagaagtgttaccttattaaaatgaccaccattctaaaccatttttcagtggtctggatacgaagtttacagtttcataccaactatctaaaacctaattgcaaattgaccacagacctctaacctcctacttttatagacttgaatacttaagtaatttaaattagggttggtatttcatttttttcttatctaaatcttagtttcctggaataataaagtttgatgttcagcaagagaactgcttgagtttaagccattttcaaaagaaacttgccttttacattattgtgttccagaacattaagtgactgtaggtactgggtattagtgatggtaaactttgtgttgctctttatgaaatgatccatataactgttgggtgcatcagtgcttttcaaaggggctgcttactatagggttaactatgtatattcattgttaagagttaacttgtggtttggctgtttcctggattttataacatacatgtgcagaaatgtattcaaatgaaaggaagcatacctttatcaagatgctattaaaattgaacatcaagtataatatttcatttggattctcttttttggttaatgcctaaaaatgcctatttgggattttttttttttttaaattaagagaagctctcttctgtgtagaacagttgttccaaaatagcttagtgttttgttttcctgttgcatgacagatttaactattctttccagcagtggaggtgctgtcagagtccagtgttctagaagaggcagtgtctaaagcctaattttacttttctaattctggtagctattaccaggaatttttgaaagttttgtttaagtagtctaatattttttatgtaaagagcattaaattttgctatgtataaatttttgtaacctaacagtgaatcaatattttctatcagtgccaagggcttcctgtagttctattcaagtgttacaataaatatttgtagataatagtcaa

SEQ ID NO: 314970 - DNA, 4880 bp, Homo sapiens
agcggggctagaagaaatgaggtggggagaaagagagagagagagagagatcgagattgagatcttaagaaagagagcaaggaggaagagcccggtggggagcaggtccttctcccccacccccctacccccaactcccactggagccgcattgagactgtaggcaccaccgggcgccgaatggctgttttctaactgggatcctcggtgacgtatggctgcctgccccttggcagctgtctttatggaccagtaggcagagcgaaattgacgctgacaagacttttgcatcttggaagggactgtaatctactgtagtgaagaacagagcctctcaatcagacgggtgtaaataagagacggaggggagtccagaagaaaaggaagaggaggaaaaacaagtgtgtgttggggggaacagggggaaaagcatttttggtggatggtatgaagccagccatggaaactgcagccgaggaaaatactgaacaaagccaagagagaaaagtgaacagcagagctgaaatggaaattggcaggtaccactggatgtacccaggctcaaagaaccaccagtaccatcccgtgccaaccctgggggacagggctagccccttgagcagtccaggctgctttgaatgctgcatcaagtgtctgggaggagtcccctacgcctccctggtggccaccatcctctgcttctccggggtggccttattctgcggctgtgggcatgtggctctcgcaggcaccgtggcgattcttgagcaacacttctccaccaacgccagtgaccatgccttgctgagcgaggtgatacaactgatgcagtatgtcatctatggaattgcgtcctttttcttcttgtatgggatcattctgttggcagaaggcttttacaccacaagtgcagtgaaagaactgcacggtgagtttaaaacaaccgcttgtggccgatgcatcagtggaatgttcgttttcctcacctatgtgcttggagtggcctggctgggtgtgtttggtttctcagcggtgcccgtgtttatgttctacaacatatggtcaacttgtgaagtcatcaagtcaccgcagaccaacgggaccacgggtgtggagcagatctgtgtggatatccgacaatacggtatcattccttggaatgctttccccggaaaaatatgtggctctgccctggagaacatctgcaacacaaacgagttctacatgtcctatcacctgttcattgtggcctgtgcaggagctggtgccaccgtcattgccctgctgatctacatgatggctactacatataactatgcggttttgaagtttaagagtcgggaagattgctgcactaaattctaaattgcataaggagttttagagagctatgctctgtagcatgaaatatcactgacactccagactaaagcagagtctaggtttctgcaattttgttacagtaatttgtaaatagctttagtaaactcaccttgcatggtagattaataagatgacttactgtacatgaattacacaataatgagatctggtggctatttccacattttgaaaaggattcagttatttactgacagtggtgagcatcctttttaaaataatgttctcatacttaaacattagagagcagtatctttaaatgaattattaacactttggaatacttacattttctgttatttttgattgcctgataaccagtttcaatgatgaaaatgaaaacaagtgctgaagatgaaatggaagagaaccgttttaatctggattttgttttgtcacacctggaaaatactttgcaaatatgttctaaattgaaaacaatttttttatgatcacatggttcactaccaaatgaccctcaaataagccagatgaaaatttgaagaaaaaggtcacccagttctctggaaaaaaaaaaaaaaaaaaaaaaaaaaaggatttatatgtgggtagttttttttttggtacaacacaatcattctgttagagcccacaaaattggtaaccttaaattgtgtgttttggtaagtaataactaactgtttcctcatagctagttctcaagctgcatgtaagattttaacgggaagagaaaataggcctggacctgaaggtctcaaatatgttgagaagaaagtatgaactataaggaacttgagatgtagatttattttgcaggaaatacgaggaaaataggaaagaagtgtttgccgcatcaagtgtaaagaatgatactgaggatttttacattttatgaaatgaaataatggcatttacaaaatgaaaaatgtagtttcacaactaagttttgttaacagagactgcatgctttgcttatagttcttaattttggttttgacattcatttaattttttccatgttaaatatgtagtttaattatttactcaaaataaacattgttcatgcttttaggcctttgggggaattgatttttatccacaggtagaaaatggtctttgcacacactacacttatttcaaatatacaatgtgctcccgaactttcgcattagtctttaaaattactctcaaaatggtattaaaaaaaaaaaaaaaagcaccctctcgtatttcattttggctttttcttaacaataccttgggccatttttttccagttcactatgttggtatactaacttttcttcagccttttaatgcgaagccaactagtagagcatgctttcaggatctgacagctctgctagtagagcgagtatttattaatacagaattaaccttcgcccctttaaagtcaagtctgtctaatctaactagcgcctcgctttgccttctcacaatgctcactagccatcatgctcacccttctcttccagatccacttcctcatgatactgtcttctaactgggcttacttaaaggatgcgagcaaaatgcaggcttaccaggatatcaaagcaaaggaagaacaggaactgcaagatatccagtctcggtcaaaagaacaactcaattcttacacataaatgtttgccagagtgtttcggccgacgtatttacagctctgacaaatcatcagacagctgctctgcagtacagatgtgtatcccaccaaactaatgtagatgtacaaacacttcactgtctgtctcaagctgctgggatgtatctctaggaaaaccttccagtgggtaaatctttttctttagaacaaatattggaggtttcatgttagccattttaaaaggcaacactttgacaaaatgatcgttcatactttgggaatttgtggcatgttcacatttattgctagggcaattctaccaagacactcaatggaatatgtcacactccttaatagggacctgtgactccttaataaggacctgtgacatgcccagcatcaagggataagaccgtaaattcacatatatgccatctgtcctcaagtgttatctacataggaaataaaatggaattgatgtaaagttccatttctgacagctgacatttattaaactttggatcaaagataatgtgattcttatgattgatttctcaaactagcttttccctcccaagtccaggacccattaatttcctgagccaatcagaaatatatttttcaataatgctaaaattagctacaattctgctgaccctactattaaagaatctggatgctggactcactgacaagctttccagaagcaattttataacagatttcattttaacaaaatactgatccaattttcattattcttgagaaatgtcagctttgccttaatgagtatttgctttaaatttctaagaatttatatcataactagagacccaaatatctttcacagaattttgttccataaatgtttttcttaattattaagaagtgttaccttattaaaatgaccaccattctaaaccatttttcagtggtctggatacgaagtttacagtttcataccaactatctaaaacctaattgcaaattgaccacagacctctaacctcctacttttatagacttgaatacttaagtaatttaaattagggttggtatttcatttttttcttatctaaatcttagtttcctggaataataaagtttgatgttcagcaagagaactgcttgagtttaagccattttcaaaagaaacttgccttttacattattgtgttccagaacattaagtgactgtaggtactgggtattagtgatggtaaactttgtgttgctctttatgaaatgatccatataactgttgggtgcatcagtgcttttcaaaggggctgcttactatagggttaactatgtatattcattgttaagagttaacttgtggtttggctgtttcctggattttataacatacatgtgcagaaatgtattcaaatgaaaggaagcatacctttatcaagatgctattaaaattgaacatcaagtataatatttcatttggattctcttttttggttaatgcctaaaaatgcctatttgggattttttttttttttaaattaagagaagctctcttctgtgtagaacagttgttccaaaatagcttagtgttttgttttcctgttgcatgacagatttaactattctttccagcagtggaggtgctgtcagagtccagtgttctagaagaggcagtgtctaaagcctaattttacttttctaattctggtagctattaccaggaatttttgaaagttttgtttaagtagtctaatattttttatgtaaagagcattaaattttgctatgtataaatttttgtaacctaacagtgaatcaatattttctatcagtgccaagggcttcctgtagttctattcaagtgttacaataaatatttgtagataatagtcaa

SEQ ID NO: 314971 - DNA, 4372 bp, Homo sapiens
cgcgcccttccgagggtcccgcccctcccccgctcaggtggcgcctcctcggccacctctgcgacgaagccgggacgctggaggtgggaggggcgcggcgcaggtgtccggaacgcccaggctgctttgaatgctgcatcaagtgtctgggaggagtcccctacgcctccctggtggccaccatcctctgcttctccggggtggccttattctgcggctgtgggcatgtggctctcgcaggcaccgtggcgattcttgagcaacacttctccaccaacgccagtgaccatgccttgctgagcgaggtgatacaactgatgcagtatgtcatctatggaattgcgtcctttttcttcttgtatgggatcattctgttggcagaaggcttttacaccacaagtgcagtgaaagaactgcacggtgagtttaaaacaaccgcttgtggccgatgcatcagtggaatgttcgttttcctcacctatgtgcttggagtggcctggctgggtgtgtttggtttctcagcggtgcccgtgtttatgttctacaacatatggtcaacttgtgaagtcatcaagtcaccgcagaccaacgggaccacgggtgtggagcagatctgtgtggatatccgacaatacggtatcattccttggaatgctttccccggaaaaatatgtggctctgccctggagaacatctgcaacacaaacgagttctacatgtcctatcacctgttcattgtggcctgtgcaggagctggtgccaccgtcattgccctgctgatctacatgatggctactacatataactatgcggttttgaagtttaagagtcgggaagattgctgcactaaattctaaattgcataaggagttttagagagctatgctctgtagcatgaaatatcactgacactccagactaaagcagagtctaggtttctgcaattttgttacagtaatttgtaaatagctttagtaaactcaccttgcatggtagattaataagatgacttactgtacatgaattacacaataatgagatctggtggctatttccacattttgaaaaggattcagttatttactgacagtggtgagcatcctttttaaaataatgttctcatacttaaacattagagagcagtatctttaaatgaattattaacactttggaatacttacattttctgttatttttgattgcctgataaccagtttcaatgatgaaaatgaaaacaagtgctgaagatgaaatggaagagaaccgttttaatctggattttgttttgtcacacctggaaaatactttgcaaatatgttctaaattgaaaacaatttttttatgatcacatggttcactaccaaatgaccctcaaataagccagatgaaaatttgaagaaaaaggtcacccagttctctggaaaaaaaaaaaaaaaaaaaaaaaaaaaggatttatatgtgggtagttttttttttggtacaacacaatcattctgttagagcccacaaaattggtaaccttaaattgtgtgttttggtaagtaataactaactgtttcctcatagctagttctcaagctgcatgtaagattttaacgggaagagaaaataggcctggacctgaaggtctcaaatatgttgagaagaaagtatgaactataaggaacttgagatgtagatttattttgcaggaaatacgaggaaaataggaaagaagtgtttgccgcatcaagtgtaaagaatgatactgaggatttttacattttatgaaatgaaataatggcatttacaaaatgaaaaatgtagtttcacaactaagttttgttaacagagactgcatgctttgcttatagttcttaattttggttttgacattcatttaattttttccatgttaaatatgtagtttaattatttactcaaaataaacattgttcatgcttttaggcctttgggggaattgatttttatccacaggtagaaaatggtctttgcacacactacacttatttcaaatatacaatgtgctcccgaactttcgcattagtctttaaaattactctcaaaatggtattaaaaaaaaaaaaaaaagcaccctctcgtatttcattttggctttttcttaacaataccttgggccatttttttccagttcactatgttggtatactaacttttcttcagccttttaatgcgaagccaactagtagagcatgctttcaggatctgacagctctgctagtagagcgagtatttattaatacagaattaaccttcgcccctttaaagtcaagtctgtctaatctaactagcgcctcgctttgccttctcacaatgctcactagccatcatgctcacccttctcttccagatccacttcctcatgatactgtcttctaactgggcttacttaaaggatgcgagcaaaatgcaggcttaccaggatatcaaagcaaaggaagaacaggaactgcaagatatccagtctcggtcaaaagaacaactcaattcttacacataaatgtttgccagagtgtttcggccgacgtatttacagctctgacaaatcatcagacagctgctctgcagtacagatgtgtatcccaccaaactaatgtagatgtacaaacacttcactgtctgtctcaagctgctgggatgtatctctaggaaaaccttccagtgggtaaatctttttctttagaacaaatattggaggtttcatgttagccattttaaaaggcaacactttgacaaaatgatcgttcatactttgggaatttgtggcatgttcacatttattgctagggcaattctaccaagacactcaatggaatatgtcacactccttaatagggacctgtgactccttaataaggacctgtgacatgcccagcatcaagggataagaccgtaaattcacatatatgccatctgtcctcaagtgttatctacataggaaataaaatggaattgatgtaaagttccatttctgacagctgacatttattaaactttggatcaaagataatgtgattcttatgattgatttctcaaactagcttttccctcccaagtccaggacccattaatttcctgagccaatcagaaatatatttttcaataatgctaaaattagctacaattctgctgaccctactattaaagaatctggatgctggactcactgacaagctttccagaagcaattttataacagatttcattttaacaaaatactgatccaattttcattattcttgagaaatgtcagctttgccttaatgagtatttgctttaaatttctaagaatttatatcataactagagacccaaatatctttcacagaattttgttccataaatgtttttcttaattattaagaagtgttaccttattaaaatgaccaccattctaaaccatttttcagtggtctggatacgaagtttacagtttcataccaactatctaaaacctaattgcaaattgaccacagacctctaacctcctacttttatagacttgaatacttaagtaatttaaattagggttggtatttcatttttttcttatctaaatcttagtttcctggaataataaagtttgatgttcagcaagagaactgcttgagtttaagccattttcaaaagaaacttgccttttacattattgtgttccagaacattaagtgactgtaggtactgggtattagtgatggtaaactttgtgttgctctttatgaaatgatccatataactgttgggtgcatcagtgcttttcaaaggggctgcttactatagggttaactatgtatattcattgttaagagttaacttgtggtttggctgtttcctggattttataacatacatgtgcagaaatgtattcaaatgaaaggaagcatacctttatcaagatgctattaaaattgaacatcaagtataatatttcatttggattctcttttttggttaatgcctaaaaatgcctatttgggattttttttttttttaaattaagagaagctctcttctgtgtagaacagttgttccaaaatagcttagtgttttgttttcctgttgcatgacagatttaactattctttccagcagtggaggtgctgtcagagtccagtgttctagaagaggcagtgtctaaagcctaattttacttttctaattctggtagctattaccaggaatttttgaaagttttgtttaagtagtctaatattttttatgtaaagagcattaaattttgctatgtataaatttttgtaacctaacagtgaatcaatattttctatcagtgccaagggcttcctgtagttctattcaagtgttacaataaatatttgtagataatagtcaa

SEQ ID NO: 314972 - DNA, 1472 bp, Homo sapiens
gcccctctccgcgcggccggcccccagtgcaggcggagccgcgccgcgctcccaccccggccgggagctaggagccagcggccagccccgcgcagcgcagcgcagcccgcagaagcccggtcagcgcacgtgcccgcgagacctgcaaacttgtgccaccggctctgcccgtccccggggagcccgaacgccccgcagccctcacccctcccgccagtctccagccatgggctgctttgaatgctgcatcaagtgtctgggaggagtcccctacgcctccctggtggccaccatcctctgcttctccggggtggccttattctgcggctgtgggcatgtggctctcgcaggcaccgtggcgattcttgagcaacacttctccaccaacgccagtgaccatgccttgctgagcgaggtgatacaactgatgcagtatgtcatctatggaattgcgtcctttttcttcttgtatgggatcattctgttggcagaaggcttttacaccacaagtgcagtgaaagaactgcacggtgagtttaaaacaaccgcttgtggccgatgcatcagtggaatgttcgttttcctcacctatgtgcttggagtggcctggctgggtgtgtttggtttctcagcggtgcccgtgtttatgttctacaacatatggtcaacttgtgaagtcatcaagtcaccgcagaccaacgggaccacgggtgtggagcagatctgtgtggatatccgacaatacggtatcattccttggaatgctttccccggaaaaatatgtggctctgccctggagaacatctgcaacacaaacgagttctacatgtcctatcacctgttcattgtggcctgtgcaggagctggtgccaccgtcattgccctgctgatctacatgatggctactacatataactatgcggttttgaagtttaagagtcgggaagattgctgcactaaattctaaattgcataaggagttttagagagctatgctctgtagcatgaaatatcactgacactccagactaaagcagagtctaggtttctgcaattttgttacagtaatttgtaaatagctttagtaaactcaccttgcatggtagattaataagatgacttactgtacatgaattacacaataatgagatctggtggctatttccacattttgaaaaggattcagttatttactgacagtggtgagcatcctttttaaaataatgttctcatacttaaacattagagagcagtatctttaaatgaattattaacactttggaatacttacattttctgttatttttgattgcctgataaccagtttcaatgatgaaaatgaaaacaagtgctgaagatgaaatggaagagaaccgttttaatctggattttgttttgtcacacctggaaaatactttgcaatttagaacatatttgcagagtattttccaggtgtgacaaaatcgtctgac

SEQ ID NO: 314973 - DNA, 4199 bp, Homo sapiens
gcccctctccgcgcggccggcccccagtgcaggcggagccgcgccgcgctcccaccccggccgggagctaggagccagcggccagccccgcgcagcgcagcgcagcccgcagaagcccggtcagcgcacgtgcccgcgagacctgcaaacttgtgccaccggctctgcccgtccccggggagcccgaacgccccgcagccctcacccctcccgccagtctccagccatgggctgctttgaatgctgcatcaagtgtctgggaggagtcccctacgcctccctggtggccaccatcctctgcttctccggggtggccttattctgcggctgtgggcatgtggctctcgcaggcaccgtggcgattcttgagcaacaatatggtcaacttgtgaagtcatcaagtcaccgcagaccaacgggaccacgggtgtggagcagatctgtgtggatatccgacaatacggtatcattccttggaatgctttccccggaaaaatatgtggctctgccctggagaacatctgcaacacaaacgagttctacatgtcctatcacctgttcattgtggcctgtgcaggagctggtgccaccgtcattgccctgctgatctacatgatggctactacatataactatgcggttttgaagtttaagagtcgggaagattgctgcactaaattctaaattgcataaggagttttagagagctatgctctgtagcatgaaatatcactgacactccagactaaagcagagtctaggtttctgcaattttgttacagtaatttgtaaatagctttagtaaactcaccttgcatggtagattaataagatgacttactgtacatgaattacacaataatgagatctggtggctatttccacattttgaaaaggattcagttatttactgacagtggtgagcatcctttttaaaataatgttctcatacttaaacattagagagcagtatctttaaatgaattattaacactttggaatacttacattttctgttatttttgattgcctgataaccagtttcaatgatgaaaatgaaaacaagtgctgaagatgaaatggaagagaaccgttttaatctggattttgttttgtcacacctggaaaatactttgcaaatatgttctaaattgaaaacaatttttttatgatcacatggttcactaccaaatgaccctcaaataagccagatgaaaatttgaagaaaaaggtcacccagttctctggaaaaaaaaaaaaaaaaaaaaaaaaaaaggatttatatgtgggtagttttttttttggtacaacacaatcattctgttagagcccacaaaattggtaaccttaaattgtgtgttttggtaagtaataactaactgtttcctcatagctagttctcaagctgcatgtaagattttaacgggaagagaaaataggcctggacctgaaggtctcaaatatgttgagaagaaagtatgaactataaggaacttgagatgtagatttattttgcaggaaatacgaggaaaataggaaagaagtgtttgccgcatcaagtgtaaagaatgatactgaggatttttacattttatgaaatgaaataatggcatttacaaaatgaaaaatgtagtttcacaactaagttttgttaacagagactgcatgctttgcttatagttcttaattttggttttgacattcatttaattttttccatgttaaatatgtagtttaattatttactcaaaataaacattgttcatgcttttaggcctttgggggaattgatttttatccacaggtagaaaatggtctttgcacacactacacttatttcaaatatacaatgtgctcccgaactttcgcattagtctttaaaattactctcaaaatggtattaaaaaaaaaaaaaaaagcaccctctcgtatttcattttggctttttcttaacaataccttgggccatttttttccagttcactatgttggtatactaacttttcttcagccttttaatgcgaagccaactagtagagcatgctttcaggatctgacagctctgctagtagagcgagtatttattaatacagaattaaccttcgcccctttaaagtcaagtctgtctaatctaactagcgcctcgctttgccttctcacaatgctcactagccatcatgctcacccttctcttccagatccacttcctcatgatactgtcttctaactgggcttacttaaaggatgcgagcaaaatgcaggcttaccaggatatcaaagcaaaggaagaacaggaactgcaagatatccagtctcggtcaaaagaacaactcaattcttacacataaatgtttgccagagtgtttcggccgacgtatttacagctctgacaaatcatcagacagctgctctgcagtacagatgtgtatcccaccaaactaatgtagatgtacaaacacttcactgtctgtctcaagctgctgggatgtatctctaggaaaaccttccagtgggtaaatctttttctttagaacaaatattggaggtttcatgttagccattttaaaaggcaacactttgacaaaatgatcgttcatactttgggaatttgtggcatgttcacatttattgctagggcaattctaccaagacactcaatggaatatgtcacactccttaatagggacctgtgactccttaataaggacctgtgacatgcccagcatcaagggataagaccgtaaattcacatatatgccatctgtcctcaagtgttatctacataggaaataaaatggaattgatgtaaagttccatttctgacagctgacatttattaaactttggatcaaagataatgtgattcttatgattgatttctcaaactagcttttccctcccaagtccaggacccattaatttcctgagccaatcagaaatatatttttcaataatgctaaaattagctacaattctgctgaccctactattaaagaatctggatgctggactcactgacaagctttccagaagcaattttataacagatttcattttaacaaaatactgatccaattttcattattcttgagaaatgtcagctttgccttaatgagtatttgctttaaatttctaagaatttatatcataactagagacccaaatatctttcacagaattttgttccataaatgtttttcttaattattaagaagtgttaccttattaaaatgaccaccattctaaaccatttttcagtggtctggatacgaagtttacagtttcataccaactatctaaaacctaattgcaaattgaccacagacctctaacctcctacttttatagacttgaatacttaagtaatttaaattagggttggtatttcatttttttcttatctaaatcttagtttcctggaataataaagtttgatgttcagcaagagaactgcttgagtttaagccattttcaaaagaaacttgccttttacattattgtgttccagaacattaagtgactgtaggtactgggtattagtgatggtaaactttgtgttgctctttatgaaatgatccatataactgttgggtgcatcagtgcttttcaaaggggctgcttactatagggttaactatgtatattcattgttaagagttaacttgtggtttggctgtttcctggattttataacatacatgtgcagaaatgtattcaaatgaaaggaagcatacctttatcaagatgctattaaaattgaacatcaagtataatatttcatttggattctcttttttggttaatgcctaaaaatgcctatttgggattttttttttttttaaattaagagaagctctcttctgtgtagaacagttgttccaaaatagcttagtgttttgttttcctgttgcatgacagatttaactattctttccagcagtggaggtgctgtcagagtccagtgttctagaagaggcagtgtctaaagcctaattttacttttctaattctggtagctattaccaggaatttttgaaagttttgtttaagtagtctaatattttttatgtaaagagcattaaattttgctatgtataaatttttgtaacctaacagtgaatcaatattttctatcagtgccaagggcttcctgtagttctattcaagtgttacaataaatatttgtagataatagtcaa

SEQ ID NO: 314974 - DNA, 3612 bp, Homo sapiens
gacaaaggggttgcctaggcccaagaacagataagtggagcaataccaaactgggagcaagttaagaagtcgggaagattgctgcactaaattctaaattgcataaggagttttagagagctatgctctgtagcatgaaatatcactgacactccagactaaagcagagtctaggtttctgcaattttgttacagtaatttgtaaatagctttagtaaactcaccttgcatggtagattaataagatgacttactgtacatgaattacacaataatgagatctggtggctatttccacattttgaaaaggattcagttatttactgacagtggtgagcatcctttttaaaataatgttctcatacttaaacattagagagcagtatctttaaatgaattattaacactttggaatacttacattttctgttatttttgattgcctgataaccagtttcaatgatgaaaatgaaaacaagtgctgaagatgaaatggaagagaaccgttttaatctggattttgttttgtcacacctggaaaatactttgcaaatatgttctaaattgaaaacaatttttttatgatcacatggttcactaccaaatgaccctcaaataagccagatgaaaatttgaagaaaaaggtcacccagttctctggaaaaaaaaaaaaaaaaaaaaaaaaaaaggatttatatgtgggtagttttttttttggtacaacacaatcattctgttagagcccacaaaattggtaaccttaaattgtgtgttttggtaagtaataactaactgtttcctcatagctagttctcaagctgcatgtaagattttaacgggaagagaaaataggcctggacctgaaggtctcaaatatgttgagaagaaagtatgaactataaggaacttgagatgtagatttattttgcaggaaatacgaggaaaataggaaagaagtgtttgccgcatcaagtgtaaagaatgatactgaggatttttacattttatgaaatgaaataatggcatttacaaaatgaaaaatgtagtttcacaactaagttttgttaacagagactgcatgctttgcttatagttcttaattttggttttgacattcatttaattttttccatgttaaatatgtagtttaattatttactcaaaataaacattgttcatgcttttaggcctttgggggaattgatttttatccacaggtagaaaatggtctttgcacacactacacttatttcaaatatacaatgtgctcccgaactttcgcattagtctttaaaattactctcaaaatggtattaaaaaaaaaaaaaaaagcaccctctcgtatttcattttggctttttcttaacaataccttgggccatttttttccagttcactatgttggtatactaacttttcttcagccttttaatgcgaagccaactagtagagcatgctttcaggatctgacagctctgctagtagagcgagtatttattaatacagaattaaccttcgcccctttaaagtcaagtctgtctaatctaactagcgcctcgctttgccttctcacaatgctcactagccatcatgctcacccttctcttccagatccacttcctcatgatactgtcttctaactgggcttacttaaaggatgcgagcaaaatgcaggcttaccaggatatcaaagcaaaggaagaacaggaactgcaagatatccagtctcggtcaaaagaacaactcaattcttacacataaatgtttgccagagtgtttcggccgacgtatttacagctctgacaaatcatcagacagctgctctgcagtacagatgtgtatcccaccaaactaatgtagatgtacaaacacttcactgtctgtctcaagctgctgggatgtatctctaggaaaaccttccagtgggtaaatctttttctttagaacaaatattggaggtttcatgttagccattttaaaaggcaacactttgacaaaatgatcgttcatactttgggaatttgtggcatgttcacatttattgctagggcaattctaccaagacactcaatggaatatgtcacactccttaatagggacctgtgactccttaataaggacctgtgacatgcccagcatcaagggataagaccgtaaattcacatatatgccatctgtcctcaagtgttatctacataggaaataaaatggaattgatgtaaagttccatttctgacagctgacatttattaaactttggatcaaagataatgtgattcttatgattgatttctcaaactagcttttccctcccaagtccaggacccattaatttcctgagccaatcagaaatatatttttcaataatgctaaaattagctacaattctgctgaccctactattaaagaatctggatgctggactcactgacaagctttccagaagcaattttataacagatttcattttaacaaaatactgatccaattttcattattcttgagaaatgtcagctttgccttaatgagtatttgctttaaatttctaagaatttatatcataactagagacccaaatatctttcacagaattttgttccataaatgtttttcttaattattaagaagtgttaccttattaaaatgaccaccattctaaaccatttttcagtggtctggatacgaagtttacagtttcataccaactatctaaaacctaattgcaaattgaccacagacctctaacctcctacttttatagacttgaatacttaagtaatttaaattagggttggtatttcatttttttcttatctaaatcttagtttcctggaataataaagtttgatgttcagcaagagaactgcttgagtttaagccattttcaaaagaaacttgccttttacattattgtgttccagaacattaagtgactgtaggtactgggtattagtgatggtaaactttgtgttgctctttatgaaatgatccatataactgttgggtgcatcagtgcttttcaaaggggctgcttactatagggttaactatgtatattcattgttaagagttaacttgtggtttggctgtttcctggattttataacatacatgtgcagaaatgtattcaaatgaaaggaagcatacctttatcaagatgctattaaaattgaacatcaagtataatatttcatttggattctcttttttggttaatgcctaaaaatgcctatttgggattttttttttttttaaattaagagaagctctcttctgtgtagaacagttgttccaaaatagcttagtgttttgttttcctgttgcatgacagatttaactattctttccagcagtggaggtgctgtcagagtccagtgttctagaagaggcagtgtctaaagcctaattttacttttctaattctggtagctattaccaggaatttttgaaagttttgtttaagtagtctaatattttttatgtaaagagcattaaattttgctatgtataaatttttgtaacctaacagtgaatcaatattttctatcagtgccaagggcttcctgtagttctattcaagtgttacaataaatatttgtagataatagtcaa

SEQ ID NO: 314975 - DNA, 1149 bp, Homo sapiens
gcccctctccgcgcggccggcccccagtgcaggcggagccgcgccgcgctcccaccccggccgggagctaggagccagcggccagccccgcgcagcgcagcgcagcccgcagaagcccggtcagcgcacgtgcccgcgagacctgcaaacttgtgccaccggctctgcccgtccccggggagcccgaacgccccgcagccctcacccctcccgccagtctccagccatgggctgctttgaatgctgcatcaagtgtctgggaggagtcccctacgcctccctggtggccaccatcctctgcttctccggggtggccttattctgcggctgtgggcatgtggctctcgcaggcaccgtggcgattcttgagcaacacttctccaccaacgccagtgaccatgccttgctgagcgaggtgatacaactgatgcagtatgtcatctatggaattgcgtcctttttcttcttgtatgggatcattctgttggcagaaggcttttacaccacaagtgcagtgaaagaactgcacggtgagtttaaaacaaccgcttgtggccgatgcatcagtggaatgttcgttttcctcacctatgtgcttggagtggcctggctgggtgtgtttggtttctcagcggtgcccgtgtttatgttctacaacatatggtcaacttgtgaagtcatcaagtcaccgcagaccaacgggaccacgggtgtggagcagatctgtgtggatatccgacaatacggtatcattccttggaatgctttccccggaaaaatatgtggctctgccctggagaacatctgcaacacaaacgagttctacatgtcctatcacctgttcattgtggcctgtgcaggagctggtgccaccgtcattgccctgatccactttcctcattgatacctggacttctaaactggggcttaacttacagggatgcgaagccaaaatgcaaggcttacccccgatattcaagccaagggacagaacacggaaactgccaggatattcccagtctcgggtcaaagagaaccacagtccacatgtttacaccataaatgttatggcccgagatgttcggacgacacaattaaccagtctgaccaagtcttcaacaagtgagccgggataccatggtgttccac

SEQ ID NO: 314976 - DNA, 1427 bp, Homo sapiens
agcggggctagaagaaatgaggtggggagaaagagagagagagagagagatcgagattgagatcttaagaaagagagcaaggaggaagagcccggtggggagcaggtccttctcccccacccccctacccccaactcccactggagccgcattgagactgtaggcaccaccgggcgccgaatggctgttttctaactgggatcctcggtgacgtatggctgcctgccccttggcagctgtctttatggaccagtaggcagagcgaaattgacgctgacaagacttttgcatcttggaagggactgtaatctactgtagtgaagaacagagcctctcaatcagacgggtgtaaataagagacggaggggagtccagaagaaaaggaagaggaggaaaaacaagtgtgtgttggggggaacagggggaaaagcatttttggtggatggtatgaagccagccatggaaactgcagccgaggaaaatactgaacaaagccaagagagaaaaggctgctttgaatgctgcatcaagtgtctgggaggagtcccctacgcctccctggtggccaccatcctctgcttctccggggtggccttattctgcggctgtgggcatgtggctctcgcaggcaccgtggcgattcttgagcaacacttctccaccaacgccagtgaccatgccttgctgagcgaggtgatacaactgatgcagtatgtcatctatggaattgcgtcctttttcttcttgtatgggatcattctgttggcagaaggcttttacaccacaagtgcagtgaaagaactgcacggtgagtttaaaacaaccgcttgtggccgatgcatcagtggaatgttcgttttcctcacctatgtgcttggagtggcctggctgggtgtgtttggtttctcagcggtgcccgtgtttatgttctacaacatatggtcaacttgtgaagtcatcaagtcaccgcagaccaacgggaccacgggtgtggagcagatctgtgtggatatccgacaatacggtatcattccttggaatgctttccccggaaaaatatgtggctctgccctggagaacatctgcaacacaaacgagttctacatgtcctatcacctgttcattgtggcctgtgcaggagctggtgccaccgtcattgccctgatccactttcctcattgatacctggacttctaaactggggcttaacttacagggatgcgaagccaaaatgcaaggcttacccccgatattcaagccaagggacagaacacggaaactgccaggatattcccagtctcgggtcaaagagaaccacagtccacatgtttacaccataaatgttatggcccgagatgttcggacgacacaattaaccagtctgaccaagtcttcaacaagtgagccgggataccatggtgttccac

SEQ ID NO: 314977 - DNA, 799 bp, Homo sapiens
cgcgcccttccgagggtcccgcccctcccccgctcaggtggcgcctcctcggccacctctgcgacgaagccgggacgctggaggtgggaggggcgcggcgcaggtgtccggaacgcccaggctgctttgaatgctgcatcaagtgtctgggaggagtcccctacgcctccctggtggccaccatcctctgcttctccggggtggccttattctgcggctgtgggcatgtggctctcgcaggcaccgtggcgattcttgagcaacacttctccaccaacgccagtgaccatgccttgctgagcgaggtgatacaactgatgcagtatgtcatctatggaattgcgtcctttttcttcttgtatgggatcattctgttggcagaaggcttttacaccacaagtgcagtgaaagaactgcacggtgagtttaaaacaaccgcttgtggccgatgcatcagtggaatgttcgttttcctcacctatgtgcttggagtggcctggctgggtgtgtttggtttctcagcggtgcccgtgtttatgttctacaacatatggtcaacttgtgaagtcatcaagtcaccgcagaccaacgggaccacgggtgtggagcagatctgtgtggatatccgacaatacggtatcattccttggaatgctttccccggaaaaatatgtggctctgccctggagaacatctgcaacacaaacgagttctacatgtcctatcacctgttcattgtggcctgtgcaggagctggtgccaccgtcattgccctggtgagtaatggccccaagaccac

SEQ ID NO: 314978 - DNA, 4589 bp, Homo sapiens
gcccctctccgcgcggccggcccccagtgcaggcggagccgcgccgcgctcccaccccggccgggagctaggagccagcggccagccccgcgcagcgcagcgcagcccgcagaagcccggtcagcgcacgtgcccgcgagacctgcaaacttgtgccaccggctctgcccgtccccggggagcccgaacgccccgcagccctcacccctcccgccagtctccagccatgggctgctttgaatgctgcatcaagtgtctgggaggagtcccctacgcctccctggtggccaccatcctctgcttctccggggtggccttattctgcggctgtgggcatgtggctctcgcaggcaccgtggcgattcttgagcaacacttctccaccaacgccagtgaccatgccttgctgagcgaggtgatacaactgatgcagtatgtcatctatggaattgcgtcctttttcttcttgtatgggatcattctgttggcagaaggcttttacaccacaagtgcagtgaaagaactgcacggtgagtttaaaacaaccgcttgtggccgatgcatcagtggaatgttcgttttcctcacctatgtgcttggagtggcctggctgggtgtgtttggtttctcagcggtgcccgtgtttatgttctacaacatatggtcaacttgtgaagtcatcaagtcaccgcagaccaacgggaccacgggtgtggagcagatctgtgtggatatccgacaatacggtatcattccttggaatgctttccccggaaaaatatgtggctctgccctggagaacatctgcaacacaaacgagttctacatgtcctatcacctgttcattgtggcctgtgcaggagctggtgccaccgtcattgccctgctgatctacatgatggctactacatataactatgcggttttgaagtttaagagtcgggaagattgctgcactaaattctaaattgcataaggagttttagagagctatgctctgtagcatgaaatatcactgacactccagactaaagcagagtctaggtttctgcaattttgttacagtaatttgtaaatagctttagtaaactcaccttgcatggtagattaataagatgacttactgtacatgaattacacaataatgagatctggtggctatttccacattttgaaaaggattcagttatttactgacagtggtgagcatcctttttaaaataatgttctcatacttaaacattagagagcagtatctttaaatgaattattaacactttggaatacttacattttctgttatttttgattgcctgataaccagtttcaatgatgaaaatgaaaacaagtgctgaagatgaaatggaagagaaccgttttaatctggattttgttttgtcacacctggaaaatactttgcaaatatgttctaaattgaaaacaatttttttatgatcacatggttcactaccaaatgaccctcaaataagccagatgaaaatttgaagaaaaaggtcacccagttctctggaaaaaaaaaaaaaaaaaaaaaaaaaaaggatttatatgtgggtagttttttttttggtacaacacaatcattctgttagagcccacaaaattggtaaccttaaattgtgtgttttggtaagtaataactaactgtttcctcatagctagttctcaagctgcatgtaagattttaacgggaagagaaaataggcctggacctgaaggtctcaaatatgttgagaagaaagtatgaactataaggaacttgagatgtagatttattttgcaggaaatacgaggaaaataggaaagaagtgtttgccgcatcaagtgtaaagaatgatactgaggatttttacattttatgaaatgaaataatggcatttacaaaatgaaaaatgtagtttcacaactaagttttgttaacagagactgcatgctttgcttatagttcttaattttggttttgacattcatttaattttttccatgttaaatatgtagtttaattatttactcaaaataaacattgttcatgcttttaggcctttgggggaattgatttttatccacaggtagaaaatggtctttgcacacactacacttatttcaaatatacaatgtgctcccgaactttcgcattagtctttaaaattactctcaaaatggtattaaaaaaaaaaaaaaaagcaccctctcgtatttcattttggctttttcttaacaataccttgggccatttttttccagttcactatgttggtatactaacttttcttcagccttttaatgcgaagccaactagtagagcatgctttcaggatctgacagctctgctagtagagcgagtatttattaatacagaattaaccttcgcccctttaaagtcaagtctgtctaatctaactagcgcctcgctttgccttctcacaatgctcactagccatcatgctcacccttctcttccagatccacttcctcatgatactgtcttctaactgggcttacttaaaggatgcgagcaaaatgcaggcttaccaggatatcaaagcaaaggaagaacaggaactgcaagatatccagtctcggtcaaaagaacaactcaattcttacacataaatgtttgccagagtgtttcggccgacgtatttacagctctgacaaatcatcagacagctgctctgcagtacagatgtgtatcccaccaaactaatgtagatgtacaaacacttcactgtctgtctcaagctgctgggatgtatctctaggaaaaccttccagtgggtaaatctttttctttagaacaaatattggaggtttcatgttagccattttaaaaggcaacactttgacaaaatgatcgttcatactttgggaatttgtggcatgttcacatttattgctagggcaattctaccaagacactcaatggaatatgtcacactccttaatagggacctgtgactccttaataaggacctgtgacatgcccagcatcaagggataagaccgtaaattcacatatatgccatctgtcctcaagtgttatctacataggaaataaaatggaattgatgtaaagttccatttctgacagctgacatttattaaactttggatcaaagataatgtgattcttatgattgatttctcaaactagcttttccctcccaagtccaggacccattaatttcctgagccaatcagaaatatatttttcaataatgctaaaattagctacaattctgctgaccctactattaaagaatctggatgctggactcactgacaagctttccagaagcaattttataacagatttcattttaacaaaatactgatccaattttcattattcttgagaaatgtcagctttgccttaatgagtatttgctttaaatttctaagaatttatatcataactagagacccaaatatctttcacagaattttgttccataaatgtttttcttaattattaagaagtgttaccttattaaaatgaccaccattctaaaccatttttcagtggtctggatacgaagtttacagtttcataccaactatctaaaacctaattgcaaattgaccacagacctctaacctcctacttttatagacttgaatacttaagtaatttaaattagggttggtatttcatttttttcttatctaaatcttagtttcctggaataataaagtttgatgttcagcaagagaactgcttgagtttaagccattttcaaaagaaacttgccttttacattattgtgttccagaacattaagtgactgtaggtactgggtattagtgatggtaaactttgtgttgctctttatgaaatgatccatataactgttgggtgcatcagtgcttttcaaaggggctgcttactatagggttaactatgtatattcattgttaagagttaacttgtggtttggctgtttcctggattttataacatacatgtgcagaaatgtattcaaatgaaaggaagcatacctttatcaagatgctattaaaattgaacatcaagtataatatttcatttggattctcttttttggttaatgcctaaaaatgcctatttgggattttttttttttttaaattaagagaagctctcttctgtgtagaacagttgttccaaaatagcttagtgttttgttttcctgttgcatgacagatttaactattctttccagcagtggaggtgctgtcagagtccagtgttctagaagaggcagtgtctaaagcctaattttacttttctaattctggtagctattaccaggaatttttgaaagttttgtttaagtagtctaatattttttatgtaaagagcattaaattttgctatgtataaatttttgtaacctaacagtgaatcaatattttctatcagtgccaagggcttcctgtagttctattcaagtgttacaataaatatttgtagataatagtcaatacttgtgtatgcttattttaaagatctatttaggtggaaatagttgtggatgtactaagagtaatgaaataaaattatagcttcattcacttgcctttttaccata

SEQ ID NO: 314979 - DNA, 4760 bp, Homo sapiens
agcggggctagaagaaatgaggtggggagaaagagagagagagagagagatcgagattgagatcttaagaaagagagcaaggaggaagagcccggtggggagcaggtccttctcccccacccccctacccccaactcccactggagccgcattgagactgtaggcaccaccgggcgccgaatggctgttttctaactgggatcctcggtgacgtatggctgcctgccccttggcagctgtctttatggaccagtaggcagagcgaaattgacgctgacaagacttttgcatcttggaagggactgtaatctactgtagtgaagaacagagcctctcaatcagacgggtgtaaataagagacggaggggagtccagaagaaaaggaagaggaggaaaaacaagtgtgtgttggggggaacagggggaaaagcatttttggtggatggtatgaagccagccatggaaactgcagccgaggaaaatactgaacaaagccaagagagaaaaggctgctttgaatgctgcatcaagtgtctgggaggagtcccctacgcctccctggtggccaccatcctctgcttctccggggtggccttattctgcggctgtgggcatgtggctctcgcaggcaccgtggcgattcttgagcaacacttctccaccaacgccagtgaccatgccttgctgagcgaggtgatacaactgatgcagtatgtcatctatggaattgcgtcctttttcttcttgtatgggatcattctgttggcagaaggcttttacaccacaagtgcagtgaaagaactgcacggtgagtttaaaacaaccgcttgtggccgatgcatcagtggaatgttcgttttcctcacctatgtgcttggagtggcctggctgggtgtgtttggtttctcagcggtgcccgtgtttatgttctacaacatatggtcaacttgtgaagtcatcaagtcaccgcagaccaacgggaccacgggtgtggagcagatctgtgtggatatccgacaatacggtatcattccttggaatgctttccccggaaaaatatgtggctctgccctggagaacatctgcaacacaaacgagttctacatgtcctatcacctgttcattgtggcctgtgcaggagctggtgccaccgtcattgccctgctgatctacatgatggctactacatataactatgcggttttgaagtttaagagtcgggaagattgctgcactaaattctaaattgcataaggagttttagagagctatgctctgtagcatgaaatatcactgacactccagactaaagcagagtctaggtttctgcaattttgttacagtaatttgtaaatagctttagtaaactcaccttgcatggtagattaataagatgacttactgtacatgaattacacaataatgagatctggtggctatttccacattttgaaaaggattcagttatttactgacagtggtgagcatcctttttaaaataatgttctcatacttaaacattagagagcagtatctttaaatgaattattaacactttggaatacttacattttctgttatttttgattgcctgataaccagtttcaatgatgaaaatgaaaacaagtgctgaagatgaaatggaagagaaccgttttaatctggattttgttttgtcacacctggaaaatactttgcaaatatgttctaaattgaaaacaatttttttatgatcacatggttcactaccaaatgaccctcaaataagccagatgaaaatttgaagaaaaaggtcacccagttctctggaaaaaaaaaaaaaaaaaaaaaaaaaaaggatttatatgtgggtagttttttttttggtacaacacaatcattctgttagagcccacaaaattggtaaccttaaattgtgtgttttggtaagtaataactaactgtttcctcatagctagttctcaagctgcatgtaagattttaacgggaagagaaaataggcctggacctgaaggtctcaaatatgttgagaagaaagtatgaactataaggaacttgagatgtagatttattttgcaggaaatacgaggaaaataggaaagaagtgtttgccgcatcaagtgtaaagaatgatactgaggatttttacattttatgaaatgaaataatggcatttacaaaatgaaaaatgtagtttcacaactaagttttgttaacagagactgcatgctttgcttatagttcttaattttggttttgacattcatttaattttttccatgttaaatatgtagtttaattatttactcaaaataaacattgttcatgcttttaggcctttgggggaattgatttttatccacaggtagaaaatggtctttgcacacactacacttatttcaaatatacaatgtgctcccgaactttcgcattagtctttaaaattactctcaaaatggtattaaaaaaaaaaaaaaaagcaccctctcgtatttcattttggctttttcttaacaataccttgggccatttttttccagttcactatgttggtatactaacttttcttcagccttttaatgcgaagccaactagtagagcatgctttcaggatctgacagctctgctagtagagcgagtatttattaatacagaattaaccttcgcccctttaaagtcaagtctgtctaatctaactagcgcctcgctttgccttctcacaatgctcactagccatcatgctcacccttctcttccagatccacttcctcatgatactgtcttctaactgggcttacttaaaggatgcgagcaaaatgcaggcttaccaggatatcaaagcaaaggaagaacaggaactgcaagatatccagtctcggtcaaaagaacaactcaattcttacacataaatgtttgccagagtgtttcggccgacgtatttacagctctgacaaatcatcagacagctgctctgcagtacagatgtgtatcccaccaaactaatgtagatgtacaaacacttcactgtctgtctcaagctgctgggatgtatctctaggaaaaccttccagtgggtaaatctttttctttagaacaaatattggaggtttcatgttagccattttaaaaggcaacactttgacaaaatgatcgttcatactttgggaatttgtggcatgttcacatttattgctagggcaattctaccaagacactcaatggaatatgtcacactccttaatagggacctgtgactccttaataaggacctgtgacatgcccagcatcaagggataagaccgtaaattcacatatatgccatctgtcctcaagtgttatctacataggaaataaaatggaattgatgtaaagttccatttctgacagctgacatttattaaactttggatcaaagataatgtgattcttatgattgatttctcaaactagcttttccctcccaagtccaggacccattaatttcctgagccaatcagaaatatatttttcaataatgctaaaattagctacaattctgctgaccctactattaaagaatctggatgctggactcactgacaagctttccagaagcaattttataacagatttcattttaacaaaatactgatccaattttcattattcttgagaaatgtcagctttgccttaatgagtatttgctttaaatttctaagaatttatatcataactagagacccaaatatctttcacagaattttgttccataaatgtttttcttaattattaagaagtgttaccttattaaaatgaccaccattctaaaccatttttcagtggtctggatacgaagtttacagtttcataccaactatctaaaacctaattgcaaattgaccacagacctctaacctcctacttttatagacttgaatacttaagtaatttaaattagggttggtatttcatttttttcttatctaaatcttagtttcctggaataataaagtttgatgttcagcaagagaactgcttgagtttaagccattttcaaaagaaacttgccttttacattattgtgttccagaacattaagtgactgtaggtactgggtattagtgatggtaaactttgtgttgctctttatgaaatgatccatataactgttgggtgcatcagtgcttttcaaaggggctgcttactatagggttaactatgtatattcattgttaagagttaacttgtggtttggctgtttcctggattttataacatacatgtgcagaaatgtattcaaatgaaaggaagcatacctttatcaagatgctattaaaattgaacatcaagtataatatttcatttggattctcttttttggttaatgcctaaaaatgcctatttgggattttttttttttttaaattaagagaagctctcttctgtgtagaacagttgttccaaaatagcttagtgttttgttttcctgttgcatgacagatttaactattctttccagcagtggaggtgctgtcagagtccagtgttctagaagaggcagtgtctaaagcctaattttacttttctaattctggtagctattaccaggaatttttgaaagttttgtttaagtagtctaatattttttatgtaaagagcattaaattttgctatgtataaatttttgtaacctaacagtgaatcaatattttctatcagtgccaagggcttcctgtagttctattcaagtgttacaataaatatttgtagataatagtcaa

SEQ ID NO: 314980 - DNA, 4567 bp, Homo sapiens
taaaaagcaaaagaattccggggtagttatgggaaagaacctagagagcaagaagaaaagaggaatggtgcccgaatctgggagagatagacttcaggatggccagtcattgaatgggggataggtgaagaacagagcctctcaatcagacgggtgtaaataagagacggaggggagtccagaagaaaaggaagaggaggaaaaacaagtgtgtgttggggggaacagggggaaaagcatttttggtggatggtatgaagccagccatggaaactgcagccgaggaaaatactgaacaaagccaagagagaaaaggctgctttgaatgctgcatcaagtgtctgggaggagtcccctacgcctccctggtggccaccatcctctgcttctccggggtggccttattctgcggctgtgggcatgtggctctcgcaggcaccgtggcgattcttgagcaacacttctccaccaacgccagtgaccatgccttgctgagcgaggtgatacaactgatgcagtatgtcatctatggaattgcgtcctttttcttcttgtatgggatcattctgttggcagaaggcttttacaccacaagtgcagtgaaagaactgcacggtgagtttaaaacaaccgcttgtggccgatgcatcagtggaatgttcgttttcctcacctatgtgcttggagtggcctggctgggtgtgtttggtttctcagcggtgcccgtgtttatgttctacaacatatggtcaacttgtgaagtcatcaagtcaccgcagaccaacgggaccacgggtgtggagcagatctgtgtggatatccgacaatacggtatcattccttggaatgctttccccggaaaaatatgtggctctgccctggagaacatctgcaacacaaacgagttctacatgtcctatcacctgttcattgtggcctgtgcaggagctggtgccaccgtcattgccctgctgatctacatgatggctactacatataactatgcggttttgaagtttaagagtcgggaagattgctgcactaaattctaaattgcataaggagttttagagagctatgctctgtagcatgaaatatcactgacactccagactaaagcagagtctaggtttctgcaattttgttacagtaatttgtaaatagctttagtaaactcaccttgcatggtagattaataagatgacttactgtacatgaattacacaataatgagatctggtggctatttccacattttgaaaaggattcagttatttactgacagtggtgagcatcctttttaaaataatgttctcatacttaaacattagagagcagtatctttaaatgaattattaacactttggaatacttacattttctgttatttttgattgcctgataaccagtttcaatgatgaaaatgaaaacaagtgctgaagatgaaatggaagagaaccgttttaatctggattttgttttgtcacacctggaaaatactttgcaaatatgttctaaattgaaaacaatttttttatgatcacatggttcactaccaaatgaccctcaaataagccagatgaaaatttgaagaaaaaggtcacccagttctctggaaaaaaaaaaaaaaaaaaaaaaaaaaaggatttatatgtgggtagttttttttttggtacaacacaatcattctgttagagcccacaaaattggtaaccttaaattgtgtgttttggtaagtaataactaactgtttcctcatagctagttctcaagctgcatgtaagattttaacgggaagagaaaataggcctggacctgaaggtctcaaatatgttgagaagaaagtatgaactataaggaacttgagatgtagatttattttgcaggaaatacgaggaaaataggaaagaagtgtttgccgcatcaagtgtaaagaatgatactgaggatttttacattttatgaaatgaaataatggcatttacaaaatgaaaaatgtagtttcacaactaagttttgttaacagagactgcatgctttgcttatagttcttaattttggttttgacattcatttaattttttccatgttaaatatgtagtttaattatttactcaaaataaacattgttcatgcttttaggcctttgggggaattgatttttatccacaggtagaaaatggtctttgcacacactacacttatttcaaatatacaatgtgctcccgaactttcgcattagtctttaaaattactctcaaaatggtattaaaaaaaaaaaaaaaagcaccctctcgtatttcattttggctttttcttaacaataccttgggccatttttttccagttcactatgttggtatactaacttttcttcagccttttaatgcgaagccaactagtagagcatgctttcaggatctgacagctctgctagtagagcgagtatttattaatacagaattaaccttcgcccctttaaagtcaagtctgtctaatctaactagcgcctcgctttgccttctcacaatgctcactagccatcatgctcacccttctcttccagatccacttcctcatgatactgtcttctaactgggcttacttaaaggatgcgagcaaaatgcaggcttaccaggatatcaaagcaaaggaagaacaggaactgcaagatatccagtctcggtcaaaagaacaactcaattcttacacataaatgtttgccagagtgtttcggccgacgtatttacagctctgacaaatcatcagacagctgctctgcagtacagatgtgtatcccaccaaactaatgtagatgtacaaacacttcactgtctgtctcaagctgctgggatgtatctctaggaaaaccttccagtgggtaaatctttttctttagaacaaatattggaggtttcatgttagccattttaaaaggcaacactttgacaaaatgatcgttcatactttgggaatttgtggcatgttcacatttattgctagggcaattctaccaagacactcaatggaatatgtcacactccttaatagggacctgtgactccttaataaggacctgtgacatgcccagcatcaagggataagaccgtaaattcacatatatgccatctgtcctcaagtgttatctacataggaaataaaatggaattgatgtaaagttccatttctgacagctgacatttattaaactttggatcaaagataatgtgattcttatgattgatttctcaaactagcttttccctcccaagtccaggacccattaatttcctgagccaatcagaaatatatttttcaataatgctaaaattagctacaattctgctgaccctactattaaagaatctggatgctggactcactgacaagctttccagaagcaattttataacagatttcattttaacaaaatactgatccaattttcattattcttgagaaatgtcagctttgccttaatgagtatttgctttaaatttctaagaatttatatcataactagagacccaaatatctttcacagaattttgttccataaatgtttttcttaattattaagaagtgttaccttattaaaatgaccaccattctaaaccatttttcagtggtctggatacgaagtttacagtttcataccaactatctaaaacctaattgcaaattgaccacagacctctaacctcctacttttatagacttgaatacttaagtaatttaaattagggttggtatttcatttttttcttatctaaatcttagtttcctggaataataaagtttgatgttcagcaagagaactgcttgagtttaagccattttcaaaagaaacttgccttttacattattgtgttccagaacattaagtgactgtaggtactgggtattagtgatggtaaactttgtgttgctctttatgaaatgatccatataactgttgggtgcatcagtgcttttcaaaggggctgcttactatagggttaactatgtatattcattgttaagagttaacttgtggtttggctgtttcctggattttataacatacatgtgcagaaatgtattcaaatgaaaggaagcatacctttatcaagatgctattaaaattgaacatcaagtataatatttcatttggattctcttttttggttaatgcctaaaaatgcctatttgggattttttttttttttaaattaagagaagctctcttctgtgtagaacagttgttccaaaatagcttagtgttttgttttcctgttgcatgacagatttaactattctttccagcagtggaggtgctgtcagagtccagtgttctagaagaggcagtgtctaaagcctaattttacttttctaattctggtagctattaccaggaatttttgaaagttttgtttaagtagtctaatattttttatgtaaagagcattaaattttgctatgtataaatttttgtaacctaacagtgaatcaatattttctatcagtgccaagggcttcctgtagttctattcaagtgttacaataaatatttgtagataatagtcaa

SEQ ID NO: 314981 - DNA, 4602 bp, Homo sapiens
gcccctctccgcgcggccggcccccagtgcaggcggagccgcgccgcgctcccaccccggccgggagctaggagccagcggccagccccgcgcagcgcagcgcagcccgcagaagcccggtcagcgcacgtgcccgcgagacctgcaaacttgtgccaccggctctgcccgtccccggggagcccgaacgccccgcagccctcacccctcccgccagtctccagccatggtgaacagcagagctgaaatggaaattggcaggtaccactggatgtacccaggctcaaagaaccaccagtaccatcccgtgccaaccctgggggacagggctagccccttgagcagtccaggctgctttgaatgctgcatcaagtgtctgggaggagtcccctacgcctccctggtggccaccatcctctgcttctccggggtggccttattctgcggctgtgggcatgtggctctcgcaggcaccgtggcgattcttgagcaacacttctccaccaacgccagtgaccatgccttgctgagcgaggtgatacaactgatgcagtatgtcatctatggaattgcgtcctttttcttcttgtatgggatcattctgttggcagaaggcttttacaccacaagtgcagtgaaagaactgcacggtgagtttaaaacaaccgcttgtggccgatgcatcagtggaatgttcgttttcctcacctatgtgcttggagtggcctggctgggtgtgtttggtttctcagcggtgcccgtgtttatgttctacaacatatggtcaacttgtgaagtcatcaagtcaccgcagaccaacgggaccacgggtgtggagcagatctgtgtggatatccgacaatacggtatcattccttggaatgctttccccggaaaaatatgtggctctgccctggagaacatctgcaacacaaacgagttctacatgtcctatcacctgttcattgtggcctgtgcaggagctggtgccaccgtcattgccctgctgatctacatgatggctactacatataactatgcggttttgaagtttaagagtcgggaagattgctgcactaaattctaaattgcataaggagttttagagagctatgctctgtagcatgaaatatcactgacactccagactaaagcagagtctaggtttctgcaattttgttacagtaatttgtaaatagctttagtaaactcaccttgcatggtagattaataagatgacttactgtacatgaattacacaataatgagatctggtggctatttccacattttgaaaaggattcagttatttactgacagtggtgagcatcctttttaaaataatgttctcatacttaaacattagagagcagtatctttaaatgaattattaacactttggaatacttacattttctgttatttttgattgcctgataaccagtttcaatgatgaaaatgaaaacaagtgctgaagatgaaatggaagagaaccgttttaatctggattttgttttgtcacacctggaaaatactttgcaaatatgttctaaattgaaaacaatttttttatgatcacatggttcactaccaaatgaccctcaaataagccagatgaaaatttgaagaaaaaggtcacccagttctctggaaaaaaaaaaaaaaaaaaaaaaaaaaaggatttatatgtgggtagttttttttttggtacaacacaatcattctgttagagcccacaaaattggtaaccttaaattgtgtgttttggtaagtaataactaactgtttcctcatagctagttctcaagctgcatgtaagattttaacgggaagagaaaataggcctggacctgaaggtctcaaatatgttgagaagaaagtatgaactataaggaacttgagatgtagatttattttgcaggaaatacgaggaaaataggaaagaagtgtttgccgcatcaagtgtaaagaatgatactgaggatttttacattttatgaaatgaaataatggcatttacaaaatgaaaaatgtagtttcacaactaagttttgttaacagagactgcatgctttgcttatagttcttaattttggttttgacattcatttaattttttccatgttaaatatgtagtttaattatttactcaaaataaacattgttcatgcttttaggcctttgggggaattgatttttatccacaggtagaaaatggtctttgcacacactacacttatttcaaatatacaatgtgctcccgaactttcgcattagtctttaaaattactctcaaaatggtattaaaaaaaaaaaaaaaagcaccctctcgtatttcattttggctttttcttaacaataccttgggccatttttttccagttcactatgttggtatactaacttttcttcagccttttaatgcgaagccaactagtagagcatgctttcaggatctgacagctctgctagtagagcgagtatttattaatacagaattaaccttcgcccctttaaagtcaagtctgtctaatctaactagcgcctcgctttgccttctcacaatgctcactagccatcatgctcacccttctcttccagatccacttcctcatgatactgtcttctaactgggcttacttaaaggatgcgagcaaaatgcaggcttaccaggatatcaaagcaaaggaagaacaggaactgcaagatatccagtctcggtcaaaagaacaactcaattcttacacataaatgtttgccagagtgtttcggccgacgtatttacagctctgacaaatcatcagacagctgctctgcagtacagatgtgtatcccaccaaactaatgtagatgtacaaacacttcactgtctgtctcaagctgctgggatgtatctctaggaaaaccttccagtgggtaaatctttttctttagaacaaatattggaggtttcatgttagccattttaaaaggcaacactttgacaaaatgatcgttcatactttgggaatttgtggcatgttcacatttattgctagggcaattctaccaagacactcaatggaatatgtcacactccttaatagggacctgtgactccttaataaggacctgtgacatgcccagcatcaagggataagaccgtaaattcacatatatgccatctgtcctcaagtgttatctacataggaaataaaatggaattgatgtaaagttccatttctgacagctgacatttattaaactttggatcaaagataatgtgattcttatgattgatttctcaaactagcttttccctcccaagtccaggacccattaatttcctgagccaatcagaaatatatttttcaataatgctaaaattagctacaattctgctgaccctactattaaagaatctggatgctggactcactgacaagctttccagaagcaattttataacagatttcattttaacaaaatactgatccaattttcattattcttgagaaatgtcagctttgccttaatgagtatttgctttaaatttctaagaatttatatcataactagagacccaaatatctttcacagaattttgttccataaatgtttttcttaattattaagaagtgttaccttattaaaatgaccaccattctaaaccatttttcagtggtctggatacgaagtttacagtttcataccaactatctaaaacctaattgcaaattgaccacagacctctaacctcctacttttatagacttgaatacttaagtaatttaaattagggttggtatttcatttttttcttatctaaatcttagtttcctggaataataaagtttgatgttcagcaagagaactgcttgagtttaagccattttcaaaagaaacttgccttttacattattgtgttccagaacattaagtgactgtaggtactgggtattagtgatggtaaactttgtgttgctctttatgaaatgatccatataactgttgggtgcatcagtgcttttcaaaggggctgcttactatagggttaactatgtatattcattgttaagagttaacttgtggtttggctgtttcctggattttataacatacatgtgcagaaatgtattcaaatgaaaggaagcatacctttatcaagatgctattaaaattgaacatcaagtataatatttcatttggattctcttttttggttaatgcctaaaaatgcctatttgggattttttttttttttaaattaagagaagctctcttctgtgtagaacagttgttccaaaatagcttagtgttttgttttcctgttgcatgacagatttaactattctttccagcagtggaggtgctgtcagagtccagtgttctagaagaggcagtgtctaaagcctaattttacttttctaattctggtagctattaccaggaatttttgaaagttttgtttaagtagtctaatattttttatgtaaagagcattaaattttgctatgtataaatttttgtaacctaacagtgaatcaatattttctatcagtgccaagggcttcctgtagttctattcaagtgttacaataaatatttgtagataatagtcaa

SEQ ID NO: 314982 - DNA, 4518 bp, Homo sapiens
ttaaatatgtagtttaattatttactcaaaataaacattgttcatgcttttaggcctttgggggaattgatttttatccacaggtagaaaatggtctttgcacacactacacttatttcaaatatacaatgtgctcccgaactttcgcattagtctttaaaattactctcaaaatggtattaaaaaaaaaaaaaaagcaccctcttgtatttcatttttgctttttcttaacaatacctttggccatttttttccagttcactatgtttgtatactaacttttcttcagccttttaatgcgaagccaactagtagagcatgctttcaggatctgacagctctgctagtagagcgagtatttattaatacagaattaaccttcgcccctttaaagtcaagtctgtctaatctaactagcgcctcgctttgccttctcacaatgctcactagccatcatgctcacccttctcttccagatccacttcctcatgatactgtcttcttgtatgggatcattctgttggcagaaggcttttacaccacaagtgcagtgaaagaactgcacggtgagtttaaaacaaccgcttgtggccgatgcatcagtggaatgttcgttttcctcacctatgtgcttggagtggcctggctgggtgtgtttggtttctcagcggtgcccgtgtttatgttctacaacatatggtcaacttgtgaagtcatcaagtcaccgcagaccaacgggaccacgggtgtggagcagatctgtgtggatatccgacaatacggtatcattccttggaatgctttccccggaaaaatatgtggctctgccctggagaacatctgcaacacaaacgagttctacatgtcctatcacctgttcattgtggcctgtgcaggagctggtgccaccgtcattgccctgctgatctacatgatggctactacatataactatgcggttttgaagtttaagagtcgggaagattgctgcactaaattctaaattgcataaggagttttagagagctatgctctgtagcatgaaatatcactgacactccagactaaagcagagtctaggtttctgcaattttgttacagtaatttgtaaatagctttagtaaactcaccttgcatggtagattaataagatgacttactgtacatgaattacacaataatgagatctggtggctatttccacattttgaaaaggattcagttatttactgacagtggtgagcatcctttttaaaataatgttctcatacttaaacattagagagcagtatctttaaatgaattattaacactttggaatacttacattttctgttatttttgattgcctgataaccagtttcaatgatgaaaatgaaaacaagtgctgaagatgaaatggaagagaaccgttttaatctggattttgttttgtcacacctggaaaatactttgcaaatatgttctaaattgaaaacaatttttttatgatcacatggttcactaccaaatgaccctcaaataagccagatgaaaatttgaagaaaaaggtcacccagttctctggaaaaaaaaaaaaaaaaaaaaaaaaaaaggatttatatgtgggtagttttttttttggtacaacacaatcattctgttagagcccacaaaattggtaaccttaaattgtgtgttttggtaagtaataactaactgtttcctcatagctagttctcaagctgcatgtaagattttaacgggaagagaaaataggcctggacctgaaggtctcaaatatgttgagaagaaagtatgaactataaggaacttgagatgtagatttattttgcaggaaatacgaggaaaataggaaagaagtgtttgccgcatcaagtgtaaagaatgatactgaggatttttacattttatgaaatgaaataatggcatttacaaaatgaaaaatgtagtttcacaactaagttttgttaacagagactgcatgctttgcttatagttcttaattttggttttgacattcatttaattttttccatgttaaatatgtagtttaattatttactcaaaataaacattgttcatgcttttaggcctttgggggaattgatttttatccacaggtagaaaatggtctttgcacacactacacttatttcaaatatacaatgtgctcccgaactttcgcattagtctttaaaattactctcaaaatggtattaaaaaaaaaaaaaaaagcaccctctcgtatttcattttggctttttcttaacaataccttgggccatttttttccagttcactatgttggtatactaacttttcttcagccttttaatgcgaagccaactagtagagcatgctttcaggatctgacagctctgctagtagagcgagtatttattaatacagaattaaccttcgcccctttaaagtcaagtctgtctaatctaactagcgcctcgctttgccttctcacaatgctcactagccatcatgctcacccttctcttccagatccacttcctcatgatactgtcttctaactgggcttacttaaaggatgcgagcaaaatgcaggcttaccaggatatcaaagcaaaggaagaacaggaactgcaagatatccagtctcggtcaaaagaacaactcaattcttacacataaatgtttgccagagtgtttcggccgacgtatttacagctctgacaaatcatcagacagctgctctgcagtacagatgtgtatcccaccaaactaatgtagatgtacaaacacttcactgtctgtctcaagctgctgggatgtatctctaggaaaaccttccagtgggtaaatctttttctttagaacaaatattggaggtttcatgttagccattttaaaaggcaacactttgacaaaatgatcgttcatactttgggaatttgtggcatgttcacatttattgctagggcaattctaccaagacactcaatggaatatgtcacactccttaatagggacctgtgactccttaataaggacctgtgacatgcccagcatcaagggataagaccgtaaattcacatatatgccatctgtcctcaagtgttatctacataggaaataaaatggaattgatgtaaagttccatttctgacagctgacatttattaaactttggatcaaagataatgtgattcttatgattgatttctcaaactagcttttccctcccaagtccaggacccattaatttcctgagccaatcagaaatatatttttcaataatgctaaaattagctacaattctgctgaccctactattaaagaatctggatgctggactcactgacaagctttccagaagcaattttataacagatttcattttaacaaaatactgatccaattttcattattcttgagaaatgtcagctttgccttaatgagtatttgctttaaatttctaagaatttatatcataactagagacccaaatatctttcacagaattttgttccataaatgtttttcttaattattaagaagtgttaccttattaaaatgaccaccattctaaaccatttttcagtggtctggatacgaagtttacagtttcataccaactatctaaaacctaattgcaaattgaccacagacctctaacctcctacttttatagacttgaatacttaagtaatttaaattagggttggtatttcatttttttcttatctaaatcttagtttcctggaataataaagtttgatgttcagcaagagaactgcttgagtttaagccattttcaaaagaaacttgccttttacattattgtgttccagaacattaagtgactgtaggtactgggtattagtgatggtaaactttgtgttgctctttatgaaatgatccatataactgttgggtgcatcagtgcttttcaaaggggctgcttactatagggttaactatgtatattcattgttaagagttaacttgtggtttggctgtttcctggattttataacatacatgtgcagaaatgtattcaaatgaaaggaagcatacctttatcaagatgctattaaaattgaacatcaagtataatatttcatttggattctcttttttggttaatgcctaaaaatgcctatttgggattttttttttttttaaattaagagaagctctcttctgtgtagaacagttgttccaaaatagcttagtgttttgttttcctgttgcatgacagatttaactattctttccagcagtggaggtgctgtcagagtccagtgttctagaagaggcagtgtctaaagcctaattttacttttctaattctggtagctattaccaggaatttttgaaagttttgtttaagtagtctaatattttttatgtaaagagcattaaattttgctatgtataaatttttgtaacctaacagtgaatcaatattttctatcagtgccaagggcttcctgtagttctattcaagtgttacaataaatatttgtagataatagtcaa

SEQ ID NO: 314983 - DNA, 2777 bp, Homo sapiens
cgcgcccttccgagggtcccgcccctcccccgctcaggtggcgcctcctcggccacctctgcgacgaagccgggacgctggaggtgggaggggcgcggcgcaggtgtccggaacgcccaggctgctttgaatgctgcatcaagtgtctgggaggagtcccctacgcctccctggtggccaccatcctctgcttctccggggtggccttattctgcggctgtgggcatgtggctctcgcaggcaccgtggcgattcttgagcaacacttctccaccaacgccagtgaccatgccttgctgagcgaggtgatacaactgatgcagtatgtcatctatggaattgcgtcctttttcttcttgtatgggatcattctgttggcagaaggcttttacaccacaagtgcagtgaaagaactgcacggtgagtttaaaacaaccgcttgtggccgatgcatcagtggaatgttcgttttcctcacctatgtgcttggagtggcctggctgggtgtgtttggtttctcagcggtgcccgtgtttatgttctacaacatatggtcaacttgtgaagtcatcaagtcaccgcagaccaacgggaccacgggtgtggagcagatctgtgtggatatccgacaatacggtatcattccttggaatgctttccccggaaaaatatgtggctctgccctggagaacatctgcaacacaaacgagttctacatgtcctatcacctgttcattgtggcctgtgcaggagctggtgccaccgtcattgccctgatccacttcctcatgatactgtcttctaactgggcttacttaaaggatgcgagcaaaatgcaggcttaccaggatatcaaagcaaaggaagaacaggaactgcaagatatccagtctcggtcaaaagaacaactcaattcttacacataaatgtttgccagagtgtttcggccgacgtatttacagctctgacaaatcatcagacagctgctctgcagtacagatgtgtatcccaccaaactaatgtagatgtacaaacacttcactgtctgtctcaagctgctgggatgtatctctaggaaaaccttccagtgggtaaatctttttctttagaacaaatattggaggtttcatgttagccattttaaaaggcaacactttgacaaaatgatcgttcatactttgggaatttgtggcatgttcacatttattgctagggcaattctaccaagacactcaatggaatatgtcacactccttaatagggacctgtgactccttaataaggacctgtgacatgcccagcatcaagggataagaccgtaaattcacatatatgccatctgtcctcaagtgttatctacataggaaataaaatggaattgatgtaaagttccatttctgacagctgacatttattaaactttggatcaaagataatgtgattcttatgattgatttctcaaactagcttttccctcccaagtccaggacccattaatttcctgagccaatcagaaatatatttttcaataatgctaaaattagctacaattctgctgaccctactattaaagaatctggatgctggactcactgacaagctttccagaagcaattttataacagatttcattttaacaaaatactgatccaattttcattattcttgagaaatgtcagctttgccttaatgagtatttgctttaaatttctaagaatttatatcataactagagacccaaatatctttcacagaattttgttccataaatgtttttcttaattattaagaagtgttaccttattaaaatgaccaccattctaaaccatttttcagtggtctggatacgaagtttacagtttcataccaactatctaaaacctaattgcaaattgaccacagacctctaacctcctacttttatagacttgaatacttaagtaatttaaattagggttggtatttcatttttttcttatctaaatcttagtttcctggaataataaagtttgatgttcagcaagagaactgcttgagtttaagccattttcaaaagaaacttgccttttacattattgtgttccagaacattaagtgactgtaggtactgggtattagtgatggtaaactttgtgttgctctttatgaaatgatccatataactgttgggtgcatcagtgcttttcaaaggggctgcttactatagggttaactatgtatattcattgttaagagttaacttgtggtttggctgtttcctggattttataacatacatgtgcagaaatgtattcaaatgaaaggaagcatacctttatcaagatgctattaaaattgaacatcaagtataatatttcatttggattctcttttttggttaatgcctaaaaatgcctatttgggattttttttttttttaaattaagagaagctctcttctgtgtagaacagttgttccaaaatagcttagtgttttgttttcctgttgcatgacagatttaactattctttccagcagtggaggtgctgtcagagtccagtgttctagaagaggcagtgtctaaagcctaattttacttttctaattctggtagctattaccaggaatttttgaaagttttgtttaagtagtctaatattttttatgtaaagagcattaaattttgctatgtataaatttttgtaacctaacagtgaatcaatattttctatcagtgccaagggcttcctgtagttctattcaagtgttacaataaatatttgtagataatagtcaa

SEQ ID NO: 314984 - DNA, 600 bp, Homo sapiens
aagcatgttcaacagaaggaaagataacatgatcctaaaagcttttactcctgcagctatgtctcccaagataataataattgtaaaactcaaaagctacttacccatggcaaataggaagaagctcagtatcggctcctcccaccataacccccacttcctccactgcctcctggaccatagtttcctcgtgccgaattcggcacgaggagaactagtctcgagttttttttttttttttaaattaagagaagctctcttctgtgtagaacagttgttccaaaatagcttagtgttttgttttcctgttgcatgacagatttaactattctttccagcagtggaggtgctgtcagagtccagtgttctagaagaggcagtgtctaaagcctaattttacttttctaattctggtagctattaccaggaatttttgaaagttttgtttaagtagtctaatattttttatgtaaagagcattaaattttgctatgtataaatttttgtaacctaacagtgaatcaatattttctatcagtgccaagggcttcctgtagttctattcaagtgttacaataaatatttgtagataatagtcaa

SEQ ID NO: 314985 - DNA, 783 bp, Homo sapiens
gagttaagtagtttgtgccacccaggagttgcaccttttctcaggttccactagatggtatgacagtggaattagccccaggcagtgtctaaaatcccacttctgttgctgaccctgtggcctcagaaaagggttctttttgctttgtttcctctttatcagggtgttggaagaaggatctctaagtgtctctctgtgatcctctgagcaaggaggtagataaaattgttagcttatttaattttcacttttactaagactctatttttattttagccgtataggtgagggacttgatcaggctctgccctgtctgacagaactcattctcaccaataatagtctcgtggaactggtaagttgcacagaaggaaaatgtatttggtgggtggggttaaaggtactatgtgcttcctacagaaaatttacaaaatctagaaaatgatctcagtatcctctttcttgtctttttcttaattcaggatctgggccttttgggttctgcagccgtatgttgcaaatattttcctacttttacttgacttttgacttaggatgtcttgttagagaagttcctaatttaggtgcagtccaatgaatcaatcttcttctttattgtagcccttttgatgtttaaatttcccctattccagggttataaactcctatgttgttttctacaattgcagtgttcaatatagtaccagtaactacaggtggctacttataattgagatgtgctagaactataaaatacacactggatttcaaagacttaagtgc

SEQ ID NO: 314986 - DNA, 1061 bp, Homo sapiens
  misc_feature (18)..(18): n is a, c, g, or t
  misc_feature (34)..(34): n is a, c, g, or t
  misc_feature (39)..(40): n is a, c, g, or t
cagcgggggcaaacttanggctaggtacgaggcngggtnngccacgggctttccacagcgcgggggaacgggaggctgcaggatggtcaagctgacggcggagctgatcgagcaggcggcgcagtacaccaacgcggtgcgcgaccgggagctggacctccgggggtataaaattcccgtcattgaaaatctaggtgctacgttagaccagtttgatgctattgatttttctgacaatgagatcaggaaactggatggttttcctttgttgagaagactgaaaacattgttagtgaacaacaacagaatatgccgtataggtgagggacttgatcaggctctgccctgtctgacagaactcattctcaccaataatagtctcgtggaactgggtgatctggaccctctggcatctctcaaatcgctgacttacctaagtatcctaagaaatccggtaaccaataagaagcattacagattgtatgtgatttataaagttccgcaagtcagagtactggatttccagaaagtgaaactaaaagagcgtcaggaagcagagaaaatgttcaagggcaaacggggtgcacagcttgcaaaggatattgccaggagaagcaaaacttttaatccaggtgctggtttgccaactgacaaaaagaaaggtgggccatctccaggggatgtagaagcaatcaagaatgccatagcaaatgcttcaactctggctgaagtggagaggctgaaggggttgctgcagtctggtcagatccctggcagagaacgcagatcagggcccactgatgatggtgaagaagagatggaagaagacacagtcacaaacgggtcctgagcagtgaggcagatgtataataataggccctcttggaacaagtcttgcttttcgaacatggtataatagccttgtttgtgttagcaaagtggaatctatcagcattgttgaaatgcttaagactgctgctgataattttgtaatataagttttgaaatctaaatgtcaattttctacaaattataaaaataaactccactcactatgctac

SEQ ID NO: 314987 - DNA, 1111 bp, Homo sapiens
gtgctgcctggcggcggggcgcggggcacgctgggacgtctcgctggcgggaggccacgggctttccacagcgcgggggaacgggaggctgcaggatggtcaagctgacggcggagctgatcgagcaggcggcgcagtacaccaacgcggtgcgcgaccgggagctggacctccgggggtataaaattcccgtcattgaaaatctaggtgctacgttagaccagtttgatgctattgatttttctgacaatgagatcaggaaactggatggttttcctttgttgagaagactgaaaacattgttagtgaacaacaacagaatatgccgtataggtgagggacttgatcaggctctgccctgtctgacagaactcattctcaccaataatagtctcgtggaactgggtgatctggaccctctggcatctctcaaatcgctgacttacctaagtatcctaagaaatccggtaaccaataagaagcattacagattgtatgtgatttataaagttccgcaagtcagagtactggatttccagaaagtgaaactaaaagagcgtcaggaagcagagaaaatgttcaagggcaaacggggtgcacagcttgcaaaggatattgccaggagaagcaaaacttttaatccaggtgctggtttgccaactgacaaaaagaaaggtgggccatctccaggggatgtagaagcaatcaagaatgccatagcaaatgcttcaactctggctgaagtggagaggctgaaggggttgctgcagtctggtcagatccctggcagagaacgcagatcagggcccactgatgatggtgaagaagagatggaagaagacacagtcacaaacgggtcctgagcagtgaggcagatgtataataataggccctcttggaacaagtcttgcttttcgaacatggtataatagccttgtttgtgttagcaaagtggaatctatcagcattgttgaaatgcttaagactgctgctgataattttgtaatataagttttgaaatctaaatgtcaattttctacaaattataaaaataaactccactcactatgctacaaaaaaaaacacgacaccaccgcgacccaaaaacaag

SEQ ID NO: 314988 - DNA, 994 bp, Homo sapiens
  misc_feature (943)..(943): n is a, c, g, or t
gtgctgcctggcggcggggcgcggggcacgctgggacgtctcgctggcgggaggccacgggctttccacagcgcgggggaacgggaggctgcaggatggtcaagctgacggcggagctgatcgagcaggcggcgcagtacaccaacgcggtgcgcgaccgggagctggacctccgggggtataaaattcccgtcattgaaaatctaggtgctacgttagaccagtttgatgctattgatttttctgacaatgagatcaggaaactggatggttttcctttgttgagaagactgaaaacattgttagtgaacaacaacagaatatgccgtataggtgagggacttgatcaggctctgccctgtctgacagaactcattctcaccaataatagtctcgtggaactgggtgatctggaccctctggcatctctcaaatcgctgacttacctaagtatcctaagaaatccggtaaccaataagaagcattacagattgtatgtgatttataaagttccgcaagtcagagtactggatttccagaaagtgaaactaaaagagcgtcaggaagcagagaaaatgttcaagggcaaacggggtgcacagcttgcaaaggatattgccaggagaagcaaaacttttaatccaggtgctggtttgccaactgacaaaaagaaaggtgggccatctccaggggatgtagaagcaatcaagaatgccatagcaaatgcttcaactctggctgaagtggagaggctgaaggggttgctgcagtctggtcagatccctggcagagaacgcagatcagggcccactgatgatggtgaagaagagatggaagaagacacagtcacaaacgggtcctgagcagtgaggcagatgtataataataggccctcttggaacaagtcttgcttttcgaacatggtataatagccttgtttccnttccccccccccaccccctccccactgcccaaacgccccccccccccgccc

SEQ ID NO: 314989 - DNA, 1025 bp, Homo sapiens
gagttaagtagtttgtgccacccaggagttgcaccttttctcaggttccactagatggtatgacagtggaattagccccaggcagtgtctaaaatcccacttctgttgctgaccctgtggcctcagaaaagggttctttttgctttgtttcctctttatcagggtgttggaagaaggatctctaagtgtctctctgtgatcctctgagcaaggaggtagataaaattgttagcttatttaattttcacttttactaagactctatttttattttagccgtataggtgagggacttgatcaggctctgccctgtctgacagaactcattctcaccaataatagtctcgtggaactgggtgatctggaccctctggcatctctcaaatcgctgacttacctaagtatcctaagaaatccggtaaccaataagaagcattacagattgtatgtgatttataaagttccgcaagtcagagtactggatttccagaaagtgaaactaaaagagcgtcaggaagcagagaaaatgttcaagggcaaacggggtgcacagcttgcaaaggatattgccaggagaagcaaaacttttaatccaggtgctggtttgccaactgacaaaaagaaaggtgggccatctccaggggatgtagaagcaatcaagaatgccatagcaaatgcttcaactctggctgaagtggagaggctgaaggggttgctgcagtctggtcagatccctggcagagaacgcagatcagggcccactgatgatggtgaagaagagatggaagaagacacagtcacaaacgggtcctgagcagtgaggcagatgtataataataggccctcttggaacaagtcttgcttttcgaacatggtataatagccttgtttgtgttagcaaagtggaatctatcagcattgttgaaatgcttaagactgctgctgataattttgtaatataagttttgaaatctaaatgtcaattttctacaaattataaaaataaactccactcactatgctac

SEQ ID NO: 314990 - DNA, 2100 bp, Homo sapiens
gtgctgcctggcggcggggcgcggggcacgctgggacgtctcgctggcgggaggccacgggctttccacagcgcgggggaacgggaggctgcaggatggtcaagctgacggcggagctgatcgagcaggcggcgcagtacaccaacgcggtgcgcgaccgggagctggacctccgggggtataaaattcccgtcattgaaaatctaggtgctacgttagaccagtttgatgctattgatttttctgacaatgagatcaggaaactggatggttttcctttgttgagaagactgaaaacattgttagtgaacaacaacagaatatgccgtataggtgagggacttgatcaggctctgccctgtctgacagaactcattctcaccaataatagtctcgtggaactgggtgatctggaccctctggcatctctcaaatcgctgacttacctaagtatcctaagaaatccggtaaccaataagaagcattacagattgtatgtgatttataaagttccgcaagtcagagtactggatttccagaaagtgaaactaaaagtaagtagtaatctgttgcttgtgagccattatagagttgtgtgtttttctttatatttttgttactgattattaaaattgtctaaatgagtaaattttaccattagtttgtaataaaagtgggagggaaaatgttacatcacatttttttctaatagcagagtttatgatagaacttttaagttggagctctcttatgtaatgctggctattccgaagttcgcaaagtgctgaggccacggtgagcagtcttaacagtggattgtctgcctagatacgttcccagcggagaacttaatgtaacctactttcgtgcagctccgtgtgttaggatgatttttccctttattaggaattcattattttattattcatttaattgccttcttagttccctgggatcccctccttggagctaggagaatgaactttcttcagggagctctaccaaagaaagaagaccactgtgtcttctcttaatttgaaattgctttttggtattttcaccagcccggagtactgtaggagagttcgcttccatgtcttctgaggaatgcatctaaatgcatgtggtattcctatttccattaactctgtgtgtggtgtcgctgtaggagcgtcaggaagcagagaaaatgttcaagggcaaacggggtgcacagcttgcaaaggatattgccaggagaagcaaaacgtaagacacggatatccaacttaactctacttcaccttcagaaacatgatctgatctgtctggcagttcgtctcctacaaaattaaccaaaaactctgacatattaatgtggtattaaatttgagtgcttatagtccatgtacatcaatggtccacacatcacaagaaatttctaccagcttagcagagcaaatatttcagtagtcagtcttcatgtgataccatgtacatcctattttctatataggaagatgaactggatggtgtttctgaaggagagagttcttgtatcagtttgttaacaaagataagatactacactggttgaattactttcaaaagcttttgaaagtaaaagagaagcaacttctgttggtctaggtctaacagttatgttcttccccctcttaagttttaatccaggtgctggtttgccaactgacaaaaagaaaggtgggccatctccaggggatgtagaagcaatcaagaatgccatagcaaatgcttcaactctggctgaagtggagaggctgaaggggttgctgcagtctggtcagatccctggcagagaacgcagatcagggcccactgatgatggtgaagaagagatggaagaagacacagtcacaaacgggtcctgagcagtgaggcagatgtataataataggccctcttggaacaagtcttgcttttcgaacatggtataatagccttgtttgtgttagcaaagtggaatctatcagcattgttgaaatgcttaagactgctgctgataattttgtaatataagttttgaaatctaaatgtcaattttctacaaattataaaaataaactccactcactatgctac

SEQ ID NO: 314991 - DNA, 2010 bp, Homo sapiens
tgccagatgagcatccggttaagctcctgggagccttctgttagcgccgtgcctcttgacaggcacgggtgacttcattacttcctgggtataaaattcccgtcattgaaaatctaggtgctacgttagaccagtttgatgctattgatttttctgacaatgagatcaggaaactggatggttttcctttgttgagaagactgaaaacattgttagtgaacaacaacagaatatgccgtataggtgagggacttgatcaggctctgccctgtctgacagaactcattctcaccaataatagtctcgtggaactgggtgatctggaccctctggcatctctcaaatcgctgacttacctaagtatcctaagaaatccggtaaccaataagaagcattacagattgtatgtgatttataaagttccgcaagtcagagtactggatttccagaaagtgaaactaaaagtaagtagtaatctgttgcttgtgagccattatagagttgtgtgtttttctttatatttttgttactgattattaaaattgtctaaatgagtaaattttaccattagtttgtaataaaagtgggagggaaaatgttacatcacatttttttctaatagcagagtttatgatagaacttttaagttggagctctcttatgtaatgctggctattccgaagttcgcaaagtgctgaggccacggtgagcagtcttaacagtggattgtctgcctagatacgttcccagcggagaacttaatgtaacctactttcgtgcagctccgtgtgttaggatgatttttccctttattaggaattcattattttattattcatttaattgccttcttagttccctgggatcccctccttggagctaggagaatgaactttcttcagggagctctaccaaagaaagaagaccactgtgtcttctcttaatttgaaattgctttttggtattttcaccagcccggagtactgtaggagagttcgcttccatgtcttctgaggaatgcatctaaatgcatgtggtattcctatttccattaactctgtgtgtggtgtcgctgtaggagcgtcaggaagcagagaaaatgttcaagggcaaacggggtgcacagcttgcaaaggatattgccaggagaagcaaaacgtaagacacggatatccaacttaactctacttcaccttcagaaacatgatctgatctgtctggcagttcgtctcctacaaaattaaccaaaaactctgacatattaatgtggtattaaatttgagtgcttatagtccatgtacatcaatggtccacacatcacaagaaatttctaccagcttagcagagcaaatatttcagtagtcagtcttcatgtgataccatgtacatcctattttctatataggaagatgaactggatggtgtttctgaaggagagagttcttgtatcagtttgttaacaaagataagatactacactggttgaattactttcaaaagcttttgaaagtaaaagagaagcaacttctgttggtctaggtctaacagttatgttcttccccctcttaagttttaatccaggtgctggtttgccaactgacaaaaagaaaggtgggccatctccaggggatgtagaagcaatcaagaatgccatagcaaatgcttcaactctggctgaagtggagaggctgaaggggttgctgcagtctggtcagatccctggcagagaacgcagatcagggcccactgatgatggtgaagaagagatggaagaagacacagtcacaaacgggtcctgagcagtgaggcagatgtataataataggccctcttggaacaagtcttgcttttcgaacatggtataatagccttgtttgtgttagcaaagtggaatctatcagcattgttgaaatgcttaagactgctgctgataattttgtaatataagttttgaaatctaaatgtcaattttctacaaattataaaaataaactccactcactatgctac

SEQ ID NO: 314992 - DNA, 994 bp, Homo sapiens
gtgctgcctggcggcggggcgcggggcacgctgggacgtctcgctggcgggaggccacgggctttccacagcgcgggggaacgggaggctgcaggatggtcaagctgacggcggagctgatcgagcaggcggcgcagtacaccaacgcggtgcgcgaccgggagctggacctccgggggtataaaattcccgtcattgaaaatctaggtgctacgttagaccagtttgatgctattgatttttctgacaatgagatcaggaaactggatggttttcctttgttgagaagactgaaaacattgttagtgaacaacaacagaatatgccgtataggtgagggacttgatcaggctctgccctgtctgacagaactcattctcaccaataatagtctcgtggaactgggtgatctggaccctctggcatctctcaaatcgctgacttacctaagtatcctaagaaatccggtaaccaataagaagcattacagattgtatgtgatttataaagttccgcaagtcagagtactggatttccagaaagtgaaactaaaattttaatccaggtgctggtttgccaactgacaaaaagaaaggtgggccatctccaggggatgtagaagcaatcaagaatgccatagcaaatgcttcaactctggctgaagtggagaggctgaaggggttgctgcagtctggtcagatccctggcagagaacgcagatcagggcccactgatgatggtgaagaagagatggaagaagacacagtcacaaacgggtcctgagcagtgaggcagatgtataataataggccctcttggaacaagtcttgcttttcgaacatggtataatagccttgtttgtgttagcaaagtggaatctatcagcattgttgaaatgcttaagactgctgctgataattttgtaatataagttttgaaatctaaatgtcaattttctacaaattataaaaataaactccactcactatgctac

SEQ ID NO: 314993 - DNA, 720 bp, Homo sapiens
gtgctgcctggcggcggggcgcggggcacgctgggacgtctcgctggcgggaggccacgggctttccacagcgcgggggaacgggaggctgcaggatggtcaagctgacggcggagctgatcgagcaggcggcgcagtacaccaacgcggtgcgcgaccgggagctggacctccgggtatcctaagaaatccggtaaccaataagaagcattacagattgtatgtgatttataaagttccgcaagtcagagtactggatttccagaaagtgaaactaaaattttaatccaggtgctggtttgccaactgacaaaaagaaaggtgggccatctccaggggatgtagaagcaatcaagaatgccatagcaaatgcttcaactctggctgaagtggagaggctgaaggggttgctgcagtctggtcagatccctggcagagaacgcagatcagggcccactgatgatggtgaagaagagatggaagaagacacagtcacaaacgggtcctgagcagtgaggcagatgtataataataggccctcttggaacaagtcttgcttttcgaacatggtataatagccttgtttgtgttagcaaagtggaatctatcagcattgttgaaatgcttaagactgctgctgataattttgtaatataagttttgaaatctaaatgtcaattttctacaaattataaaaataaactccactcactatgctac

SEQ ID NO: 314994 - DNA, 2077 bp, Homo sapiens
gtgctgcctggcggcggggcgcggggcacgctgggacgtctcgctggcgggaggccacgggctttccacagcgcgggggaacgggaggctgcaggatggtcaagctgacggcggagctgatcgagcaggcggcgcagtacaccaacgcggtgcgcgaccgggagctggacctccgggggtataaaattcccgtcattgaaaatctaggtgctacgttagaccagtttgatgctattgatttttctgacaatgagatcaggaaactggatggttttcctttgttgagaagactgaaaacattgttagtgaacaacaacagaatatgccgtataggtgagggacttgatcaggctctgccctgtctgacagaactcattctcaccaataatagtctcgtggaactgggtgatctggaccctctggcatctctcaaatcgctgacttacctaagtatcctaagaaatccggtaaccaataagaagcattacagattgtatgtgatttataaagttccgcaagtcagagtactggatttccagaaagtgaaactaaaagtaagtagtaatctgttgcttgtgagccattatagagttgtgtgtttttctttatatttttgttactgattattaaaattgtctaaatgagtaaattttaccattagtttgtaataaaagtgggagggaaaatgttacatcacatttttttctaatagcagagtttatgatagaacttttaagttggagctctcttatgtaatgctggctattccgaagttcgcaaagtgctgaggccacggtgagcagtcttaacagtggattgtctgcctagatacgttcccagcggagaacttaatgtaacctactttcgtgcagctccgtgtgttaggatgatttttccctttattaggaattcattattttattattcatttaattgccttcttagttccctgggatcccctccttggagctaggagaatgaactttcttcagggagctctaccaaagaaagaagaccactgtgtcttctcttaatttgaaattgctttttggtattttcaccagcccggagtactgtaggagagttcgcttccatgtcttctgaggaatgcatctaaatgcatgtggtattcctatttccattaactctgtgtgtggtgtcgctgtaggagcgtcaggaagcagagaaaatgttcaagggcaaacggggtgcacagcttgcaaaggatattgccaggagaagcaaaacgtaagacacggatatccaacttaactctacttcaccttcagaaacatgatctgatctgtctggcagttcgtctcctacaaaattaaccaaaaactctgacatattaatgtggtattaaatttgagtgcttatagtccatgtacatcaatggtccacacatcacaagaaatttctaccagcttagcagagcaaatatttcagtagtcagtcttcatgtgataccatgtacatcctattttctatataggaagatgaactggatggtgtttctgaaggagagagttcttgtatcagtttgttaacaaagataagatactacactggttgaattactttcaaaagcttttgaaagtaaaagagaagcaacttctgttggtctaggtctaacagttatgttcttccccctcttaagttttaatccaggtgctggtttgccaactgacaaaaagaaaggtgggccatctccaggggatgtagaagcaatcaaggtaatcatgtgttaggattcttggactggaatgagctaagatgggttcagaacacaaagctggataataaacatgttccgaacattaaaacaaaacaaacacaacaaaacacaaaaacacaaaaaaaacaaaaaacataaaaaaaaaataaacaaaaataaatcaaacaaaacaataaaaaataatacaaacaataaaacacaaataaagaagaaaagaacaaagacagataaaagaaacaaaacaagacgaacgggaagacataagcagcgggcatcggggaggcgccgggtcagcaacaagtggggggggagaggaggagcgccaggtgtggttggggg

SEQ ID NO: 314995 - DNA, 1030 bp, Homo sapiens
gtgctgcctggcggcggggcgcggggcacgctgggacgtctcgctggcgggaggccacgggctttccacagcgcgggggaacgggaggctgcaggatggtcaagctgacggcggagctgatcgagcaggcggcgcagtacaccaacgcggtgcgcgaccgggagctggacctccgggggtataaaattcccgtcattgaaaatctaggtgctacgttagaccagtttgatgctattgatttttctgacaatgagatcaggaaactggatggttttcctttgttgagaagactgaaaacattgttagtgaacaacaacagaatatgccgtataggtgagggacttgatcaggctctgccctgtctgacagaactcattctcaccaataatagtctcgtggaactgggtgatctggaccctctggcatctctcaaatcgctgacttacctaagtatcctaagaaatccggtaaccaataagaagcattacagattgtatgtgatttataaagttccgcaagtcagagtactggatttccagaaagtgaaactaaaagagcgtcaggaagcagagaaaatgttcaagggcaaacggggtgcacagcttgcaaaggatattgccaggagaagcaaaacttttaatccaggtgctggtttgccaactgacaaatgccatagcaaatgcttcaactctggctgaagtggagaggctgaaggggttgctgcagtctggtcagatccctggcagagaacgcagatcagggcccactgatgatggtgaagaagagatggaagaagacacagtcacaaacgggtcctgagcagtgaggcagatgtataataataggccctcttggaacaagtcttgcttttcgaacatggtataatagccttgtttgtgttagcaaagtggaatctatcagcattgttgaaatgcttaagactgctgctgataattttgtaatataagttttgaaatctaaatgtcaattttctacaaattataaaaataaactccactcactatgctac

SEQ ID NO: 314996 - DNA, 2077 bp, Homo sapiens
ttgggcttgttgctagagagtaaaaattcagtaaataatgaaaagacaacttgcttcaaaagcactctccatttcagaatctcaaaatagcgtgtggtattcgcgttcttacctgtggctattgcttgacagggtgatctggaccctctggcatctctcaaatcgctgacttacctaagtatcctaagaaatccggtaaccaataagaagcattacagattgtatgtgatttataaagttccgcaagtcagagtactggatttccagaaagtgaaactaaaagtaagtagtaatctgttgcttgtgagccaccgcgcctggccgaagactgttttcatctaataacaccaaggtgttacttgctttagtatgaacatttgcactgatggagcaatagtgggtagaactgcgggcacctcagtaggagtcaaggcagcagcctaaataatagctgttacattcttccctgctctgcactcccagtagcgtgcataccagtttcacttaagagtgtcctggatgcagcagtaaagataattaaatatcactcctcgggcacacgtctctttgatattctgggtgacagaaagggggtgcacatgtctgcattcttgagttaggtggttatctccatgcactggtgcagttgtttcagttgagaggcagctacctgtcttctcaaacatgatgaagtgagcctgtcacttcagggaaaacaattgaaaattcaaggtttaaagcaaaaattaaaatttagaaaacttgtatccactgccgtaacctgccagcttcccagtactttaagacttttctggggaactcaatagtaatgttatgtgcatgtgaattaatgggtgtgacatttttgatgtgtaattacatggctcaacgtttggaagatctgcaaaagtcggtgaaccacagttttccaaatgatacgaaatcatgtacgggtaaaagatttgttcaaagtacaagataaaccaagtaagagtatgaaaagttcattgataaggtttcagacttttacactgccatctaaccttgaggaagctaccatttgtcaagttttagcatagtatctaaaaagagcatccaccattatctgcacaggctgttaaaatcttcctcccttttctaactgtgtgcctgtgtggccagattttcttcatgcccgtcaatcaaaatgccgtattgcacaggatggaatgatgaaaccaatacaataattcagctgactgatgttaagtcagacattaagtcaacaataacaattgtttcccaaacaattgaaggagttacaacttttttttccccctggaatacattgagcaaaatacctgccataaattgttgaacaaatgtaacattttttggtagttgttggcatatttccctaatttagagacaataaagtcattgaactgttgccagtatatggcatgtagtaggtgcccagatgtttttgagtatttccggtttctttgcctacggtagtgccatgaaaagcacatgagtataggctttaccttcaccaaaaatgaattattatcaactacaatgggaggcaacaattttgaaatctttgtgacccttttcctttgaaattgagcatcccttccagtacctgccaaagacagactagaccgtccctggacgataagctcctcaaaggcaggtgctgcttttgatctttttgtacctacttcagtgtgtaacaaacagtggccacagaacaaacacttgcatgctaagggaatggattctctaaaattgatactacttttgctttggtggttttctttagggcccactgatgatggtgaagaagagatggaagaagacacagtcacaaacgggtcctgagcagtgaggcagatgtataataataggccctcttggaacaagtcttgcttttcgaacatggtataatagccttgtttgtgttagcaaagtggaatctatcagcattgttgaaatgcttaagactgctgctgataattttgtaatataagttttgaaatctaaatgtcaattttctacaaattataaaaataaactccactcactatgctac

SEQ ID NO: 314997 - DNA, 611 bp, Homo sapiens
ttttactttcgaagatttgctgtctggcaaatccttttgactgatcagtagggaccctcgttttataatattgcctccttaaattattcagtaacataattgcaaatagttacttcacttagctacgattttagaacatgtggagtgattatttataagaaggcctgcatctcttcaccaattttagaaatttgtggtttggcttctagttttatttttgtgggccaataacattcttccccctacaccaaagtatttaatgttcctgatggagaagttgctgtgaatttctgtaggtgattgacacttagttttctgggtagctgatacttggttgaagttaatcatccatctccattgccctctgtcctccagaaatgccatagcaaatgcttcaactctggctgaagtggagaggctgaaggggttgctgcagtctggtcagatccctggcagagaacgcagatcaggtgaacaaatggtgttctttgtatgttcaaattaatgttacactcagagtgtaactcacaaccatttagatgccatgactctggaatgccagagtagtgcctccttacatcaaatctaatatatgaaatctctttaaatgc

SEQ ID NO: 314998 - DNA, 619 bp, Homo sapiens
atacatatgtaacaaacctgcaagttgtgcacatgtaccctagaacttaaaagtataatttaaaaaaaaagtgccttttacaaagaaagattgaatatatttccttaatgttaaattgttacaatgttgcaatgtgaagaatgtgaatgttcccttgatttataggttccttagactattcaaacagacctcttgagtgctgtgccatgaacaagtttgccattgtgtcattccttttcttgtagtatcctaagaaatccggtaaccaataagaagcattacagattgtatgtgatttataaagttccgcaagtcagagtactggatttccagaaagtgaaactaaaagtaagtagtaatctgttgcttgtgagccattatagagttgtgtgtttttctttatatttttgttactgattattaaaattgtctaaatgagtaaattttaccattagtttgtaataaaagtgggagggaaaatgttacatcacatttttttctaatagcagagtttatgatagaacttttaagttggagctctcttatgtaatgctggctattccgaagttcgcaaagtgctgaggccacggtgagcagtcttaacagtggattgtctgcc

SEQ ID NO: 314999 - DNA, 435 bp, Homo sapiens
acttagttttctgggtagctgatacttggttgaagttaatcatccatctccattgccctctgtcctccagaaatgccatagcaaatgcttcaactctggctgaagtggagaggctgaaggggttgctgcagtctggtcagatccctggcagagaacgcagatcagggcccactgatgatggtgaagaagagatggaagaagacacagtcacaaacgggtcctgagcagtgaggcagatgtataataataggccctcttggaacaagtcttgcttttcgaacatggtataatagccttgtttgtgttagcaaagtggaatctatcagcattgttgaaatgcttaagactgctgctgataattttgtaatataagttttgaaatctaaatgtcaattttctacaaattataaaaataaactccactcactatgctac

SEQ ID NO: 315000 - DNA, 1074 bp, Homo sapiens
gtgctgcctggcggcggggcgcggggcacgctgggacgtctcgctggcgggaggccacgggctttccacagcgcgggggaacgggaggctgcaggatggtcaagctgacggcggagctgatcgagcaggcggcgcagtacaccaacgcggtgcgcgaccgggagctggacctccgggggtataaaattcccgtcattgaaaatctaggtgctacgttagaccagtttgatgctattgatttttctgacaatgagatcaggaaactggatggttttcctttgttgagaagactgaaaacattgttagtgaacaacaacagaatatgccgtataggtgagggacttgatcaggctctgccctgtctgacagaactcattctcaccaataatagtctcgtggaactgggtgatctggaccctctggcatctctcaaatcgctgacttacctaagtatcctaagaaatccggtaaccaataagaagcattacagattgtatgtgatttataaagttccgcaagtcagagtactggatttccagaaagtgaaactaaaagagcgtcaggaagcagagaaaatgttcaagggcaaacggggtgcacagcttgcaaaggatattgccaggagaagcaaaacttttaatccaggtgctggtttgccaactgacaaaaagaaaggtgggccatctccaggggatgtagaagcaatcaagaatgccatagcaaatgcttcaactctggctgaagtggagaggctgaaggggttgctgcagtctggtcagatccctggcagagaacgcagatcagggcccactgatgatggtgaagaagagatggaagaagacacagtcacaaacgggtcctgagcagtgaggcagatgtataataataggccctcttggaacaagtcttgcttttcgaacatggtataatagccttgtttgtgttagcaaagtggaatctatcagcattgttgaaatgcttaagactgctgctgataattttgtaatataagttttgaaatctaaatgtcaattttctacaaattataaaaataaactccactcactatgctac

SEQ ID NO: 315001 - DNA, 1208 bp, Homo sapiens
gtgctgcctggcggcggggcgcggggcacgctgggacgtctcgctggcgggaggccacgggctttccacagcgcgggggaacgggaggctgcaggatggtcaagctgacggcggagctgatcgagcaggcggcgcagtacaccaacgcggtgcgcgaccgggagctggacctccgggggtataaaattcccgtcattgaaaatctaggtgctacgttagaccagtttgatgctattgatttttctgacaatgagatcaggaaactggatggttttcctttgttgagaagactgaaaacattgttagtgaacaacaacagaatatgccgtataggtgagggacttgatcaggctctgccctgtctgacagaactcattctcaccaataatagtctcgtggaactgggtgatctggaccctctggcatctctcaaatcgctgacttacctaagtatcctaagaaatccggtaaccaataagaagcattacagattgtatgtgatttataaagttccgcaagtcagagtactggatttccagaaagtgaaactaaaagagcgtcaggaagcagagaaaatgttcaagggcaaacggggtgcacagcttgcaaaggatattgccaggagaagcaaaacttttaatccaggtgctggtttgccaactgacaaaaagaaaggtgggccatctccaggggatgtagaagcaatcaagaatgccatagcaaatgcttcaactctggctgaagtggagaggctgaaggggttgctgcagtctggtcagatccctggcagagaacgcagatcagggcccactgatgatggtgaagaagagatggaagaagacacagtcacaaacgggtcctgagcagtgaggcagatgtataataataggccctcttggaacaagtcttgcttttcgaacatggtataatagccttgtttgtgttagcaaagtggaatctatcagcattgttgaaatgcttaagactgctgctgataattttgtaatataagttttgaaatctaaatgtcaattttctacaaattataaaaataaactccactcactatgctacaaaaaaaaacacaaaaagaaaaaaaaaagaaagagaaaagaaaagagaaataggaagaaaagagaaggaagaagggggagaggatagaggggaaaatgagggaagggaggagacgagatagtagaagggagagg

SEQ ID NO: 315002 - DNA, 1085 bp, Homo sapiens
tgccagatgagcatccggttaagctcctgggagccttctgttagcgccgtgcctcttgacaggcacgggtgacttcattacttcctgattctaagcttcatggcactggggacttgagactcgttcagcgttttctctctagtatcttaaacagcggcaagtcatgcgtgacccgacataggtgctagggtataaaattcccgtcattgaaaatctaggtgctacgttagaccagtttgatgctattgatttttctgacaatgagatcaggaaactggatggttttcctttgttgagaagactgaaaacattgttagtgaacaacaacagaatatgccgtataggtgagggacttgatcaggctctgccctgtctgacagaactcattctcaccaataatagtctcgtggaactgggtgatctggaccctctggcatctctcaaatcgctgacttacctaagtatcctaagaaatccggtaaccaataagaagcattacagattgtatgtgatttataaagttccgcaagtcagagtactggatttccagaaagtgaaactaaaagagcgtcaggaagcagagaaaatgttcaagggcaaacggggtgcacagcttgcaaaggatattgccaggagaagcaaaacttttaatccaggtgctggtttgccaactgacaaaaagaaaggtgggccatctccaggggatgtagaagcaatcaagaatgccatagcaaatgcttcaactctggctgaagtggagaggctgaaggggttgctgcagtctggtcagatccctggcagagaacgcagatcagggcccactgatgatggtgaagaagagatggaagaagacacagtcacaaacgggtcctgagcagtgaggcagatgtataataataggccctcttggaacaagtcttgcttttcgaacatggtataatagccttgtttgtgttagcaaagtggaatctatcagcattgttgaaatgcttaagactgctgctgataattttgtaatataagttttgaaatctaaatgtcaattttctacaaattataaaaataaactccactcactatgctac

SEQ ID NO: 315003 - DNA, 754 bp, Homo sapiens
  misc_feature (18)..(18): n is a, c, g, or t
  misc_feature (34)..(34): n is a, c, g, or t
  misc_feature (39)..(40): n is a, c, g, or t
cagcgggggcaaacttanggctaggtacgaggcngggtnngccacgggctttccacagcgcgggggaacgggaggctgcaggatggtcaagctgacggcggagctgatcgagcaggcggcgcagtacaccaacgcggtgcgcgaccgggagctggacctccgggggtgatctggaccctctggcatctctcaaatcgctgacttacctaagtatcctaagaaatccggtaaccaataagaagcattacagattgtatgtgatttataaagttccgcaagtcagagtactggatttccagaaagtgaaactaaaattttaatccaggtgctggtttgccaactgacaaaaagaaaggtgggccatctccaggggatgtagaagcaatcaagaatgccatagcaaatgcttcaactctggctgaagtggagaggctgaaggggttgctgcagtctggtcagatccctggcagagaacgcagatcagggcccactgatgatggtgaagaagagatggaagaagacacagtcacaaacgggtcctgagcagtgaggcagatgtataataataggccctcttggaacaagtcttgcttttcgaacatggtataatagccttgtttgtgttagcaaagtggaatctatcagcattgttgaaatgcttaagactgctgctgataattttgtaatataagttttgaaatctaaatgtcaattttctacaaattataaaaataaactccactcactatgctac

SEQ ID NO: 315004 - DNA, 2349 bp, Homo sapiens
gtgctgcctggcggcggggcgcggggcacgctgggacgtctcgctggcgggaggccacgggctttccacagcgcgggggaacgggaggctgcaggatggtcaagctgacggcggagctgatcgagcaggcggcgcagtacaccaacgcggtgcgcgaccgggagctggacctccgggggtataaaattcccgtcattgaaaatctaggtgctacgttagaccagtttgatgctattgatttttctgacaatgagatcaggaaactggatggttttcctttgttgagaagactgaaaacattgttagtgaacaacaacagaatatgccgtataggtgagggacttgatcaggctctgccctgtctgacagaactcattctcaccaataatagtctcgtggaactgggtgatctggaccctctggcatctctcaaatcgctgacttacctaagtatcctaagaaatccggtaaccaataagaagcattacagattgtatgtgatttataaagttccgcaagtcagagtactggatttccagaaagtgaaactaaaagtaagtagtaatctgttgcttgtgagccaccgcgcctggccgaagactgttttcatctaataacaccaaggtgttacttgctttagtatgaacatttgcactgatggagcaatagtgggtagaactgcgggcacctcagtaggagtcaaggcagcagcctaaataatagctgttacattcttccctgctctgcactcccagtagcgtgcataccagtttcacttaagagtgtcctggatgcagcagtaaagataattaaatatcactcctcgggcacacgtctctttgatattctgggtgacagaaagggggtgcacatgtctgcattcttgagttaggtggttatctccatgcactggtgcagttgtttcagttgagaggcagctacctgtcttctcaaacatgatgaagtgagcctgtcacttcagggaaaacaattgaaaattcaaggtttaaagcaaaaattaaaatttagaaaacttgtatccactgccgtaacctgccagcttcccagtactttaagacttttctggggaactcaatagtaatgttatgtgcatgtgaattaatgggtgtgacatttttgatgtgtaattacatggctcaacgtttggaagatctgcaaaagtcggtgaaccacagttttccaaatgatacgaaatcatgtacgggtaaaagatttgttcaaagtacaagataaaccaagtaagagtatgaaaagttcattgataaggtttcagacttttacactgccatctaaccttgaggaagctaccatttgtcaagttttagcatagtatctaaaaagagcatccaccattatctgcacaggctgttaaaatcttcctcccttttctaactgtgtgcctgtgtggccagattttcttcatgcccgtcaatcaaaatgccgtattgcacaggatggaatgatgaaaccaatacaataattcagctgactgatgttaagtcagacattaagtcaacaataacaattgtttcccaaacaattgaaggagttacaacttttttttccccctggaatacattgagcaaaatacctgccataaattgttgaacaaatgtaacattttttggtagttgttggcatatttccctaatttagagacaataaagtcattgaactgttgccagtatatggcatgtagtaggtgcccagatgtttttgagtatttccggtttctttgcctacggtagtgccatgaaaagcacatgagtataggctttaccttcaccaaaaatgaattattatcaactacaatgggaggcaacaattttgaaatctttgtgacccttttcctttgaaattgagcatcccttccagtacctgccaaagacagactagaccgtccctggacgataagctcctcaaaggcaggtgctgcttttgatctttttgtacctacttcagtgtgtaacaaacagtggccacagaacaaacacttgcatgctaagggaatggattctctaaaattgatactacttttgctttggtggttttctttagggcccactgatgatggtgaagaagagatggaagaagacacagtcacaaacgggtcctgagcagtgaggcagatgtataataataggccctcttggaacaagtcttgcttttcgaacatggtataatagccttgtttgtgttagcaaagtggaatctatcagcattgttgaaatgcttaagactgctgctgataattttgtaatataagttttgaaatctaaatgtcaattttctacaaattataaaaataaactccactcactatgctac

SEQ ID NO: 315005 - DNA, 832 bp, Homo sapiens
gtgctgcctggcggcggggcgcggggcacgctgggacgtctcgctggcgggaggccacgggctttccacagcgcgggggaacgggaggctgcaggatggtcaagctgacggcggagctgatcgagcaggcggcgcagtacaccaacgcggtgcgcgaccgggagctggacctccgggggtataaaattcccgtcattgaaaatctaggtgctacgttagaccagtttgatgctattgatttttctgacaatgagatcaggaaactggatggttttcctttgttgagaagactgaaaacattgttagtgaacaacaacagaatatgccgtataggtgagggacttgatcaggctctgccctgtctgacagaactcattctcaccaataatagtctcgtggaactggtaagttgcacagaaggaaaatgtatttggtgggtggggttaaaggtactatgtgcttcctacagaaaatttacaaaatctagaaaatgatctcagtatcctctttcttgtctttttcttaattcaggatctgggccttttgggttctgcagccgtatgttgcaaatattttcctacttttacttgacttttgacttaggatgtcttgttagagaagttcctaatttaggtgcagtccaatgaatcaatcttcttctttattgtagcccttttgatgtttaaatttcccctattccagggttataaactcctatgttgttttctacaattgcagtgttcaatatagtaccagtaactacaggtggctacttataattgagatgtgctagaactataaaatacacactggatttcaaagacttaagtgc

SEQ ID NO: 315006 - DNA, 3884 bp, Homo sapiens
gaattccggcccccgtgtctgggcgtccgcctcctggcctcctggctgaggggaagctgagtgggccacggcccatgtgtcgcactcgcctcggctcccacacagccgcctctgctccagcaaggatgtggctcttccacactctgctctgcatagccagcctggccctgctggccgctttcaatgtggatgtggcccggccctggctcacgcccaagggaggtgcccctttcgtgctcagctcccttctgcaccaagaccccagcaccaaccagacctggctcctggtcaccagccccagaaccaagaggacaccagggcccctccatcgatgttcccttgtccaggatgaaatcctttgccatcctgtagagcatgtccccatccccaaggggaggcaccggggagtgaccgttgtccggagccaccacggtgttttgatatgcattcaagtgctggtccggcggcctcacagcctcagctcagaactcacaggcacctgtagcctcctgggccctgacctccgtccccaggctcaggccaacttcttcgaccttgaaaatctcctggatccagatgcacgtgtggacactggagactgctacagcaacaaagaaggcggtggagaagacgatgtgaacacagccaggcagcgccgggctctggagaaggaggaggaggaagacaaggaggaggaggaagacgaggaggaggaggaagctggcaccgagattgccatcatcctggatggctcaggaagcattgatcccccagactttcagagagccaaagacttcatctccaacatgatgaggaacttctatgaaaagtgttttgagtgcaactttgccttggtgcagtatggaggagtgatccagactgagtttgaccttcgggacagccaggatgtgatggcctccctcgccagagtccagaacatcactcaagtggggagtgtcaccaagactgcctcagccatgcaacacgtcttagacagcatcttcacctcaagccacggctccaggagaaaggcatccaaggtcatggtggtgctcaccgatggtggcatattcgaggaccccctcaaccttacgacagtcatcaactcccccaaaatgcagggtgttgagcgctttgccattggggtgggagaagaatttaagagtgctaggactgcgagggaactgaacctgatcgcctcagacccggatgagacccatgctttcaaggtgaccaactacatggcgctggatgggctgctgagcaaactgcggtacaacatcatcagcatggaaggcacggttggagacgcccttcactaccagctggcacagattggcttcagtgctcagatcctggatgagcggcaggtgctgctcggcgccgtcggggcctttgactggtccggaggggcgttgctctacgacacacgcagccgccggggccgcttcctgaaccagacagcggcggcggcggcagacgcggaggctgcgcagtacagctacctgggttacgctgtggccgtgctgcacaagacctgcagcctctcctacgtcgcgggggctccacagtacaaacatcatggggccgtgtttgagctccagaaggagggcagagaggccagcttcctgccagtgctggagggagagcagatggggtcctattttggctctgagctgtgccctgtggacattgacatggatggaagcacggacttcttgctggtggctgctccattttaccacgttcatggagaagaaggcagagtctacgtgtaccgtctcagcgagcaggatggttctttctccttggcacgcatactgagtgggcaccccgggttcaccaatgcccgctttggctttgccatggcggctatgggggatctcagtcaggataagctcacagatgtggccatcggggcccccctggaaggttttggggcagatgatggtgccagcttcggcagtgtgtatatctacaatggacactgggacggcctctccgccagcccctcgcagcggatcagagcctccacggtggccccaggactccagtacttcggcatgtccatggctggtggctttgatattagtggcgacggccttgccgacatcaccgtgggcactctgggccaggcggttgtgttccgctcccggcctgtggttcgcctgaaggtctccatggccttcacccccagcgcactgcccatcggcttcaacggcgtcgtgaatgtccgtttatgttttgaaatcagctctgtaaccacagcctctgagtcaggcctccgtgaggcacttctcaacttcacgctggatgtggatgtggggaagcagaggagacggctgcagtgttcagacgtaagaagctgtctgggctgcctgagggagtggagcagcggatcccagctttgtgaggacctcctgctcatgcccacagagggagagctctgtgaggaggactgcttctccaatgccagtgtcaaagtcagctaccagctccagacccctgagggacagacggaccatccccagcccatcctggaccgctacactgagccctttgccatcttccagctgccctatgagaaggcctgcaagaataagctgttttgtgtcgcagaattacagttggccaccaccgtctctcagcaggagttggtggtgggtctcacaaaggagctgaccctgaacattaacctaactaactccggggaagattcctacatgacaagcatggccttgaattaccccagaaacctgcagttgaagaggatgcaaaagcctccctctccaaacattcagtgtgatgaccctcagccggttgcttctgtcctgatcatgaactgcaggattggtcaccccgtcctcaagaggtcatctgctcatgtttcagtcgtttggcagctagaggagaatgcctttccaaacaggacagcagacatcactgtgactgtcaccaattccaatgaaagacggtctttggccaacgagacccacacccttcaattcaggcatggcttcgttgcagttctgtccaaaccatccataatgtacgtgaacacaggccaggggctttctcaccacaaagaattcctcttccatgtacatggggagaacctctttggagcagaataccagttgcaaatttgcgtcccaaccaaattacgaggtctccaggttgcagcagtgaagaagctgacgaggactcaggcctccacggtgtgcacctggagtcaggagcgcgcttgtgcgtacagttcggttcagcatgtggaagaatggcattcagtgagctgtgtcatcgcttcagataaagaaaatgtcaccgtggctgcagagatctcctgggatcactctgaggagttactaaaagatgtaactgaactgcagatccttggtgaaatatctttcaacaaatctctatatgagggactgaatgcagagaaccacagaactaagatcactgtcgtcttcctgaaagatgagaagtaccattctttgcctatcatcattaaaggcagcgttggtggacttctggtgttgatcgtgattctggtcatcctgttcaagtgtggcttttttaaaagaaaatatcaacaactgaacttggagagcatcaggaaggcccagctgaaatcagagaatctgctcgaagaagagaattaggacctgctatccactgggagaggctatcagccagtcctgggacttggagacccagcatcctttgcattactttttccttcaggatgatctagagcagcatggagctgttggtagaatattagtttttaaccatacattgtcccaaaagtgtctgtgcattgtgcaaaaagtaaacttaggaaacatttggtattaaataaatttacacttttctttgca

SEQ ID NO: 315007 - DNA, 649 bp, Homo sapiens
gagaatcgcttgaacctgacggggtggaggttgcagtgagccgagatcgcaccacttcactccagcctgggcgaaagagcgaaactccatctcaaaaaaaaaaaaaaggaagttgaagaataactgcagatgtcttgtttgggtaactttatgtagtgttgtgtacgttagggccattaactaagcccaggaatacctttaaagggaaaggtggtgaaggctgttcaaacacagtgagttcatgtctaaaatatgttttgtttccctcattcctttccccatcttctagttactaaaagatgtaactgaactgcagatccttggtgaaatatctttcaacaaatctctatatgagggactgaatgcagagaaccacagaactaaggtaattcctggctggcttctgagtagtgcccaaggaaaattgtgcctaacctttgagcacctccacagacattctgttgccctcttcctgttttcagccttaacacttctgatcttggctctgccatcgctgcctttgtgacctttgagtgagtcagcttcttatgaaataaggcaattaagaggcctaagctgaggagttctgagttgaaataactaggctggaatctgcagtatatactttgatttgaaaatggattgatta

SEQ ID NO: 315008 - DNA, 750 bp, Homo sapiens
  misc_feature (672)..(672): n is a, c, g, or t
  misc_feature (750)..(750): n is a, c, g, or t
ctagctcccggccctgcgcatgcgcacctcgccagggccggggccgggacgggacggaaaactggcggcttggtttgttcagcgcgtcgcggtcatggctctcgtttcaggcctccacggtgtgcacctggagtcaggagcgcgcttgtgcgtacagttcggttcagcatgtggaagaatggcattcagtgagctgtgtcatcgcttcagataaagaaaatgtcaccgtggctgcagagatctcctgggatcactctgaggagttactaaaagatgtaactgaactgcagatccttggtgaaatatctttcaacaaatctctatatgagggactgaatgcagagaaccacagaactaagatcactgtcgtcttcctgaaagatgagaagtaccattctttgcctatcatcattaaaggcagcgttggtggacttctggtgttgatcgtgattctggtcatcctgttcaagtgtggcttttttaaaagaaaatatcaacaactgaacttggagagcatcaggaaggcccagctgaaatcagagaatctgctcgaagaagagaattaggacctgctatccactgggagaggctatcagccagtcctgggacttggagacccagcatcctttgcattactttttccttcaggatgatctagaagcaaccatgggnaacctgtttgggttaaaaataattaagtttttttaaacccattaccatttgttccccaaaaaagttgttctggttgcn

SEQ ID NO: 315009 - DNA, 593 bp, Homo sapiens
ctagctcccggccctgcgcatgcgcacctcgccagggccggggccgggacgggacggaaaactggcggcttggtttgttcagcgcgtcgcggtcatggctctcgtttcaggcctccacggtgtgcacctggagtcaggagcgcgcttgtgcgtacagttcggttcagatcactgtcgtcttcctgaaagatgagaagtaccattctttgcctatcatcattaaaggcagcgttggtggacttctggtgttgatcgtgattctggtcatcctgttcaagtgtggcttttttaaaagaaaatatcaacaactgaacttggagagcatcaggaaggcccagctgaaatcagagaatctgctcgaagaagagaattaggacctgctatccactgggagaggctatcagccagtcctgggacttggagacccagcatcctttgcattactttttccttcaggatgatctagagcagcatggagctgttggtagaatattagtttttaaccatacattgtcccaaaagtgtctgtgcattgtgcaaaaagtaaacttaggaaacatttggtattaaataaatttacacttttctttgca

SEQ ID NO: 315010 - DNA, 621 bp, Homo sapiens
tgggtgattggatagttttagatgatctaaaatgctgcatcagggaatatctagctttttgctttactgtcatcagctttgatcaatacacgggttgttgccaagtcctcgtattttgctccttaaaataacatgtaggattttttcctcgtttgcttcacctgatttattgggcgatctctttgtcttgtctagatcactgtcgtcttcctgaaagatgagaagtaccattctttgcctatcatcattaaaggcagcgttggtggacttctggtgttgatcgtgattctggtcatcctgttcaagtgtggcttttttaaaagaaaatatcaacaactgaacttggagagcatcaggaaggcccagctgaaatcagagaatctgctcgaagaagagaattaggacctgctatccactgggagaggctatcagccagtcctgggacttggagacccagcatcctttgcattactttttccttcaggatgatctagagcagcatggagctgttggtagaatattagtttttaaccatacattgtcccaaaagtgtctgtgcattgtgcaaaaagtaaacttaggaaacatttggtattaaataaatttacacttttctttgca

SEQ ID NO: 315011 - DNA, 552 bp, Homo sapiens
ggttcaactgctcgggagagcagggttcagaggaaggtggagtcagttctgattgagggatgagcaccagaggtcttgaaggattggactctccaggagagattcagagtaagttaggagaagggagtagtaagtatgagaagcagaggaatataggggctatttaggcaacagccagaatgccagttttctgaaacagatggctatctttggcctgtaactggacttttccttcctttgtttcagtgtggcttttttaaaagaaaatatcaacaactgaacttggagagcatcaggaaggcccagctgaaatcagagaatctgctcgaagaagagaattaggacctgctatccactgggagaggctatcagccagtcctgggacttggagacccagcatcctttgcattactttttccttcaggatgatctagagcagcatggagctgttggtagaatattagtttttaaccatacattgtcccaaaagtgtctgtgcattgtgcaaaaagtaaacttaggaaacatttggtattaaataaatttacactt

SEQ ID NO: 315012 - DNA, 689 bp, Homo sapiens
ctagctcccggccctgcgcatgcgcacctcgccagggccggggccgggacgggacggaaaactggcggcttggtttgttcagcgcgtcgcggtcatggctctcgtttcaggcctccacggtgtgcacctggagtcaggagcgcgcttgtgcgtacagttcggttcagttactaaaagatgtaactgaactgcagatccttggtgaaatatctttcaacaaatctctatatgagggactgaatgcagagaaccacagaactaagatcactgtcgtcttcctgaaagatgagaagtaccattctttgcctatcatcattaaaggcagcgttggtggacttctggtgttgatcgtgattctggtcatcctgttcaagtgtggcttttttaaaagaaaatatcaacaactgaacttggagagcatcaggaaggcccagctgaaatcagagaatctgctcgaagaagagaattaggacctgctatccactgggagaggctatcagccagtcctgggacttggagacccagcatcctttgcattactttttccttcaggatgatctagagcagcatggagctgttggtagaatattagtttttaaccatacattgtcccaaaagtgtctgtgcattgtgcaaaaagtaaacttaggaaacatttggtattaaataaatttacacttttctttgca

SEQ ID NO: 315013 - DNA, 822 bp, Homo sapiens
  misc_feature (705)..(705): n is a, c, g, or t
ctagctcccggccctgcgcatgcgcacctcgccagggccggggccgggacgggacggaaaactggcggcttggtttgttcagcgcgtcgcggtcatggctctcgtttcaggcctccacggtgtgcacctggagtcaggagcgcgcttgtgcgtacagttcggttcagttactaaaagatgtaactgaactgcagatccttggtgaaatatctttcaacaaatctctatatgagggactgaatgcagagaaccacagaactaagatcactgtcgtcttcctgaaagatgagaagtaccattctttgcctatcatcattaaaggcagcgttggtggacttctggtgttgatcgtgattctggtcatcctgttcaagtgtggcttttttaaaagaaaatatcaacaactgaacttggagagcatcaggaaggcccagctgaaatcagagaatctgctcgaagaagagaattaggacctgctatccactgggagaggctatcagccagtcctgggacttggagacccagcatcctttgcattactttttccttcaggatgatctagagcagcatggagctgttggtagaatattagtttttaaccatacattgtcccaaaagtgtctgtgcattgtgcaaaaagtaaacttaggaaacatttggtattaaataaatttacacttttctttgcaaaaaaaaaaaaaaaanaaaatttgggggcggcctgaaattttaacattgtgggggggcgccgagaaatggggtcgggaacgggaggggggtcccaaaaagcggggcggggtgaaccagggtgggcggtaggcc

SEQ ID NO: 315014 - DNA, 3611 bp, Homo sapiens
gaattccggcccccgtgtctgggcgtccgcctcctggcctcctggctgaggggaagctgagtgggccacggcccatgtgtcgcactcgcctcggctcccacacagccgcctctgctccagcaaggatgtggctcttccacactctgctctgcatagccagcctggccctgctggccgctttcaatgtggatgtggcccggccctggctcacgcccaagggaggtgcccctttcgtgctcagctcccttctgcaccaagaccccagcaccaaccagacctggctcctggtcaccagccccagaaccaagaggacaccagggcccctccatcgatgttcccttgtccaggatgaaatcctttgccatcctgtagagcatgtccccatccccaaggggaggcaccggggagtgaccgttgtccggagccaccacggtgttttgatatgcattcaagtgctggtccggcggcctcacagcctcagctcagaactcacaggcacctgtagcctcctgggccctgacctccgtccccaggctcaggccaacttcttcgaccttgaaaatctcctggatccagatgcacgtgtggacactggagactgctacagcaacaaagaaggcggtggagaagacgatgtgaacacagccaggcagcgccgggctctggagaaggaggaggaggaagacaaggaggaggaggaagacgaggaggaggaggaagctggcaccgagattgccatcatcctggatggctcaggaagcattgatcccccagactttcagagagccaaagacttcatctccaacatgatgaggaacttctatgaaaagtgttttgagtgcaactttgccttggtgcagtatggaggagtgatccagactgagtttgaccttcgggacagccaggatgtgatggcctccctcgccagagtccagaacatcactcaagtggggagtgtcaccaagactgcctcagccatgcaacacgtcttagacagcatcttcacctcaagccacggctccaggagaaaggcatccaaggtcatggtggtgctcaccgatggtggcatattcgaggaccccctcaaccttacgacagtcatcaactcccccaaaatgcagggtgttgagcgctttgccattggggtgggagaagaatttaagagtgctaggactgcgagggaactgaacctgatcgcctcagacccggatgagacccatgctttcaaggtgaccaactacatggcgctggatgggctgctgagcaaactgcggtacaacatcatcagcatggaaggcacggttggagacgcccttcactaccagctggcacagattggcttcagtgctcagatcctggatgagcggcaggtgctgctcggcgccgtcggggcctttgactggtccggaggggcgttgctctacgacacacgcagccgccggggccgcttcctgaaccagacagcggcggcggcggcagacgcggaggctgcgcagtacagctacctgggttacgctgtggccgtgctgcacaagacctgcagcctctcctacgtcgcgggggctccacagtacaaacatcatggggccgtgtttgagctccagaaggagggcagagaggccagcttcctgccagtgctggagggagagcagatggggtcctattttggctctgagctgtgccctgtggacattgacatggatggaagcacggacttcttgctggtggctgctccattttaccacgttcatggagaagaaggcagagtctacgtgtaccgtctcagcgagcaggatggttctttctccttggcacgcatactgagtgggcaccccgggttcaccaatgcccgctttggctttgccatggcggctatgggggatctcagtcaggataagctcacagatgtggccatcggggcccccctggaaggttttggggcagatgatggtgccagcttcggcagtgtgtatatctacaatggacactgggacggcctctccgccagcccctcgcagcggatcagagcctccacggtggccccaggactccagtacttcggcatgtccatggctggtggctttgatattagtggcgacggccttgccgacatcaccgtgggcactctgggccaggcggttgtgttccgctcccggcctgtggttcgcctgaaggtctccatggccttcacccccagcgcactgcccatcggcttcaacggcgtcgtgaatgtccgtttatgttttgaaatcagctctgtaaccacagcctctgagtcaggcctccgtgaggcacttctcaacttcacgctggatgtggatgtggggaagcagaggagacggctgcagtgttcagacgtaagaagctgtctgggctgcctgagggagtggagcagcggatcccagctttgtgaggacctcctgctcatgcccacagagggagagctctgtgaggaggactgcttctccaatgccagtgtcaaagtcagctaccagctccagacccctgagggacagacggaccatccccagcccatcctggaccgctacactgagccctttgccatcttccagctgccctatgagaaggcctgcaagaataagctgttttgtgtcgcagaattacagttggccaccaccgtctctcagcaggagttggtggtgggtctcacaaaggagctgaccctgaacattaacctaactaactccggggaagattcctacatgacaagcatggccttgaattaccccagaaacctgcagttgaagaggatgcaaaaggctcatgtttcagtcgtttggcagctagaggagaatgcctttccaaacaggacagcagacatcactgtgactgtcaccaaaccatccataatgtacgtgaacacaggccaggggctttctcaccacaaagaattcctcttccatgtacatggggagaacctctttggagcagaataccagttgcaaatttgcgtcccaaccaaattacgaggtctccaggttgcagcagtgaagaagctgacgaggactcaggcctccacggtgtgcacctggagtcaggagcgcgcttgtgcgtacagttcggttcagttactaaaagatgtaactgaactgcagatccttggtgaaatatctttcaacaaatctctatatgagggactgaatgcagagaaccacagaactaagatcactgtcgtcttcctgaaagatgagaagtaccattctttgcctatcatcattaaaggcagcgttggtggacttctggtgttgatcgtgattctggtcatcctgttcaagtgtggcttttttaaaagaaaatatcaacaactgaacttggagagcatcaggaaggcccagctgaaatcagagaatctgctcgaagaagagaattaggacctgctatccactgggagaggctatcagccagtcctgggacttggagacccagcatcctttgcattactttttccttcaggatgatctagagcagcatggagctgttggtagaatattagtttttaaccatacattgtcccaaaagtgtctgtgcattgtgcaaaaagtaaacttaggaaacatttggtattaaataaatttacacttttctttgca

SEQ ID NO: 315015 - DNA, 1020 bp, Homo sapiens
ttttgaaactgaaagaagtagcattttggcatgatctggagctgacatacattccagaggctatatagatgatgacatctaccagtgaggctacatgactgacgtagaaactgaggttctttcgctagtctaggacaaagatgaagcttaacttcactgatggatagaaccagactttgtcactgtttaaataatacatttttggttgttttctaaatatgaattcggttcactctgaaattagagcagttccatgagttcactgaatttatttgaacaatagtgtttgccatggtttgaatgatggtatctgctccaaaattcatgttgaaatttaaccctcaatgcaacagtgttaaaaggtgtagttggcctgtgggaggttattaaattatgacagagcttcactatcataaataggattaacgccttatgaagtggctcaaggtcgaaaggcgcaccttcttgcccttccactcttctaccctgtgaggacacggcgtttatctcttgcccttctgccatttgaagatacagtattgctcccctcagaggaggcagcaataaagtgccatgttggaagcagagagcaacccatatcagatgccagtcctgctagccccttaatcttagacttctcagtctctagaaccatgagaaataaatttgtattgtttgtaaattaccgattctatggaatttttgttacagcagcacaaatggtctgacagtgttcttctttaaaaaggaataatgttcatggatacagctctattgttcctggaattcttggggaagattctttggagttttgtggagttatatataacttactaggttgtccttgccatatttttatgatggtgagtgaacacagtatacctatgggtgagattagaataaaatagagatttttatttgtgtattacatatttagccaacatttattgtctactatatgctattctatttaaaatgttttcacttttcctgcttcttatctccttgtttccttgtaca

SEQ ID NO: 315016 - DNA, 1262 bp, Homo sapiens
tgccactcggtgtcctcccgcggaggggcgtagggtgtaaacaggcgacgcgctgggggaggtgcggccttgctgcgtccacgtctcgggcatgctcgaggcgggccagggcggtagcgccgccagctcagagcccacctgaggtaactcctgcggcctctaggatcggagtcccccacgccgcgcgcagccgccgccgctggccgccaataagggcggccgagcccccggcccgggcagggggtgtggctgccggcagcgcgtcggctacaggtgggctgggctgggctgggctgggctgggctgggtgggggcggccgccaaggacccatccctgcgctgcgggcccggcgtggagcccgcggagaggcagcgcgactccaggcagtgggtctctctgccccggtgctcgcgtctgcccctggggccgggccgagcggaaccaggaatcgcagaaacggtcagcgcccagggctctaggccggccgccccgggtgccaggtgaattcctttccctgaccggctgtgagacgttggcccgtcagccgtcgtctttggcctgagtgtgcacatctgtaaaatggaagctcggactagtgatccgtgaggaccttccacgtctgacgtgtgatctcgagagacctgcgtacattcggggtgccagaaggaaagcatagcttgaaatccatggcccaaaatgactctaccagtggagactctcttctgtgaagaagacgaccagataagaggttgggatgagcatgccactgcatcagatctctgccattccatcccaggatgccatctctgctagagtctacagaagtaagaccaaagaaaaggagagggaagaacagaatgagaagactttgggacatttcatgagtcattcaagcaacatttctaaggctgggagtcctccgtcagcatcagctccggctccggtgtcctccttctctcgcacttctatcacgccatccagccaggacatctgcagttccagtgcagtgttttctgagtgttgtcaccacagttccgtgcagtctgctgttgtctcgaaagctcctcactgccagagttctctgacacaagggctcactgtgacagttatctgtaaggacacattacaggcgtcaaagagaaattcctttggttcagaatgggcccaggccttgaagcctgctaagaataccaaagccagaagaacactaaagttctcaaggtccctcaatgatgtgggtgagaaggcgcaggatacttca

SEQ ID NO: 315017 - DNA, 751 bp, Homo sapiens
agcggatggtaggtatagggctgtggatatcgtcagtttgaccaagtattccaagaggccccatggagtttgtcatctgtaatagaggacgttagtgcattagtgatgaaaaaactgcttaccactgactattgtgatctcccagggagtataaggcagctccgcacttgaaatccatggcccaaaatgactctaccagtggagactctcttctgtgaagaagacgaccagataagaggttgggatgagcatgccactgcatcagatctctgccattccatcccaggatgccatctctgctagagtctacagaagtaagaccaaagaaaaggagagggaagaacagaatgagaagactttgggacatttcatgagtcattcaagcaacatttctaaggctgggagtcctccgtcagcatcagctccggctccggtgtcctccttctctcgcacttctatcacgccatccagccaggacatctgcagttccagtgcagtgttttctgagtgttgtcaccacagttccgtgcagtctgctgttgtctcgaaagctcctcactgccagagttctctgacacaagggctcactgtgacagttatctgtaaggacacattacaggcgtcaaagagaaattcctttggttcagaatgggcccaggccttgaagcctgctaagaataccaaagccagaagaacactaaagttctcaaggtccctcaatgatgtgggtgagaaggcgcaggatacttca

SEQ ID NO: 315018 - DNA, 5388 bp, Homo sapiens
tgccactcggtgtcctcccgcggaggggcgtagggtgtaaacaggcgacgcgctgggggaggtgcggccttgctgcgtccacgtctcgggcatgctcgaggcgggccagggcggtagcgccgccagctcagagcccacctgaggtaactcctgcggcctctaggatcggagtcccccacgccgcgcgcagccgccgccgctggccgccaataagggcggccgagcccccggcccgggcagggggtgtggctgccggcagcgcgtcggctacaggtgggctgggctgggctgggctgggctgggctgggtgggggcggccgccaaggacccatccctgcgctgcgggcccggcgtggagcccgcggagaggcagcgcgactccaggcagtgggtctctctgccccggtgctcgcgtctgcccctggggccgggccgagcggaaccaggaatcgcagaaacggtcagcgcccagggctctaggccggccgccccgggtgccaggtgaattcctttccctgaccggctgtgagacgttggcccgtcagccgtcgtctttggcctgagtgtgcacatctgtaaaatggaagctcggactagtgatccgtgaggaccttccacgtctgacgtgtgatctcgagagacctgcgtacattcggggtgccagaaggaaagcatagagatggggtcttgctgtgttgcccagactggtctcaaactcctggcctcaagtgatccttctgcctcagcttcccaaagtactgggattacagcttgaaatccatggcccaaaatgactctaccagtggagactctcttctgtgaagaagacgaccagataagaggttgggatgagcatgccactgcatcagatctctgccattccatcccaggatgccatctctgctagagtctacagaagtaagaccaaagaaaaggagagggaagaacagaatgagaagactttgggacatttcatgagtcattcaagcaacatttctaaggctgggagtcctccgtcagcatcagctccggctccggtgtcctccttctctcgcacttctatcacgccatccagccaggacatctgcaggatctgccactgtgaaggagatgatgagagccccctgatcaccccctgccactgcacaggaagcctccacttcgtgcaccaggcctgcctgcagcagtggatcaagagctccgacacgcgctgctgcgagctctgcaagtatgagttcatcatggagaccaagctgaagccactgagaaaatgggagaagttgcagatgacgtccagcgagcgcaggaagatcatgtgctcagtgacattccacgtcattgccatcacatgtgtggtctggtccttgtatgtgctcattgaccgtactgctgaggagatcaagcaggggcaggcaacaggaatcctagaatggcccttttggactaaattggtggttgtggccatcggcttcaccggaggacttctttttatgtatgttcagtgtaaagtgtatgtgcaattgtggaagagactcaaggcctataatagagtgatctatgttcaaaactgtccagaaacaagcaaaaagaatatttttgaaaaatctccactaacagagcccaactttgaaaataaacatggatatggaatctgtcattccgacacaaactcttcttgttgcacagagcctgaagacactggagcagaaatcattcacgtctgattgtgtgcgggttgtcattttcctggacatccatgaagagctgaaggaaattgtttactgccaattgtatacctttcttatgtcctttaatagcatagactggacaggtgactatttatagtggcttctctttttctaaaccctccttagtctcctagaaaaccttcctgtgggccaggcatgcctgggtcctgcctctgcctggcagctctgtgggaaagtggaagaccccatgatgacatcatggggagccagcagagttcctgcccatggtcttgagctgaatgagagaataaaatgccaatcccaagggaagaggaggagcaggggtgcccaggccctgatacccagccgcctccagcttgcagtggtccccagcctggagcagagcattggggagtgtctagccatgacgagaagattccctctgcatcacggcgaaccccaggagatggtattgaaacagacccccaaacacagactcctgcctgccctctgccgatgctgcctcctccatgctcttgagcaggtggagccatggtgctctgtggtggcgcatgattcactgagcaaacagcactttacagaagaaaatctttattttgtaatatgtgtgtccagcgggattgacactcaaaaaaagtctcacttagaaatcttcccttccttacctttgtatctcctttacatcatgagagatcaaaaatccattttgccttacatatgctaagaagcgtggcattctttctgttcataaaacagactcatgacttttaagacaggacaagcaggccagaggctttttttttaatcacagatctcatgggaattagtggatgctaaatggcaattaaagcatgattcctatgcttttgagcctgttttatgacaaggtgttactttgtagacctggcccatacatttcttttttgtcaacactgaaaaagaacagtttctgagatcgaaatggaaggaaaggaagtgagtaatgacaacaaaactgaatatttaaaaaatattcctttatagttaaatctctccagttggtgttggcttcacattgaaagagcagccatgtgccaccctggccggggtgtgtgcactgcatgcaggttctcccttgcatgcaagatgggtgctggcccactgtgaggcttctgctcggggaagttctgtggagtcactaccagggccaagaggcaggtgggctggctctgggacgagggccaggtgtgagcaaactgccagggtccgctgtgccactgctccccggccacatgcccgcccagctgtcgccttaaccagactgaacagacaggatccttcagggcccttggccccactctcagtgcattctgtcatcagggattaccacctgtaccattttcataaaacaaaaccaaaatcactaccatcaaatggccttgtccctctaaaaagtctgcttaaaattctgtttttaaaacccagtttcctagttttccaggcaaatagttacctccgggaaagttgctgggggggcctgaagcacaatgtagcgcagatgcttcctttccaggccattctctcacccagcctgcacggaggagatgggagatgctgggggtcctgccctcagtctttttgggccttaggcgtttcgttcatcctgctaaggggatgaagcaaacacgaggtgattcctttgcctttcagagtggaagccctggagtttgttttgaaggccaggaggctgaaggatctctaagctacggtgtgggcttaatagcagcaggctttgtcctcctgtctcctccaagccagtgtctgattccttggcaacacaggtcttagtctgtggagtggctctgctgtggccttcctctggccgggcaggcactgtccagccatagccagctcctgagaataggtcagcctctcctttctgtctcccagggcacatccagcccgtgcctgtgttcactgtgccccgaagtgcaattacccataccccttctcagcctggggaccccaggcaaccacagactgtccactcaggggagctgaatcccaggtcagccctgccaatgtcccttaggaactgcccaggcaaggcccctggttttgtatacttgttcctgccacccagcagtagatgagtgtttcaggtgaagaccaggatagattttctaagtgtgaatccccacttcacatatggaaccccttatgctgaacttgaaaagcaccaagacttcctgtagacaagaaagtgcttaggtagggacagcccctgggcatcccacccaatgtagctggcaccccactatggcaaaggtgccttgataactgagccctgtatccctcccatgcccagccagattctcatgggaagccctctcccttcttttctgcctaacaccatctcatcgtttctggcctcactgtggacaatccacacacattcttctttcctctcctggcggggcacagagccacccccttgccttttcttttcttgaaggttctagttcagctcctgattcatcagacccttctagccccctgcatctagcagtgaagcatgaagcctggtggggatgtggtactcccatctggtgtggccaccagctctgccaatgttcctgtagccttggaaaacttgctctctcggttcttttgggtgctgtgtactccccagcttccccccttccccccccattttgcacctgggtttagtgaaaggatggcatttggttgacccatatagaaacccagaatgaggtctcagggccaggaggcctggtatttgtaggccagggaaggggaagaggcaagtggtctggggtatcaccagccagccctctctgatttggcctctactccccataagtcacagtaccataagcaggcttctggcctcagcaatttggtctttgtgcccaagtttattgtgagaatttcctgaaaactctataaaaggtctcttcctactgtaggcctctaatgtttctcccctttttgcttcagtccactcttcagtcttgtaggcctagttttcaaacctgcacatgtgtcctacctggccacaggcatgcaggcctcaggcagctgggccagtttgggagcctcgggtgatgtctgcacgatctggggctgcctctgcacccctgctgtgggcttcagggttggagaagggctgggaccaaccgggtgagatccacaagtctctggatgtggctgaaggcaaatacacaattgaagtactttctgttttgaagtgctttcccttttgaatctggtttgaaacatgcagcttctgtctctagcccaaggaaagaccaaaacatagggaaataaaagcatttatctttgtcttggaagtaattgttgaagttgtgcagttgatcagtgcacagttagatgcaatgtttatagaaattgattgttaaaccaaatttacactggcatgtgtggtgtagtttctaaaaggcacttcacatttgaaatttttcttaccttagaaagtttctagtgatctaaatgtctagttttgtattcttttgtgtgtgttcactgtttctcagtattaccacttgaataattctctgtacaggggggtttgtgctatacactgggatgtctaattgcagcaataaagcctttctttaaaaaggaaaaaaaaaat

SEQ ID NO: 315019 - DNA, 5349 bp, Homo sapiens
tgccactcggtgtcctcccgcggaggggcgtagggtgtaaacaggcgacgcgctgggggaggtgcggccttgctgcgtccacgtctcgggcatgctcgaggcgggccagggcggtagcgccgccagctcagagcccacctgaggtaactcctgcggcctctaggatcggagtcccccacgccgcgcgcagccgccgccgctggccgccaataagggcggccgagcccccggcccgggcagggggtgtggctgccggcagcgcgtcggctacaggtgggctgggctgggctgggctgggctgggctgggtgggggcggccgccaaggacccatccctgcgctgcgggcccggcgtggagcccgcggagaggcagcgcgactccaggcagtgggtctctctgccccggtgctcgcgtctgcccctggggccgggccgagcggaaccaggaatcgcagaaacggtcagcgcccagggctctaggccggccgccccgggtgccaggtgaattcctttccctgaccggctgtgagacgttggcccgtcagccgtcgtctttggcctgagtgtgcacatctgtaaaatggaagctcggactagtgatccgtgaggaccttccacgtctgacgtgtgatctcgagagacctgcgtacattcggggtgccagaaggaaagcatagagatggggtcttgctgtgttgcccagactggtctcaaactcctggcctcaagtgatccttctgcctcagcttcccaaagtactgggattacagcttgaaatccatggcccaaaatgactctaccagtggagactctcttctgtgaagaagacgaccagataagaggttgggatgagcatgccactgcatcagatctctgccattccatcccaggatgccatctctgctagagtctacagaagtaagaccaaagaaaaggagagggaagaacagaatgagaagactttgggacatttcatgagtcattcaagcaacatttctaaggctgggagtcctccgtcagcatcagctccggctccggtgtcctccttctctcgcacttctatcacgccatccagccaggacatctgcaggatctgccactgtgaaggagatgatgagagccccctgatcaccccctgccactgcacaggaagcctccacttcgtgcaccaggcctgcctgcagcagtggatcaagagctccgacacgcgctgctgcgagctctgcaagtatgagttcatcatggagaccaagctgaagccactgagaaaatgggagaagttgcagatgacgtccagcgagcgcaggaagatcatgtgctcagtgacattccacgtcattgccatcacatgtgtggtctggtccttgtatgtgctcattgaccgtactgctgaggagatcaagcaggggcaggcaacaggaatcctagaatggcccttttggattctttttatgtatgttcagtgtaaagtgtatgtgcaattgtggaagagactcaaggcctataatagagtgatctatgttcaaaactgtccagaaacaagcaaaaagaatatttttgaaaaatctccactaacagagcccaactttgaaaataaacatggatatggaatctgtcattccgacacaaactcttcttgttgcacagagcctgaagacactggagcagaaatcattcacgtctgattgtgtgcgggttgtcattttcctggacatccatgaagagctgaaggaaattgtttactgccaattgtatacctttcttatgtcctttaatagcatagactggacaggtgactatttatagtggcttctctttttctaaaccctccttagtctcctagaaaaccttcctgtgggccaggcatgcctgggtcctgcctctgcctggcagctctgtgggaaagtggaagaccccatgatgacatcatggggagccagcagagttcctgcccatggtcttgagctgaatgagagaataaaatgccaatcccaagggaagaggaggagcaggggtgcccaggccctgatacccagccgcctccagcttgcagtggtccccagcctggagcagagcattggggagtgtctagccatgacgagaagattccctctgcatcacggcgaaccccaggagatggtattgaaacagacccccaaacacagactcctgcctgccctctgccgatgctgcctcctccatgctcttgagcaggtggagccatggtgctctgtggtggcgcatgattcactgagcaaacagcactttacagaagaaaatctttattttgtaatatgtgtgtccagcgggattgacactcaaaaaaagtctcacttagaaatcttcccttccttacctttgtatctcctttacatcatgagagatcaaaaatccattttgccttacatatgctaagaagcgtggcattctttctgttcataaaacagactcatgacttttaagacaggacaagcaggccagaggctttttttttaatcacagatctcatgggaattagtggatgctaaatggcaattaaagcatgattcctatgcttttgagcctgttttatgacaaggtgttactttgtagacctggcccatacatttcttttttgtcaacactgaaaaagaacagtttctgagatcgaaatggaaggaaaggaagtgagtaatgacaacaaaactgaatatttaaaaaatattcctttatagttaaatctctccagttggtgttggcttcacattgaaagagcagccatgtgccaccctggccggggtgtgtgcactgcatgcaggttctcccttgcatgcaagatgggtgctggcccactgtgaggcttctgctcggggaagttctgtggagtcactaccagggccaagaggcaggtgggctggctctgggacgagggccaggtgtgagcaaactgccagggtccgctgtgccactgctccccggccacatgcccgcccagctgtcgccttaaccagactgaacagacaggatccttcagggcccttggccccactctcagtgcattctgtcatcagggattaccacctgtaccattttcataaaacaaaaccaaaatcactaccatcaaatggccttgtccctctaaaaagtctgcttaaaattctgtttttaaaacccagtttcctagttttccaggcaaatagttacctccgggaaagttgctgggggggcctgaagcacaatgtagcgcagatgcttcctttccaggccattctctcacccagcctgcacggaggagatgggagatgctgggggtcctgccctcagtctttttgggccttaggcgtttcgttcatcctgctaaggggatgaagcaaacacgaggtgattcctttgcctttcagagtggaagccctggagtttgttttgaaggccaggaggctgaaggatctctaagctacggtgtgggcttaatagcagcaggctttgtcctcctgtctcctccaagccagtgtctgattccttggcaacacaggtcttagtctgtggagtggctctgctgtggccttcctctggccgggcaggcactgtccagccatagccagctcctgagaataggtcagcctctcctttctgtctcccagggcacatccagcccgtgcctgtgttcactgtgccccgaagtgcaattacccataccccttctcagcctggggaccccaggcaaccacagactgtccactcaggggagctgaatcccaggtcagccctgccaatgtcccttaggaactgcccaggcaaggcccctggttttgtatacttgttcctgccacccagcagtagatgagtgtttcaggtgaagaccaggatagattttctaagtgtgaatccccacttcacatatggaaccccttatgctgaacttgaaaagcaccaagacttcctgtagacaagaaagtgcttaggtagggacagcccctgggcatcccacccaatgtagctggcaccccactatggcaaaggtgccttgataactgagccctgtatccctcccatgcccagccagattctcatgggaagccctctcccttcttttctgcctaacaccatctcatcgtttctggcctcactgtggacaatccacacacattcttctttcctctcctggcggggcacagagccacccccttgccttttcttttcttgaaggttctagttcagctcctgattcatcagacccttctagccccctgcatctagcagtgaagcatgaagcctggtggggatgtggtactcccatctggtgtggccaccagctctgccaatgttcctgtagccttggaaaacttgctctctcggttcttttgggtgctgtgtactccccagcttccccccttccccccccattttgcacctgggtttagtgaaaggatggcatttggttgacccatatagaaacccagaatgaggtctcagggccaggaggcctggtatttgtaggccagggaaggggaagaggcaagtggtctggggtatcaccagccagccctctctgatttggcctctactccccataagtcacagtaccataagcaggcttctggcctcagcaatttggtctttgtgcccaagtttattgtgagaatttcctgaaaactctataaaaggtctcttcctactgtaggcctctaatgtttctcccctttttgcttcagtccactcttcagtcttgtaggcctagttttcaaacctgcacatgtgtcctacctggccacaggcatgcaggcctcaggcagctgggccagtttgggagcctcgggtgatgtctgcacgatctggggctgcctctgcacccctgctgtgggcttcagggttggagaagggctgggaccaaccgggtgagatccacaagtctctggatgtggctgaaggcaaatacacaattgaagtactttctgttttgaagtgctttcccttttgaatctggtttgaaacatgcagcttctgtctctagcccaaggaaagaccaaaacatagggaaataaaagcatttatctttgtcttggaagtaattgttgaagttgtgcagttgatcagtgcacagttagatgcaatgtttatagaaattgattgttaaaccaaatttacactggcatgtgtggtgtagtttctaaaaggcacttcacatttgaaatttttcttaccttagaaagtttctagtgatctaaatgtctagttttgtattcttttgtgtgtgttcactgtttctcagtattaccacttgaataattctctgtacaggggggtttgtgctatacactgggatgtctaattgcagcaataaagcctttctttaaaaaggaaaaaaaaaat

SEQ ID NO: 315020 - DNA, 4772 bp, Homo sapiens
tcttggacatgaaaataaactgacaataccaccggtggtcctagcgcacaatactaatcagagatggggtcttgctgtgttgcccagactggtctcaaactcctggcctcaagtgatccttctgcctcagcttcccaaagtactgggattacagcttgaaatccatggcccaaaatgactctaccagtggagactctcttctgtgaagaagacgaccagataagaggttgggatgagcatgccactgcatcagatctctgccattccatcccaggatgccatctctgctagagtctacagaagtaagaccaaagaaaaggagagggaagaacagaatgagaagactttgggacatttcatgagtcattcaagcaacatttctaaggctgggagtcctccgtcagcatcagctccggctccggtgtcctccttctctcgcacttctatcacgccatccagccaggacatctgcaggatctgccactgtgaaggagatgatgagagccccctgatcaccccctgccactgcacaggaagcctccacttcgtgcaccaggcctgcctgcagcagtggatcaagagctccgacacgcgctgctgcgagctctgcaagtatgagttcatcatggagaccaagctgaagccactgagaaaatgggagaagttgcagatgacgtccagcgagcgcaggaagatcatgtgctcagtgacattccacgtcattgccatcacatgtgtggtctggtccttgtatgtgctcattgaccgtactgctgaggagatcaagcaggggcaggcaacaggaatcctagaatggcccttttggactaaattggtggttgtggccatcggcttcaccggaggacttctttttatgtatgttcagtgtaaagtgtatgtgcaattgtggaagagactcaaggcctataatagagtgatctatgttcaaaactgtccagaaacaagcaaaaagaatatttttgaaaaatctccactaacagagcccaactttgaaaataaacatggatatggaatctgtcattccgacacaaactcttcttgttgcacagagcctgaagacactggagcagaaatcattcacgtctgattgtgtgcgggttgtcattttcctggacatccatgaagagctgaaggaaattgtttactgccaattgtatacctttcttatgtcctttaatagcatagactggacaggtgactatttatagtggcttctctttttctaaaccctccttagtctcctagaaaaccttcctgtgggccaggcatgcctgggtcctgcctctgcctggcagctctgtgggaaagtggaagaccccatgatgacatcatggggagccagcagagttcctgcccatggtcttgagctgaatgagagaataaaatgccaatcccaagggaagaggaggagcaggggtgcccaggccctgatacccagccgcctccagcttgcagtggtccccagcctggagcagagcattggggagtgtctagccatgacgagaagattccctctgcatcacggcgaaccccaggagatggtattgaaacagacccccaaacacagactcctgcctgccctctgccgatgctgcctcctccatgctcttgagcaggtggagccatggtgctctgtggtggcgcatgattcactgagcaaacagcactttacagaagaaaatctttattttgtaatatgtgtgtccagcgggattgacactcaaaaaaagtctcacttagaaatcttcccttccttacctttgtatctcctttacatcatgagagatcaaaaatccattttgccttacatatgctaagaagcgtggcattctttctgttcataaaacagactcatgacttttaagacaggacaagcaggccagaggctttttttttaatcacagatctcatgggaattagtggatgctaaatggcaattaaagcatgattcctatgcttttgagcctgttttatgacaaggtgttactttgtagacctggcccatacatttcttttttgtcaacactgaaaaagaacagtttctgagatcgaaatggaaggaaaggaagtgagtaatgacaacaaaactgaatatttaaaaaatattcctttatagttaaatctctccagttggtgttggcttcacattgaaagagcagccatgtgccaccctggccggggtgtgtgcactgcatgcaggttctcccttgcatgcaagatgggtgctggcccactgtgaggcttctgctcggggaagttctgtggagtcactaccagggccaagaggcaggtgggctggctctgggacgagggccaggtgtgagcaaactgccagggtccgctgtgccactgctccccggccacatgcccgcccagctgtcgccttaaccagactgaacagacaggatccttcagggcccttggccccactctcagtgcattctgtcatcagggattaccacctgtaccattttcataaaacaaaaccaaaatcactaccatcaaatggccttgtccctctaaaaagtctgcttaaaattctgtttttaaaacccagtttcctagttttccaggcaaatagttacctccgggaaagttgctgggggggcctgaagcacaatgtagcgcagatgcttcctttccaggccattctctcacccagcctgcacggaggagatgggagatgctgggggtcctgccctcagtctttttgggccttaggcgtttcgttcatcctgctaaggggatgaagcaaacacgaggtgattcctttgcctttcagagtggaagccctggagtttgttttgaaggccaggaggctgaaggatctctaagctacggtgtgggcttaatagcagcaggctttgtcctcctgtctcctccaagccagtgtctgattccttggcaacacaggtcttagtctgtggagtggctctgctgtggccttcctctggccgggcaggcactgtccagccatagccagctcctgagaataggtcagcctctcctttctgtctcccagggcacatccagcccgtgcctgtgttcactgtgccccgaagtgcaattacccataccccttctcagcctggggaccccaggcaaccacagactgtccactcaggggagctgaatcccaggtcagccctgccaatgtcccttaggaactgcccaggcaaggcccctggttttgtatacttgttcctgccacccagcagtagatgagtgtttcaggtgaagaccaggatagattttctaagtgtgaatccccacttcacatatggaaccccttatgctgaacttgaaaagcaccaagacttcctgtagacaagaaagtgcttaggtagggacagcccctgggcatcccacccaatgtagctggcaccccactatggcaaaggtgccttgataactgagccctgtatccctcccatgcccagccagattctcatgggaagccctctcccttcttttctgcctaacaccatctcatcgtttctggcctcactgtggacaatccacacacattcttctttcctctcctggcggggcacagagccacccccttgccttttcttttcttgaaggttctagttcagctcctgattcatcagacccttctagccccctgcatctagcagtgaagcatgaagcctggtggggatgtggtactcccatctggtgtggccaccagctctgccaatgttcctgtagccttggaaaacttgctctctcggttcttttgggtgctgtgtactccccagcttccccccttccccccccattttgcacctgggtttagtgaaaggatggcatttggttgacccatatagaaacccagaatgaggtctcagggccaggaggcctggtatttgtaggccagggaaggggaagaggcaagtggtctggggtatcaccagccagccctctctgatttggcctctactccccataagtcacagtaccataagcaggcttctggcctcagcaatttggtctttgtgcccaagtttattgtgagaatttcctgaaaactctataaaaggtctcttcctactgtaggcctctaatgtttctcccctttttgcttcagtccactcttcagtcttgtaggcctagttttcaaacctgcacatgtgtcctacctggccacaggcatgcaggcctcaggcagctgggccagtttgggagcctcgggtgatgtctgcacgatctggggctgcctctgcacccctgctgtgggcttcagggttggagaagggctgggaccaaccgggtgagatccacaagtctctggatgtggctgaaggcaaatacacaattgaagtactttctgttttgaagtgctttcccttttgaatctggtttgaaacatgcagcttctgtctctagcccaaggaaagaccaaaacatagggaaataaaagcatttatctttgtcttggaagtaattgttgaagttgtgcagttgatcagtgcacagttagatgcaatgtttatagaaattgattgttaaaccaaatttacactggcatgtgtggtgtagtttctaaaaggcacttcacatttgaaatttttcttaccttagaaagtttctagtgatctaaatgtctagttttgtattcttttgtgtgtgttcactgtttctcagtattaccacttgaataattctctgtacaggggggtttgtgctatacactgggatgtctaattgcagcaataaagcctttctttaaaaaggaaaaaaaaaat

SEQ ID NO: 315021 - DNA, 4744 bp, Homo sapiens
gaattttgatcaccttagcatctgagtgaggagagatggggtcttgctgtgttgcccagactggtctcaaactcctggcctcaagtgatccttctgcctcagcttcccaaagtactgggattacagcttgaaatccatggcccaaaatgactctaccagtggagactctcttctgtgaagaagacgaccagataagaggttgggatgagcatgccactgcatcagatctctgccattccatcccaggatgccatctctgctagagtctacagaagtaagaccaaagaaaaggagagggaagaacagaatgagaagactttgggacatttcatgagtcattcaagcaacatttctaaggctgggagtcctccgtcagcatcagctccggctccggtgtcctccttctctcgcacttctatcacgccatccagccaggacatctgcaggatctgccactgtgaaggagatgatgagagccccctgatcaccccctgccactgcacaggaagcctccacttcgtgcaccaggcctgcctgcagcagtggatcaagagctccgacacgcgctgctgcgagctctgcaagtatgagttcatcatggagaccaagctgaagccactgagaaaatgggagaagttgcagatgacgtccagcgagcgcaggaagatcatgtgctcagtgacattccacgtcattgccatcacatgtgtggtctggtccttgtatgtgctcattgaccgtactgctgaggagatcaagcaggggcaggcaacaggaatcctagaatggcccttttggactaaattggtggttgtggccatcggcttcaccggaggacttctttttatgtatgttcagtgtaaagtgtatgtgcaattgtggaagagactcaaggcctataatagagtgatctatgttcaaaactgtccagaaacaagcaaaaagaatatttttgaaaaatctccactaacagagcccaactttgaaaataaacatggatatggaatctgtcattccgacacaaactcttcttgttgcacagagcctgaagacactggagcagaaatcattcacgtctgattgtgtgcgggttgtcattttcctggacatccatgaagagctgaaggaaattgtttactgccaattgtatacctttcttatgtcctttaatagcatagactggacaggtgactatttatagtggcttctctttttctaaaccctccttagtctcctagaaaaccttcctgtgggccaggcatgcctgggtcctgcctctgcctggcagctctgtgggaaagtggaagaccccatgatgacatcatggggagccagcagagttcctgcccatggtcttgagctgaatgagagaataaaatgccaatcccaagggaagaggaggagcaggggtgcccaggccctgatacccagccgcctccagcttgcagtggtccccagcctggagcagagcattggggagtgtctagccatgacgagaagattccctctgcatcacggcgaaccccaggagatggtattgaaacagacccccaaacacagactcctgcctgccctctgccgatgctgcctcctccatgctcttgagcaggtggagccatggtgctctgtggtggcgcatgattcactgagcaaacagcactttacagaagaaaatctttattttgtaatatgtgtgtccagcgggattgacactcaaaaaaagtctcacttagaaatcttcccttccttacctttgtatctcctttacatcatgagagatcaaaaatccattttgccttacatatgctaagaagcgtggcattctttctgttcataaaacagactcatgacttttaagacaggacaagcaggccagaggctttttttttaatcacagatctcatgggaattagtggatgctaaatggcaattaaagcatgattcctatgcttttgagcctgttttatgacaaggtgttactttgtagacctggcccatacatttcttttttgtcaacactgaaaaagaacagtttctgagatcgaaatggaaggaaaggaagtgagtaatgacaacaaaactgaatatttaaaaaatattcctttatagttaaatctctccagttggtgttggcttcacattgaaagagcagccatgtgccaccctggccggggtgtgtgcactgcatgcaggttctcccttgcatgcaagatgggtgctggcccactgtgaggcttctgctcggggaagttctgtggagtcactaccagggccaagaggcaggtgggctggctctgggacgagggccaggtgtgagcaaactgccagggtccgctgtgccactgctccccggccacatgcccgcccagctgtcgccttaaccagactgaacagacaggatccttcagggcccttggccccactctcagtgcattctgtcatcagggattaccacctgtaccattttcataaaacaaaaccaaaatcactaccatcaaatggccttgtccctctaaaaagtctgcttaaaattctgtttttaaaacccagtttcctagttttccaggcaaatagttacctccgggaaagttgctgggggggcctgaagcacaatgtagcgcagatgcttcctttccaggccattctctcacccagcctgcacggaggagatgggagatgctgggggtcctgccctcagtctttttgggccttaggcgtttcgttcatcctgctaaggggatgaagcaaacacgaggtgattcctttgcctttcagagtggaagccctggagtttgttttgaaggccaggaggctgaaggatctctaagctacggtgtgggcttaatagcagcaggctttgtcctcctgtctcctccaagccagtgtctgattccttggcaacacaggtcttagtctgtggagtggctctgctgtggccttcctctggccgggcaggcactgtccagccatagccagctcctgagaataggtcagcctctcctttctgtctcccagggcacatccagcccgtgcctgtgttcactgtgccccgaagtgcaattacccataccccttctcagcctggggaccccaggcaaccacagactgtccactcaggggagctgaatcccaggtcagccctgccaatgtcccttaggaactgcccaggcaaggcccctggttttgtatacttgttcctgccacccagcagtagatgagtgtttcaggtgaagaccaggatagattttctaagtgtgaatccccacttcacatatggaaccccttatgctgaacttgaaaagcaccaagacttcctgtagacaagaaagtgcttaggtagggacagcccctgggcatcccacccaatgtagctggcaccccactatggcaaaggtgccttgataactgagccctgtatccctcccatgcccagccagattctcatgggaagccctctcccttcttttctgcctaacaccatctcatcgtttctggcctcactgtggacaatccacacacattcttctttcctctcctggcggggcacagagccacccccttgccttttcttttcttgaaggttctagttcagctcctgattcatcagacccttctagccccctgcatctagcagtgaagcatgaagcctggtggggatgtggtactcccatctggtgtggccaccagctctgccaatgttcctgtagccttggaaaacttgctctctcggttcttttgggtgctgtgtactccccagcttccccccttccccccccattttgcacctgggtttagtgaaaggatggcatttggttgacccatatagaaacccagaatgaggtctcagggccaggaggcctggtatttgtaggccagggaaggggaagaggcaagtggtctggggtatcaccagccagccctctctgatttggcctctactccccataagtcacagtaccataagcaggcttctggcctcagcaatttggtctttgtgcccaagtttattgtgagaatttcctgaaaactctataaaaggtctcttcctactgtaggcctctaatgtttctcccctttttgcttcagtccactcttcagtcttgtaggcctagttttcaaacctgcacatgtgtcctacctggccacaggcatgcaggcctcaggcagctgggccagtttgggagcctcgggtgatgtctgcacgatctggggctgcctctgcacccctgctgtgggcttcagggttggagaagggctgggaccaaccgggtgagatccacaagtctctggatgtggctgaaggcaaatacacaattgaagtactttctgttttgaagtgctttcccttttgaatctggtttgaaacatgcagcttctgtctctagcccaaggaaagaccaaaacatagggaaataaaagcatttatctttgtcttggaagtaattgttgaagttgtgcagttgatcagtgcacagttagatgcaatgtttatagaaattgattgttaaaccaaatttacactggcatgtgtggtgtagtttctaaaaggcacttcacatttgaaatttttcttaccttagaaagtttctagtgatctaaatgtctagttttgtattcttttgtgtgtgttcactgtttctcagtattaccacttgaataattctctgtacaggggggtttgtgctatacactgggatgtctaattgcagcaataaagcctttctttaaaaaggaaaaaaaaaat

SEQ ID NO: 315022 - DNA, 5027 bp, Homo sapiens
ctaacatttggatcagagatcccctcactaaaacagcctgagagcctggctccttccaggacgagtgccccaacctgttctctagctgctggaaaagacccctctgtttcttaaaagcctgttaagttccttcaggctagtagctacaccttgttgcatacttccttggaaatagagagtgctttcaaattaatttctcacttattgctattagtggtcccaagaaaaagagatgaaattgcagcatcttgtaatggtgagttttttaggtctaggagagaggtactgtcatctttgtttacttgctgagagacgacagaaatgtgtagttgtggggtatgaaggtaaagtcagtgattatagctaaaaagcaaacgtcatttaaggtcactggtatttttggatgttggaatgcaggttttgttttacatagaaattttccctctaattattttaccatcttatgttctggaaaatgattccatgttgctttaaattcatctttcagtgaagttcttatttcttaccaaaaaatgacagctttgtcatttcttacatcgttttttcctttctgttgccaaatgccctccagactttccatgttggtgcggtaagctagacatttttagtttgtagtgattgttttcgtttgtgtttgtatgtttttgtgcccatagtcacttctgtaatgttcgtttctgagtttcctttggggggattaacctgccactgaagtgtcagcttccctgtcatgggactgtccttggaatgacaggttttccttccaccataggatctgccactgtgaaggagatgatgagagccccctgatcaccccctgccactgcacaggaagcctccacttcgtgcaccaggcctgcctgcagcagtggatcaagagctccgacacgcgctgctgcgagctctgcaagtatgagttcatcatggagaccaagctgaagccactgagaaaatgggagaagttgcagatgacgtccagcgagcgcaggaagatcatgtgctcagtgacattccacgtcattgccatcacatgtgtggtctggtccttgtatgtgctcattgaccgtactgctgaggagatcaagcaggggcaggcaacaggaatcctagaatggcccttttggactaaattggtggttgtggccatcggcttcaccggaggacttctttttatgtatgttcagtgtaaagtgtatgtgcaattgtggaagagactcaaggcctataatagagtgatctatgttcaaaactgtccagaaacaagcaaaaagaatatttttgaaaaatctccactaacagagcccaactttgaaaataaacatggatatggaatctgtcattccgacacaaactcttcttgttgcacagagcctgaagacactggagcagaaatcattcacgtctgattgtgtgcgggttgtcattttcctggacatccatgaagagctgaaggaaattgtttactgccaattgtatacctttcttatgtcctttaatagcatagactggacaggtgactatttatagtggcttctctttttctaaaccctccttagtctcctagaaaaccttcctgtgggccaggcatgcctgggtcctgcctctgcctggcagctctgtgggaaagtggaagaccccatgatgacatcatggggagccagcagagttcctgcccatggtcttgagctgaatgagagaataaaatgccaatcccaagggaagaggaggagcaggggtgcccaggccctgatacccagccgcctccagcttgcagtggtccccagcctggagcagagcattggggagtgtctagccatgacgagaagattccctctgcatcacggcgaaccccaggagatggtattgaaacagacccccaaacacagactcctgcctgccctctgccgatgctgcctcctccatgctcttgagcaggtggagccatggtgctctgtggtggcgcatgattcactgagcaaacagcactttacagaagaaaatctttattttgtaatatgtgtgtccagcgggattgacactcaaaaaaagtctcacttagaaatcttcccttccttacctttgtatctcctttacatcatgagagatcaaaaatccattttgccttacatatgctaagaagcgtggcattctttctgttcataaaacagactcatgacttttaagacaggacaagcaggccagaggctttttttttaatcacagatctcatgggaattagtggatgctaaatggcaattaaagcatgattcctatgcttttgagcctgttttatgacaaggtgttactttgtagacctggcccatacatttcttttttgtcaacactgaaaaagaacagtttctgagatcgaaatggaaggaaaggaagtgagtaatgacaacaaaactgaatatttaaaaaatattcctttatagttaaatctctccagttggtgttggcttcacattgaaagagcagccatgtgccaccctggccggggtgtgtgcactgcatgcaggttctcccttgcatgcaagatgggtgctggcccactgtgaggcttctgctcggggaagttctgtggagtcactaccagggccaagaggcaggtgggctggctctgggacgagggccaggtgtgagcaaactgccagggtccgctgtgccactgctccccggccacatgcccgcccagctgtcgccttaaccagactgaacagacaggatccttcagggcccttggccccactctcagtgcattctgtcatcagggattaccacctgtaccattttcataaaacaaaaccaaaatcactaccatcaaatggccttgtccctctaaaaagtctgcttaaaattctgtttttaaaacccagtttcctagttttccaggcaaatagttacctccgggaaagttgctgggggggcctgaagcacaatgtagcgcagatgcttcctttccaggccattctctcacccagcctgcacggaggagatgggagatgctgggggtcctgccctcagtctttttgggccttaggcgtttcgttcatcctgctaaggggatgaagcaaacacgaggtgattcctttgcctttcagagtggaagccctggagtttgttttgaaggccaggaggctgaaggatctctaagctacggtgtgggcttaatagcagcaggctttgtcctcctgtctcctccaagccagtgtctgattccttggcaacacaggtcttagtctgtggagtggctctgctgtggccttcctctggccgggcaggcactgtccagccatagccagctcctgagaataggtcagcctctcctttctgtctcccagggcacatccagcccgtgcctgtgttcactgtgccccgaagtgcaattacccataccccttctcagcctggggaccccaggcaaccacagactgtccactcaggggagctgaatcccaggtcagccctgccaatgtcccttaggaactgcccaggcaaggcccctggttttgtatacttgttcctgccacccagcagtagatgagtgtttcaggtgaagaccaggatagattttctaagtgtgaatccccacttcacatatggaaccccttatgctgaacttgaaaagcaccaagacttcctgtagacaagaaagtgcttaggtagggacagcccctgggcatcccacccaatgtagctggcaccccactatggcaaaggtgccttgataactgagccctgtatccctcccatgcccagccagattctcatgggaagccctctcccttcttttctgcctaacaccatctcatcgtttctggcctcactgtggacaatccacacacattcttctttcctctcctggcggggcacagagccacccccttgccttttcttttcttgaaggttctagttcagctcctgattcatcagacccttctagccccctgcatctagcagtgaagcatgaagcctggtggggatgtggtactcccatctggtgtggccaccagctctgccaatgttcctgtagccttggaaaacttgctctctcggttcttttgggtgctgtgtactccccagcttccccccttccccccccattttgcacctgggtttagtgaaaggatggcatttggttgacccatatagaaacccagaatgaggtctcagggccaggaggcctggtatttgtaggccagggaaggggaagaggcaagtggtctggggtatcaccagccagccctctctgatttggcctctactccccataagtcacagtaccataagcaggcttctggcctcagcaatttggtctttgtgcccaagtttattgtgagaatttcctgaaaactctataaaaggtctcttcctactgtaggcctctaatgtttctcccctttttgcttcagtccactcttcagtcttgtaggcctagttttcaaacctgcacatgtgtcctacctggccacaggcatgcaggcctcaggcagctgggccagtttgggagcctcgggtgatgtctgcacgatctggggctgcctctgcacccctgctgtgggcttcagggttggagaagggctgggaccaaccgggtgagatccacaagtctctggatgtggctgaaggcaaatacacaattgaagtactttctgttttgaagtgctttcccttttgaatctggtttgaaacatgcagcttctgtctctacaccccggcaggtccactatataggagtcactctgagcgcattatacgattgtacgtagtagtaactctctgagatgtgagacatgctgatctgctgtcacagttagacgctatgtttatcgacatcgtctgtcattctctaggcccactggcatgcatgttgtacagcctcttagtgcacatctacatggtgacactgtttttaccgagcgaatgtttctactgatctatatctctacatgtgtgattctcttagtgtgtgtactactctttctcatgattaccagcttgcatac

SEQ ID NO: 315023 - DNA, 587 bp, Homo sapiens
tttgtagtgtgtctaaatgcaatcatgattgcatttagacctgcacgatctggggctgcctctgcacccctgctgtgggcttcagggttggagaagggctgggaccaaccgggtgagatccacaagtctctggatgtggctgaaggcaaatacacaattgaagtactttctgttttgaagtgctttcccttttgaatctggtttgaaacatgcagcttctgtctctagcccaaggaaagaccaaaacatagggaaataaaagcatttatctttgtcttggaagtaattgttgaagttgtgcagttgatcagtgcacagttagatgcaatgtttatagaaattgattgttaaaccaaatttacactggcatgtgtggtgtagtttctaaaaggcacttcacatttgaaatttttcttaccttagaaagtttctagtgatctaaatgtctagttttgtattcttttgtgtgtgttcactgtttctcagtattaccacttgaataattctctgtacaggggggtttgtgctatacactgggatgtctaattgcagcaataaagcctttctttaaaaaggaaaaaaaaaat

SEQ ID NO: 315024 - DNA, 624 bp, Homo sapiens
tggcccaaaatgactctaccagtggagactctcttctgtgaagaagacgaccagataagaggttgggatgagcatgccactgcatcagatctctgccattccatcccaggatgccatctctgctagagtctacagaagtaagaccaaagaaaaggagagggaagaacaggtactgggagagtatcttttttagtttcattatttttattaaatttttattaaagatgacctagaacagtgcttaaactctaaaggtcaggttttctctgataatatactgacaagcacacaaatagttgtactcagaaggaattgtctttttgtagatttctaggttttcagattttggtgtaaactactgtttataaatggttataaatgacttatcttcattggttaaatctacctgattatttttggttaatcactgtgactaagttctttggattctcagaacatgatgctgctagtttcctattcatcgtagtgtgaaatttggacaccagatggctggaatttcttaatatgtgtcttagtctgccctagctgctgtaacaaaatgccatagcctgggtggtttaaataacaagcatttatttctcacagttctggaggctggaaatc

SEQ ID NO: 315025 - DNA, 267 bp, Homo sapiens
tttactttctgtgcttttatcccactgttctgcatgcagttccagtgcagtgttttctgagtgttgtcaccacagttccgtgcagtctgctgttgtctcgaaagctcctcactgccagagttctctgacacaagggctcactgtgacagttatctgtaaggacacattacaggcgtcaaagagaaattcctttggttcagaatgggcccaggccttgaagcctgctaagaataccaaagccagaagaacactaaagttctcaaggtc

SEQ ID NO: 315026 - DNA, 451 bp, Homo sapiens
gcccgcggagaggcagcgcgactccaggcagtgggtctctctgccccggtgctcgcgtctgcccctggggccgggccgagcggaaccaggaatcgcagaaacggtcagcgcccagggctctaggccggccgccccgggtgccaggtgaattcctttccctgaccggctgtgagacgttggcccgtcagccgtcgtctttggcctgagtgtgcacatctgtaaaatggaagctcggactagtgatccgtgaggaccttccacgtctgacgtgtgatctcgagagacctgcgtacattcggggtgccagaaggaaagcataggtaactattttgtcctttaattgctaacttttctttggtctttaaatctgttttcatcttaaacgattcgtattcctgtccacctgggtgaagtttttaatagaaaacttattgggtgggggttataatgg

SEQ ID NO: 315027 - DNA, 872 bp, Homo sapiens
tgccactcggtgtcctcccgcggaggggcgtagggtgtaaacaggcgacgcgctgggggaggtgcggccttgctgcgtccacgtctcgggcatgctcgaggcgggccagggcggtagcgccgccagctcagagcccacctgaggtaactcctgcggcctctaggatcggagtcccccacgccgcgcgcagccgccgccgctggccgccaataagggcggccgagcccccggcccgggcagggggtgtggctgccggcagcgcgtcggctacaggtgggctgggctgggctgggctgggctgggctgggtgggggcggccgccaaggacccatccctgcgctgcgggcccggcgtggagcccgcggagaggcagcgcgactccaggcagtgggtctctctgccccggtgctcgcgtctgcccctggggccgggccgagcggaaccaggaatcgcagaaacggtcagcgcccagggctctaggccggccgccccgggtgccaggtgaattcctttccctgaccggctgtgagacgttggcccgtcagccgtcgtctttggcctgagtgtgcacatctgtaaaatggaagctcggactagtgatccgtgaggaccttccacgtctgacgtgtgatctcgagagacctgcgtacattcggggtgccagaaggaaagcatagttgctccgatacagaatgggaatggaagacttttgaggccaaccgaatgggttaggacatatctgaaaaacatgaaaacgctaaaaagcatgaaaactgaaggagtatacgaactcaagtcgttgagagtcatgaaataatgtgaacatgctcttgtgtgaaatcttgagaccctggagcaagagaattttggat

SEQ ID NO: 315028 - DNA, 5091 bp, Homo sapiens
ctaacatttggatcagagatcccctcactaaaacagcctgagagcctggctccttccaggacgagtgccccaacctgttctctagctgctggaaaagacccctctgtttcttaaaagcctgttaagttccttcaggctagtagctacaccttgttgcatacttccttggaaatagagagtgctttcaaattaatttctcacttattgctattagtggtcccaagaaaaagagatgaaattgcagcatcttgtaatggtgagttttttaggtctaggagagaggtactgtcatctttgtttacttgctgagagacgacagaaatgtgtagttgtggggtatgaaggtaaagtcagtgattatagctaaaaagcaaacgtcatttaaggtcactggtatttttggatgttggaatgcaggttttgttttacatagaaattttccctctaattattttaccatcttatgttctggaaaatgattccatgttgctttaaattcatctttcagtgaagttcttatttcttaccaaaaaatgacagctttgtcatttcttacatcgttttttcctttctgttgccaaatgccctccagactttccatgttggtgcggtaagctagacatttttagtttgtagtgattgttttcgtttgtgtttgtatgtttttgtgcccatagtcacttctgtaatgttcgtttctgagtttcctttggggggattaacctgccactgaagtgtcagcttccctgtcatgggactgtccttggaatgacaggttttccttccaccataggatctgccactgtgaaggagatgatgagagccccctgatcaccccctgccactgcacaggaagcctccacttcgtgcaccaggcctgcctgcagcagtggatcaagagctccgacacgcgctgctgcgagctctgcaagtatgagttcatcatggagaccaagctgaagccactgagaaaatgggagaagttgcagatgacgtccagcgagcgcaggaagatcatgtgctcagtgacattccacgtcattgccatcacatgtgtggtctggtccttgtatgtgctcattgaccgtactgctgaggagatcaagcaggggcaggcaacaggaatcctagaatggcccttttggactaaattggtggttgtggccatcggcttcaccggaggacttctttttatgtatgttcagtgtaaagtgtatgtgcaattgtggaagagactcaaggcctataatagagtgatctatgttcaaaactgtccagaaacaagcaaaaagaatatttttgaaaaatctccactaacagagcccaactttgaaaataaacatggatatggaatctgtcattccgacacaaactcttcttgttgcacagagcctgaagacactggagcagaaatcattcacgtctgattgtgtgcgggttgtcattttcctggacatccatgaagagctgaaggaaattgtttactgccaattgtatacctttcttatgtcctttaatagcatagactggacaggtgactatttatagtggcttctctttttctaaaccctccttagtctcctagaaaaccttcctgtgggccaggcatgcctgggtcctgcctctgcctggcagctctgtgggaaagtggaagaccccatgatgacatcatggggagccagcagagttcctgcccatggtcttgagctgaatgagagaataaaatgccaatcccaagggaagaggaggagcaggggtgcccaggccctgatacccagccgcctccagcttgcagtggtccccagcctggagcagagcattggggagtgtctagccatgacgagaagattccctctgcatcacggcgaaccccaggagatggtattgaaacagacccccaaacacagactcctgcctgccctctgccgatgctgcctcctccatgctcttgagcaggtggagccatggtgctctgtggtggcgcatgattcactgagcaaacagcactttacagaagaaaatctttattttgtaatatgtgtgtccagcgggattgacactcaaaaaaagtctcacttagaaatcttcccttccttacctttgtatctcctttacatcatgagagatcaaaaatccattttgccttacatatgctaagaagcgtggcattctttctgttcataaaacagactcatgacttttaagacaggacaagcaggccagaggctttttttttaatcacagatctcatgggaattagtggatgctaaatggcaattaaagcatgattcctatgcttttgagcctgttttatgacaaggtgttactttgtagacctggcccatacatttcttttttgtcaacactgaaaaagaacagtttctgagatcgaaatggaaggaaaggaagtgagtaatgacaacaaaactgaatatttaaaaaatattcctttatagttaaatctctccagttggtgttggcttcacattgaaagagcagccatgtgccaccctggccggggtgtgtgcactgcatgcaggttctcccttgcatgcaagatgggtgctggcccactgtgaggcttctgctcggggaagttctgtggagtcactaccagggccaagaggcaggtgggctggctctgggacgagggccaggtgtgagcaaactgccagggtccgctgtgccactgctccccggccacatgcccgcccagctgtcgccttaaccagactgaacagacaggatccttcagggcccttggccccactctcagtgcattctgtcatcagggattaccacctgtaccattttcataaaacaaaaccaaaatcactaccatcaaatggccttgtccctctaaaaagtctgcttaaaattctgtttttaaaacccagtttcctagttttccaggcaaatagttacctccgggaaagttgctgggggggcctgaagcacaatgtagcgcagatgcttcctttccaggccattctctcacccagcctgcacggaggagatgggagatgctgggggtcctgccctcagtctttttgggccttaggcgtttcgttcatcctgctaaggggatgaagcaaacacgaggtgattcctttgcctttcagagtggaagccctggagtttgttttgaaggccaggaggctgaaggatctctaagctacggtgtgggcttaatagcagcaggctttgtcctcctgtctcctccaagccagtgtctgattccttggcaacacaggtcttagtctgtggagtggctctgctgtggccttcctctggccgggcaggcactgtccagccatagccagctcctgagaataggtcagcctctcctttctgtctcccagggcacatccagcccgtgcctgtgttcactgtgccccgaagtgcaattacccataccccttctcagcctggggaccccaggcaaccacagactgtccactcaggggagctgaatcccaggtcagccctgccaatgtcccttaggaactgcccaggcaaggcccctggttttgtatacttgttcctgccacccagcagtagatgagtgtttcaggtgaagaccaggatagattttctaagtgtgaatccccacttcacatatggaaccccttatgctgaacttgaaaagcaccaagacttcctgtagacaagaaagtgcttaggtagggacagcccctgggcatcccacccaatgtagctggcaccccactatggcaaaggtgccttgataactgagccctgtatccctcccatgcccagccagattctcatgggaagccctctcccttcttttctgcctaacaccatctcatcgtttctggcctcactgtggacaatccacacacattcttctttcctctcctggcggggcacagagccacccccttgccttttcttttcttgaaggttctagttcagctcctgattcatcagacccttctagccccctgcatctagcagtgaagcatgaagcctggtggggatgtggtactcccatctggtgtggccaccagctctgccaatgttcctgtagccttggaaaacttgctctctcggttcttttgggtgctgtgtactccccagcttccccccttccccccccattttgcacctgggtttagtgaaaggatggcatttggttgacccatatagaaacccagaatgaggtctcagggccaggaggcctggtatttgtaggccagggaaggggaagaggcaagtggtctggggtatcaccagccagccctctctgatttggcctctactccccataagtcacagtaccataagcaggcttctggcctcagcaatttggtctttgtgcccaagtttattgtgagaatttcctgaaaactctataaaaggtctcttcctactgtaggcctctaatgtttctcccctttttgcttcagtccactcttcagtcttgtaggcctagttttcaaacctgcacatgtgtcctacctggccacaggcatgcaggcctcaggcagctgggccagtttgggagcctcgggtgatgtctgcacgatctggggctgcctctgcacccctgctgtgggcttcagggttggagaagggctgggaccaaccgggtgagatccacaagtctctggatgtggctgaaggcaaatacacaattgaagtactttctgttttgaagtgctttcccttttgaatctggtttgaaacatgcagcttctgtctctagcccaaggaaagaccaaaacatagggaaataaaagcatttatctttgtcttggaagtaattgttgaagttgtgcagttgatcagtgcacagttagatgcaatgtttatagaaattgattgttaaaccaaatttacactggcatgtgtggtgtagtttctaaaaggcacttcacatttgaaatttttcttaccttagaaagtttctagtgatctaaatgtctagttttgtattcttttgtgtgtgttcactgtttctcagtattaccacttgaataattctctgtacaggggggtttgtgctatacactgggatgtctaattgcagcaataaagcctttctttaaaaaggaaaaaaaaaat

SEQ ID NO: 315029 - DNA, 5295 bp, Homo sapiens
tgccactcggtgtcctcccgcggaggggcgtagggtgtaaacaggcgacgcgctgggggaggtgcggccttgctgcgtccacgtctcgggcatgctcgaggcgggccagggcggtagcgccgccagctcagagcccacctgaggtaactcctgcggcctctaggatcggagtcccccacgccgcgcgcagccgccgccgctggccgccaataagggcggccgagcccccggcccgggcagggggtgtggctgccggcagcgcgtcggctacaggtgggctgggctgggctgggctgggctgggctgggtgggggcggccgccaaggacccatccctgcgctgcgggcccggcgtggagcccgcggagaggcagcgcgactccaggcagtgggtctctctgccccggtgctcgcgtctgcccctggggccgggccgagcggaaccaggaatcgcagaaacggtcagcgcccagggctctaggccggccgccccgggtgccaggtgaattcctttccctgaccggctgtgagacgttggcccgtcagccgtcgtctttggcctgagtgtgcacatctgtaaaatggaagctcggactagtgatccgtgaggaccttccacgtctgacgtgtgatctcgagagacctgcgtacattcggggtgccagaaggaaagcatagcttgaaatccatggcccaaaatgactctaccagtggagactctcttctgtgaagaagacgaccagataagaggttgggatgagcatgccactgcatcagatctctgccattccatcccaggatgccatctctgctagagtctacagaagtaagaccaaagaaaaggagagggaagaacagaatgagaagactttgggacatttcatgagtcattcaagcaacatttctaaggctgggagtcctccgtcagcatcagctccggctccggtgtcctccttctctcgcacttctatcacgccatccagccaggacatctgcaggatctgccactgtgaaggagatgatgagagccccctgatcaccccctgccactgcacaggaagcctccacttcgtgcaccaggcctgcctgcagcagtggatcaagagctccgacacgcgctgctgcgagctctgcaagtatgagttcatcatggagaccaagctgaagccactgagaaaatgggagaagttgcagatgacgtccagcgagcgcaggaagatcatgtgctcagtgacattccacgtcattgccatcacatgtgtggtctggtccttgtatgtgctcattgaccgtactgctgaggagatcaagcaggggcaggcaacaggaatcctagaatggcccttttggactaaattggtggttgtggccatcggcttcaccggaggacttctttttatgtatgttcagtgtaaagtgtatgtgcaattgtggaagagactcaaggcctataatagagtgatctatgttcaaaactgtccagaaacaagcaaaaagaatatttttgaaaaatctccactaacagagcccaactttgaaaataaacatggatatggaatctgtcattccgacacaaactcttcttgttgcacagagcctgaagacactggagcagaaatcattcacgtctgattgtgtgcgggttgtcattttcctggacatccatgaagagctgaaggaaattgtttactgccaattgtatacctttcttatgtcctttaatagcatagactggacaggtgactatttatagtggcttctctttttctaaaccctccttagtctcctagaaaaccttcctgtgggccaggcatgcctgggtcctgcctctgcctggcagctctgtgggaaagtggaagaccccatgatgacatcatggggagccagcagagttcctgcccatggtcttgagctgaatgagagaataaaatgccaatcccaagggaagaggaggagcaggggtgcccaggccctgatacccagccgcctccagcttgcagtggtccccagcctggagcagagcattggggagtgtctagccatgacgagaagattccctctgcatcacggcgaaccccaggagatggtattgaaacagacccccaaacacagactcctgcctgccctctgccgatgctgcctcctccatgctcttgagcaggtggagccatggtgctctgtggtggcgcatgattcactgagcaaacagcactttacagaagaaaatctttattttgtaatatgtgtgtccagcgggattgacactcaaaaaaagtctcacttagaaatcttcccttccttacctttgtatctcctttacatcatgagagatcaaaaatccattttgccttacatatgctaagaagcgtggcattctttctgttcataaaacagactcatgacttttaagacaggacaagcaggccagaggctttttttttaatcacagatctcatgggaattagtggatgctaaatggcaattaaagcatgattcctatgcttttgagcctgttttatgacaaggtgttactttgtagacctggcccatacatttcttttttgtcaacactgaaaaagaacagtttctgagatcgaaatggaaggaaaggaagtgagtaatgacaacaaaactgaatatttaaaaaatattcctttatagttaaatctctccagttggtgttggcttcacattgaaagagcagccatgtgccaccctggccggggtgtgtgcactgcatgcaggttctcccttgcatgcaagatgggtgctggcccactgtgaggcttctgctcggggaagttctgtggagtcactaccagggccaagaggcaggtgggctggctctgggacgagggccaggtgtgagcaaactgccagggtccgctgtgccactgctccccggccacatgcccgcccagctgtcgccttaaccagactgaacagacaggatccttcagggcccttggccccactctcagtgcattctgtcatcagggattaccacctgtaccattttcataaaacaaaaccaaaatcactaccatcaaatggccttgtccctctaaaaagtctgcttaaaattctgtttttaaaacccagtttcctagttttccaggcaaatagttacctccgggaaagttgctgggggggcctgaagcacaatgtagcgcagatgcttcctttccaggccattctctcacccagcctgcacggaggagatgggagatgctgggggtcctgccctcagtctttttgggccttaggcgtttcgttcatcctgctaaggggatgaagcaaacacgaggtgattcctttgcctttcagagtggaagccctggagtttgttttgaaggccaggaggctgaaggatctctaagctacggtgtgggcttaatagcagcaggctttgtcctcctgtctcctccaagccagtgtctgattccttggcaacacaggtcttagtctgtggagtggctctgctgtggccttcctctggccgggcaggcactgtccagccatagccagctcctgagaataggtcagcctctcctttctgtctcccagggcacatccagcccgtgcctgtgttcactgtgccccgaagtgcaattacccataccccttctcagcctggggaccccaggcaaccacagactgtccactcaggggagctgaatcccaggtcagccctgccaatgtcccttaggaactgcccaggcaaggcccctggttttgtatacttgttcctgccacccagcagtagatgagtgtttcaggtgaagaccaggatagattttctaagtgtgaatccccacttcacatatggaaccccttatgctgaacttgaaaagcaccaagacttcctgtagacaagaaagtgcttaggtagggacagcccctgggcatcccacccaatgtagctggcaccccactatggcaaaggtgccttgataactgagccctgtatccctcccatgcccagccagattctcatgggaagccctctcccttcttttctgcctaacaccatctcatcgtttctggcctcactgtggacaatccacacacattcttctttcctctcctggcggggcacagagccacccccttgccttttcttttcttgaaggttctagttcagctcctgattcatcagacccttctagccccctgcatctagcagtgaagcatgaagcctggtggggatgtggtactcccatctggtgtggccaccagctctgccaatgttcctgtagccttggaaaacttgctctctcggttcttttgggtgctgtgtactccccagcttccccccttccccccccattttgcacctgggtttagtgaaaggatggcatttggttgacccatatagaaacccagaatgaggtctcagggccaggaggcctggtatttgtaggccagggaaggggaagaggcaagtggtctggggtatcaccagccagccctctctgatttggcctctactccccataagtcacagtaccataagcaggcttctggcctcagcaatttggtctttgtgcccaagtttattgtgagaatttcctgaaaactctataaaaggtctcttcctactgtaggcctctaatgtttctcccctttttgcttcagtccactcttcagtcttgtaggcctagttttcaaacctgcacatgtgtcctacctggccacaggcatgcaggcctcaggcagctgggccagtttgggagcctcgggtgatgtctgcacgatctggggctgcctctgcacccctgctgtgggcttcagggttggagaagggctgggaccaaccgggtgagatccacaagtctctggatgtggctgaaggcaaatacacaattgaagtactttctgttttgaagtgctttcccttttgaatctggtttgaaacatgcagcttctgtctctagcccaaggaaagaccaaaacatagggaaataaaagcatttatctttgtcttggaagtaattgttgaagttgtgcagttgatcagtgcacagttagatgcaatgtttatagaaattgattgttaaaccaaatttacactggcatgtgtggtgtagtttctaaaaggcacttcacatttgaaatttttcttaccttagaaagtttctagtgatctaaatgtctagttttgtattcttttgtgtgtgttcactgtttctcagtattaccacttgaataattctctgtacaggggggtttgtgctatacactgggatgtctaattgcagcaataaagcctttctttaaaaaggaaaaaaaaaat

SEQ ID NO: 315030 - DNA, 4784 bp, Homo sapiens
agcggatggtaggtatagggctgtggatatcgtcagtttgaccaagtattccaagaggccccatggagtttgtcatctgtaatagaggacgttagtgcattagtgatgaaaaaactgcttaccactgactattgtgatctcccagggagtataaggcagctccgcacttgaaatccatggcccaaaatgactctaccagtggagactctcttctgtgaagaagacgaccagataagaggttgggatgagcatgccactgcatcagatctctgccattccatcccaggatgccatctctgctagagtctacagaagtaagaccaaagaaaaggagagggaagaacagaatgagaagactttgggacatttcatgagtcattcaagcaacatttctaaggctgggagtcctccgtcagcatcagctccggctccggtgtcctccttctctcgcacttctatcacgccatccagccaggacatctgcaggatctgccactgtgaaggagatgatgagagccccctgatcaccccctgccactgcacaggaagcctccacttcgtgcaccaggcctgcctgcagcagtggatcaagagctccgacacgcgctgctgcgagctctgcaagtatgagttcatcatggagaccaagctgaagccactgagaaaatgggagaagttgcagatgacgtccagcgagcgcaggaagatcatgtgctcagtgacattccacgtcattgccatcacatgtgtggtctggtccttgtatgtgctcattgaccgtactgctgaggagatcaagcaggggcaggcaacaggaatcctagaatggcccttttggactaaattggtggttgtggccatcggcttcaccggaggacttctttttatgtatgttcagtgtaaagtgtatgtgcaattgtggaagagactcaaggcctataatagagtgatctatgttcaaaactgtccagaaacaagcaaaaagaatatttttgaaaaatctccactaacagagcccaactttgaaaataaacatggatatggaatctgtcattccgacacaaactcttcttgttgcacagagcctgaagacactggagcagaaatcattcacgtctgattgtgtgcgggttgtcattttcctggacatccatgaagagctgaaggaaattgtttactgccaattgtatacctttcttatgtcctttaatagcatagactggacaggtgactatttatagtggcttctctttttctaaaccctccttagtctcctagaaaaccttcctgtgggccaggcatgcctgggtcctgcctctgcctggcagctctgtgggaaagtggaagaccccatgatgacatcatggggagccagcagagttcctgcccatggtcttgagctgaatgagagaataaaatgccaatcccaagggaagaggaggagcaggggtgcccaggccctgatacccagccgcctccagcttgcagtggtccccagcctggagcagagcattggggagtgtctagccatgacgagaagattccctctgcatcacggcgaaccccaggagatggtattgaaacagacccccaaacacagactcctgcctgccctctgccgatgctgcctcctccatgctcttgagcaggtggagccatggtgctctgtggtggcgcatgattcactgagcaaacagcactttacagaagaaaatctttattttgtaatatgtgtgtccagcgggattgacactcaaaaaaagtctcacttagaaatcttcccttccttacctttgtatctcctttacatcatgagagatcaaaaatccattttgccttacatatgctaagaagcgtggcattctttctgttcataaaacagactcatgacttttaagacaggacaagcaggccagaggctttttttttaatcacagatctcatgggaattagtggatgctaaatggcaattaaagcatgattcctatgcttttgagcctgttttatgacaaggtgttactttgtagacctggcccatacatttcttttttgtcaacactgaaaaagaacagtttctgagatcgaaatggaaggaaaggaagtgagtaatgacaacaaaactgaatatttaaaaaatattcctttatagttaaatctctccagttggtgttggcttcacattgaaagagcagccatgtgccaccctggccggggtgtgtgcactgcatgcaggttctcccttgcatgcaagatgggtgctggcccactgtgaggcttctgctcggggaagttctgtggagtcactaccagggccaagaggcaggtgggctggctctgggacgagggccaggtgtgagcaaactgccagggtccgctgtgccactgctccccggccacatgcccgcccagctgtcgccttaaccagactgaacagacaggatccttcagggcccttggccccactctcagtgcattctgtcatcagggattaccacctgtaccattttcataaaacaaaaccaaaatcactaccatcaaatggccttgtccctctaaaaagtctgcttaaaattctgtttttaaaacccagtttcctagttttccaggcaaatagttacctccgggaaagttgctgggggggcctgaagcacaatgtagcgcagatgcttcctttccaggccattctctcacccagcctgcacggaggagatgggagatgctgggggtcctgccctcagtctttttgggccttaggcgtttcgttcatcctgctaaggggatgaagcaaacacgaggtgattcctttgcctttcagagtggaagccctggagtttgttttgaaggccaggaggctgaaggatctctaagctacggtgtgggcttaatagcagcaggctttgtcctcctgtctcctccaagccagtgtctgattccttggcaacacaggtcttagtctgtggagtggctctgctgtggccttcctctggccgggcaggcactgtccagccatagccagctcctgagaataggtcagcctctcctttctgtctcccagggcacatccagcccgtgcctgtgttcactgtgccccgaagtgcaattacccataccccttctcagcctggggaccccaggcaaccacagactgtccactcaggggagctgaatcccaggtcagccctgccaatgtcccttaggaactgcccaggcaaggcccctggttttgtatacttgttcctgccacccagcagtagatgagtgtttcaggtgaagaccaggatagattttctaagtgtgaatccccacttcacatatggaaccccttatgctgaacttgaaaagcaccaagacttcctgtagacaagaaagtgcttaggtagggacagcccctgggcatcccacccaatgtagctggcaccccactatggcaaaggtgccttgataactgagccctgtatccctcccatgcccagccagattctcatgggaagccctctcccttcttttctgcctaacaccatctcatcgtttctggcctcactgtggacaatccacacacattcttctttcctctcctggcggggcacagagccacccccttgccttttcttttcttgaaggttctagttcagctcctgattcatcagacccttctagccccctgcatctagcagtgaagcatgaagcctggtggggatgtggtactcccatctggtgtggccaccagctctgccaatgttcctgtagccttggaaaacttgctctctcggttcttttgggtgctgtgtactccccagcttccccccttccccccccattttgcacctgggtttagtgaaaggatggcatttggttgacccatatagaaacccagaatgaggtctcagggccaggaggcctggtatttgtaggccagggaaggggaagaggcaagtggtctggggtatcaccagccagccctctctgatttggcctctactccccataagtcacagtaccataagcaggcttctggcctcagcaatttggtctttgtgcccaagtttattgtgagaatttcctgaaaactctataaaaggtctcttcctactgtaggcctctaatgtttctcccctttttgcttcagtccactcttcagtcttgtaggcctagttttcaaacctgcacatgtgtcctacctggccacaggcatgcaggcctcaggcagctgggccagtttgggagcctcgggtgatgtctgcacgatctggggctgcctctgcacccctgctgtgggcttcagggttggagaagggctgggaccaaccgggtgagatccacaagtctctggatgtggctgaaggcaaatacacaattgaagtactttctgttttgaagtgctttcccttttgaatctggtttgaaacatgcagcttctgtctctagcccaaggaaagaccaaaacatagggaaataaaagcatttatctttgtcttggaagtaattgttgaagttgtgcagttgatcagtgcacagttagatgcaatgtttatagaaattgattgttaaaccaaatttacactggcatgtgtggtgtagtttctaaaaggcacttcacatttgaaatttttcttaccttagaaagtttctagtgatctaaatgtctagttttgtattcttttgtgtgtgttcactgtttctcagtattaccacttgaataattctctgtacaggggggtttgtgctatacactgggatgtctaattgcagcaataaagcctttctttaaaaaggaaaaaaaaaat

SEQ ID NO: 315031 - DNA, 4603 bp, Homo sapiens
agcggatggtaggtatagggctgtggatatcgtcagtttgaccaagtattccaagaggccccatggagtttgtcatctgtaatagaggacgttagtgcattagtgatgaaaaaactgcttaccactgactattgtgatctcccagggagtataaggcagctccgcacttgaaatccatggcccaaaatgactctaccagtggagactctcttctgtgaagaagacgaccagataagaggttgggatgagcatgccactgcatcagatctctgccattccatcccaggatgccatctctgctagagtctacagaagtaagaccaaagaaaaggagagggaagaacagaatgagaagactttgggacatttcatgagtcattcaagcaacatttctaaggctgggagtcctccgtcagcatcagctccggctccggtgtcctccttctctcgcacttctatcacgccatccagccaggacatctgcagtgggagaagttgcagatgacgtccagcgagcgcaggaagatcatgtgctcagtgacattccacgtcattgccatcacatgtgtggtctggtccttgtatgtgctcattgaccgtactgctgaggagatcaagcaggggcaggcaacaggaatcctagaatggcccttttggactaaattggtggttgtggccatcggcttcaccggaggacttctttttatgtatgttcagtgtaaagtgtatgtgcaattgtggaagagactcaaggcctataatagagtgatctatgttcaaaactgtccagaaacaagcaaaaagaatatttttgaaaaatctccactaacagagcccaactttgaaaataaacatggatatggaatctgtcattccgacacaaactcttcttgttgcacagagcctgaagacactggagcagaaatcattcacgtctgattgtgtgcgggttgtcattttcctggacatccatgaagagctgaaggaaattgtttactgccaattgtatacctttcttatgtcctttaatagcatagactggacaggtgactatttatagtggcttctctttttctaaaccctccttagtctcctagaaaaccttcctgtgggccaggcatgcctgggtcctgcctctgcctggcagctctgtgggaaagtggaagaccccatgatgacatcatggggagccagcagagttcctgcccatggtcttgagctgaatgagagaataaaatgccaatcccaagggaagaggaggagcaggggtgcccaggccctgatacccagccgcctccagcttgcagtggtccccagcctggagcagagcattggggagtgtctagccatgacgagaagattccctctgcatcacggcgaaccccaggagatggtattgaaacagacccccaaacacagactcctgcctgccctctgccgatgctgcctcctccatgctcttgagcaggtggagccatggtgctctgtggtggcgcatgattcactgagcaaacagcactttacagaagaaaatctttattttgtaatatgtgtgtccagcgggattgacactcaaaaaaagtctcacttagaaatcttcccttccttacctttgtatctcctttacatcatgagagatcaaaaatccattttgccttacatatgctaagaagcgtggcattctttctgttcataaaacagactcatgacttttaagacaggacaagcaggccagaggctttttttttaatcacagatctcatgggaattagtggatgctaaatggcaattaaagcatgattcctatgcttttgagcctgttttatgacaaggtgttactttgtagacctggcccatacatttcttttttgtcaacactgaaaaagaacagtttctgagatcgaaatggaaggaaaggaagtgagtaatgacaacaaaactgaatatttaaaaaatattcctttatagttaaatctctccagttggtgttggcttcacattgaaagagcagccatgtgccaccctggccggggtgtgtgcactgcatgcaggttctcccttgcatgcaagatgggtgctggcccactgtgaggcttctgctcggggaagttctgtggagtcactaccagggccaagaggcaggtgggctggctctgggacgagggccaggtgtgagcaaactgccagggtccgctgtgccactgctccccggccacatgcccgcccagctgtcgccttaaccagactgaacagacaggatccttcagggcccttggccccactctcagtgcattctgtcatcagggattaccacctgtaccattttcataaaacaaaaccaaaatcactaccatcaaatggccttgtccctctaaaaagtctgcttaaaattctgtttttaaaacccagtttcctagttttccaggcaaatagttacctccgggaaagttgctgggggggcctgaagcacaatgtagcgcagatgcttcctttccaggccattctctcacccagcctgcacggaggagatgggagatgctgggggtcctgccctcagtctttttgggccttaggcgtttcgttcatcctgctaaggggatgaagcaaacacgaggtgattcctttgcctttcagagtggaagccctggagtttgttttgaaggccaggaggctgaaggatctctaagctacggtgtgggcttaatagcagcaggctttgtcctcctgtctcctccaagccagtgtctgattccttggcaacacaggtcttagtctgtggagtggctctgctgtggccttcctctggccgggcaggcactgtccagccatagccagctcctgagaataggtcagcctctcctttctgtctcccagggcacatccagcccgtgcctgtgttcactgtgccccgaagtgcaattacccataccccttctcagcctggggaccccaggcaaccacagactgtccactcaggggagctgaatcccaggtcagccctgccaatgtcccttaggaactgcccaggcaaggcccctggttttgtatacttgttcctgccacccagcagtagatgagtgtttcaggtgaagaccaggatagattttctaagtgtgaatccccacttcacatatggaaccccttatgctgaacttgaaaagcaccaagacttcctgtagacaagaaagtgcttaggtagggacagcccctgggcatcccacccaatgtagctggcaccccactatggcaaaggtgccttgataactgagccctgtatccctcccatgcccagccagattctcatgggaagccctctcccttcttttctgcctaacaccatctcatcgtttctggcctcactgtggacaatccacacacattcttctttcctctcctggcggggcacagagccacccccttgccttttcttttcttgaaggttctagttcagctcctgattcatcagacccttctagccccctgcatctagcagtgaagcatgaagcctggtggggatgtggtactcccatctggtgtggccaccagctctgccaatgttcctgtagccttggaaaacttgctctctcggttcttttgggtgctgtgtactccccagcttccccccttccccccccattttgcacctgggtttagtgaaaggatggcatttggttgacccatatagaaacccagaatgaggtctcagggccaggaggcctggtatttgtaggccagggaaggggaagaggcaagtggtctggggtatcaccagccagccctctctgatttggcctctactccccataagtcacagtaccataagcaggcttctggcctcagcaatttggtctttgtgcccaagtttattgtgagaatttcctgaaaactctataaaaggtctcttcctactgtaggcctctaatgtttctcccctttttgcttcagtccactcttcagtcttgtaggcctagttttcaaacctgcacatgtgtcctacctggccacaggcatgcaggcctcaggcagctgggccagtttgggagcctcgggtgatgtctgcacgatctggggctgcctctgcacccctgctgtgggcttcagggttggagaagggctgggaccaaccgggtgagatccacaagtctctggatgtggctgaaggcaaatacacaattgaagtactttctgttttgaagtgctttcccttttgaatctggtttgaaacatgcagcttctgtctctagcccaaggaaagaccaaaacatagggaaataaaagcatttatctttgtcttggaagtaattgttgaagttgtgcagttgatcagtgcacagttagatgcaatgtttatagaaattgattgttaaaccaaatttacactggcatgtgtggtgtagtttctaaaaggcacttcacatttgaaatttttcttaccttagaaagtttctagtgatctaaatgtctagttttgtattcttttgtgtgtgttcactgtttctcagtattaccacttgaataattctctgtacaggggggtttgtgctatacactgggatgtctaattgcagcaataaagcctttctttaaaaaggaaaaaaaaaat

SEQ ID NO: 315032 - DNA, 568 bp, Homo sapiens
cgccggaagttgcagccgggaagcctgcgaggtcggttccgcccgactctaacatggcggcgccctttgtctgctctggagtgccgtccccggccttctcgcggccgtgatgcacctccctctgcggtggggtccgggacatggcaggtaatgagccggacgaggggagccaagctggagtttacacaggcaaactgtcagaaaagagtagcctgggctgtctggaaatctgagctggatgccaacagcctggctcagcatgtgcgaatccacacagcccaggcactggtcatgttccagacagacgcggacttctatcagcagtatgggccaggtggcacgtggcctgccgggcaggtgctgcaggctggggagctggtcttccgccctcgcgacggggctgagggccagcccgcactggcagagacctcccctacagctcctgaatgtcccccgcctgccgagtgagctggcggcccttctgactgtttatttaaggatggatggcaccctggaaccgggaagggtggcctgttccctagagagaataaattggattattttctaa

SEQ ID NO: 315033 - DNA, 822 bp, Homo sapiens
gtccgtctcagttatctcctgctgcacagcacagcaccccaaaacccagtggcataagtcatcgccatggactttccccagcacagccagcatgtcttggaacagctgaaccagcagcggcagctggggcttctctgtgactgcacctttgtggtggacggtgttcactttaaggctcataaagcagtgctggcggcctgcagcgagtacttcaagatgctcttcgtggaccagaaggacgtggtgcacctggacatcagtaacgcggcaggcctggggcaggtgctggagtttatgtacacggccaagctgagcctgagccctgagaacgtggatgatgtgctggccgtggccactttcctccaaatgcaggacatcatcacggcctgccatgccctcaagtcacttgctgagccggctaccagccctgggggaaatgcggaggccttggccacagaaggaggggacaagagagccaaagaggagaaggtggccaccagcacgctgagcaggctggagcaggcaggacgcagcacacccataggccccagcagggacctcaaggaggagcgcggcggtcaggcccagagtgcggccagcggtgagtcagatgccaaggacccagccggctgtcctgtcacctcccagcagcctgggcacagggtagtgagggctgccttggggcaggtagcacgggcacctgcacctcttgagcctgtgttacccagaatgacctattgtgtgttccagggggtctgtttcaaccagagcagacacaacagccttggctaggggtgtgctggggcctcccctcctgggtca

SEQ ID NO: 315034 - DNA, 2769 bp, Homo sapiens
cgccggaagttgcagccgggaagcctgcgaggtcggttccgcccgactctaacatggcggcgccctttgtctgctctggagtgccgtccccggccttctcgcggccgtgatgcacctccctctgcggtggggtccgggacatggcaggtaatgagccggacgaggggagccaagctggagtttacacaggcaaactgtcagaaaagagtagcctgggctgtctggaaatctgagccatggactttccccagcacagccagcatgtcttggaacagctgaaccagcagcggcagctggggcttctctgtgactgcacctttgtggtggacggtgttcactttaaggctcataaagcagtgctggcggcctgcagcgagtacttcaagatgctcttcgtggaccagaaggacgtggtgcacctggacatcagtaacgcggcaggcctggggcaggtgctggagtttatgtacacggccaagctgagcctgagccctgagaacgtggatgatgtgctggccgtggccactttcctccaaatgcaggacatcatcacggcctgccatgccctcaagtcacttgctgagccggctaccagccctgggggaaatgcggaggccttggccacagaaggaggggacaagagagccaaagaggagaaggtggccaccagcacgctgagcaggctggagcaggcaggacgcagcacacccataggccccagcagggacctcaaggaggagcgcggcggtcaggcccagagtgcggccagcggtgcagagcagacagagaaagccgatgcgccccgggagccgccgcctgtggagctcaagccagaccccacgagtggcatggctgctgcagaagctgaggccgctttgtccgagagctcggagcaagaaatggaggtggagcccgcccggaaaggggaagaggagcaaaaggagcaagaggagcaagaggaggagggcgcagggccagctgaggtcaaggaggagggttcccagctggagaacggagaggcccccgaggagaacgagaatgaggagtcagcgggcacagactcggggcaggagctcggctccgaggcccggggcctgcgctcaggcacctacggcgaccgcacggagtccaaggcctacggctccgtcatccacaagtgcgaggactgtgggaaggagttcacgcacacggggaacttcaagcggcacatccgcatccacacgggggagaagcccttctcgtgccgggagtgcagcaaggccttttccgacccggccgcgtgcaaggcccatgagaagacgcacagccctctgaagccctacggctgcgaggagtgcgggaagagctaccgcctcatcagcctgctgaacctgcacaagaagcggcactcgggcgaggcgcgctaccgctgcgaggactgcggcaagctcttcaccacctcgggcaacctcaagcgccaccagctggtgcacagcggcgagaagccctaccagtgcgactactgcggccgctccttctccgaccccacttccaagatgcgccacctggagacccacgacacggacaaggagcacaagtgcccacactgcgacaagaagttcaaccaggtagggaacctgaaggcccacctgaagatccacatcgctgacgggcccctcaagtgccgagagtgtgggaagcagttcaccacctcagggaacctgaagcggcaccttcggatccacagcggggagaagccctacgtgtgcatccactgccagcgacagtttgcagaccccggcgctctgcagcggcacgtccgcattcacacaggtgagaagccatgccagtgtgtgatgtgcggtaaggccttcacccaggccagctccctcatcgcccacgtgcgccagcacaccggggagaagccctacgtctgcgagcgctgcggcaagagattcgtccagtccagccagttggccaatcatattcgccaccacgacaacatccgcccacacaagtgcagcgtgtgcagcaaggccttcgtgaacgtgggggacctgtccaagcacatcatcattcacactggagagaagccttacctgtgtgataagtgtgggcgtggcttcaaccgggtagacaacctgcgctcccacgtgaagaccgtgcaccagggcaaggcaggcatcaagatcctggagcccgaggagggcagtgaggtcagcgtggtcactgtggatgacatggtcacgctggctaccgaggcactggcagcgacagccgtcactcagctcacaggccctgcgactctgcccgcagtggtgccggtgggagctgcagtgacagccgatgagacggaagtcctgaaggccgagatcagcaaagctgtgaagcaagtgcaggaagaagaccccaacactcacatcctctacgcctgtgactcctgtggggacaagtttctggatgccaacagcctggctcagcatgtgcgaatccacacagcccaggcactggtcatgttccagacagacgcggacttctatcagcagtatgggccaggtggcacgtggcctgccgggcaggtgctgcaggctggggagctggtcttccgccctcgcgacggggctgagggccagcccgcactggcagagacctcccctacagctcctgaatgtcccccgcctgccgagtgagctggcggcccttctgactgtttatttaaggatggatggcaccctggaaccgggaagggtggcctgttccctagagagaataaattggattattttctaa

SEQ ID NO: 315035 - DNA, 2770 bp, Homo sapiens
cgccggaagttgcagccgggaagcctgcgaggtcggttccgcccgactctaacatggcggcgccctttgtctgctctggagtgccgtccccggccttctcgcggccgtgatgcacctccctctgcggtggggtccgggacatggcaggtaatgagccggacgaggggagccaagctggagtttacacaggcaaactgtcagaaaagagtagcctgggctgtctggaaatctgagccatggactttccccagcacagccagcatgtcttggaacagctgaaccagcagcggcagctggggcttctctgtgactgcacctttgtggtggacggtgttcactttaaggctcataaagcagtgctggcggcctgcagcgagtacttcaagatgctcttcgtggaccagaaggacgtggtgcacctggacatcagtaacgcggcaggcctggggcaggtgctggagtttatgtacacggccaagctgagcctgagccctgagaacgtggatgatgtgctggccgtggccactttcctccaaatgcaggacatcatcacggcctgccatgccctcaagtcacttgctgagccggctaccagccctgggggaaatgcggaggccttggccacagaaggtctgccctgttccatctccaggaggggacaagagagccaaagaggagaaggtggccaccagcacgctgagcaggctggagcaggcaggacgcagcacacccataggccccagcagggacctcaaggaggagcgcggcggtcaggcccagagtgcggccagcggtgcagagcagacagagaaagccgatgcgccccgggagccgccgcctgtggagctcaagccagaccccacgagtggcatggctgctgcagaagctgaggccgctttgtccgagagctcggagcaagaaatggaggtggagcccgcccggaaaggggaagaggagcaaaaggagcaagaggagcaagaggaggagggcgcagggccagctgaggtcaaggaggagggttcccagctggagaacggagaggcccccgaggagaacgagaatgaggagtcagcgggcacagactcggggcaggagctcggctccgaggcccggggcctgcgctcaggcacctacggcgaccgcacggagtccaaggcctacggctccgtcatccacaagtgcgaggactgtgggaaggagttcacgcacacggggaacttcaagcggcacatccgcatccacacgggggagaagcccttctcgtgccgggagtgcagcaaggccttttccgacccggccgcgtgcaaggcccatgagaagacgcacagccctctgaagccctacggctgcgaggagtgcgggaagagctaccgcctcatcagcctgctgaacctgcacaagaagcggcactcgggcgaggcgcgctaccgctgcgaggactgcggcaagctcttcaccacctcgggcaacctcaagcgccaccagctggtgcacagcggcgagaagccctaccagtgcgactactgcggccgctccttctccgaccccacttccaagatgcgccacctggagacccacgacacggacaaggagcacaagtgcccacactgcgacaagaagttcaaccaggtagggaacctgaaggcccacctgaagatccacatcgctgacgggcccctcaagtgccgagagtgtgggaagcagttcaccacctcagggaacctgaagcggcaccttcggatccacagcggggagaagccctacgtgtgcatccactgccagcgacagtttgcagaccccggcgctctgcagcggcacgtccgcattcacacaggtgagaagccatgccagtgtgtgatgtgcggtaaggccttcacccaggccagctccctcatcgcccacgtgcgccagcacaccggggagaagccctacgtctgcgagcgctgcggcaagagattcgtccagtccagccagttggccaatcatattcgccaccacgacaacatccgcccacacaagtgcagcgtgtgcagcaaggccttcgtgaacgtgggggacctgtccaagcacatcatcattcacactggagagaagccttacctgtgtgataagtgtgggcgtggcttcaaccgggtagacaacctgcgctcccacgtgaagaccgtgcaccagggcaaggcaggcatcaagatcctggagcccgaggagggcagtgaggtcagcgtggtcactgtggatgacatggtcacgctggctaccgaggcactggcagcgacagccgtcactcagctcacagtggtgccggtgggagctgcagtgacagccgatgagacggaagtcctgaaggccgagatcagcaaagctgtgaagcaagtgcaggaagaagaccccaacactcacatcctctacgcctgtgactcctgtggggacaagtttctggatgccaacagcctggctcagcatgtgcgaatccacacagcccaggcactggtcatgttccagacagacgcggacttctatcagcagtatgggccaggtggcacgtggcctgccgggcaggtgctgcaggctggggagctggtcttccgccctcgcgacggggctgagggccagcccgcactggcagagacctcccctacagctcctgaatgtcccccgcctgccgagtgagctggcggcccttctgactgtttatttaaggatggatggcaccctggaaccgggaagggtggcctgttccctagagagaataaattggattattttctaa

SEQ ID NO: 315036 - DNA, 2660 bp, Homo sapiens
cgccggaagttgcagccgggaagcctgcgaggtcggttccgcccgactctaacatggcggcgccctttgtctgctctggagtgccgtccccggccttctcgcggccgtgatgcacctccctctgcggtggggtccgggacatggcaggtaatgagccggacgaggggagccaagctggagtttacacaggcaaactgtcagaaaagagtagcctgggctgtctggaaatctgagccatggactttccccagcacagccagcatgtcttggaacagctgaaccagcagcggcagctggggcttctctgtgactgcacctttgtggtggacggtgttcactttaaggctcataaagcagtgctggcggcctgcagcgagtacttcaagatgctcttcgtggaccagaaggacgtggtgcacctggacatcagtaacgcggcaggcctggggcaggtgctggagtttatgtacacggccaagctgagcctgagccctgagaacgtggatgatgtgctggccgtggccactttcctccaaatgcaggacatcatcacggcctgccatgccctcaagtcacttgctgagccggctaccagccctgggggaaatgcggaggccttggccacagaaggaggggacaagagagccaaagaggagaaggtggccaccagcacgctgagcaggctggagcaggcaggacgcagcacacccataggccccagcagggacctcaaggaggagcgcggcggtcaggcccagagtgcggccagcggtgcagagcagacagagaaagccgatgcgccccgggagccgccgcctgtggagctcaagccagaccccacgagtggcatggctgctgcagaagctgaggccgctttgtccgagagctcggagcaagaaatggaggtggagcccgcccggaaaggggaagaggagcaaaaggagcaagaggagcaagaggaggagggcgcagggccagctgaggtcaaggaggagggttcccagctggagaacggagaggcccccgaggagaacgagaatgaggagtcagcgggcacagactcggggcaggagctcggctccgaggcccggggcctgcgctcaggcacctacggcgaccgcacggagtccaaggcctacggctccgtcatccacaagtgcgaggactgtgggaaggagttcacgcacacggggaacttcaagcggcacatccgcatccacacgggggagaagcccttctcgtgccgggagtgcagcaaggccttttccgacccggccgcgtgcaaggcccatgagaagacgcacagccctctgaagccctacggctgcgaggagtgcgggaagagctaccgcctcatcagcctgctgaacctgcacaagaagcggcactcgggcgaggcgcgctaccgctgcgaggactgcggcaagctcttcaccacctcgggcaacctcaagcgccaccagctggtgcacagcggcgagaagccctaccagtgcgactactgcggccgctccttctccgaccccacttccaagatgcgccacctggagacccacgacacggacaaggagcacaagtgcccacactgcgacaagaagttcaaccagggaacctgaagcggcaccttcggatccacagcggggagaagccctacgtgtgcatccactgccagcgacagtttgcagaccccggcgctctgcagcggcacgtccgcattcacacaggtgagaagccatgccagtgtgtgatgtgcggtaaggccttcacccaggccagctccctcatcgcccacgtgcgccagcacaccggggagaagccctacgtctgcgagcgctgcggcaagagattcgtccagtccagccagttggccaatcatattcgccaccacgacaacatccgcccacacaagtgcagcgtgtgcagcaaggccttcgtgaacgtgggggacctgtccaagcacatcatcattcacactggagagaagccttacctgtgtgataagtgtgggcgtggcttcaaccgggtagacaacctgcgctcccacgtgaagaccgtgcaccagggcaaggcaggcatcaagatcctggagcccgaggagggcagtgaggtcagcgtggtcactgtggatgacatggtcacgctggctaccgaggcactggcagcgacagccgtcactcagctcacagtggtgccggtgggagctgcagtgacagccgatgagacggaagtcctgaaggccgagatcagcaaagctgtgaagcaagtgcaggaagaagaccccaacactcacatcctctacgcctgtgactcctgtggggacaagtttctggatgccaacagcctggctcagcatgtgcgaatccacacagcccaggcactggtcatgttccagacagacgcggacttctatcagcagtatgggccaggtggcacgtggcctgccgggcaggtgctgcaggctggggagctggtcttccgccctcgcgacggggctgagggccagcccgcactggcagagacctcccctacagctcctgaatgtcccccgcctgccgagtgagctggcggcccttctgactgtttatttaaggatggatggcaccctggaaccgggaagggtggcctgttccctagagagaataaattggattattttctaa

SEQ ID NO: 315037 - DNA, 2559 bp, Homo sapiens
cgccggaagttgcagccgggaagcctgcgaggtcggttccgcccgactctaacatggcggcgccctttgtctgctctggagtgccgtccccggccttctcgcggccgtgatgcacctccctctgcggtggggtccgggacatggcaggtaatgagccggacgaggggagccaagctggagtttacacaggcaaactgtcagaaaagagtagcctgggctgtctggaaatctgagccatggactttccccagcacagccagcatgtcttggaacagctgaaccagcagcggcagctggggcttctctgtgactgcacctttgtggtggacggtgttcactttaaggctcataaagcagtgctggcggcctgcagcgagtacttcaagatgctcttcgtggaccagaaggacgtggtgcacctggacatcagtaacgcggcaggaggggacaagagagccaaagaggagaaggtggccaccagcacgctgagcaggctggagcaggcaggacgcagcacacccataggccccagcagggacctcaaggaggagcgcggcggtcaggcccagagtgcggccagcggtgcagagcagacagagaaagccgatgcgccccgggagccgccgcctgtggagctcaagccagaccccacgagtggcatggctgctgcagaagctgaggccgctttgtccgagagctcggagcaagaaatggaggtggagcccgcccggaaaggggaagaggagcaaaaggagcaagaggagcaagaggaggagggcgcagggccagctgaggtcaaggaggagggttcccagctggagaacggagaggcccccgaggagaacgagaatgaggagtcagcgggcacagactcggggcaggagctcggctccgaggcccggggcctgcgctcaggcacctacggcgaccgcacggagtccaaggcctacggctccgtcatccacaagtgcgaggactgtgggaaggagttcacgcacacggggaacttcaagcggcacatccgcatccacacgggggagaagcccttctcgtgccgggagtgcagcaaggccttttccgacccggccgcgtgcaaggcccatgagaagacgcacagccctctgaagccctacggctgcgaggagtgcgggaagagctaccgcctcatcagcctgctgaacctgcacaagaagcggcactcgggcgaggcgcgctaccgctgcgaggactgcggcaagctcttcaccacctcgggcaacctcaagcgccaccagctggtgcacagcggcgagaagccctaccagtgcgactactgcggccgctccttctccgaccccacttccaagatgcgccacctggagacccacgacacggacaaggagcacaagtgcccacactgcgacaagaagttcaaccaggtagggaacctgaaggcccacctgaagatccacatcgctgacgggcccctcaagtgccgagagtgtgggaagcagttcaccacctcagggaacctgaagcggcaccttcggatccacagcggggagaagccctacgtgtgcatccactgccagcgacagtttgcagaccccggcgctctgcagcggcacgtccgcattcacacaggtgagaagccatgccagtgtgtgatgtgcggtaaggccttcacccaggccagctccctcatcgcccacgtgcgccagcacaccggggagaagccctacgtctgcgagcgctgcggcaagagattcgtccagtccagccagttggccaatcatattcgccaccacgacaacatccgcccacacaagtgcagcgtgtgcagcaaggccttcgtgaacgtgggggacctgtccaagcacatcatcattcacactggagagaagccttacctgtgtgataagtgtgggcgtggcttcaaccgggtagacaacctgcgctcccacgtgaagaccgtgcaccagggcaaggcaggcatcaagatcctggagcccgaggagggcagtgaggtcagcgtggtcactgtggatgacatggtcacgctggctaccgaggcactggcagcgacagccgtcactcagctcacagtggtgccggtgggagctgcagtgacagccgatgagacggaagtcctgaaggccgagatcagcaaagctgtgaagcaagtgcaggaagaagaccccaacactcacatcctctacgcctgtgactcctgtggggacaagtttctggatgccaacagcctggctcagcatgtgcgaatccacacagcccaggcactggtcatgttccagacagacgcggacttctatcagcagtatgggccaggtggcacgtggcctgccgggcaggtgctgcaggctggggagctggtcttccgccctcgcgacggggctgagggccagcccgcactggcagagacctcccctacagctcctgaatgtcccccgcctgccgagtgagctggcggcccttctgactgtttatttaaggatggatggcaccctggaaccgggaagggtggcctgttccctagagagaataaattggattattttctaa

SEQ ID NO: 315038 - DNA, 1652 bp, Homo sapiens
gaccgccgacggcgccgcacctacggcgagagtccaggcctacggctccgtcatccacaagtgcgaggactgtgggaaggagttcacgcacacggggaacttcaagcggcacatccgcatccacacgggggagaagcccttctcgtgccgggagtgcagcaaggccttttccgacccggccgcgtgcaaggcccatgagaagacgcacagccctctgaagccctacggctgcgaggagtgcgggaagagctaccgcctcatcagcctgctgaacctgcacaagaagcggcactcgggcgaggcgcgctaccgctgcgaggactgcggcaagctcttcaccacctcgggcaacctcaagcgccaccagctggtgcacagcggcgagaagccctaccagtgcgactactgcggccgctccttctccgaccccacttccaagatgcgccacctggagacccacgacacggacaaggagcacaagtgcccacactgcgacaagaagttcaaccaggtagggaacctgaaggcccacctgaagatccacatcgctgacgggcccctcaagtgccgagagtgtgggaagcagttcaccacctcagggaacctgaagcggcaccttcggatccacagcggggagaagccctacgtgtgcatccactgccagcgacagtttgcagaccccggcgctctgcagcggcacgtccgcattcacacaggtgagaagccatgccagtgtgtgatgtgcggtaaggccttcacccaggccagctccctcatcgcccacgtgcgccagcacaccggggagaagccctacgtctgcgagcgctgcggcaagagattcgtccagtccagccagttggccaatcatattcgccaccacgacaacatccgcccacacaagtgcagcgtgtgcagcaaggccttcgtgaacgtgggggacctgtccaagcacatcatcattcacactggagagaagccttacctgtgtgataagtgtgggcgtggcttcaaccgggtagacaacctgcgctcccacgtgaagaccgtgcaccagggcaaggcaggcatcaagatcctggagcccgaggagggcagtgaggtcagcgtggtcactgtggatgacatggtcacgctggctaccgaggcactggcagcgacagccgtcactcagctcacagtggtgccggtgggagctgcagtgacagccgatgagacggaagtcctgaaggccgagatcagcaaagctgtgaagcaagtgcaggaagaagaccccaacactcacatcctctacgcctgtgactcctgtggggacaagtttctggatgccaacagcctggctcagcatgtgcgaatccacacagcccaggcactggtcatgttccagacagacgcggacttctatcagcagtatgggccaggtggcacgtggcctgccgggcaggtgctgcaggctggggagctggtcttccgccctcgcgacggggctgagggccagcccgcactggcagagacctcccctacagctcctgaatgtcccccgcctgccgagtgagctggcggcccttctgactgtttatttaaggatggatggcaccctggaaccgggaagggtggcctgttccctagagagaataaattggattattttctaa

SEQ ID NO: 315039 - DNA, 846 bp, Homo sapiens
tccatgcgagtcccttcctgtggccccacagattcgtccagtccagccagttggccaatcatattcgccaccacgacaacatccgcccacacaagtgcagcgtgtgcagcaaggccttcgtgaacgtgggggacctgtccaagcacatcatcattcacactggagagaagccttacctgtgtgataagtgtgggcgtggcttcaaccgggtagacaacctgcgctcccacgtgaagaccgtgcaccagggcaaggcaggcatcaagatcctggagcccgaggagggcagtgaggtcagcgtggtcactgtggatgacatggtcacgctggctaccgaggcactggcagcgacagccgtcactcagctcacagtggtgccggtgggagctgcagtgacagccgatgagacggaagtcctgaaggccgagatcagcaaagctgtgaagcaagtgcaggaagaagaccccaacactcacatcctctacgcctgtgactcctgtggggacaagtttctggatgccaacagcctggctcagcatgtgcgaatccacacagcccaggcactggtcatgttccagacagacgcggacttctatcagcagtatgggccaggtggcacgtggcctgccgggcaggtgctgcaggctggggagctggtcttccgccctcgcgacggggctgagggccagcccgcactggcagagacctcccctacagctcctgaatgtcccccgcctgccgagtgagctggcggcccttctgactgtttatttaaggatggatggcaccctggaaccgggaagggtggcctgttccctagagagaataaattggattattttctaa

SEQ ID NO: 315040 - DNA, 875 bp, Homo sapiens
cgccggaagttgcagccgggaagcctgcgaggtcggttccgcccgactctaacatggcggcgccctttgtctgctctggagtgccgtccccggccttctcgcggccgtgatgcacctccctctgcggtggggtccgggacatggcaggtaatgagccggacgaggggagccaagctggagtttacacaggcaaactgtcagaaaagagtagcctgggctgtctggaaatctgagccatggactttccccagcacagccagcatgtcttggaacagctgaaccagcagcggcagctggggcttctctgtgactgcacctttgtggtggacggtgttcactttaaggctcataaagcagtgctggcggcctgcagcgagtacttcaagatgctcttcgtggaccagaaggacgtggtgcacctggacatcagtaacgcggcaggcctggggcaggtgctggagtttatgtacacggccaagctgagcctgagccctgagaacgtggatgatgtgctggccgtggccactttcctccaaatgcaggacatcatcacggcctgccatgccctcaagtcacttgctgagccggctaccagccctgggggaaatgcggaggccttggccacagaaggaggggacaagagagccaaagaggagaaggtggccaccagcacgctgagcagctggtcttccgccctcgcgacggggctgagggccagcccgcactggcagagacctcccctacagctcctgaatgtcccccgcctgccgagtgagctggcggcccttctgactgtttatttaaggatggatggcaccctggaaccgggaagggtggcctgttccctagagagaataaattggattattttctaa

SEQ ID NO: 315041 - DNA, 705 bp, Homo sapiens
cgccggaagttgcagccgggaagcctgcgaggtcggttccgcccgactctaacatggcggcgccctttgtctgctctggagtgccgtccccggccttctcgcggccgtgatgcacctccctctgcggtggggtccgggacatggcaggtaatgagccggacgaggggagccaagctggagtttacacaggcaaactgtcagaaaagagtagcctgggctgtctggaaatctgagccatggactttccccagcacagccagcatgtcttggaacagctgaaccagcagcggcagctggggcttctctgtgactgcacctttgtggtggacggtgttcactttaaggctcataaagcagtgctggcggcctgcagcgagtacttcaagatgctcttcgtggaccagaaggacgtggtgcacctggacatcagtaacgcggcaggcctggggcaggtgctggagtttatgtacacggccaagtggcctgccgggcaggtgctgcaggctggggagctggtcttccgccctcgcgacggggctgagggccagcccgcactggcagagacctcccctacagctcctgaatgtcccccgcctgccgagtgagctggcggcccttctgactgtttatttaaggatggatggcaccctggaaccgggaagggtggcctgttccctagagagaataaattggattattttctaa

SEQ ID NO: 315042 - DNA, 437 bp, Homo sapiens
cgcgctggtccaggagaggtatccgacccctgggcagagggtagcaatccagcctccggtgcttcccccacccaggtgcagagcagacagagaaagccgatgcgccccgggagccgccgcctgtggagctcaagccagaccccacgagtggcatggctgctgcagaagctgaggccgctttgtccgagagctcggagcaaggtagccccgcccagccaggaccaggccctacctggtgcatcctcccagggccctgcctccactgcgcactggggcctccctctcctcctgcctccagctagtcccacctggagtcaccatgcacttcagctttgggacaccttggtcttcgcatgttcttgagtctcgaggtcgttccttggttgaccatgctagccgtgtgtctgtgagcacaggcacgtccttcaaagccctgg

SEQ ID NO: 315043 - DNA, 2748 bp, Homo sapiens
cgccggaagttgcagccgggaagcctgcgaggtcggttccgcccgactctaacatggcggcgccctttgtctgctctggagtgccgtccccggccttctcgcggccgtgatgcacctccctctgcggtggggtccgggacatggcaggtaatgagccggacgaggggagccaagctggagtttacacaggcaaactgtcagaaaagagtagcctgggctgtctggaaatctgagccatggactttccccagcacagccagcatgtcttggaacagctgaaccagcagcggcagctggggcttctctgtgactgcacctttgtggtggacggtgttcactttaaggctcataaagcagtgctggcggcctgcagcgagtacttcaagatgctcttcgtggaccagaaggacgtggtgcacctggacatcagtaacgcggcaggcctggggcaggtgctggagtttatgtacacggccaagctgagcctgagccctgagaacgtggatgatgtgctggccgtggccactttcctccaaatgcaggacatcatcacggcctgccatgccctcaagtcacttgctgagccggctaccagccctgggggaaatgcggaggccttggccacagaaggaggggacaagagagccaaagaggagaaggtggccaccagcacgctgagcaggctggagcaggcaggacgcagcacacccataggccccagcagggacctcaaggaggagcgcggcggtcaggcccagagtgcggccagcggtgcagagcagacagagaaagccgatgcgccccgggagccgccgcctgtggagctcaagccagaccccacgagtggcatggctgctgcagaagctgaggccgctttgtccgagagctcggagcaagaaatggaggtggagcccgcccggaaaggggaagaggagcaaaaggagcaagaggagcaagaggaggagggcgcagggccagctgaggtcaaggaggagggttcccagctggagaacggagaggcccccgaggagaacgagaatgaggagtcagcgggcacagactcggggcaggagctcggctccgaggcccggggcctgcgctcaggcacctacggcgaccgcacggagtccaaggcctacggctccgtcatccacaagtgcgaggactgtgggaaggagttcacgcacacggggaacttcaagcggcacatccgcatccacacgggggagaagcccttctcgtgccgggagtgcagcaaggccttttccgacccggccgcgtgcaaggcccatgagaagacgcacagccctctgaagccctacggctgcgaggagtgcgggaagagctaccgcctcatcagcctgctgaacctgcacaagaagcggcactcgggcgaggcgcgctaccgctgcgaggactgcggcaagctcttcaccacctcgggcaacctcaagcgccaccagctggtgcacagcggcgagaagccctaccagtgcgactactgcggccgctccttctccgaccccacttccaagatgcgccacctggagacccacgacacggacaaggagcacaagtgcccacactgcgacaagaagttcaaccaggtagggaacctgaaggcccacctgaagatccacatcgctgacgggcccctcaagtgccgagagtgtgggaagcagttcaccacctcagggaacctgaagcggcaccttcggatccacagcggggagaagccctacgtgtgcatccactgccagcgacagtttgcagaccccggcgctctgcagcggcacgtccgcattcacacaggtgagaagccatgccagtgtgtgatgtgcggtaaggccttcacccaggccagctccctcatcgcccacgtgcgccagcacaccggggagaagccctacgtctgcgagcgctgcggcaagagattcgtccagtccagccagttggccaatcatattcgccaccacgacaacatccgcccacacaagtgcagcgtgtgcagcaaggccttcgtgaacgtgggggacctgtccaagcacatcatcattcacactggagagaagccttacctgtgtgataagtgtgggcgtggcttcaaccgggtagacaacctgcgctcccacgtgaagaccgtgcaccagggcaaggcaggcatcaagatcctggagcccgaggagggcagtgaggtcagcgtggtcactgtggatgacatggtcacgctggctaccgaggcactggcagcgacagccgtcactcagctcacagtggtgccggtgggagctgcagtgacagccgatgagacggaagtcctgaaggccgagatcagcaaagctgtgaagcaagtgcaggaagaagaccccaacactcacatcctctacgcctgtgactcctgtggggacaagtttctggatgccaacagcctggctcagcatgtgcgaatccacacagcccaggcactggtcatgttccagacagacgcggacttctatcagcagtatgggccaggtggcacgtggcctgccgggcaggtgctgcaggctggggagctggtcttccgccctcgcgacggggctgagggccagcccgcactggcagagacctcccctacagctcctgaatgtcccccgcctgccgagtgagctggcggcccttctgactgtttatttaaggatggatggcaccctggaaccgggaagggtggcctgttccctagagagaataaattggattattttctaa

SEQ ID NO: 315044 - DNA, 3387 bp, Homo sapiens
cgccggaagttgcagccgggaagcctgcgaggtcggttccgcccgactctaacatggcggcgccctttgtctgctctggagtgccgtccccggccttctcgcggccgtgatgcacctccctctgcggtggggtccgggacatggcaggtaatgagccggacgaggggagccaagctggagtttacacaggcaaactgtcagaaaagagtagcctgggctgtctggaaatctgagccatggactttccccagcacagccagcatgtcttggaacagctgaaccagcagcggcagctggggcttctctgtgactgcacctttgtggtggacggtgttcactttaaggctcataaagcagtgctggcggcctgcagcgagtacttcaagatgctcttcgtggaccagaaggacgtggtgcacctggacatcagtaacgcggcaggcctggggcaggtgctggagtttatgtacacggccaagctgagcctgagccctgagaacgtggatgatgtgctggccgtggccactttcctccaaatgcaggacatcatcacggcctgccatgccctcaagtcacttgctgagccggctaccagccctgggggaaatgcggaggccttggccacagaaggaggggacaagagagccaaagaggagaaggtggccaccagcacgctgagcaggctggagcaggcaggacgcagcacacccataggccccagcagggacctcaaggaggagcgcggcggtcaggcccagagtgcggccagcggtgcagagcagacagagaaagccgatgcgccccgggagccgccgcctgtggagctcaagccagaccccacgagtggcatggctgctgcagaagctgaggccgctttgtccgagagctcggagcaagaaatggaggtggagcccgcccggaaaggggaagaggagcaaaaggagcaagaggagcaagaggaggagggcgcagggccagctgaggtcaaggaggagggttcccagctggagaacggagaggcccccgaggagaacgagaatgaggagtcagcgggcacagactcggggcaggagctcggctccgaggcccggggcctgcgctcaggcacctacggcgaccgcacggagtccaaggcctacggctccgtcatccacaagtgcgaggactgtgggaaggagttcacgcacacggggaacttcaagcggcacatccgcatccacacgggggagaagcccttctcgtgccgggagtgcagcaaggccttttccgacccggccgcgtgcaaggcccatgagaagacgcacagccctctgaagccctacggctgcgaggagtgcgggaagagctaccgcctcatcagcctgctgaacctgcacaagaagcggcactcgggcgaggcgcgctaccgctgcgaggactgcggcaagctcttcaccacctcgggcaacctcaagcgccaccagctggtgcacagcggcgagaagccctaccagtgcgactactgcggccgctccttctccgaccccacttccaagatgcgccacctggagacccacgacacggacaaggagcacaagtgcccacactgcgacaagaagttcaaccaggtagggaacctgaaggcccacctgaagatccacatcgctgacgggcccctcaagtgccgagagtgtgggaagcagttcaccacctcagggaacctgaagcggcaccttcggatccacagcggggagaagccctacgtgtgcatccactgccagcgacagtttgcagaccccggcgctctgcagcggcacgtccgcattcacacaggtgagaagccatgccagtgtgtgatgtgcggtaaggccttcacccaggccagctccctcatcgcccacgtgcgccagcacaccggggagaagccctacgtctgcgagcgctgcggcaagagattcgtccagtccagccagttggccaatcatattcgccaccacgacaacatccgcccacacaagtgcagcgtgtgcagcaaggccttcgtgaacgtgggggacctgtccaagcacatcatcattcacactggagagaagccttacctgtgtgataagtgtgggcgtggcttcaaccgggtagacaacctgcgctcccacgtgaagaccgtgcaccagggcaaggcaggcatcaagatcctggagcccgaggagggcagtgaggtcagcgtggtcactgtggatgacatggtcacgctggctaccgaggcactggcagcgacagccgtcactcagctcacagtggtgccggtgggagctgcagtgacagccgatgagacggaagtcctgaaggccgagatcagcaaagctgtgaagcaagtgcaggaagaagaccccaacactcacatcctctacgcctgtgactcctgtggggacaagtttctggatgccaacagcctggctcagcatgtgcgaatccacacagcccaggcactggtcatgttccagacagacgcggacttctatcagcagtatgggccaggtggcacgtggcctgccgggcaggtgctgcaggctggggagctggtcttccgccctcgcgacggggctgagggccagcccgcactggcagagacctcccctacagctcctgaatgtcccccgcctgccgagtgagctggcggcccttctgactgtttatttaaggatggatggcaccctggaaccgggaagggtggcctgttccctagagagaataaattggattattttctaaaaaaaaaaaaaaaaaaaaaaaaaaaaaaaaaaaaaaaaaaaaaaaaaaaaaaaaaggaggggggcccaacaaatagaaatgccccacaggagagggaacgaaagacacgcactagacacaacgatttagtgggaaacaacagaggggcccacaaaggaaggcagaatgaagaagaacgagaacgagagcagtgggcccgatgatataaaagagaagcgccagagacggggagaaaaagtggccaagacagcagcagcaccacactgaggaggaagaaaaaagacaaccaaacatatctgcatgagggggggaagaagacaaaaacaagcgaggcgaaccacaaacaacaacaaacgaacaaaagaactaaaaaaaaacaaacacataaaggaagggagaacacatcaacacaaaacaacacacaaagacaaagagagagaaggactaaaataagagggcgagagaacacacaaccaaacacgggacaaacataaaacagaagcagggaagcgaccagtagacaaagacaaagagagagggacgtcaaacgaagagaaatataaaagagacggacagaacgacacacacaatcaataacaacaaccggagcgagacgacacataagacaaaaaacgaaca

SEQ ID NO: 315045 - DNA, 3153 bp, Homo sapiens
cgccggaagttgcagccgggaagcctgcgaggtcggttccgcccgactctaacatggcggcgccctttgtctgctctggagtgccgtccccggccttctcgcggccgtgatgcacctccctctgcggtggggtccgggacatggcaggtaatgagccggacgaggggagccaagctggagtttacacaggcaaactgtcagaaaagagtagcctgggctgtctggaaatctgagccatggactttccccagcacagccagcatgtcttggaacagctgaaccagcagcggcagctggggcttctctgtgactgcacctttgtggtggacggtgttcactttaaggctcataaagcagtgctggcggcctgcagcgagtacttcaagatgctcttcgtggaccagaaggacgtggtgcacctggacatcagtaacgcggcaggcctggggcaggtgctggagtttatgtacacggccaagctgagcctgagccctgagaacgtggatgatgtgctggccgtggccactttcctccaaatgcaggacatcatcacggcctgccatgccctcaagtcacttgctgagccggctaccagccctgggggaaatgcggaggccttggccacagaaggaggggacaagagagccaaagaggagaaggtggccaccagcacgctgagcaggctggagcaggcaggacgcagcacacccataggccccagcagggacctcaaggaggagcgcggcggtcaggcccagagtgcggccagcggtgcagagcagacagagaaagccgatgcgccccgggagccgccgcctgtggagctcaagccagaccccacgagtggcatggctgctgcagaagctgaggccgctttgtccgagagctcggagcaagaaatggaggtggagcccgcccggaaaggggaagaggagcaaaaggagcaagaggagcaagaggaggagggcgcagggccagctgaggtcaaggaggagggttcccagctggagaacggagaggcccccgaggagaacgagaatgaggagtcagcgggcacagactcggggcaggagctcggctccgaggcccggggcctgcgctcaggcacctacggcgaccgcacggagtccaaggcctacggctccgtcatccacaagtgcgaggactgtgggaaggagttcacgcacacggggaacttcaagcggcacatccgcatccacacgggggagaagcccttctcgtgccgggagtgcagcaaggccttttccgacccggccgcgtgcaaggcccatgagaagacgcacagccctctgaagccctacggctgcgaggagtgcgggaagagctaccgcctcatcagcctgctgaacctgcacaagaagcggcactcgggcgaggcgcgctaccgctgcgaggactgcggcaagctcttcaccacctcgggcaacctcaagcgccaccagctggtgcacagcggcgagaagccctaccagtgcgactactgcggccgctccttctccgaccccacttccaagatgcgccacctggagacccacgacacggacaaggagcacaagtgcccacactgcgacaagaagttcaaccaggtgtgcggacccctcccggaaccagcgcctggcagccgccggtggccgcagccgcatgcatgccacgtggtggggcgggcggggagcacagccccggcctccaggagctcatcagcttgttcacccaggaaacaggcgcagcgatgagccacttccgcgggggagctcccggttgctctgcggagggcaggccgactcagggcggggtttggtcctgaaaaaatggggtggggcggcttacctctcaccgctgggacctgggacctctcctgacccaggagagatagagcccttcacggaccctggcaagcctgagagtcaattgttcctttgtgggaggggcaggtgagggggcccggggccgagctctgtggggtggcccccctgacccctccctgggcacaggtagggaacctgaaggcccacctgaagatccacatcgctgacgggcccctcaagtgccgagagtgtgggaagcagttcaccacctcagggaacctgaagcggcaccttcggatccacagcggggagaagccctacgtgtgcatccactgccagcgacagtttgcagaccccggcgctctgcagcggcacgtccgcattcacacaggtgagaagccatgccagtgtgtgatgtgcggtaaggccttcacccaggccagctccctcatcgcccacgtgcgccagcacaccggggagaagccctacgtctgcgagcgctgcggcaagagattcgtccagtccagccagttggccaatcatattcgccaccacgacaacatccgcccacacaagtgcagcgtgtgcagcaaggccttcgtgaacgtgggggacctgtccaagcacatcatcattcacactggagagaagccttacctgtgtgataagtgtgggcgtggcttcaaccgggtagacaacctgcgctcccacgtgaagaccgtgcaccagggcaaggcaggcatcaagatcctggagcccgaggagggcagtgaggtcagcgtggtcactgtggatgacatggtcacgctggctaccgaggcactggcagcgacagccgtcactcagctcacagtggtgccggtgggagctgcagtgacagccgatgagacggaagtcctgaaggccgagatcagcaaagctgtgaagcaagtgcaggaagaagaccccaacactcacatcctctacgcctgtgactcctgtggggacaagtttctggatgccaacagcctggctcagcatgtgcgaatccacacagcccaggcactggtcatgttccagacagacgcggacttctatcagcagtatgggccaggtggcacgtggcctgccgggcaggtgctgcaggctggggagctggtcttccgccctcgcgacggggctgagggccagcccgcactggcagagacctcccctacagctcctgaatgtcccccgcctgccgagtgagctggcggcccttctgactgtttatttaaggatggatggcaccctggaaccgggaagggtggcctgttccctagagagaataaattggattattttctaa

SEQ ID NO: 315046 - DNA, 2840 bp, Homo sapiens
cgccggaagttgcagccgggaagcctgcgaggtcggttccgcccgactctaacatggcggcgccctttgtctgctctggagtgccgtccccggccttctcgcggccgtgatgcacctccctctgcggtggggtccgggacatggcaggtaatgagccggacgaggggagccaagctggagtttacacaggcaaactgtcagaaaagagtagcctgggctgtctggaaatctgagccatggactttccccagcacagccagcatgtcttggaacagctgaaccagcagcggcagctggggcttctctgtgactgcacctttgtggtggacggtgttcactttaaggctcataaagcagtgctggcggcctgcagcgagtacttcaagatgctcttcgtggaccagaaggacgtggtgcacctggacatcagtaacgcggcaggcctggggcaggtgctggagtttatgtacacggccaagctgagcctgagccctgagaacgtggatgatgtgctggccgtggccactttcctccaaatgcaggacatcatcacggcctgccatgccctcaagtcacttgctgagccggctaccagccctgggggaaatgcggaggccttggccacagaaggaggggacaagagagccaaagaggagaaggtggccaccagcacgctgagcaggctggagcaggcaggacgcagcacacccataggccccagcagggacctcaaggaggagcgcggcggtcaggcccagagtgcggccagcggtgcagagcagacagagaaagccgatgcgccccgggagccgccgcctgtggagctcaagccagaccccacgagtggcatggctgctgcagaagctgaggccgctttgtccgagagctcggagcaagaaatggaggtggagcccgcccggaaaggggaagaggagcaaaaggagcaagaggagcaagaggaggagggcgcagggccagctgaggtcaaggaggagggttcccagctggagaacggagaggcccccgaggagaacgagaatgaggagtcagcgggcacagactcggggcaggagctcggctccgaggcccggggcctgcgctcaggcacctacggcgaccgcacggagtccaaggcctacggctccgtcatccacaagtgcgaggactgtgggaaggagttcacgcacacggggaacttcaagcggcacatccgcatccacacgggggagaagcccttctcgtgccgggagtgcagcaaggccttttccgacccggccgcgtgcaaggcccatgagaagacgcacagccctctgaagccctacggctgcgaggagtgcgggaagagctaccgcctcatcagcctgctgaacctgcacaagaagcggcactcgggcgaggcgcgctaccgctgcgaggactgcggcaagctcttcaccacctcgggcaacctcaagcgccaccagctggtgcacagcggcgagaagccctaccagtgcgactactgcggccgctccttctccgaccccacttccaagatgcgccacctggagacccacgacacggacaaggagcacaagtgcccacactgcgacaagaagttcaaccaggtagggaacctgaaggcccacctgaagatccacatcgctgacgggcccctcaagtgccgagagtgtgggaagcagttcaccacctcaggtagggccagggctgccctggctgccctcacacccctgctcctcggccaccggtggtgccccacgccaggttcgccctcggtctcgccacagggaacctgaagcggcaccttcggatccacagcggggagaagccctacgtgtgcatccactgccagcgacagtttgcagaccccggcgctctgcagcggcacgtccgcattcacacaggtgagaagccatgccagtgtgtgatgtgcggtaaggccttcacccaggccagctccctcatcgcccacgtgcgccagcacaccggggagaagccctacgtctgcgagcgctgcggcaagagattcgtccagtccagccagttggccaatcatattcgccaccacgacaacatccgcccacacaagtgcagcgtgtgcagcaaggccttcgtgaacgtgggggacctgtccaagcacatcatcattcacactggagagaagccttacctgtgtgataagtgtgggcgtggcttcaaccgggtagacaacctgcgctcccacgtgaagaccgtgcaccagggcaaggcaggcatcaagatcctggagcccgaggagggcagtgaggtcagcgtggtcactgtggatgacatggtcacgctggctaccgaggcactggcagcgacagccgtcactcagctcacagtggtgccggtgggagctgcagtgacagccgatgagacggaagtcctgaaggccgagatcagcaaagctgtgaagcaagtgcaggaagaagaccccaacactcacatcctctacgcctgtgactcctgtggggacaagtttctggatgccaacagcctggctcagcatgtgcgaatccacacagcccaggcactggtcatgttccagacagacgcggacttctatcagcagtatgggccaggtggcacgtggcctgccgggcaggtgctgcaggctggggagctggtcttccgccctcgcgacggggctgagggccagcccgcactggcagagacctcccctacagctcctgaatgtcccccgcctgccgagtgagctggcggcccttctgactgtttatttaaggatggatggcaccctggaaccgggaagggtggcctgttccctagagagaataaattggattattttctaa

SEQ ID NO: 315047 - DNA, 2358 bp, Homo sapiens
ccggtgccggatcttgaggtgggtctgtgacagctgtcctgtccttggtaggcctggggcaggtgctggagtttatgtacacggccaagctgagcctgagccctgagaacgtggatgatgtgctggccgtggccactttcctccaaatgcaggacatcatcacggcctgccatgccctcaagtcacttgctgagccggctaccagccctgggggaaatgcggaggccttggccacagaaggaggggacaagagagccaaagaggagaaggtggccaccagcacgctgagcaggctggagcaggcaggacgcagcacacccataggccccagcagggacctcaaggaggagcgcggcggtcaggcccagagtgcggccagcggtgcagagcagacagagaaagccgatgcgccccgggagccgccgcctgtggagctcaagccagaccccacgagtggcatggctgctgcagaagctgaggccgctttgtccgagagctcggagcaagaaatggaggtggagcccgcccggaaaggggaagaggagcaaaaggagcaagaggagcaagaggaggagggcgcagggccagctgaggtcaaggaggagggttcccagctggagaacggagaggcccccgaggagaacgagaatgaggagtcagcgggcacagactcggggcaggagctcggctccgaggcccggggcctgcgctcaggcacctacggcgaccgcacggagtccaaggcctacggctccgtcatccacaagtgcgaggactgtgggaaggagttcacgcacacggggaacttcaagcggcacatccgcatccacacgggggagaagcccttctcgtgccgggagtgcagcaaggccttttccgacccggccgcgtgcaaggcccatgagaagacgcacagccctctgaagccctacggctgcgaggagtgcgggaagagctaccgcctcatcagcctgctgaacctgcacaagaagcggcactcgggcgaggcgcgctaccgctgcgaggactgcggcaagctcttcaccacctcgggcaacctcaagcgccaccagctggtgcacagcggcgagaagccctaccagtgcgactactgcggccgctccttctccgaccccacttccaagatgcgccacctggagacccacgacacggacaaggagcacaagtgcccacactgcgacaagaagttcaaccaggtagggaacctgaaggcccacctgaagatccacatcgctgacgggcccctcaagtgccgagagtgtgggaagcagttcaccacctcagggaacctgaagcggcaccttcggatccacagcggggagaagccctacgtgtgcatccactgccagcgacagtttgcagaccccggcgctctgcagcggcacgtccgcattcacacaggtgagaagccatgccagtgtgtgatgtgcggtaaggccttcacccaggccagctccctcatcgcccacgtgcgccagcacaccggggagaagccctacgtctgcgagcgctgcggcaagagattcgtccagtccagccagttggccaatcatattcgccaccacgacaacatccgcccacacaagtgcagcgtgtgcagcaaggccttcgtgaacgtgggggacctgtccaagcacatcatcattcacactggagagaagccttacctgtgtgataagtgtgggcgtggcttcaaccgggtagacaacctgcgctcccacgtgaagaccgtgcaccagggcaaggcaggcatcaagatcctggagcccgaggagggcagtgaggtcagcgtggtcactgtggatgacatggtcacgctggctaccgaggcactggcagcgacagccgtcactcagctcacagtggtgccggtgggagctgcagtgacagccgatgagacggaagtcctgaaggccgagatcagcaaagctgtgaagcaagtgcaggaagaagaccccaacactcacatcctctacgcctgtgactcctgtggggacaagtttctggatgccaacagcctggctcagcatgtgcgaatccacacagcccaggcactggtcatgttccagacagacgcggacttctatcagcagtatgggccaggtggcacgtggcctgccgggcaggtgctgcaggctggggagctggtcttccgccctcgcgacggggctgagggccagcccgcactggcagagacctcccctacagctcctgaatgtcccccgcctgccgagtgagctggcggcccttctgactgtttatttaaggatggatggcaccctggaaccgggaagggtggcctgttccctagagagaataaattggattattttctaa

SEQ ID NO: 315048 - DNA, 1123 bp, Homo sapiens
cgccggaagttgcagccgggaagcctgcgaggtcggttccgcccgactctaacatggcggcgccctttgtctgctctggagtgccgtccccggccttctcgcggccgtgatgcacctccctctgcggtggggtccgggacatggcaggtaatgagccggacgaggggagccaagctggagtttacacaggcaaactgtcagaaaagagtagcctgggctgtctggaaatctgagccatggactttccccagcacagccagcatgtcttggaacagctgaaccagcagcggcagctggggcttctctgtgactgcacctttgtggtggacggtgttcactttaaggctcataaagcagtgctggcggcctgcagcgagtacttcaagatgctcttcgtggaccagaaggacgtggtgcacctggacatcagtaacgcggcaggcctggggcaggtgctggagtttatgtacacggccaagctgagcctgagccctgagaacgtggatgatgtgctggccgtggccactttcctccaaatgcaggacatcatcacggcctgccatgccctcaagtcacttgctgagccggctaccagccctgggggaaatgcggaggccttggccacagaaggaggggacaagagagccaaagaggagaaggtggccaccagcacgctgagcaggctggagcaggcaggacgcagcacacccataggccccagcagggacctcaaggaggagcgcggcggtcaggcccagagtgcggccagcggtgcagagcagacagagaaagccgatgcgccccgggagccgccgcctgtggagctcaagccagaccccacgagtggcatggctgctgcagaagctgaggccgctttgtccgagagctcggagcaagtggcctgccgggcaggtgctgcaggctggggagctggtcttccgccctcgcgacggggctgagggccagcccgcactggcagagacctcccctacagctcctgaatgtcccccgcctgccgagtgagctggcggcccttctgactgtttatttaaggatggatggcaccctggaaccgggaagggtggcctgttccctagagagaataaattggattattttctaa

SEQ ID NO: 315049 - DNA, 1225 bp, Homo sapiens
cgccggaagttgcagccgggaagcctgcgaggtcggttccgcccgactctaacatggcggcgccctttgtctgctctggagtgccgtccccggccttctcgcggccgtgatgcacctccctctgcggtggggtccgggacatggcaggtaatgagccggacgaggggagccaagctggagtttacacaggcaaactgtcagaaaagagtagcctgggctgtctggaaatctgagccatggactttccccagcacagccagcatgtcttggaacagctgaaccagcagcggcagctggggcttctctgtgactgcacctttgtggtggacggtgttcactttaaggctcataaagcagtgctggcggcctgcagcgagtacttcaagatgctcttcgtggaccagaaggacgtggtgcacctggacatcagtaacgcggcaggcctggggcaggtgctggagtttatgtacacggccaagctgagcctgagccctgagaacgtggatgatgtgctggccgtggccactttcctccaaatgcaggacatcatcacggcctgccatgccctcaagtcacttgctgagccggctaccagccctgggggaaatgcggaggccttggccacagaaggaggggacaagagagccaaagaggagaaggtggccaccagcacgctgagcaggctggagcaggcaggacgcagcacacccataggccccagcagggacctcaaggaggagcgcggcggtcaggcccagagtgcggccagcggtgagtcagatgccaaggacccagccggctgtcctgtcacctcccagcagcctgggcacagggtagtgagggctgccttggggcaggtagcacgggcacctgcacctcttgagcctgtgttacccagaatgacctattgtgtgttccagggggtctgtttcaaccagagcactggtcatgttccagacagacgcggacttctatcagcagtatgggccaggtggcacgtggcctgccgggcaggtgctgcaggctggggagctggtcttccgccctcgcgacggggctgagggccagcccgcactggcagagacctcccctacagctcctgaatgtcccccgcctgccgagtgagctggcggcccttctgactgtttatttaaggatggatggcaccctggaaccgggaagggtggcctgttccctagagagaataaattggattattttctaa

SEQ ID NO: 315050 - DNA, 360 bp, Homo sapiens
catgatgttactgttatatttggaagagaaaccaaggcaggggtacaatgaggacaactctgagcgccgaagtactgtaaggtggaacttttggatagctaggcgcatgcgtctgtctatgggcgctctcctagcgaggacgctgcgcatgcgccggaagttgcagccgggaagcctgcgaggtcggttccgcccgactctaacatggcggcgccctttgtctgctctggagtgccgtccccggccttctcgcggccgtgatgcacctccctctgcggtggggtccgggacatggcaggtgagtgtcaacaatcgcccggggccggggaagtcccgggagccggggcggaggcggcggag

SEQ ID NO: 315051 - DNA, 518 bp, Homo sapiens
tgctgggattacaggcgtgagccaccgcgcccggcccatatttttttaatgatagaaaatgaaactgaaattcagtttcagtttcatttaatataccatggtacacaatggtatataccatattttaaagctaaaattcagtattaatgtatttacagtgttgtgcaaccaccatctcactctcgtttcaaaactttcatcagcccataaaaacactccatatccattaaataatcaccaccactccctcattctctagtaacctctaatgggtattctgactatggatttgcctattctggatttatcatataaaagcagtcatacaatatgcgaccttttgtgtctttcagctggcatagtattttcaaatttcatccaagttgtagcatgtatcagtactttggttttttgtatggctaagtaatattccgtgtgtgtgtgtggcggatttcgccatccattcatttgttgatggacatttggttttgtttctaccatttggctattgtaatgat

SEQ ID NO: 315052 - DNA, 1042 bp, Homo sapiens
cgtggtaccggcgcatcacgtgggcgagttaggtgacgctgcggggcgggcggacagactgcgggacggacggtggacgctgggacgcgtttgtagctccggccccgccgttccgacccccgccgccgtcgccgccatgacggggctagcactgctctactccggggtcttcgtggccttctgggcctgcgcgctggccgtgggagtctgctacaccatttttgatttgggcttccgctttgatgtggcatggttcctgacggagacttcgcccttcatgtggtccaacctgggcattggcctagctatctccctgtctgtggttggggcagcctggggcatctatattaccggctcctccatcattggtggaggagtgaaggcccccaggatcaagaccaagaacctggtcagcatcatcttctgtgaggctgtggccatctacggcatcatcatggcaattgtcattagcaacatggctgagcctttcagtgccacagaccccaaggccatcggccatcggaactaccatgcaggctactccatgtttggggctggcctcaccgtaggcctgtctaacctcttctgtggagtctgcgtgggcatcgtgggcagtggggctgccctggccgatgctcagaaccccagcctctttgtaaagattctcatcgtggagatctttggcagcgccattggcctctttggggtcatcgtcgcaattcttcagacctccagagtgaagatgggtgactagatgatatgtgtgggtggggccgtgcctcacttttatttattgctggttttcctgggacagctggagctgtgtcccttagcctttcagaggcttggtgttcagggccctccctgcactcccctcttgctgcgtgttgatttggaggcactgcagtccaggccgagtcctcagtgcggggagcaggctgctgctgctgactctgtgcagctgcgcacctgtgtcccccacctccaccctcaacccatcttcctagtgtttgtgaaataaacttggtatttgtctgggtca

SEQ ID NO: 315053 - DNA, 825 bp, Homo sapiens
gagctgaactgctttcttctctgcttccacaacaggttcctgacggagacttcgcccttcatgtggtccaacctgggcattggcctagctatctccctgtctgtggttggggcagcctggggcatctatattaccggctcctccatcattggtggaggagtgaaggcccccaggatcaagaccaagaacctggtcagcatcatcttctgtgaggctgtggccatctacggcatcatcatggcaattgtcattagcaacatggctgagcctttcagtgccacagaccccaaggccatcggccatcggaactaccatgcaggctactccatgtttggggctggcctcaccgtaggcctgtctaacctcttctgtggagtctgcgtgggcatcgtgggcagtggggctgccctggccgatgctcagaaccccagcctctttgtaaagattctcatcgtggagatctttggcagcgccattggcctctttggggtcatcgtcgcaattcttcagacctccagagtgaagatgggtgactagatgatatgtgtgggtggggccgtgcctcacttttatttattgctggttttcctgggacagctggagctgtgtcccttagcctttcagaggcttggtgttcagggccctccctgcactcccctcttgctgcgtgttgatttggaggcactgcagtccaggccgagtcctcagtgcggggagcaggctgctgctgctgactctgtgcagctgcgcacctgtgtcccccacctccaccctcaacccatcttcctagtgtttgtgaaataaacttggtatttgtctgggtca

SEQ ID NO: 315054 - DNA, 1288 bp, Homo sapiens
  misc_feature (1118)..(1118): n is a, c, g, or t
cgtggtaccggcgcatcacgtgggcgagttaggtgacgctgcggggcgggcggacagactgcgggacggacggtggacgctgggacgcgtttgtagctccggccccgccgttccgacccccgccgccgtcgccgccatgacggggctagcactgctctactccggggtcttcgtggccttctgggcctgcgcgctggccgtgggagtctgctacaccatttttgatttgggcttccgctttgatgtggcatggttcctgacggagacttcgcccttcatgtggtccaacctgggcattggcctagctatctccctgtctgtggttggggcagcctggggcatctatattaccggctcctccatcattggtggaggagtgaaggcccccaggatcaagaccaagaacctggtcagcatcatcttctgtgaggctgtggccatctacggcatcatcatggcaattgtcattagcaacatggctgagcctttcagtgccacagaccccaaggccatcggccatcggaactaccatgcaggctactccatgtttggggctggcctcaccgtaggcctgtctaacctcttctgtggagtctgcgtgggcatcgtgggcagtggggctgccctggccgatgctcagaaccccagcctctttgtaaagattctcatcgtggagatctttggcagcgccattggcctctttggggtcatcgtcgcaattcttcagacctccagagtgaagatgggtgactagatgatatgtgtgggtggggccgtgcctcacttttatttattgctggttttcctgggacagctggagctgtgtcccttagcctttcagaggcttggtgttcagggccctccctgcactcccctcttgctgcgtgttgatttggaggcactgcagtccaggccgagtcctcagtgcggggagcaggctgctgctgctgactctgtgcagctgcgcacctgtgtcccccacctccaccctcaacccatcttcctagtgtttgtgaaataaacttggtatttgtctgggtcaaaaaaaaaaaaaaaaaaaaaaaaaaaaaaaaaaaaaaaaataaagaaaaaacacgaaacacaatagggactaaaangagacatattacaattaaaatctcggggggggccccggcacccaattggccctatagtggggcgaatccaatacactgcccgcagtttaacaccggttgggactgggacttgccgaattaacgaaaggccccaaccagaaggccttttccaaacagttgcgcaactttga

SEQ ID NO: 315055 - DNA, 1468 bp, Homo sapiens
cgtggtaccggcgcatcacgtgggcgagttaggtgacgctgcggggcgggcggacagactgcgggacggacggtggacgctgggacgcgtttgtagctccggccccgccgttccgacccccgccgccgtcgccgccatgacggggctagcactgctctactccggggtcttcgtggccttctgggcctgcgcgctggccgtgggagtctgctacaccatttttgatttgggcttccgctttgatgtggcatggttcctgacggagacttcgcccttcatgtggtccaacctgggcattggcctagctatctccctgtctgtggttggggcagcctggggcatctatattaccggctcctccatcattggtggaggagtgaaggcccccaggatcaagaccaagaacctggtcagcatcatcttctgtgaggctgtggccatctacggcatcatcatggcaattgtcattagcaacatggctgagcctttcagtgccacagaccccaaggccatcggccatcggaactaccatgcaggctactccatgtttggggctggcctcaccgtaggcctgtctaacctcttctgtggagtctgcgtgggcatcgtgggcagtggggctgccctggccgatgctcagaaccccagcctctttgtaaagattctcatcgtggagatctttggcagcgccattggcctctttggggtcatcgtcgcaattcttcagacctccagagtgaagatgggtgactagatgatatgtgtgggtggggccgtgcctcacttttatttattgctggttttcctgggacagctggagctgtgtcccttagcctttcagaggcttggtgttcagggccctccctgcactcccctcttgctgcgtgttgatttggaggcactgcagtccaggccgagtcctcagtgcggggagcaggctgctgctgctgactctgtgcagctgcgcacctgtgtcccccacctccaccctcaacccatcttcctagtgtttgtgaaataaacttggtatttgtctgggtcaaaaaaaaaaaaaaaaaaaaaaaaaaaacaactgtgtgtgtggggcgcgcgccgcgggcccccgcgaaaagagcctttaacagaacacatgcgcggggggcgcgcgcgggggccccgaggagggtaaagcggaacacggggcccaaatacgcggctctcccaagaggaagaaccggggcccagagaaacagaggggggagaaattctctccccattaaaaaaaggcccggggggccacccgcgaagagcgttccggaaaaaaaacccaaaagggagaatacggggagcgaccacaagaggggaactcaatcaacgggggagtccaaggcagaaaccccgaaaaatccaactataaacccggactgcggggcagcacaccacaaaccacgatacacacaccgaccacacaaccaacaccgaccacaaa

SEQ ID NO: 315056 - DNA, 1134 bp, Homo sapiens
  misc_feature (1048)..(1048): n is a, c, g, or t
cgtggtaccggcgcatcacgtgggcgagttaggtgacgctgcggggcgggcggacagactgcgggacggacggtggacgctgggacgcgtttgtagctccggccccgccgttccgacccccgccgccgtcgccgccatgacggggctagcactgctctactccggggtcttcgtggccttctgggcctgcgcgctggccgtgggagtctgctacaccatttttgatttgggcttccgctttgatgtggcatggttcctgacggagacttcgcccttcatgtggtccaacctgggcattggcctagctatctccctgtctgtggttggggcagcctggggcatctatattaccggctcctccatcattggtggaggagtgaaggcccccaggatcaagaccaagaacctggtcagcatcatcttctgtgaggctgtggccatctacggcatcatcatggcaattgtcattagcaacatggctgagcctttcagtgccacagaccccaaggccatcggccatcggaactaccatgcaggctactccatgtttggggctggcctcaccgtaggcctgtctaacctcttctgtggagtctgcgtgggcatcgtgggcagtggggctgccctggccgatgctcagaaccccagcctctttgtaaagattctcatcgtggagatctttggcagcgccattggcctctttggggtcatcgtcgcaattcttcagacctccagagtgaagatgggtgactagatgatatgtgtgggtggggccgtgcctcacttttatttattgctggttttcctgggacagctggagctgtgtcccttagcctttcagaggcttggtgttcagggccctccctgcactcccctcttgctgcgtgttgatttggaggcactgcagtccaggccgagtcctcagtgcggggagcaggctgctgctgctgactctgtgcagctgcgcacctgtgtcccccacctccaccctcaacccatcttcctagtgtttgtgaaataaacttggtatttgtctgggtcaaaaaanacaaaaaatatatattttatattttctatcttctatcactctatatctctcctctcttctccttttacctaaacaaaataatcacg

SEQ ID NO: 315057 - DNA, 1094 bp, Homo sapiens
cgtggtaccggcgcatcacgtgggcgagttaggtgacgctgcggggcgggcggacagactgcgggacggacggtggacgctgggacgcgtttgtagctccggccccgccgttccgacccccgccgccgtcgccgccatgacggggctagcactgctctactccggggtcttcgtggccttctgggcctgcgcgctggccgtgggagtctgctacaccatttttgatttgggcttccgctttgatgtggcatggttcctgacggagacttcgcccttcatgtggtccaacctgggcattggcctagctatctccctgtctgtggttggggcagcctggggcatctatattaccggctcctccatcattggtggaggagtgaaggcccccaggatcaagaccaagaacctggtcagcatcatcttctgtgaggctgtggccatctacggcatcatcatggcaattgtcattagcaacatggctgagcctttcagtgccacagaccccaaggccatcggccatcggaactaccatgcaggctactccatgtttggggctggcctcaccgtaggcctgtctaacctcttctgtggagtctgcgtgggcatcgtgggcagtggggctgccctggccgatgctcagaaccccagcctctttgtaaagattctcatcgtggagatctttggcagcgccattggcctctttggggtcatcgtcgcaattcttcagacctccagagtgaagatgggtgactagatgatatgtgtgggtggggccgtgcctcacttttatttattgctggttttcctgggacagctggagctgtgtcccttagcctttcagaggcttggtgttcagggccctccctgcactcccctcttgctgcgtgttgatttggaggcactgcagtccaggccgagtcctcagtgcggggagcaggctgctgctgctgactctgtgcagctgcgcacctgtgtcccccacctccaccctcaacccatcttcctagtgtttgtgaaataaacttggtatttgtctgggtcaaaaaaaaagtcgagcgccgcgaaatttagtagtagtagtaggtcgcggccgc

SEQ ID NO: 315058 - DNA, 1734 bp, Homo sapiens
cgtggtaccggcgcatcacgtgggcgagttaggtgacgctgcggggcgggcggacagactgcgggacggacggtggacgctgggacgcgtttgtagctccggccccgccgttccgacccccgccgccgtcgccgccatgacggggctagcactgctctactccggggtcttcgtggccttctgggcctgcgcgctggccgtgggtgaggccgggtcctggcgggcgggagcagcatcgcggccgagctggccgggtcggaactcggcggggaagtggcctgcggggaatactggccccccgcgcgctctgcacccgaggctctggggacttgcgcctgcgagggcctctgactccgacaaaggagacccggatttccagctgcttgaggaggggtgcgggcgggtaggggccgcgagggcagcactcccccgtcctgccactatcgctgtctcccctcgctcccacgtctcactgctgtcccccctttcttgctcctgaccggcccgctcggtcacaagccggctgctccggttcctcttttcccagtcgctttgccctcccccacccacagcttgttgggtaaacagcggaacggactgggccggcgggatctggctggagcgcttgctccctcggtcccgcctcggattcgggcttgcgggtggcgaccctgcctgcgcaggtgcttggtctgggaggtggttttagcgagggaatggcagaaaatggaggcctaagcagaggaatctgtctacacagctgtactgtcacctgggggcagcctgaggacgccccttcagggaggtggcccttcagctcggcagctactttaggttgaagaacttctctctaccgagcagcccgtaaccccctttttctccctcactgctgcaggagtctgctacaccatttttgatttgggcttccgctttgatgtggcatggttcctgacggagacttcgcccttcatgtggtccaacctgggcattggcctagctatctccctgtctgtggttggggcagcctggggcatctatattaccggctcctccatcattggtggaggagtgaaggcccccaggatcaagaccaagaacctggtcagcatcatcttctgtgaggctgtggccatctacggcatcatcatggcaattgtcattagcaacatggctgagcctttcagtgccacagaccccaaggccatcggccatcggaactaccatgcaggctactccatgtttggggctggcctcaccgtaggcctgtctaacctcttctgtggagtctgcgtgggcatcgtgggcagtggggctgccctggccgatgctcagaaccccagcctctttgtaaagattctcatcgtggagatctttggcagcgccattggcctctttggggtcatcgtcgcaattcttcagacctccagagtgaagatgggtgactagatgatatgtgtgggtggggccgtgcctcacttttatttattgctggttttcctgggacagctggagctgtgtcccttagcctttcagaggcttggtgttcagggccctccctgcactcccctcttgctgcgtgttgatttggaggcactgcagtccaggccgagtcctcagtgcggggagcaggctgctgctgctgactctgtgcagctgcgcacctgtgtcccccacctccaccctcaacccatcttcctagtgtttgtgaaataaacttggtatttgtctgggtca

SEQ ID NO: 315059 - DNA, 993 bp, Homo sapiens
cgtggtaccggcgcatcacgtgggcgagttaggtgacgctgcggggcgggcggacagactgcgggacggacggtggacgctgggacgcgtttgtagctccggccccgccgttccgacccccgccgccgtcgccgccatgacggggctagcactgctctactccggggtcttcgtggccttctgggcctgcgcgctggccgtgggttcctgacggagacttcgcccttcatgtggtccaacctgggcattggcctagctatctccctgtctgtggttggggcagcctggggcatctatattaccggctcctccatcattggtggaggagtgaaggcccccaggatcaagaccaagaacctggtcagcatcatcttctgtgaggctgtggccatctacggcatcatcatggcaattgtcattagcaacatggctgagcctttcagtgccacagaccccaaggccatcggccatcggaactaccatgcaggctactccatgtttggggctggcctcaccgtaggcctgtctaacctcttctgtggagtctgcgtgggcatcgtgggcagtggggctgccctggccgatgctcagaaccccagcctctttgtaaagattctcatcgtggagatctttggcagcgccattggcctctttggggtcatcgtcgcaattcttcagacctccagagtgaagatgggtgactagatgatatgtgtgggtggggccgtgcctcacttttatttattgctggttttcctgggacagctggagctgtgtcccttagcctttcagaggcttggtgttcagggccctccctgcactcccctcttgctgcgtgttgatttggaggcactgcagtccaggccgagtcctcagtgcggggagcaggctgctgctgctgactctgtgcagctgcgcacctgtgtcccccacctccaccctcaacccatcttcctagtgtttgtgaaataaacttggtatttgtctgggtca

SEQ ID NO: 315060 - DNA, 947 bp, Homo sapiens
cgtggtaccggcgcatcacgtgggcgagttaggtgacgctgcggggcgggcggacagactgcgggacggacggtggacgctgggacgcgtttgtagctccggccccgccgttccgacccccgccgccgtcgccgccatgacggggctagcactgctctactccggggtcttcgtggccttctgggcctgcgcgctggccgtgggttcctgacggagacttcgcccttcatgtggtccaacctgggcattggcctagctatctccccatcattggtggaggagtgaaggcccccaggatcaagaccaagaacctggtcagcatcatcttctgtgaggctgtggccatctacggcatcatcatggcaattgtcattagcaacatggctgagcctttcagtgccacagaccccaaggccatcggccatcggaactaccatgcaggctactccatgtttggggctggcctcaccgtaggcctgtctaacctcttctgtggagtctgcgtgggcatcgtgggcagtggggctgccctggccgatgctcagaaccccagcctctttgtaaagattctcatcgtggagatctttggcagcgccattggcctctttggggtcatcgtcgcaattcttcagacctccagagtgaagatgggtgactagatgatatgtgtgggtggggccgtgcctcacttttatttattgctggttttcctgggacagctggagctgtgtcccttagcctttcagaggcttggtgttcagggccctccctgcactcccctcttgctgcgtgttgatttggaggcactgcagtccaggccgagtcctcagtgcggggagcaggctgctgctgctgactctgtgcagctgcgcacctgtgtcccccacctccaccctcaacccatcttcctagtgtttgtgaaataaacttggtatttgtctgggtca

SEQ ID NO: 315061 - DNA, 1806 bp, Homo sapiens
cgtggtaccggcgcatcacgtgggcgagttaggtgacgctgcggggcgggcggacagactgcgggacggacggtggacgctgggacgcgtttgtagctccggccccgccgttccgacccccgccgccgtcgccgccatgacggggctagcactgctctactccggggtcttcgtggccttctgggcctgcgcgctggccgtgggagtctgctacaccatttttgatttgggcttccgctttgatgtggcatggttcctgacggagacttcgcccttcatgtggtccaacctgggcattggcctagctatctccctgtctgtggttggggcagcctggggcatctatattaccggctcctccatcattggtggaggagtgaaggcccccaggatcaagaccaagaacctggtcagcatcatcttctgtgaggctgtggccatctacggcatcatcatggcaattgtcattagcaacatggctgagcctttcagtgccacagaccccaaggccatcggccatcggaactaccatgcaggctactccatgtttggggctggcctcaccgtaggcctgtctaacctcttctgtggagtctgcgtgggcatcgtgggcagtggggctgccctggccgatgctcagaaccccagcctctttgtaaagattctcatcgtggagatctttggcagcgccattggcctctttggggtcatcgtcgcaattcttcaggtgatgaatccccttgggaagcctctgtgtccttgtccccaacctagccttaccctccttctggagaagctgaagtgctctccttctctacctataactatagattcccccaaacagcttccacctcctcatttccatcttctggttttctcctacagggggctctctatttttgtctctgatttggtgtcactgacaacagccctgttctttttcccccctttctaatgcgttgtatctgtatagcacttagtcctccctctttctgttctctcattttatctgccatgcttttcatgtctccagtctgtatttgtgatctagactagaatggaattttgtctgtctatatcagtctgtcatggtgtgtttgactgtctctcggagctatgtgtatctccctctcacatgcctgtcagtaggacaccattgtctaaattgtgtgtgtctagtctgtctgacagtgtgtgagtttgtgactaaggatcagcctgagggtctgagtgtgactgtgggtgcttgactgagttgattcttagtgactagctttatccatatgccacttctctccgtctgtcccacagcgtaactctgtggttgtctgtccctgtctgccttgtctgtcacagtgtgtccatcctggttagtcatatatctcttgtggtctgtccatccaaccatgtgctagatgtcatcttctatcatttgtcactgccttacctattcctctgtccctgcctgatttctcctgttctttttttgcaacctccagagtgaagatgggtgactagatgatatgtgtgggtggggccgtgcctcacttttatttattgctggttttcctgggacagctggagctgtgtcccttagcctttcagaggcttggtgttcagggccctccctgcactcccctcttgctgcgtgttgatttggaggcactgcagtccaggccgagtcctcagtgcggggagcaggctgctgctgctgactctgtgcagctgcgcacctgtgtcccccacctccaccctcaacccatcttcctagtgtttgtgaaataaacttggtatttgtctgggtca

SEQ ID NO: 315062 - DNA, 1074 bp, Homo sapiens
cgtggtaccggcgcatcacgtgggcgagttaggtgacgctgcggggcgggcggacagactgcgggacggacggtggacgctgggacgcgtttgtagctccggccccgccgttccgacccccgccgccgtcgccgccatgacggggctagcactgctctactccggggtcttcgtggccttctgggcctgcgcgctggccgtgggtgaggccgggtcctggcgggcgggagcagcatcgcggccgagctggccgggtcggaactcggcggggaagtggcctgcggggaatactggccccccgcgcgctctgcacccgaggctctggggacttgcgcctgcgagggcctctgactccgacaaaggagacccggatttccagctgcttgaggaggggtgcgggcgggtaggggccgcgagggcagcactcccccgtcctgccactatcgctgtctcccctcgctcccacgtctcactgctgtcccccctttcttgctcctgaccggcccgctcggtcacaagccggctgctccggttcctcttttcccagtcgctttgccctcccccacccacagcttgttgggtaaacagcggaacggactgggccggcgggatctggctggagcgcttgctccctcggtcccgcctcggattcgggcttgcgggtggcgaccctgcctgcgcaggtgcttggtctgggaggtggttttagcgagggaatggcagaaaatggaggcctaagcagaggaatctgtctacacagctgtactgtcacctgggggcagcctgaggacgccccttcagggaggtggcccttcagctcggcagctactttaggttgaagaacttctctctaccgagcagcccgtaaccccctttttctccctcactgctgcaggagtctgctacaccatttttgatttgggcttccgctttgatgtggcatggtaagggagggcagggggaggattccccttgaagcttcttccctgcagcctctcttcttttctctggtctgagtccctcccccacaccactgcctgcctgggacatggacctttgggaaatacgcggtca

SEQ ID NO: 315063 - DNA, 1038 bp, Homo sapiens
cgtggtaccggcgcatcacgtgggcgagttaggtgacgctgcggggcgggcggacagactgcgggacggacggtggacgctgggacgcgtttgtagctccggccccgccgttccgacccccgccgccgtcgccgccatgacggggctagcactgctctactccggggtcttcgtggccttctgggcctgcgcgctggccgtgggagtctgctacaccatttttgatttgggcttccgctttgatgtggcatggttcctgacggagacttcgcccttcatgtggtccaacctgggcattggcctagctatctccctgtctgtggttggggcagcctggggcatctatattaccggctcctccatcattggtggaggagtgaaggcccccaggatcaagaccaagaacctggtcagcatcatcttctgtgaggctgtggccatctacggcatcatcatggcaattgtcattagcaacatggctgagcctttcagtgccacagaccccaaggccatcggccatcggaactaccatgcaggctactccatgtttggggctggcctcaccgtaggcctgtctaacctcttctgtggagtctgcgtgggcatcgtgggcagtggggctgccctggccgatgctcagaaccccagcctctttgtaaagattctcatcgtggagatctttggcagcgccattggcctctttggggtcatcgtcgcaattcttcagacctccagagtgaagatgggtgactagatgatatgtgtgggtggggccgtgcctcacttttatttattgctggttttcctgggacagctggagctgtgtcccttagcctttcagaggcttggtgttcagggccctccctgcactcccctcttgctgcgtgttgatttggaggcactgcagtccaggccgagtcctcagtgcggggagcaggctgctgctgctgactctgtgcagctgcgcacctgtgtcccccacctagacaaataccaagtttatttcacaaacactaggaagatgggttgagggtggtc

SEQ ID NO: 315064 - DNA, 770 bp, Homo sapiens
gtactactactaaattcgcggcgtcgacgcgtagctatctccctgtctgtggttggggcagcctgggcatctatattaccggctcctccatcattggtggaggagtgaaggcccccaggatcaagaccaagaacctggtcagcatcatcttctgtgaggctgtggccatctacggcatcatcatggcaattgtcattagcaacatggctgagcctttcagtgccacagaccccaaggccatcggccatcggaactaccatgcaggctactccatgtttggggctggcctcaccgtaggcctgtctaacctcttctgtggagtctgcgtgggcatcgtgggcagtggggctgccctggccgatgctcagaaccccagcctctttgtaaagattctcatcgtggagatctttggcagcgccattggcctctttggggtcatcgtcgcaattcttcagacctccagagtgaagatgggtgactagatgatatgtgtgggtggggccgtgcctcacttttatttattgctggttttcctgggacagctggagctgtgtcccttagcctttcagaggcttggtgttcagggccctccctgcactcccctcttgctgcgtgttgatttggaggcactgcagtccaggccgagtcctcagtgcggggagcaggctgctgctgctgactctgtgcagctgcgcacctgtgtcccccacctccaccctcaacccatcttcctagtgtttgtgaaataaacttggtatttgtctgggtca

SEQ ID NO: 315065 - DNA, 922 bp, Homo sapiens
cgtggtaccggcgcatcacgtgggcgagttaggtgacgctgcggggcgggcggacagactgcgggacggacggtggacgctgggacgcgtttgtagctccggccccgccgttccgacccccgccgccgtcgccgccatgacggggctagcactgctctactccggggtcttcgtggccttctgggcctgcgcgctggccgtgggagtctgctacaccatttttgatttgggcttccgctttgatgtggcatggttcctgacggagacttcgcccttcatgtggtccaacctgggcattggcctagctatctccctgtctgtggttggggcagcctggggcatctatattaccggctcctccatcattggtggaggagtgaaggcccccaggatcaagaccaagaacctggtcagcatcatcttctgtgaggctgtggccatctacggcatcatcatggcaattgtcattagcaacatggctgagcctttcagtgccacagaccccaaggccatcggccatcggaactaccatgcaggctactccatgtttggggctggcctcaccgtaggcctgtctaacctcttctgtggagtctgcgtgggcatcacctccagagtgaagatgggtgactagatgatatgtgtgggtggggccgtgcctcacttttatttattgctggttttcctgggacagctggagctgtgtcccttagcctttcagaggcttggtgttcagggccctccctgcactcccctcttgctgcgtgttgatttggaggcactgcagtccaggccgagtcctcagtgcggggagcaggctgctgctgctgactctgtgcagctgcgcacctgtgtcccccacctccaccctcaacccatcttcctagtgtttgtgaaataaacttggtatttgtctgggtca

SEQ ID NO: 315066 - DNA, 1203 bp, Homo sapiens
tggagtcttccgaaaatgttcagacacatttaagaatttttattgagtaatacaatgttctaattgaggcatacacgttgttctaggagtctgtgaaattctaaagataaaagtttgattatgcttgttttgactttaatgaactattcacataattttaatacacagtgtctaacacgtatgaaagttgtgtaataccttataccttaacaatggagaattactaagcaattttggctactctgatattagcatttcctgaaactcctcaggctgatgtggcaaaggagaaatagcaatcttgagttctgaaaagctaggccgcattttggtcctgaaaaatcacttgctgtgaacttgggccagtttttgattttttaaatggcataacagttcgttgctacaagaggttacatcaggaaaatttcctaaggatttaagattttgttcatctattgagttcttttgggtgatttgtttaggaggaagtatctgctcctttttgagttgcttcaccaaagtacttgagtgagaaggcagaatataatgagaatgatcatgctggcaaggaagacatatatatgagatgggttatcctttacacctacgtcagctaaaaccgtctcctacgaacaaatccagcacttggcactttattcgacggtcctaaaaatagagtcctaaatttagaaggcaaggtgctacttttagctcctcttctcggaggaaaacagcacgcaccgcgccaggccaaggtccacggggatttgatttagcatttgggtaactggccgctaatggaactgaagacagctgggcctaacaagtgcccaggtgactcaggtaagcgaggaaaccagatcgaggttctcttgcgtgggacaggttaaactctgaccaaaccacagctgagccgggacgccttcctgtctaaagtccaaagtccggacgtggttggcagggcgcaccggcgcgtgccccgcaggccatttttctgactggaatgacggcggcggctggcttctcggggctgccggggtctcccggggtacgccgccgtcaggacttctgcagggcgcagacagcaggctccagcgaggacgacagcgcggagtatgaggccgaatctcatcctctagtcccaagcctctccactaccagggctgggtggcttcgccaggtagagcgccggcccctttaagc

SEQ ID NO: 315067 - DNA, 3660 bp, Homo sapiens
tgcccggcggaaaccaaaccgagggatggggtggcgaggacagggtacgtcgcaggcttgtgcgggtcgggttcggacctgcgctgcctcgggatgtaaagtataacaagagggtcgggatgggcagcgtaggcctgtgaggcctgcgggtgcccctgtcccccagctccccccgcagccggctccgcagtggtccactccggttgccgggtgcggattcgggttccggaccgaaggctgtgtgttctccgccgttcattgtggccccgacaggccggggttactgtggcgaccacgagagcagctttggcgctatggaggagcccggggctacccctcaaccgtatttggggctgctcctggaggagctacgcagggttgtggcagcactgcctgaaggtatgagaccagattctaatctttatggttttccatgggaattggtgatatgtgcagctgttgttggattttttgctgttctcttttttttgtggagaagttttagatcggttaggagtcggctttatgtgggacgagagaaaaagcttgctctaatgctttctggactaattgaagaaaaaagtaaactacttgaaaaatttagccttgttcaaaaagagtatgaaggctatgaagtagagtcatctttaaaggatgccagctttgagaaggaggcaacagaagcacaaagtttggaggcaacctgtgaaaagctgaacaggtccaattctgaacttgaggatgaaatactctgtctagaaaaagagttaaaagaagagaaatccaaacattctgaacaagatgaattgatggcggatatttcaaaaaggatacagtctctagaagatgagtcaaaatccctcaaatcacaagtagctgaagccaaaatgaccttcaagatatttcaaatgaatgaagaacgactgaagatagcaataaaagatgctttgaatgaaaattctcaacttcaggaaagccagaaacagcttttgcaagaagctgaagtatggaaagaacaagtgagtgaacttaataaacagaaagtaacatttgaagactccaaagtacatgcagaacaagttctaaatgataaagaaagtcacatcaagactctgactgaacgcttgttaaagatgaaagattgggctgctatgcttggagaagacataacggatgatgataacttggaattagaaatgaacagtgaatcggaaaatggtgcttacttagataatcctccaaaaggagctttgaagaaactgattcatgctgctaagttaaatgcttctttaaaaaccttagaaggagaaagaaaccaaatttatattcagttgtctgaagttgataaaacaaaggaagagcttacagagcatattaaaaatcttcagactcaacaagcatctttgcagtcagaaaacacacattttgaaaatgagaatcagaagcttcaacagaaacttaaagtaatgactgaattatatcaagaaaatgaaatgaaactccacaggaaattaacagtagaggaaaattatcggttagagaaagaagagaaactttctaaagtagatgaaaagatcagccatgccactgaagagctggagacctatagaaagcgagccaaagatcttgaagaagaattggagagaactattcattcttatcaagggcagattatttcccatgagaaaaaagcacatgataattggttggcagctcggaatgctgaaagaaacctcaatgatttaaggaaagaaaatgctcacaacagacaaaaattaactgaaacagagcttaaatttgaacttttagaaaaagatccttatgcactcgatgttccaaatacagcatttggcagagagcattccccatatggtccctcaccattgggttggccttcatctgaaacaagagcttttctctctcctccaactttgttggagggtccactcagactctcacctttgcttccagggggaggaggaagaggctcacgaggcccagggaatcctctggaccatcagattaccaatgaaagaggagaatcaagctgtgataggttaaccgatcctcatagggctccctctgacactgggtctctgtcacctccatgggaccaggaccgtaggatgatgtttcctccgccaggacaatcatatcctgattcagcccttcctccacaaaggcaagacagattttgttctaattctggtagactgtctggaccagcagaactcagaagttttaatatgccttctttggataaaatggatgggtcaatgccttcagaaatggaatccagtagaaatgataccaaagatgatcttggtaatttaaatgtgcctgattcatctctccctgctgaaaatgaagccactggccctggctttgttcctccacctcttgctccagtcagaggtccattgtttccagtggatgcaagaggcccattcttgagaagaggacctcctttccccccacctcctccaggagccatgtttggagcttctcgagattattttccaccaggggatttcccaggtccaccacctgctccatttgcaatgagaaatgtctatccaccgaggggttttcctccttaccttcccccaagacctggatttttccccccacccccacattctgaaggtagaagtgagttcccctcaggtttgattccaccttcaaatgagcctgctactgaacatccagaaccacagcaagaaacctgacaatatttttgctctcttcaaaagtaattttgactgatctcattttcagtttaagtaactgctgttacttaagtgattacacttttgctcaaattgaagcttaatggaattataattctcaggatagtattttgtaaataaagatgatttaaatatgaatcttatgagtaaattatttcaattttattttagacggtataactatttcaatttgattaatccactattatataaacaatagtgggagttttatatatgtaatctttcaggtggggaggctttaaattctgaagtctgtgtctttatgccaagaactgtatttactgtggttgtggacaaatgtgaaagtaactttatgcttaaataaattatagttgatttaaagatttgtttggcattgataataataaaatcagtagtttttctataactatggctctattaattaacttttttccttttaccaataactttgaggtgcaaaactcaaacttatgtgggtcttttgtgttcaattatgttatgacaaatgtgctctctttcttgtaaatagacatgagtggcccaaagcaacaaattaatacacttttaaaagtcaaaattgattatattttaaagataaccaggatattatctaatggtgaattgtagaattttgatcttcttattcactgagtttcttgcacggtttctttattgcttttttttccccgcctgttcttttgtaaggtatttactattttctgtggaggatattgagatgtactacaggataactgtagtgaatgatgtgtcatcattttgagctttggactcaatatctttagtgtttccctaaatcagatttgtaggtcatgttaagcttcttgcacattaatatgattatggaaggaaaggcagtgaagcataactaataaacatcataatactt

SEQ ID NO: 315068 - DNA, 1378 bp, Homo sapiens
tggagtcttccgaaaatgttcagacacatttaagaatttttattgagtaatacaatgttctaattgaggcatacacgttgttctaggagtctgtgaaattctaaagataaaagtttgattatgcttgttttgactttaatgaactattcacataattttaatacacagtgtctaacacgtatgaaagttgtgtaataccttataccttaacaatggagaattactaagcaattttggctactctgatattagcatttcctgaaactcctcaggctgatgtggcaaaggagaaatagcaatcttgagttctgaaaagctaggccgcattttggtcctgaaaaatcacttgctgtgaacttgggccagtttttgattttttaaatggcataacagttcgttgctacaagaggttacatcaggaaaatttcctaaggatttaagattttgttcatctattgagttcttttgggtgatttgtttaggaggaagtatctgctcctttttgagttgcttcaccaaagtacttgagtgagaaggcagaatataatgagaatgatcatgctggcaaggaagacatatatatgagatgggttatcctttacacctacgtcagctaaaaccgtctcctacgaacaaatccagcacttggcactttattcgacggtcctaaaaatagagtcctaaatttagaaggcaaggtgctacttttagctcctcttctcggaggaaaacagcacgcaccgcgccaggccaaggtccacggggatttgatttagcatttgggtaactggccgctaatggaactgaagacagctgggcctaacaagtgcccaggtgactcaggtaagcgaggaaaccagatcgaggttctcttgcgtgggacaggttaaactctgaccaaaccacagctgagccgggacgccttcctgtctaaagtccaaagtccggacgtggttggcagggcgcaccggcgcgtgccccgcaggccatttttctgactggaatgacggcggcggctggcttctcggggctgccggggtctcccggggtacgccgccgtcaggacttctgcagggcgcagacagcaggctccagcgaggctgcggaaggaaagccttgggtgtcggggctgggcctggcgtcggcccctgggtcgggggggtgggggttgcgccgagacgcctctaggagaagtctcgccgccgccgccaccgcggccgcccgaggcgggtgcccttgggacatagccctggtctttggggttgtgcggctcacacgacagcgcggagtatgaggccgaatctcatcctctagtcccaagcctctccactaccagggctgggtggcttcgccaggtagagcgccggcccctttaagc

SEQ ID NO: 315069 - DNA, 3774 bp, Homo sapiens
tggagtcttccgaaaatgttcagacacatttaagaatttttattgagtaatacaatgttctaattgaggcatacacgttgttctaggagtctgtgaaattctaaagataaaagtttgattatgcttgttttgactttaatgaactattcacataattttaatacacagtgtctaacacgtatgaaagttgtgtaataccttataccttaacaatggagaattactaagcaattttggctactctgatattagcatttcctgaaactcctcaggctgatgtggcaaaggagaaatagcaatcttgagttctgaaaagctaggccgcattttggtcctgaaaaatcacttgctgtgaacttgggccagtttttgattttttaaatggcataacagttcgttgctacaagaggttacatcaggaaaatttcctaaggatttaagattttgttcatctattgagttcttttgggtgatttgtttaggaggaagtatctgctcctttttgagttgcttcaccaaagtacttgagtgagaaggcagaatataatgagaatgatcatgctggcaaggaagacatatatatgagatgggttatcctttacacctacgtcagctaaaaccgtctcctacgaacaaatccagcacttggcactttattcgacggtcctaaaaatagagtcctaaatttagaaggcaaggtgctacttttagctcctcttctcggaggaaaacagcacgcaccgcgccaggccaaggtccacggggatttgatttagcatttgggtaactggccgctaatggaactgaagacagctgggcctaacaagtgcccaggtgactcaggtaagcgaggaaaccagatcgaggttctcttgcgtgggacaggttaaactctgaccaaaccacagctgagccgggacgccttcctgtctaaagtccaaagtccggacgtggttggcagggcgcaccggcgcgtgccccgcaggccatttttctgactggaatgacggcggcggctggcttctcggggctgccggggtctcccggggttgtggcagcactgcctgaaggtatgagaccagattctaatctttatggttttccatgggaattggtgatatgtgcagctgttgttggattttttgctgttctcttttttttgtggagaagttttagatcggttaggagtcggctttatgtgggacgagagaaaaagcttgctctaatgctttctggactaattgaagaaaaaagtaaactacttgaaaaatttagccttgttcaaaaagagtatgaaggctatgaagtagagtcatctttaaaggatgccagctttgagaaggaggcaacagaagcacaaagtttggaggcaacctgtgaaaagctgaacaggtccaattctgaacttgaggatgaaatactctgtctagaaaaagagttaaaagaagagaaatccaaacattctgaacaagatgaattgatggcggatatttcaaaaaggatacagtctctagaagatgagtcaaaatccctcaaatcacaagtagctgaagccaaaatgaccttcaagatatttcaaatgaatgaagaacgactgaagatagcaataaaagatgctttgaatgggaaagaacaagtgagtgaacttaataaacagaaagtaacatttgaagactccaaagtacatgcagaacaagttctaaatgataaagaaagtcacatcaagactctgactgaacgcttgttaaagatgaaagattgggctgctatgcttggagaagacataacggatgatgataacttggaattagaaatgaacagtgaatcggaaaatggtgcttacttagataatcctccaaaaggagctttgaagaaactgattcatgctgctaagttaaatgcttctttaaaaaccttagaaggagaaagaaaccaaatttatattcagttgtctgaagttgataaaacaaaggaagagcttacagagcatattaaaaatcttcagactcaacaagcatctttgcagtcagaaaacacacattttgaaaatgagaatcagaagcttcaacagaaacttaaagtaatgactgaattatatcaagaaaatgaaatgaaactccacaggaaattaacagtagaggaaaattatcggttagagaaagaagagaaactttctaaagtagatgaaaagatcagccatgccactgaagagctggagacctatagaaagcgagccaaagatcttgaagaagaattggagagaactattcattcttatcaagggcagattatttcccatgagaaaaaagcacatgataattggttggcagctcggaatgctgaaagaaacctcaatgatttaaggaaagaaaatgctcacaacagacaaaaattaactgaaacagagcttaaatttgaacttttagaaaaagatccttatgcactcgatgttccaaatacagcatttggcagagagcattccccatatggtccctcaccattgggttggccttcatctgaaacaagagcttttctctctcctccaactttgttggagggtccactcagactctcacctttgcttccagggggaggaggaagaggctcacgaggcccagggaatcctctggaccatcagattaccaatgaaagaggagaatcaagctgtgataggttaaccgatcctcatagggctccctctgacactgggtctctgtcacctccatgggaccaggaccgtaggatgatgtttcctccgccaggacaatcatatcctgattcagcccttcctccacaaaggcaagacagattttgttctaattctggtagactgtctggaccagcagaactcagaagttttaatatgccttctttggataaaatggatgggtcaatgccttcagaaatggaatccagtagaaatgataccaaagatgatcttggtaatttaaatgtgcctgattcatctctccctgctgaaaatgaagccactggccctggctttgttcctccacctcttgctccagtcagaggtccattgtttccagtggatgcaagaggcccattcttgagaagaggacctcctttccccccacctcctccaggagccatgtttggagcttctcgagattattttccaccaggggatttcccaggtccaccacctgctccatttgcaatgagaaatgtctatccaccgaggggttttcctccttaccttcccccaagacctggatttttccccccacccccacattctgaaggtagaagtgagttcccctcaggtttgattccaccttcaaatgagcctgctactgaacatccagaaccacagcaagaaacctgacaatatttttgctctcttcaaaagtaattttgactgatctcattttcagtttaagtaactgctgttacttaagtgattacacttttgctcaaattgaagcttaatggaattataattctcaggatagtattttgtaaataaagatgatttaaatatgaatcttatgagtaaattatttcaattttattttagacggtataactatttcaatttgattaatccactattatataaacaatagtgggagttttatatatgtaatctttcaggtggggaggctttaaattctgaagtctgtgtctttatgccaagaactgtatttactgtggttgtggacaaatgtgaaagtaactttatgcttaaataaattatagttgatttaaagatttgtttggcattgataataataaaatcagtagtttttctat

SEQ ID NO: 315070 - DNA, 2906 bp, Homo sapiens
gcaggatatattagaatctgaaatctttctcaaggatatgaggtgcctggtagaactttatttacatgttaggaaattttaacatgagcttttcaagaaatggaattgaaaagtccagaggaagaggttgtggcagcactgcctgaaggtatgagaccagattctaatctttatggttttccatgggaattggtgatatgtgcagctgttgttggattttttgctgttctcttttttttgtggagaagttttagatcggttaggagtcggctttatgtgggacgagagaaaaagcttgctctaatgctttctggactaattgaagaaaaaagtaaactacttgaaaaatttagccttgttcaaaaagagtatgaaggctatgaagtagagtcatctttaaaggatgccagctttgagaaggaggcaacagaagcacaaagtttggaggcaacctgtgaaaagctgaacaggtccaattctgaacttgaggatgaaatactctgtctagaaaaagagttaaaagaagagaaatccaaacattctgaacaagatgaattgatggcggatatttcaaaaaggatacagtctctagaagatgagtcaaaatccctcaaatcacaagtagctgaagccaaaatgaccttcaagatatttcaaatgaatgaagaacgactgaagatagcaataaaagatgctttgaatgaaaattctcaacttcaggaaagccagaaacagcttttgcaagaagctgaagtatggaaagaacaagtgagtgaacttaataaacagaaagtaacatttgaagactccaaagtacatgcagaacaagttctaaatgataaagaaagtcacatcaagactctgactgaacgcttgttaaagatgaaagattgggctgctatgcttggagaagacataacggatgatgataacttggaattagaaatgaacagtgaatcggaaaatggtgcttacttagataatcctccaaaaggagctttgaagaaactgattcatgctgctaagttaaatgcttctttaaaaaccttagaaggagaaagaaaccaaatttatattcagttgtctgaagttgataaaacaaaggaagagcttacagagcatattaaaaatcttcagactcaacaagcatctttgcagtcagaaaacacacattttgaaaatgagaatcagaagcttcaacagaaacttaaagtaatgactgaattatatcaagaaaatgaaatgaaactccacaggaaattaacagtagaggaaaattatcggttagagaaagaagagaaactttctaaagtagatgaaaagatcagccatgccactgaagagctggagacctatagaaagcgagccaaagatcttgaagaagaattggagagaactattcattcttatcaagggcagattatttcccatgagaaaaaagcacatgataattggttggcagctcggaatgctgaaagaaacctcaatgatttaaggaaagaaaatgctcacaacagacaaaaattaactgaaacagagcttaaatttgaacttttagaaaaagatccttatgcactcgatgttccaaatacagcatttggcagagagcattccccatatggtccctcaccattgggttggccttcatctgaaacaagagcttttctctctcctccaactttgttggagggtccactcagactctcacctttgcttccagggggaggaggaagaggctcacgaggcccagggaatcctctggaccatcagattaccaatgaaagaggagaatcaagctgtgataggttaaccgatcctcatagggctccctctgacactgggtctctgtcacctccatgggaccaggaccgtaggatgatgtttcctccgccaggacaatcatatcctgattcagcccttcctccacaaaggcaagacagattttgttctaattctggtagactgtctggaccagcagaactcagaagttttaatatgccttctttggataaaatggatgggtcaatgccttcagaaatggaatccagtagaaatgataccaaagatgatcttggtaatttaaatgtgcctgattcatctctccctgctgaaaatgaagccactggccctggctttgttcctccacctcttgctccagtcagaggtccattgtttccagtggatgcaagaggcccattcttgagaagaggacctcctttccccccacctcctccaggagccatgtttggagcttctcgagattattttccaccaggggatttcccaggtccaccacctgctccatttgcaatgagaaatgtctatccaccgaggggttttcctccttaccttcccccaagacctggatttttccccccacccccacattctgaaggtagaagtgagttcccctcaggtttgattccaccttcaaatgagcctgctactgaacatccagaaccacagcaagaaacctgacaatatttttgctctcttcaaaagtaattttgactgatctcattttcagtttaagtaactgctgttacttaagtgattacacttttgctcaaattgaagcttaatggaattataattctcaggatagtattttgtaaataaagatgatttaaatatgaatcttatgagtaaattatttcaattttattttagacggtataactatttcaatttgattaatccactattatataaacaatagtgggagttttatatatgtaatctttcaggtggggaggctttaaattctgaagtctgtgtctttatgccaagaactgtatttactgtggttgtggacaaatgtgaaagtaactttatgcttaaataaattatagttgatttaaagatttgtttggcattgataataataaaatcagtagtttttctat

SEQ ID NO: 315071 - DNA, 1038 bp, Homo sapiens
gttttctggcactaataaaatatttatgataactaaaatgtgatagctgatacattactgtggaaagctgtttgaatctttctctagagctttctaagactatcatggaatgctttctgtctagatgatttcttctaagcctgagattttcgggaaaatgattgcaaatttactgttttagtgactgccatatgtcaatttgttgtagaatttaaatgtgcctgattcatctctccctgctgaaaatgaagccactggccctggctttgttcctccacctcttgctccagtcagaggtccattgtttccagtggatgcaagaggcccattcttgagaagaggacctcctttccccccacctcctccaggagccatgtttggagcttctcgagattattttccaccaggggatttcccaggtccaccacctgctccatttgcaatgagaaatgtctatccaccgaggggttttcctccttaccttcccccaagacctggatttttccccccacccccacattctgaaggtagaagtgagttcccctcaggtttgattccaccttcaaatgagcctgctactgaacatccagaaccacagcaagaaacctgacaatatttttgctctcttcaaaagtaattttgactgatctcattttcagtttaagtaactgctgttacttaagtgattacacttttgctcaaattgaagcttaatggaattataattctcaggatagtattttgtaaataaagatgatttaaatatgaatcttatgagtaaattatttcaattttattttagacggtataactatttcaatttgattaatccactattatataaacaatagtgggagttttatatatgtaatctttcaggtggggaggctttaaattctgaagtctgtgtctttatgccaagaactgtatttactgtggttgtggacaaatgtgaaagtaactttatgcttaaataaattatagttgatttaaagatttgtttggcattgataataataaaatcagtagtttttctat

SEQ ID NO: 315072 - DNA, 3534 bp, Homo sapiens
tggagtcttccgaaaatgttcagacacatttaagaatttttattgagtaatacaatgttctaattgaggcatacacgttgttctaggagtctgtgaaattctaaagataaaagtttgattatgcttgttttgactttaatgaactattcacataattttaatacacagtgtctaacacgtatgaaagttgtgtaataccttataccttaacaatggagaattactaagcaattttggctactctgatattagcatttcctgaaactcctcaggctgatgtggcaaaggagaaatagcaatcttgagttctgaaaagctaggccgcattttggtcctgaaaaatcacttgctgtgaacttgggccagtttttgattttttaaatggcataacagttcgttgctacaagaggttacatcaggaaaatttcctaaggatttaagattttgttcatctattgagttcttttgggtgatttgtttaggaggaagtatctgctcctttttgagttgcttcaccaaagtacttgagtgagaaggcagaatataatgagaatgatcatgctggcaaggaagacatatatatgagatgggttatcctttacacctacgtcagctaaaaccgtctcctacgaacaaatccagcacttggcactttattcgacggtcctaaaaatagagtcctaaatttagaaggcaaggtgctacttttagctcctcttctcggaggaaaacagcacgcaccgcgccaggccaaggtccacggggatttgatttagcatttgggtaactggccgctaatggaactgaagacagctgggcctaacaagtgcccaggtgactcaggtaagcgaggaaaccagatcgaggttctcttgcgtgggacaggttaaactctgaccaaaccacagctgagccgggacgccttcctgtctaaagtccaaagtccggacgtggttggcagggcgcaccggcgcgtgccccgcaggccatttttctgactggaatgacggcggcggctggcttctcggggctgccggggtctcccggggttgtggcagcactgcctgaaggtatgagaccagattctaatctttatggttttccatgggaattggtgatatgtgcagctgttgttggattttttgctgttctcttttttttgtggagaagttttagatcggttaggagtcggctttatgtgggacgagagaaaaagcttgctctaatgctttctggactaattgaagaaaaaagtaaactacttgaaaaatttagccttgttcaaaaagagtatgaaggctatgaagtagagtcatctttaaaggatgccagctttgagaaggaggcaacagaagcacaaagtttggaggcaacctgtgaaaagctgaacaggtccaattctgaacttgaggatgaaatactctgtctagaaaaagagttaaaagaagagaaatccaaacattctgaacaagatgaattgatggcggatatttcaaaaaggatacagtctctagaagatgagtcaaaatccctcaaatcacaagtagctgaagccaaaatgaccttcaagatatttcaaatgaatgaagaacgactgaagatagcaataaaagatgctttgaatgaaaattctcaacttcaggaaagccagaaacagcttttgcaagaagctgaagtatggaaagaacaagtgagtgaacttaataaacagaaagtaacatttgaagactccaaagtacatgcagaacaagttctaaatgataaagaaagtcacatcaagactctgactgaacgcttgttaaagatgaaagattgggctgctatgcttggagaagacataacggatgatgataacttggaattagaaatgaacagtgaatcggaaaatggtgcttacttagataatcctccaaaaggagctttgaagaaactgattcatgctgctaagttaaatgcttctttaaaaaccttagaaggagaaagaaaccaaatttatattcagttgtctgaagttgataaaacaaaggaagagcttacagagcatattaaaaatcttcagactcaacaagcatctttgcagtcagaaaacacacattttgaaaatgagaatcagaagcttcaacagaaacttaaagtaatgactgaattatatcaagaaaatgaaatgaaactccacaggaaattaacagtagaggaaaattatcggttagagaaagaagagaaactttctaaagtagatgaaaagatcagccatgccactgaagagctggagacctatagaaagcgagccaaagatcttgaagaagaattggagagaactattcattcttatcaagggcagattatttcccatgagaaaaaagcacatgataattggttggcagctcggaatgctgaaagaaacctcaatgatttaaggaaagaaaatgctcacaacagacaaaaattaactgaaacagagcttaaatttgaacttttagaaaaagatccttatgcactcgatgttccaaatacagcatttggcagagagcattccccatatggtccctcaccattgggttggccttcatctgaaacaagagcttttctctctcctccaactttgttggagggtccactcagactctcacctttgcttccagggggaggaggaagaggctcacgaggcccagggaatcctctggaccatcagattaccaatgaaagaggagaatcaagctgtgataggttaaccgatcctcatagggctccctctgacactgggtctctgtcacctccatgggaccaggaccgtaggatgatgtttcctccgccaggacaatcatatcctgattcagcccttcctccacaaaggcaagacagattttgttctaattctggtagactgtctggaccagcagaactcagaagttttaatatgccttctttggataaaatggatgggtcaatgccttcagaaatggaatccagtagaaatgataccaaagatgatcttggtaatttaaatgtgcctgattcatctctccctgctgaaaatgaagccactggccctggctttgttcctccacctcttgctccagtcagaggtccattgtttccagtggatgcaagaggcccattcttgagaagaggacctcctttccccccacctcctccaggagccatgtttggcgttcctccccgttggagggaaggtagtggacaactctagaggcattgcggaggtcatgcttttttgacagacaatgcacgtggatttgttttgccatttaccaacagtgtgactttatgccagtttcctttctccttcagttttcatttgcaaagtgctagtatgatgataatgttatggttttgagaagaataaatgtgctaacatctgtaaaatgcatgtcacaatgccgggcacactacaagcagtcattcaacataaggtattatttttacttgagtaacagtagttacgaaaaatgtcctaggaatggatttgaaagctagatagtactttattctgggggcagggaagaccgccca

SEQ ID NO: 315073 - DNA, 654 bp, Homo sapiens
  misc_feature (45)..(46): n is a, c, g, or t
ggctaactctagaggatttacacggcacccctgctacacggcacnnctgctcatttgcatgagaaatgtctatccaccgaggggttttcctccttaccttcccccaagacctggatttttccccccacccccacattctgaaggtagaagtgagttcccctcaggtttgattccaccttcaaatgagcctgctactgaacatccagaaccacagcaagaaacctgacaatatttttgctctcttcaaaagtaattttgactgatctcattttcagtttaagtaactgctgttacttaagtgattacacttttgctcaaattgaagcttaatggaattataattctcaggatagtattttgtaaataaagatgatttaaatatgaatcttatgagtaaattatttcaattttattttagacggtataactatttcaatttgattaatccactattatataaacaatagtgggagttttatatatgtaatctttcaggtggggaggctttaaattctgaagtctgtgtctttatgccaagaactgtatttactgtggttgtggacaaatgtgaaagtaactttatgcttaaataaattatagttgatttaaagatttgtttggcattgataataataaaatcagtagtttttctat

SEQ ID NO: 315074 - DNA, 3028 bp, Homo sapiens
tgcccggcggaaaccaaaccgagggatggggtggcgaggacagggtacgtcgcaggcttgtgcgggtcgggttcggacctgcgctgcctcgggatgtaaagtataacaagagggtcgggatgggcagcgtaggcctgtgaggcctgcgggtgcccctgtcccccagctccccccgcagccggctccgcagtggtccactccggttgccgggtgcggattcgggttccggaccgaaggctgtgtgttctccgccgttcattgtggccccgacaggccggggttactgtggcgaccacgagagcagctttggcgctatggaggagcccggggctacccctcaaccgtatttggggctgctcctggaggagctacgcagggttgtggcagcactgcctgaaggtatgagaccagattctaatctttatggttttccatgggaattggtgatatgtgcagctgttgttggattttttgctgttctcttttttttgtggagaagttttagatcggttaggagtcggctttatgtgggacgagagaaaaagcttgctctaatgctttctggactaattgaagaaaaaagtaaactacttgaaaaatttagccttgttcaaaaagagtatgaaggctatgaagtagagtcatctttaaaggatgccagctttgagaaggaggcaacagaagcacaaagtttggaggcaacctgtgaaaagctgaacaggtccaattctgaacttgaggatgaaatactctgtctagaaaaagagttaaaagaagagaaatccaaacattctgaacaagatgaattgatggcggatatttcaaaaaggatacagtctctagaagatgagtcaaaatccctcaaatcacaagtagctgaagccaaaatgaccttcaagatatttcaaatgaatgaagaacgactgaagatagcaataaaagatgctttgaatgaaaattctcaacttcaggaaagccagaaacagcttttgcaagaagctgaagtatggaaagaacaagtgagtgaacttaataaacagaaagtaacatttgaagactccaaagtacatgcagaacaagttctaaatgataaagaaagtcacatcaagactctgactgaacgcttgttaaagatgaaagattgggctgctatgcttggagaagacataacggatgatgataacttggaattagaaatgaacagtgaatcggaaaatggtgcttacttagataatcctccaaaaggagctttgaagaaactgattcatgctgctaagttaaatgcttctttaaaaaccttagaaggagaaagaaaccaaatttatattcagttgtctgaagttgataaaacaaaggaagagcttacagagcatattaaaaatcttcagactcaacaagcatctttgcagtcagaaaacacacattttgaaaatgagaatcagaagcttcaacagaaacttaaagtaatgactgaattatatcaagaaaatgaaatgaaactccacaggaaattaacagtagaggaaaattatcggttagagaaagaagagaaactttctaaagtagatgaaaagatcagccatgccactgaagagctggagacctatagaaagcgagccaaagatcttgaagaagaattggagagaactattcattcttatcaagggcagattatttcccatgagaaaaaagcacatgataattggttggcagctcggaatgctgaaagaaacctcaatgatttaaggaaagaaaatgctcacaacagacaaaaattaactgaaacagagcttaaatttgaacttttagaaaaagatccttatgcactcgatgttccaaatacagcatttggcagaggctcacgaggcccagggaatcctctggaccatcagattaccaatgaaagaggagaatcaagctgtgataggttaaccgatcctcatagggctccctctgacactgggtctctgtcacctccatgggaccaggaccgtaggatgatgtttcctccgccaggacaatcatatcctgattcagcccttcctccacaaaggcaagacagattttgttctaattctggtagactgtctggaccagcagaactcagaagttttaatatgccttctttggataaaatggatgggtcaatgccttcagaaatggaatccagtagaaatgataccaaagatgatcttggtaatttaaatgtgcctgattcatctctccctgctgaaaatgaagccactggccctggctttgttcctccacctcttgctccagtcagaggtccattgtttccagtggatgcaagaggcccattcttgagaagaggacctcctttccccccacctcctccaggagccatgtttggagcttctcgagattattttccaccaggggatttcccaggtccaccacctgctccatttgcaatgagaaatgtctatccaccgaggggttttcctccttaccttcccccaagacctggatttttccccccacccccacattctgaaggtagaagtgagttcccctcaggtttgattccaccttcaaatgagcctgctactgaacatccagaaccacagcaagaaacctgacaatatttttgctctcttcaaaagtaattttgactgatctcattttcagtttaagtaactgctgttacttaagtgattacacttttgctcaaattgaagcttaatggaattataattctcaggatagtattttgtaaataaagatgatttaaatatgaatcttatgagtaaattatttcaattttattttagacggtataactatttcaatttgattaatccactattatataaacaatagtgggagttttatatatgtaatctttcaggtggggaggctttaaattctgaagtctgtgtctttatgccaagaactgtatttactgtggttgtggacaaatgtgaaagtaactttatgcttaaataaattatagttgatttaaagatttgtttggcattgataataataaaatcagtagtttttctat

SEQ ID NO: 315075 - DNA, 3828 bp, Homo sapiens
tggagtcttccgaaaatgttcagacacatttaagaatttttattgagtaatacaatgttctaattgaggcatacacgttgttctaggagtctgtgaaattctaaagataaaagtttgattatgcttgttttgactttaatgaactattcacataattttaatacacagtgtctaacacgtatgaaagttgtgtaataccttataccttaacaatggagaattactaagcaattttggctactctgatattagcatttcctgaaactcctcaggctgatgtggcaaaggagaaatagcaatcttgagttctgaaaagctaggccgcattttggtcctgaaaaatcacttgctgtgaacttgggccagtttttgattttttaaatggcataacagttcgttgctacaagaggttacatcaggaaaatttcctaaggatttaagattttgttcatctattgagttcttttgggtgatttgtttaggaggaagtatctgctcctttttgagttgcttcaccaaagtacttgagtgagaaggcagaatataatgagaatgatcatgctggcaaggaagacatatatatgagatgggttatcctttacacctacgtcagctaaaaccgtctcctacgaacaaatccagcacttggcactttattcgacggtcctaaaaatagagtcctaaatttagaaggcaaggtgctacttttagctcctcttctcggaggaaaacagcacgcaccgcgccaggccaaggtccacggggatttgatttagcatttgggtaactggccgctaatggaactgaagacagctgggcctaacaagtgcccaggtgactcaggtaagcgaggaaaccagatcgaggttctcttgcgtgggacaggttaaactctgaccaaaccacagctgagccgggacgccttcctgtctaaagtccaaagtccggacgtggttggcagggcgcaccggcgcgtgccccgcaggccatttttctgactggaatgacggcggcggctggcttctcggggctgccggggtctcccggggttgtggcagcactgcctgaaggtatgagaccagattctaatctttatggttttccatgggaattggtgatatgtgcagctgttgttggattttttgctgttctcttttttttgtggagaagttttagatcggttaggagtcggctttatgtgggacgagagaaaaagcttgctctaatgctttctggactaattgaagaaaaaagtaaactacttgaaaaatttagccttgttcaaaaagagtatgaaggctatgaagtagagtcatctttaaaggatgccagctttgagaaggaggcaacagaagcacaaagtttggaggcaacctgtgaaaagctgaacaggtccaattctgaacttgaggatgaaatactctgtctagaaaaagagttaaaagaagagaaatccaaacattctgaacaagatgaattgatggcggatatttcaaaaaggatacagtctctagaagatgagtcaaaatccctcaaatcacaagtagctgaagccaaaatgaccttcaagatatttcaaatgaatgaagaacgactgaagatagcaataaaagatgctttgaatgaaaattctcaacttcaggaaagccagaaacagcttttgcaagaagctgaagtatggaaagaacaagtgagtgaacttaataaacagaaagtaacatttgaagactccaaagtacatgcagaacaagttctaaatgataaagaaagtcacatcaagactctgactgaacgcttgttaaagatgaaagattgggctgctatgcttggagaagacataacggatgatgataacttggaattagaaatgaacagtgaatcggaaaatggtgcttacttagataatcctccaaaaggagctttgaagaaactgattcatgctgctaagttaaatgcttctttaaaaaccttagaaggagaaagaaaccaaatttatattcagttgtctgaagttgataaaacaaaggaagagcttacagagcatattaaaaatcttcagactcaacaagcatctttgcagtcagaaaacacacattttgaaaatgagaatcagaagcttcaacagaaacttaaagtaatgactgaattatatcaagaaaatgaaatgaaactccacaggaaattaacagtagaggaaaattatcggttagagaaagaagagaaactttctaaagtagatgaaaagatcagccatgccactgaagagctggagacctatagaaagcgagccaaagatcttgaagaagaattggagagaactattcattcttatcaagggcagattatttcccatgagaaaaaagcacatgataattggttggcagctcggaatgctgaaagaaacctcaatgatttaaggaaagaaaatgctcacaacagacaaaaattaactgaaacagagcttaaatttgaacttttagaaaaagatccttatgcactcgatgttccaaatacagcatttggcagagagcattccccatatggtccctcaccattgggttggccttcatctgaaacaagagcttttctctctcctccaactttgttggagggtccactcagactctcacctttgcttccagggggaggaggaagaggctcacgaggcccagggaatcctctggaccatcagattaccaatgaaagaggagaatcaagctgtgataggttaaccgatcctcatagggctccctctgacactgggtctctgtcacctccatgggaccaggaccgtaggatgatgtttcctccgccaggacaatcatatcctgattcagcccttcctccacaaaggcaagacagattttgttctaattctggtagactgtctggaccagcagaactcagaagttttaatatgccttctttggataaaatggatgggtcaatgccttcagaaatggaatccagtagaaatgataccaaagatgatcttggtaatttaaatgtgcctgattcatctctccctgctgaaaatgaagccactggccctggctttgttcctccacctcttgctccagtcagaggtccattgtttccagtggatgcaagaggcccattcttgagaagaggacctcctttccccccacctcctccaggagccatgtttggagcttctcgagattattttccaccaggggatttcccaggtccaccacctgctccatttgcaatgagaaatgtctatccaccgaggggttttcctccttaccttcccccaagacctggatttttccccccacccccacattctgaaggtagaagtgagttcccctcaggtttgattccaccttcaaatgagcctgctactgaacatccagaaccacagcaagaaacctgacaatatttttgctctcttcaaaagtaattttgactgatctcattttcagtttaagtaactgctgttacttaagtgattacacttttgctcaaattgaagcttaatggaattataattctcaggatagtattttgtaaataaagatgatttaaatatgaatcttatgagtaaattatttcaattttattttagacggtataactatttcaatttgattaatccactattatataaacaatagtgggagttttatatatgtaatctttcaggtggggaggctttaaattctgaagtctgtgtctttatgccaagaactgtatttactgtggttgtggacaaatgtgaaagtaactttatgcttaaataaattatagttgatttaaagatttgtttggcattgataataataaaatcagtagtttttctat

SEQ ID NO: 315076 - DNA, 4527 bp, Homo sapiens
tggagtcttccgaaaatgttcagacacatttaagaatttttattgagtaatacaatgttctaattgaggcatacacgttgttctaggagtctgtgaaattctaaagataaaagtttgattatgcttgttttgactttaatgaactattcacataattttaatacacagtgtctaacacgtatgaaagttgtgtaataccttataccttaacaatggagaattactaagcaattttggctactctgatattagcatttcctgaaactcctcaggctgatgtggcaaaggagaaatagcaatcttgagttctgaaaagctaggccgcattttggtcctgaaaaatcacttgctgtgaacttgggccagtttttgattttttaaatggcataacagttcgttgctacaagaggttacatcaggaaaatttcctaaggatttaagattttgttcatctattgagttcttttgggtgatttgtttaggaggaagtatctgctcctttttgagttgcttcaccaaagtacttgagtgagaaggcagaatataatgagaatgatcatgctggcaaggaagacatatatatgagatgggttatcctttacacctacgtcagctaaaaccgtctcctacgaacaaatccagcacttggcactttattcgacggtcctaaaaatagagtcctaaatttagaaggcaaggtgctacttttagctcctcttctcggaggaaaacagcacgcaccgcgccaggccaaggtccacggggatttgatttagcatttgggtaactggccgctaatggaactgaagacagctgggcctaacaagtgcccaggtgactcaggtaagcgaggaaaccagatcgaggttctcttgcgtgggacaggttaaactctgaccaaaccacagctgagccgggacgccttcctgtctaaagtccaaagtccggacgtggttggcagggcgcaccggcgcgtgccccgcaggccatttttctgactggaatgacggcggcggctggcttctcggggctgccggggtctcccggggttgtggcagcactgcctgaaggtatgagaccagattctaatctttatggttttccatgggaattggtgatatgtgcagctgttgttggattttttgctgttctcttttttttgtggagaagttttagatcggttaggagtcggctttatgtgggacgagagaaaaagcttgctctaatgctttctggactaattgaagaaaaaagtaaactacttgaaaaatttagccttgttcaaaaagagtatgaaggctatgaagtagagtcatctttaaaggatgccagctttgagaaggaggcaacagaagcacaaagtttggaggcaacctgtgaaaagctgaacaggtccaattctgaacttgaggatgaaatactctgtctagaaaaagagttaaaagaagagaaatccaaacattctgaacaagatgaattgatggcggatatttcaaaaaggatacagtctctagaagatgagtcaaaatccctcaaatcacaagtagctgaagccaaaatgaccttcaagatatttcaaatgaatgaagaacgactgaagatagcaataaaagatgctttgaatgaaaattctcaacttcaggaaagccagaaacagcttttgcaagaagctgaagtatggaaagaacaagtgagtgaacttaataaacagaaagtaacatttgaagactccaaagtacatgcagaacaagttctaaatgataaagaaagtcacatcaagactctgactgaacgcttgttaaagatgaaagattgggctgctatgcttggagaagacataacggatgatgataacttggaattagaaatgaacagtgaatcggaaaatggtgcttacttagataatcctccaaaaggagctttgaagaaactgattcatgctgctaagttaaatgcttctttaaaaaccttagaaggagaaagaaaccaaatttatattcagttgtctgaagttgataaaacaaaggaagagcttacagagcatattaaaaatcttcagactcaacaagcatctttgcagtcagaaaacacacattttgaaaatgagaatcagaagcttcaacagaaacttaaagtaatgactgaattatatcaagaaaatgaaatgaaactccacaggaaattaacagtagaggaaaattatcggttagagaaagaagagaaactttctaaagtagatgaaaagatcagccatgccactgaagagctggagacctatagaaagcgagccaaagatcttgaagaagaattggagagaactattcattcttatcaagggcagattatttcccatgagaaaaaagcacatgataattggttggcagctcggaatgctgaaagaaacctcaatgatttaaggaaagaaaatgctcacaacagacaaaaattaactgaaacagagcttaaatttgaacttttagaaaaagatccttatgcactcgatgttccaaatacagcatttggcagagagcattccccatatggtccctcaccattgggttggccttcatctgaaacaagagcttttctctctcctccaactttgttggagggtccactcagactctcacctttgcttccagggggaggaggaagaggctcacgaggcccagggaatcctctggaccatcagattaccaatgaaagaggagaatcaagctgtgataggttaaccgatcctcatagggctccctctgacactgggtctctgtcacctccatgggaccaggaccgtaggatgatgtttcctccgccaggacaatcatatcctgattcagcccttcctccacaaaggcaagacagattttgttctaattctggtagactgtctggaccagcagaactcagaagttttaatatgccttctttggataaaatggatgggtcaatgccttcagaaatggaatccagtagaaatgataccaaagatgatcttggtaatttaaatgtgcctgattcatctctccctgctgaaaatgaagccactggccctggctttgttcctccacctcttgctccagtcagaggtccattgtttccagtggatgcaagaggcccattcttgagaagaggacctcctttccccccacctcctccaggagccatgtttggagcttctcgagattattttccaccaggggatttcccaggtccaccacctgctccatttgcaatgagaaatgtctatccaccgaggggttttcctccttaccttcccccaagacctggatttttccccccacccccacattctgaaggtagaagtgagttcccctcaggtttgattccaccttcaaatgagcctgctactgaacatccagaaccacagcaagaaacctgacaatatttttgctctcttcaaaagtaattttgactgatctcattttcagtttaagtaactgctgttacttaagtgattacacttttgctcaaattgaagcttaatggaattataattctcaggatagtattttgtaaataaagatgatttaaatatgaatcttatgagtaaattatttcaattttattttagacggtataactatttcaatttgattaatccactattatataaacaatagtgggagttttatatatgtaatctttcaggtggggaggctttaaattctgaagtctgtgtctttatgccaagaactgtatttactgtggttgtggacaaatgtgaaagtaactttatgcttaaataaattatagttgatttaaagatttgtttggcattgataataataaaatcagtagtttttctataactatggctctattaattaacttttttccttttaccaataactttgaggtgcaaaactcaaacttatgtgggtcttttgtgttcaattatgttatgacaaatgtgctctctttcttgtaaatagacatgagtggcccaaagcaacaaattaatacacttttaaaagtcaaaattgattatattttaaagataaccaggatattatctaatggtgaattgtagaattttgatcttcttattcactgagtttcttgcacggtttctttattgcttttttttccccgcctgttcttttgtaaggtatttactattttctgtggaggatattgagatgtactacaggataactgtagtgaatgatgtgtcatcattttgagctttggactcaatatctttagtgtttccctaaatcagatttgtaggtcatgttaagcttcttgcacattaatatgattatggaaggaaaggcagtgaagcataactaataaacatcataatacttaacgttgcccagttggttgttttagtattagacttttttttcaatgccaaaagatagaagattaaatattcttgaataaagcagtgatatatattggaacacttcaccccagcatttccccaggtgttgtttggaacactgatcttgtgaagtatttttgctccctttctattctaaccctcacctcaaaaaaaaa

SEQ ID NO: 315077 - DNA, 3050 bp, Homo sapiens
tgcccggcggaaaccaaaccgagggatggggtggcgaggacagggtacgtcgcaggcttgtgcgggtcgggttcggacctgcgctgcctcgggatgtaaagtataacaagagggtcgggatgggcagcgtaggcctgtgaggcctgcgggtgcccctgtcccccagctccccccgcagccggctccgcagtggtccactccggttgccgggtgcggattcgggttccggaccgaaggctgtgtgttctccgccgttcattgtggccccgacaggccggggttactgtggcgaccacgagagcagctttggcgctatggaggagcccggggctacccctcaaccgtatttggggctgctcctggaggagctacgcagggtgagcccaggcgcgatgagtgttacgtgggagtcggctttatgtgggacgagagaaaaagcttgctctaatgctttctggactaattgaagaaaaaagtaaactacttgaaaaatttagccttgttcaaaaagagtatgaaggctatgaagtagagtcatctttaaaggatgccagctttgagaaggaggcaacagaagcacaaagtttggaggcaacctgtgaaaagctgaacaggtccaattctgaacttgaggatgaaatactctgtctagaaaaagagttaaaagaagagaaatccaaacattctgaacaagatgaattgatggcggatatttcaaaaaggatacagtctctagaagatgagtcaaaatccctcaaatcacaagtagctgaagccaaaatgaccttcaagatatttcaaatgaatgaagaacgactgaagatagcaataaaagatgctttgaatgaaaattctcaacttcaggaaagccagaaacagcttttgcaagaagctgaagtatggaaagaacaagtgagtgaacttaataaacagaaagtaacatttgaagactccaaagtacatgcagaacaagttctaaatgataaagaaagtcacatcaagactctgactgaacgcttgttaaagatgaaagattgggctgctatgcttggagaagacataacggatgatgataacttggaattagaaatgaacagtgaatcggaaaatggtgcttacttagataatcctccaaaaggagctttgaagaaactgattcatgctgctaagttaaatgcttctttaaaaaccttagaaggagaaagaaaccaaatttatattcagttgtctgaagttgataaaacaaaggaagagcttacagagcatattaaaaatcttcagactcaacaagcatctttgcagtcagaaaacacacattttgaaaatgagaatcagaagcttcaacagaaacttaaagtaatgactgaattatatcaagaaaatgaaatgaaactccacaggaaattaacagtagaggaaaattatcggttagagaaagaagagaaactttctaaagtagatgaaaagatcagccatgccactgaagagctggagacctatagaaagcgagccaaagatcttgaagaagaattggagagaactattcattcttatcaagggcagattatttcccatgagaaaaaagcacatgataattggttggcagctcggaatgctgaaagaaacctcaatgatttaaggaaagaaaatgctcacaacagacaaaaattaactgaaacagagcttaaatttgaacttttagaaaaagatccttatgcactcgatgttccaaatacagcatttggcagagagcattccccatatggtccctcaccattgggttggccttcatctgaaacaagagcttttctctctcctccaactttgttggagggtccactcagactctcacctttgcttccagggggaggaggaagaggctcacgaggcccagggaatcctctggaccatcagattaccaatgaaagaggagaatcaagctgtgataggttaaccgatcctcatagggctccctctgacactgggtctctgtcacctccatgggaccaggaccgtaggatgatgtttcctccgccaggacaatcatatcctgattcagcccttcctccacaaaggcaagacagattttgttctaattctggtagactgtctggaccagcagaactcagaagttttaatatgccttctttggataaaatggatgggtcaatgccttcagaaatggaatccagtagaaatgataccaaagatgatcttggtaatttaaatgtgcctgattcatctctccctgctgaaaatgaagccactggccctggctttgttcctccacctcttgctccagtcagaggtccattgtttccagtggatgcaagaggcccattcttgagaagaggacctcctttccccccacctcctccaggagccatgtttggagcttctcgagattattttccaccaggggatttcccaggtccaccacctgctccatttgcaatgagaaatgtctatccaccgaggggttttcctccttaccttcccccaagacctggatttttccccccacccccacattctgaaggtagaagtgagttcccctcaggtttgattccaccttcaaatgagcctgctactgaacatccagaaccacagcaagaaacctgacaatatttttgctctcttcaaaagtaattttgactgatctcattttcagtttaagtaactgctgttacttaagtgattacacttttgctcaaattgaagcttaatggaattataattctcaggatagtattttgtaaataaagatgatttaaatatgaatcttatgagtaaattatttcaattttattttagacggtataactatttcaatttgattaatccactattatataaacaatagtgggagttttatatatgtaatctttcaggtggggaggctttaaattctgaagtctgtgtctttatgccaagaactgtatttactgtggttgtggacaaatgtgaaagtaactttatgcttaaataaattatagttgatttaaagatttgtttggcattgataataataaaatcagtagtttttctat

SEQ ID NO: 315078 - DNA, 4473 bp, Homo sapiens
tggagtcttccgaaaatgttcagacacatttaagaatttttattgagtaatacaatgttctaattgaggcatacacgttgttctaggagtctgtgaaattctaaagataaaagtttgattatgcttgttttgactttaatgaactattcacataattttaatacacagtgtctaacacgtatgaaagttgtgtaataccttataccttaacaatggagaattactaagcaattttggctactctgatattagcatttcctgaaactcctcaggctgatgtggcaaaggagaaatagcaatcttgagttctgaaaagctaggccgcattttggtcctgaaaaatcacttgctgtgaacttgggccagtttttgattttttaaatggcataacagttcgttgctacaagaggttacatcaggaaaatttcctaaggatttaagattttgttcatctattgagttcttttgggtgatttgtttaggaggaagtatctgctcctttttgagttgcttcaccaaagtacttgagtgagaaggcagaatataatgagaatgatcatgctggcaaggaagacatatatatgagatgggttatcctttacacctacgtcagctaaaaccgtctcctacgaacaaatccagcacttggcactttattcgacggtcctaaaaatagagtcctaaatttagaaggcaaggtgctacttttagctcctcttctcggaggaaaacagcacgcaccgcgccaggccaaggtccacggggatttgatttagcatttgggtaactggccgctaatggaactgaagacagctgggcctaacaagtgcccaggtgactcaggtaagcgaggaaaccagatcgaggttctcttgcgtgggacaggttaaactctgaccaaaccacagctgagccgggacgccttcctgtctaaagtccaaagtccggacgtggttggcagggcgcaccggcgcgtgccccgcaggccatttttctgactggaatgacggcggcggctggcttctcggggctgccggggtctcccggggttgtggcagcactgcctgaaggtatgagaccagattctaatctttatggttttccatgggaattggtgatatgtgcagctgttgttggattttttgctgttctcttttttttgtggagaagttttagatcggttaggagtcggctttatgtgggacgagagaaaaagcttgctctaatgctttctggactaattgaagaaaaaagtaaactacttgaaaaatttagccttgttcaaaaagagtatgaaggctatgaagtagagtcatctttaaaggatgccagctttgagaaggaggcaacagaagcacaaagtttggaggcaacctgtgaaaagctgaacaggtccaattctgaacttgaggatgaaatactctgtctagaaaaagagttaaaagaagagaaatccaaacattctgaacaagatgaattgatggcggatatttcaaaaaggatacagtctctagaagatgagtcaaaatccctcaaatcacaagtagctgaagccaaaatgaccttcaagatatttcaaatgaatgaagaacgactgaagatagcaataaaagatgctttgaatgaaaattctcaacttcaggaaagccagaaacagcttttgcaagaagctgaagtatggaaagaacaagtgagtgaacttaataaacagaaagtaacatttgaagactccaaagtacatgcagaacaagttctaaatgataaagaaagtcacatcaagactctgactgaacgcttgttaaagatgaaagattgggctgctatgcttggagaagacataacggatgatgataacttggaattagaaatgaacagtgaatcggaaaatggtgcttacttagataatcctccaaaaggagctttgaagaaactgattcatgctgctaagttaaatgcttctttaaaaaccttagaaggagaaagaaaccaaatttatattcagttgtctgaagttgataaaacaaaggaagagcttacagagcatattaaaaatcttcagactcaacaagcatctttgcagtcagaaaacacacattttgaaaatgagaatcagaagcttcaacagaaacttaaagtaatgactgaattatatcaagaaaatgaaatgaaactccacaggaaattaacagtagaggaaaattatcggttagagaaagaagagaaactttctaaagtagatgaaaagatcagccatgccactgaagagctggagacctatagaaagcgagccaaagatcttgaagaagaattggagagaactattcattcttatcaagggcagattatttcccatgagaaaaaagcacatgataattggttggcagctcggaatgctgaaagaaacctcaatgatttaaggaaagaaaatgctcacaacagacaaaaattaactgaaacagagcttaaatttgaacttttagaaaaagatccttatgcactcgatgttccaaatacagcatttggcagagagcattccccatatggtccctcaccattgggttggccttcatctgaaacaagagcttttctctctcctccaactttgttggagggtccactcagactctcacctttgcttccagggggaggaggaagaggctcacgaggcccagggaatcctctggaccatcagattaccaatgaaagaggagaatcaagctgtgataggttaaccgatcctcatagggctccctctgacactgggtctctgtcacctccatgggaccaggaccgtaggatgatgtttcctccgccaggacaatcatatcctgattcagcccttcctccacaaaggcaagacagattttgttctaattctggtagactgtctggaccagcagaactcagaagttttaatatgccttctttggataaaatggatgggtcaatgccttcagaaatggaatccagtagaaatgataccaaagatgatcttggtaatttaaatgtgcctgattcatctctccctgctgaaaatgaagccactggccctggctttgttcctccacctcttgctccagtcagaggtccattgtttccagtggatgcaagaggcccattcttgagaagaggacctcctttccccccacctcctccaggagccatgtttggagcttctcgagattattttccaccaggggatttcccaggtccaccacctgctccatttgcaatgagaaatgtctatccaccgaggggttttcctccttaccttcccccaagacctggatttttccccccacccccacattctgaaggtagaagtgagttcccctcaggtttgattccaccttcaaatgagcctgctactgaacatccagaaccacagcaagaaacctgacaatatttttgctctcttctgattacacttttgctcaaattgaagcttaatggaattataattctcaggatagtattttgtaaataaagatgatttaaatatgaatcttatgagtaaattatttcaattttattttagacggtataactatttcaatttgattaatccactattatataaacaatagtgggagttttatatatgtaatctttcaggtggggaggctttaaattctgaagtctgtgtctttatgccaagaactgtatttactgtggttgtggacaaatgtgaaagtaactttatgcttaaataaattatagttgatttaaagatttgtttggcattgataataataaaatcagtagtttttctataactatggctctattaattaacttttttccttttaccaataactttgaggtgcaaaactcaaacttatgtgggtcttttgtgttcaattatgttatgacaaatgtgctctctttcttgtaaatagacatgagtggcccaaagcaacaaattaatacacttttaaaagtcaaaattgattatattttaaagataaccaggatattatctaatggtgaattgtagaattttgatcttcttattcactgagtttcttgcacggtttctttattgcttttttttccccgcctgttcttttgtaaggtatttactattttctgtggaggatattgagatgtactacaggataactgtagtgaatgatgtgtcatcattttgagctttggactcaatatctttagtgtttccctaaatcagatttgtaggtcatgttaagcttcttgcacattaatatgattatggaaggaaaggcagtgaagcataactaataaacatcataatacttaacgttgcccagttggttgttttagtattagacttttttttcaatgccaaaagatagaagattaaatattcttgaataaagcagtgatatatattggaacacttcaccccagcatttccccaggtgttgtttggaacactgatcttgtgaagtatttttgctccctttctattctaaccctcacctcaaaaaaaaa

SEQ ID NO: 315079 - DNA, 2565 bp, Homo sapiens
tggagtcttccgaaaatgttcagacacatttaagaatttttattgagtaatacaatgttctaattgaggcatacacgttgttctaggagtctgtgaaattctaaagataaaagtttgattatgcttgttttgactttaatgaactattcacataattttaatacacagtgtctaacacgtatgaaagttgtgtaataccttataccttaacaatggagaattactaagcaattttggctactctgatattagcatttcctgaaactcctcaggctgatgtggcaaaggagaaatagcaatcttgagttctgaaaagctaggccgcattttggtcctgaaaaatcacttgctgtgaacttgggccagtttttgattttttaaatggcataacagttcgttgctacaagaggttacatcaggaaaatttcctaaggatttaagattttgttcatctattgagttcttttgggtgatttgtttaggaggaagtatctgctcctttttgagttgcttcaccaaagtacttgagtgagaaggcagaatataatgagaatgatcatgctggcaaggaagacatatatatgagatgggttatcctttacacctacgtcagctaaaaccgtctcctacgaacaaatccagcacttggcactttattcgacggtcctaaaaatagagtcctaaatttagaaggcaaggtgctacttttagctcctcttctcggaggaaaacagcacgcaccgcgccaggccaaggtccacggggatttgatttagcatttgggtaactggccgctaatggaactgaagacagctgggcctaacaagtgcccaggtgactcaggtaagcgaggaaaccagatcgaggttctcttgcgtgggacaggttaaactctgaccaaaccacagctgagccgggacgccttcctgtctaaagtccaaagtccggacgtggttggcagggcgcaccggcgcgtgccccgcaggccatttttctgactggaatgacggcggcggctggcttctcggggctgccggggtctcccggggttgtggcagcactgcctgaaggtatgagaccagattctaatctttatggttttccatgggaattggtgatatgtgcagctgttgttggattttttgctgttctcttttttttgtggagaagttttagatcggttaggagtcggctttatgtgggacgagagaaaaagcttgctctaatgctttctggactaattgaagaaaaaagtaaactacttgaaaaatttagccttgttcaaaaagagtatgaaggctatgaagtagagtcatctttaaaggatgccagctttgagaaggaggcaacagaagcacaaagtttggaggcaacctgtgaaaagctgaacaggtccaattctgaacttgaggatgaaatactctgtctagaaaaagagttaaaagaagagaaatccaaacattctgaacaagatgaattgatggcggatatttcaaaaaggatacagtctctagaagatgagtcaaaatccctcaaatcacaagtagctgaagccaaaatgaccttcaagatatttcaaatgaatgaagaacgactgaagatagcaataaaagatgctttgaatgaaaattctcaacttcaggaaagccagaaacagcttttgcaagaagctgaagtatggaaagaacaagtgagtgaacttaataaacagaaagtaacatttgaagactccaaagtacatgcagaacaagttctaaatgataaagaaagtcacatcaagactctgactgaacgcttgttaaagatgaaagattgggctgctatgcttggagaagacataacggatgatgataacttggaattagaaatgaacagtgaatcggaaaatggtgcttacttagataatcctccaaaaggagctttgaagaaactgattcatgctgctaagttaaatgcttctttaaaaaccttagaaggagaaagaaaccaaatttatattcagttgtctgaagttgataaaacaaaggaagagcttacagagcatattaaaaatcttcagactcaacaagcatctttgcagtcagaaaacacacattttgaaaatgagaatcagaagcttcaacagaaacttaaagtaatgactgaattatatcaagaaaatgaaatgaaactccacaggaaattaacagtagaggaaaattatcggttagagaaagaagagaaactttctaaagtagatgaaaagatcagccatgccactgaagagctggagacctatagaaagcgagccaaagatcttgaagaagaattggagagaactattcattcttatcaagggcagattattttcccatgagaaaaaaggcccatgataatggggtggggtccggaatgctgaagaaactcatggatttggaaggaaattgttcccccgcaaattatcggacaaaggttattggcttgaagtctttgctcgtgtcccaaccatggggaagatccccagggcgccgggtgcctcggaaaaggtctctccccacggggggcgcaacacctctatgggggaac

SEQ ID NO: 315080 - DNA, 215 bp, Homo sapiens
cacatgtctgggaggcaatgacagaattcctccccagtcctctgtcttcagagcacagtacgtgcactaggacactggcatgggggaggtgcccctcggaagggcagcagggaccagatagtagcctgagctagaaagcccagaggtttacttggttggttggttgttcgtatgtttgtttgtttgcttgttttttggagatggagtctcactct

SEQ ID NO: 315081 - DNA, 563 bp, Homo sapiens
  misc_feature (28)..(31): n is a, c, g, or t
taacataaaaaataaatagtaaaattcnnnnttcaaacgaggcctggagaacaccttgcacgatgccaagcactggcatgacatggagctccagaacctgggcgctgtggtcggccggctggaggcggagctcagggaaatccgagcggaggcggagcagcagcaacaggagcgcgcgcatctgctggcccgcaagtgccagctgcagaaggacgtggcgtcctaccacgccctgctggacagggaggagagcggctgatggagaaacttcctctttttcatgaagaaaacacccttcctcaacagctgacccaagaagttgcttgaggagctttctcctgagctccagtccctgctggattccctggttaattcagcttgagctgaaaagcttcctggaagtggagaggatccttctgctttaatctgagtagtctgtagcttgagcaatctcccttgtcctccttcaaataaatgcttacatttacggacgcttacctaaagagacggttaaaccatcatgctcggtcactgactaaatgtgtgccctcgttggccttagg

SEQ ID NO: 315082 - DNA, 1571 bp, Homo sapiens
cacagaggcagaaggggtgatgagtgagaggcgagtggtagtggacttgcccaccagtgccagctccagcatgcccctccagaggcgcagggcgtccttcagggggccacggtcatcatcctccctggagagccccccagcctccaggaccaatgccatgagtggccttgtccgagcacccggggtctatgtaggaacagcacccagtgggtgcataggtggcttgggtgcccgtgtgacccgccgggccctcggcatcagcagtgtcttccttcagggcctgcggagctcaggcctggccaccgtgccggctccaggtttggagagggaccatggtgctgttgaggacctagggggctgcctggtggaatatatggccaaagtgcacgcccttgagcaagtcagtcaggagctggaaacacaactgcggatgcacctggagagcaaagccacacgctcgggaaactggggtgccctacgggcttcctgggccagcagctgccagcaggtgggtgaggcagtcttggaaaatgcccggctcatgctgcagacagaaactatccaggccggagcagatgactttaaagagagatatgaaaatgagcagccatttcgaaaggcagcagaagaggaaattaactctctgtataaagtcattgatgaggctaatttgactaaaatggacctggagagtcaaatagaaagtctgaaagaagaacttggctctctatcaagaaactatgaagaggatgtgaagctgctgcacaaacagttggcagggtgtgagctggaacaaatggatgctcccattggcactggtctggacgacatccttgagacgatcagaattcagtgggagagagatgttgaaaagaaccgggtggaggcaggagccctgctccaagctaagcaacaggcggaggtggcccacatgtcccagacccaggaggagaagctggcagctgccctcagggtggagttacacaacacttcgtgccaagtccagagcctccaggctgagacagaatccttacgtgccctgaaacgaggcctggagaacaccttgcacgatgccaagcactggcatgacatggagctccagaacctgggcgctgtggtcggccggctggaggcggagctcagggaaatccgagcggaggcggagcagcagcaacaggagcgcgcgcatctgctggcccgcaagtgccagctgcagaaggacgtggcgtcctaccacgccctgctggacagggaggagagcggctgatggagaaacttcctctttttcatgaagaaaacacccttcctcaacagctgacccaagaagttgcttgaggagctttctcctgagctccagtccctgctggattccctggttaattcagcttgagctgaaaagcttcctggaagtggagaggatccttctgctttaatctgagtagtctgtagcttgagcaatctcccttgtcctccttcaaataaatgcttacatttacggacgcttacctaaagagacggttaaaccatcatgctcggtcactgactaaatgtgtgccctcgttggccttagg

SEQ ID NO: 315083 - DNA, 516 bp, Homo sapiens
  misc_feature (28)..(31): n is a, c, g, or t
taacataaaaaataaatagtaaaattcnnnnttcaaacgaggcctggagaacaccttgcacgatgccaagcactggcatgacatggagctccagaacctgggcgctgtggtcggccggctggaggcggagctcagggaaatccgagcggaggcggagcagcagcaacaggagcgcgcgcatctgctggcccgcaagtgccagctgcagaaggacgtggcgtcctaccacgccctgctggacagggaggagagcggctgatggagaaacttcctctttttcatgaagaaaacacccttcctcaacagctgacccaagaagttgcttgaggagctttctcctgagctccagtccctgctggattccctggttaattcagcttgagctgaaaagcttcctggaagtggagaggatccttctgctttaatctgagtagtctgtagcttgagcaatctcccttgtcctccttcaaataaatgcttggcctcgttggcctcagcggtggagctctgcggctg

SEQ ID NO: 315084 - DNA, 1474 bp, Homo sapiens
cacagaggcagaaggggtgatgagtgagaggcgagtggtagtggacttgcccaccagtgccagctccagcatgcccctccagaggcgcagggcgtccttcagggggccacggtcatcatcctccctggagagccccccagcctccaggaccaatgccatgagtggccttgtccgagcacccggggtctatgtaggaacagcacccagtgggtgcataggtggcttgggtgcccgtgtgacccgccgggccctcggcatcagcagtgtcttccttcagggcctgcggagctcaggcctggccaccgtgccggctccaggtttggagagggaccatggtgctgttgaggacctagggggctgcctggtggaatatatggccaaagtgcacgcccttgagcaagtcagtcaggagctggaaacacaactgcggatgcacctggagagcaaagccacacgctcgggaaactggggtgccctacgggcttcctgggccagcagctgccagcaggtgggtgaggcagtcttggaaaatgcccggctcatgctgcagacagaaactatccaggccggagcagatgactttaaagagagatatgaaaatgagcagccatttcgaaaggcagcagaagaggaaattaactctctgtataaagtcattgatgaggctaatttgactaaaatggacctggagagtcaaatagaaagtctgaaagaagaacttggctctctatcaagaaactatgaagaggatgtgaagctgctgcacaaacagttggcagggtgtgagctggaacaaatggatgctcccattggcactggtctggacgacatccttgagacgatcagaattcagtgggagagagatgttgaaaagaaccgggtggaggcaggagccctgctccaagctaagcaacaggcggaggtggcccacatgtcccagacccaggaggagaagctggcagctgccctcagggtggagttacacaacacttcgtgccaagtccagagcctccaggctgagacagaatccttacgtgccctgaaacgaggcctggagaacaccttgcacgatgccaagcactggcatgacatggagctccagaacctgggcgctgtggtcggccggctggaggcggagctcagggaaatccgagcggaggcggagcagcagcaacaggagcgcgcgcatctgctggcccgcaagtgccagctgctgatggagaaacttcctctttttcatgaagaaaacacccttcctcaacagctgacccaagaagttgcttgaggagctttctcctgagctccagtccctgctggattccctggttaattcagcttgagctgaaaagcttcctggaagtggagaggatccttctgctttaatctgagtagtctgtagcttgagcaatctcccttgtcctccttcaaataaatgcttggcctcgttggcctcagcggtggagctctgcggctg

SEQ ID NO: 315085 - DNA, 316 bp, Homo sapiens
tctgctggctagaattctatgccatttatttccccccgtaactcatctaagatgtatattgttgttttcaggatgtgaagctgctgcacaaacagttggcagggtgtgagctggaacaaatggatgctcccattggcactggtctggacgacatccttgagacgatcagaattcagtgggagagagatgttgaaaagaaccgggtggaggcaggagccctgctccaagctaaggtgagaggcaggaccagcatcctccactctgccctatgcagaaggaggccacgctgagctgcaaactagtcaatgtgcagacg

SEQ ID NO: 315086 - DNA, 1524 bp, Homo sapiens
cacagaggcagaaggggtgatgagtgagaggcgagtggtagtggacttgcccaccagtgccagctccagcatgcccctccagaggcgcagggcgtccttcagggggccacggtcatcatcctccctggagagccccccagcctccaggaccaatgccatgagtggccttgtccgagcacccggggtctatgtaggaacagcacccagtgggtgcataggtggcttgggtgcccgtgtgacccgccgggccctcggcatcagcagtgtcttccttcagggcctgcggagctcaggcctggccaccgtgccggctccaggtttggagagggaccatggtgctgttgaggacctagggggctgcctggtggaatatatggccaaagtgcacgcccttgagcaagtcagtcaggagctggaaacacaactgcggatgcacctggagagcaaagccacacgctcgggaaactggggtgccctacgggcttcctgggccagcagctgccagcaggtgggtgaggcagtcttggaaaatgcccggctcatgctgcagacagaaactatccaggccggagcagatgactttaaagagagatatgaaaatgagcagccatttcgaaaggcagcagaagaggaaattaactctctgtataaagtcattgatgaggctaatttgactaaaatggacctggagagtcaaatagaaagtctgaaagaagaacttggctctctatcaagaaactatgaagaggatgtgaagctgctgcacaaacagttggcagggtgtgagctggaacaaatggatgctcccattggcactggtctggacgacatccttgagacgatcagaattcagtgggagagagatgttgaaaagaaccgggtggaggcaggagccctgctccaagctaagcaacaggcggaggtggcccacatgtcccagacccaggaggagaagctggcagctgccctcagggtggagttacacaacacttcgtgccaagtccagagcctccaggctgagacagaatccttacgtgccctgaaacgaggcctggagaacaccttgcacgatgccaagcactggcatgacatggagctccagaacctgggcgctgtggtcggccggctggaggcggagctcagggaaatccgagcggaggcggagcagcagcaacaggagcgcgcgcatctgctggcccgcaagtgccagctgcagaaggacgtggcgtcctaccacgccctgctggacagggaggagagcggctgatggagaaacttcctctttttcatgaagaaaacacccttcctcaacagctgacccaagaagttgcttgaggagctttctcctgagctccagtccctgctggattccctggttaattcagcttgagctgaaaagcttcctggaagtggagaggatccttctgctttaatctgagtagtctgtagcttgagcaatctcccttgtcctccttcaaataaatgcttggcctcgttggcctcagcggtggagctctgcggctg

SEQ ID NO: 315087 - DNA, 1472 bp, Homo sapiens
cacagaggcagaaggggtgatgagtgagaggcgagtggtagtggacttgcccaccagtgccagctccagcatgcccctccagaggcgcagggcgtccttcagggggccacggtcatcatcctccctggagagccccccagcctccaggaccaatgccatgagtggccttgtccgagcacccggggtctatgtaggaacagcacccagtgggtgcataggtggcttgggtgcccgtgtgacccgccgggccctcggcatcagcagtgtcttccttcagggcctgcggagctcaggcctggccaccgtgccggctccaggtttggagagggaccatggtgctgttgaggacctagggggctgcctggtggaatatatggccaaagtgcacgcccttgagcaagtcagtcaggagctggaaacacaactgcggatgcacctggagagcaaagccacacgctcgggaaactggggtgccctacgggcttcctgggccagcagctgccagcaggtgggtgaggcagtcttggaaaatgcccggctcatgctgcagacagaaactatccaggccggagcagatgactttaaagagagatatgaaaatgagcagccatttcgaaaggcagcagaagaggaaattaactctctgtataaagtcattgatgaggctaatttgactaaaatggacctggagagtcaaatagaaagtctgaaagaagaacttggctctctatcaagaaactatgaagaggatgtgaagctgctgcacaaacagttggcagggtgtgagctggaacaaatggatgctcccattggcactggtctggacgacatccttgagacgatcagaattcagtgggagagagatgttgaaaagaaccgggtggaggcaggagccctgctccaagctaagcaacaggcggaggtggcccacatgtcccagacccaggaggagaagctggcagctgccctcagggtggagttacacaacacttcgtgccaagtccagagcctccaggctgagacagaatccttacgtgccctgaaacgaggcctggagaacaccttgcacgatgccaagcactggcatgacatggagctccagaacctgggcgctgtggtcggccggctggaggcggagctcagggaaatccgagcggaggcggagcagcagcaacaggagcgcacgccctgctggacagggaggagagcggctgatggagaaacttcctctttttcatgaagaaaacacccttcctcaacagctgacccaagaagttgcttgaggagctttctcctgagctccagtccctgctggattccctggttaattcagcttgagctgaaaagcttcctggaagtggagaggatccttctgctttaatctgagtagtctgtagcttgagcaatctcccttgtcctccttcaaataaatgcttggcctcgttggcctcagcggtggagctctgcggctg

SEQ ID NO: 315088 - DNA, 466 bp, Homo sapiens
cggtcaagtagtcttgaaaagaatgaaaaataatctaaacgaggcctggagaacaccttgcacgatgccaagcactggcatgacatggagctccagaacctgggcgctgtggtcggccggctggaggcggagctcagggaaatccgagcggaggcggagcagcagcaacaggagcgcacgccctgctggacagggaggagagcggctgatggagaaacttcctctttttcatgaagaaaacacccttcctcaacagctgacccaagaagttgcttgaggagctttctcctgagctccagtccctgctggattccctggttaattcagcttgagctgaaaagcttcctggaagtggagaggatccttctgctttaatctgagtagtctgtagcttgagcaatctcccttgtcctccttcaaataaatgcttggcctcgttggcctcagcggtggagctctgcggctg

SEQ ID NO: 315089 - DNA, 853 bp, Homo sapiens
tcaccacgggaagatgggaagatcctgactttgggcagagcacctgagaggaccccaggatctaggtaccttctctgcgtgcagtttctcaaacaagtggagcttcctctccatccatggccctcggaggaggaaagtgcctgcatagcttggggccagctctggctactgtgaaaggacatttgatcctctctgctgttcagttgtgctctcttctcctggtgtggtctcttgcttcagggcttactttgtggttagctgagtccagtaaggtgaagagtcttctggattatttcagtggcaaaaagccttttatttccttctttagctttcgtaataacaggccgtgcttgtcttgcctaatacccttagaacatgctgtcatgttcttcaacttgcggtcatagagacacaattccgactcttcctgtgctgaacatcagctgaaataacatgccgtattgatccagttcatgagtgagaagtttagtctacacaagccttttctgtcttgctctttgcagaaggattgcgtcagcctaaaaagcggatctttttgtctccatccgctgccacaaagctgttgacggaggctatctgcccaagttggctgccttctctagctcttatcagtaaacttatctgcctcattgtgacatatctacaacagttgcttagccttattcaatcagtattggaagacaagtggaatcatctttcttctcataggaaattttttgaatggaaacttgccctcttaaatatgtaccgccaaaatttagccctgctgtcccacgcaaaggctgtacatgacctggatatcgtcatggggcatgtcctaactataatcatc

SEQ ID NO: 315090 - DNA, 770 bp, Homo sapiens
agggagtctcgctgtgtcgcgcagactggagtgcagtggtgcgatctgcacactgcaacctccacctcctgagatcaagcaattctcctgcctcaacctcacgggtagctgggattacagacgtgcatcaccacgcccagctaatttttgtatttttaatagagacaggttttcaccatgttggccaggttggtctcaaactcccgacctcaggtgatccacccgcctcggcctcccaaagtgctgggattacaggcatgagccaccgggcggtttccatgtgtgatctttaaaaggcagaaacaaataagcaaaaatcattactaaaggcccacgagggttgtttctatcttagaaaatgtgtaaagaaaagtgatacaacaataaatggtttgatttaatgagaagtcaaaaatcataagatctgttgaaaataacaaaatcacttctaaaaaagataatatgttttattgaaataaagccttagaagtcatctggttttaccttttacaaagaagaaagcagtctaagagaggccaaatgacttatcccaagctatacggctaggtagtagcagattcaaatttatactacccaggcttcctaattcttagcccagagctgtgtccaccctaccacccaccttttaattcagtgcgagctcaattattgctaacagttttattgttgaccttccatggactcgatagtcaaatcaagtcttccattacaataaatgggatttatttgtattttgcaacataaccttg

SEQ ID NO: 315091 - DNA, 4995 bp, Homo sapiens
caaagctctaagtatgctgggacagatactacaaatgaactttatgatgagcgaattaacctgatttatagtcctgtactttctctacgtgccatatccattattaaagaaatgagtctaagtaggaagtagagttaacctatagtttcatttcttgaatttcttattctctttcttcagtctttttcagttaacctacacacacacacacacacacacacacacacacacacatatgtttataagtgggatgggagaacgggtacggtgataattaaaagaggtaaggtttctcttgagatgaaaatgttctaaaattgtgatggcggatgcacacctctgaatatattaaaagccattgaaatgaaaaaagggtggggggaatccaaaagtgtagcagacccaaccttgagatttgcttgtttgggaatgaattttccaataacttgaaagttgtaaaaactcacacttctcagggttaggtgtcagaaagaaaaggaagtaatttattctttaataaagcaattgttaaatactctttagaactaccactgattgcaattttgcagtgtctactcatagtgtctatataggtaccatgaaaaagatgtacttgtgaaactgttctcatgttacttcagaaaaattttgcttctaagtgtgtattctatgtctggttaaatgttcattgaattttatttaatcattaatctcaacagcattaaacagtcaataacataaatgacagtcttctctttgtactcctccctgtacaacatcacagagctccatctgtatacacgaaagtcacatgaaaatagaactcagtgttttgtattacatagtctattcagtacatttagaagtattttgcctccaatattcaaccacagtaaaagactcagtgagaacgcgtggtggcgctgcaggttaagatgacggaaaatacaactgcctacgcagctccaggatccagcaaaccgtttcccaaagcctggaagcaaaagaatagctgagccagagcgaacgtgagtgtgaaacctctttaagacaccgttgggctgcttggttctgacattctggactgcaaaacagttctactaggatcctggggatacatgaagcttctgtgaaccaacttttcaagaaaaagcaatggagattggatggatgcacaatcggagacaaaggcaagtccttgttttctttgttttgctgagcttgtctggggcgggcgccgagttggggtcctattccgtagtggaagaaacggagagaggctcttttgtggcaaatctaggaaaagacctggggttggggttgacagagatgtccacccgcaaggccaggatcatttcccaggggaacaaacagcatttgcagctcaaggctcaaactggggatttgctcataaatgagaagctagatcgagaggagctatgcggtcccactgagccttgcatactacatttccaagtgttaatggaaaaccctttagaaatatttcaggctgaactgagggtgatagatataaatgaccattctcccatgttcactgaaaaggaaatgattctaaaaataccggaaaacagtcctctaggaactgagttccctctgaatcatgctttggacttggacgtaggaagcaataatgttcaaaactataaaatcagcccaagctctcatttccgggttctaatccatgaattcagagatggcaggaaataccctgagctagtgttggataaagagctggatcgggaggaggagcctcaactaagattaaccctgacagcgctggatggtggctctccaccgcgatctggaactgctcaggtccgtattgaagtggtggacatcaatgataacgctcctgagtttgagcagcccatctacaaagtgcagattccagagaacagtcctcttggctccctggttgccaccgtctccgccagggatttagacggcggagccaatggaaaaatatcatacacactctttcagccttcggaggatattagtaaaactttggaggtaaatcctatgacaggggaagttcgactgagaaagcaagtagatttcgaaatggttacgtcttatgaagtgcgcatcaaagccacagatgggggaggtctttcaggaaagtgcactcttctcctgcaggtggtggacgtgaatgacaatcccccacaggtgaccatgtctgcactcaccagccccatcccagagaactcgcctgagatagtagttgctgttttcagcgtttcagatcctgactccggaaacaatgggaagacgatttcctccatccaggaagaccttccctttcttctaaaaccttcagtcaagaacttttacaccttggtaacggagagagcactcgacagagaagcaagagctgaatataatatcaccctcaccgtcacagatatggggactccaaggctgaaaacggagcacaacataacagtgcagatatcagatgtcaatgataacgcccccactttcacccaaacctcctacaccctgttcgtccgcgagaacaacagccccgccctgcacatcggcagcgtcagcgccacagacagagactcaggcaccaacgcccaggtcacctactcgctgctgccgccccaggacccgcacctgcccctcgcctccctggtctccatcaacgcagacaacggccacctgttcgccctcaggtcgctggactacgaggccctgcgggagttcgagttccgcgtgagcgccacagaccgcggctccccggctttgagcagcgaggcgctggtgcgcgtgctggtgctggacgccaacgacaactcgcccttcgtgctgtacccgctgcagaacggctccgcgccctgcactgagctggtgccccgggcggccgagccgggctacctggtgaccaaggtggtggcggtggacggcgactcgggccagaatgcctggctgtcgtaccagctgctcaaggccacggagcccgggctgttcggtgtgtgggcgcacaatggcgaggtgcgcaccgccaggctgctgagcgagcgcgacgcagccaagcagaggctggtggtgctggtcaaggacaatggcgagcctccgcgctcggccaccgccacgctgcacgtgctcctggtggacggcttctcccagcccttcctgccgctcccagaggcggcccccggccagacccaggccaactcgctcactgtctacctggtggtggcgttggcctcggtgtcgtcgctcttcctcttttcggtgctcctgttcgtggcggtgcggctgtgcaggaggagcagggcggcctcggtgggccgctgctcgatgcctgagggcccctttccagggcgtctggtggacgtaagcggcaccgggaccctgtcccagagctaccaatacgaggtgtgtctgacaggaggctcagaaacaagtgagttcaagttcctgaagccgattatccccaacttctctccttagggcactaggaaagaaatagattaaaattccacccttcacaatagctttggatttaattattgataggaacccatttgataaattccttaacttcttatgattgtcttgttgattaaattgttcatgctcaccaccaccaataaggtatttttctctgattgttagttcaaattatattgttaattccagtttcccttttcctcatatttaccccgaagaggtgttgcatatagaatcccaattaacaaaatatactttatcttcaaagttgatgtcatttaaaatttttccgtctttatattttatttacttcctattcattttttgctccatttttcatgttacttctcagtttcctagaacttcaagtattaaaataacctgttgcatgtattaggcatatttcctatgttacatttcttttgtctattttcctttcaaaattggtatttttgttgggctcaattttcattataatacttttcttaaagtttctttctttcttttcttttctttctttttttttttttcctttttgagacagggtcttactcttgtcacccaggctggagtgcagtggcacaatcttggctcactgcaacctctgcctcctgggctcaacggatccttccacctcagcctcccaagtagcttggactataggtgcatgccaccatgcctggctaatcttttgcagcgatgggattttgccaagttgcccaggctgatcttgaactcctgggctcaagccatcctccctcctcagcctcccaaaattctgggattacaggcataagccaatgtgcccatccaaagttttatttatttatttttttgagatggagtctcgtaaagttacctttaaaaaaaaagttctattttccctgtattggtatctccttaaataaaataaaatattcctattgtaagtgatatgagaaatctttaaccagccttatctaaaaataaaaagagaagccattgtaagacattcagtatgtgtaaatgtgtttgtgtttgtagacaaaaggcaaaggtattatgtaaaaatatttaataatttattctttctattactgaattaaaaaatcagaggtccctgttatatttttaatggctaacaactcaatctcattaagttggaaaaaaaacttatcaaagagacatttacatggtttggcttttatattcatcatagtatacattggcggtatctagccctttctctgtaaaatatccctatgtttaatctgtatttcttgcttattatatgtaaagttgagcttctttctagatattaggcctttgaataaaattctatgtgagtcagatttaataatttgttttcactttcaatagtgttaggataggtgttagtttgatctgttctttacctccgcttatttggttcagagaaattagggcctactagatttccactaaaagggacttgaaaataaaggtcagtcccttctttaattctgcaagttactttaaagctaatctaag

SEQ ID NO: 315092 - DNA, 2007 bp, Homo sapiens
  misc_feature (76)..(76): n is a, c, g, or t
  misc_feature (92)..(92): n is a, c, g, or t
  misc_feature (121)..(121): n is a, c, g, or t
gcacgaggcggcccccggccgcctctgggagcggcaggaagggctgggagaagccgtccaccaggagcacgtgcancgtggcggtggccgancgcggaggctcgccattgtccttgaccancaccaccagcctctgcttggctgcgtcgcgctcgctcagcagcctggcggtgcgcacctcgccattgtgcgcccacacaccgaacagcccaggccaactcgctcactgtctacctggtggtggcgttggcctcggtgtcgtcgctcttcctcttttcggtgctcctgttcgtggcggtgcggctgtgcaggaggagcagggcggcctcggtgggccgctgctcgatgcctgagggcccctttccagggcgtctggtggacgtaagcggcaccgggaccctgtcccagagctaccaatacgaggtgtgtctgacaggaggctcagaaacaagtgagttcaagttcctgaagccgattatccccaacttctctccttagggcactaggaaagaaatagattaaaattccacccttcacaatagctttggatttaattattgataggaacccatttgataaattccttaacttcttatgattgtcttgttgattaaattgttcatgctcaccaccaccaataaggtatttttctctgattgttagttcaaattatattgttaattccagtttcccttttcctcatatttaccccgaagaggtgttgcatatagaatcccaattaacaaaatatactttatcttcaaagttgatgtcatttaaaatttttccgtctttatattttatttacttcctattcattttttgctccatttttcatgttacttctcagtttcctagaacttcaagtattaaaataacctgttgcatgtattaggcatatttcctatgttacatttcttttgtctattttcctttcaaaattggtatttttgttgggctcaattttcattataatacttttcttaaagtttctttctttcttttcttttctttctttttttttttttcctttttgagacagggtcttactcttgtcacccaggctggagtgcagtggcacaatcttggctcactgcaacctctgcctcctgggctcaacggatccttccacctcagcctcccaagtagcttggactataggtgcatgccaccatgcctggctaatcttttgcagcgatgggattttgccaagttgcccaggctgatcttgaactcctgggctcaagccatcctccctcctcagcctcccaaaattctgggattacaggcataagccaatgtgcccatccaaagttttatttatttatttttttgagatggagtctcgtaaagttacctttaaaaaaaaagttctattttccctgtattggtatctccttaaataaaataaaatattcctattgtaagtgatatgagaaatctttaaccagccttatctaaaaataaaaagagaagccattgtaagacattcagtatgtgtaaatgtgtttgtgtttgtagacaaaaggcaaaggtattatgtaaaaatatttaataatttattctttctattactgaattaaaaaatcagaggtccctgttatatttttaatggctaacaactcaatctcattaagttggaaaaaaaacttatcaaagagacatttacatggtttggcttttatattcatcatagtatacattggcggtatctagccctttctctgtaaaatatccctatgtttaatctgtatttcttgcttattatatgtaaagttgagcttctttctagatattaggcctttgaataaaattctatgtgagtcagatttaataatttgttttcactttcaatagtgttaggataggtgttagtttgatctgttctttacctccgcttatttggttcagagaaattagggcctactagatttccactaaaagggacttgaaaataaaggtcagtcccttctttaattctgcaagttactttaaagctaatctaag

SEQ ID NO: 315093 - DNA, 708 bp, Homo sapiens
cacggtggaagggctggggccacggggcagagaagaaaggttatctctgcttgttggacaaacagaggggagattataaaacatacccggcagtggacaccatgcattctgcaagccaccctggggtgcagctgagctagacatgggacggcgagacgcccagctcctggcagcgctcctcgtcctggggctatgtgccctggcggggagtgagaaaccctccccctgccagtgctccaggctgagcccccataacaggacgaactgcggcttccctggaatcaccagtgaccagtgttttgacaatggatgctgtttcgactccagtgtcactggggtcccctggtgtttccaccccctcccaaagcaagagtcggatcagtgcgtcatggaggtctcagaccgaagaaactgtggctacccgggcatcagccccgaggaatgcgcctctcggaagtgctgcttctccaacttcatctttgaagtgccctggtgcttcttcccgaagtctgtggaagactgccattactaagagaggctggttccagaggatgcatctggctcaccgggtgttccgaaaccaaagaagaaacttcgccttatcagcttcatatttcatgaaatcctgggttttcttaaccatcttttcctcattttcaatggtttaacatataatttctttaaataaaacccttaaaatctgctaaa

SEQ ID NO: 315094 - DNA, 388 bp, Homo sapiens
atccgtaaatatctcacctcacgacccaccccacctcccatctattctatgagtcggatcagtgcgtcatggaggtctcagaccgaagaaactgtggctacccgggcatcagccccgaggaatgcgcctctcggaagtgctgcttctccaacttcatctttgaagtgccctggtgcttcttcccgaagtctgtggaagactgccattactaagagaggctggttccagaggatgcatctggctcaccgggtgttccgaaaccaaagaagaaacttcgccttatcagcttcatatttcatgaaatcctgggttttcttaaccatcttttcctcattttcaatggtttaacatataatttctttaaataaaacccttaaaatctgctaaa

SEQ ID NO: 315095 - DNA, 1054 bp, Homo sapiens
cacggtggaagggctggggccacggggcagagaagaaaggttatctctgcttgttggacaaacagaggggagattataaaacatacccggcagtggacaccatgcattctgcaagccaccctggggtgcagctgagctagacatgggacggcgagacgcccagctcctggcagcgctcctcgtcctggggctatgtgccctggcggggagtgagaaaccctccccctgccagtgctccaggctgagcccccataacaggacgaactgcggcttccctggaatcaccagtgaccagtgttttgacaatggatgctgtttcgactccagtgtcactggggtcccctggtgtttccaccccctcccaaagcaagagtcggatcagtgcgtcatggaggtctcagaccgaagaaactgtggctacccgggcatcagccccgaggaatgcgcctctcggaagtgctgcttctccaacttcatctttgaagtgccctggtgcttcttcccgaagtctgtggaagactgccattactaagagaggctggttccagaggatgcatctggctcaccgggtgttccgaaaccaaagaagaaacttcgccttatcagcttcatatttcatgaaatcctgggttttcttaaccatcttttcctcattttcaatggtttaacatataatttctttaaataaaacccttaaaatctgctaaaaaaaaacacaccaagacaaaaaacacacacaaaaaaaaaaacaacaaaaaaaaaaaacacacccgcaccgaaacgccgacaacacaaagcgagggcgggcccacacatacaccccgcgtggggccacccatacttagtgcaacacccatttttgtaagacagggggccacaaatggccgagcgtgttattaagcggcggagcgggcgcgcgtggtattatacccaacctgtggacagtccacacagtgttaaggagcgacacatcgtggtgagggggcccactactcgcgtaggggtaggcaaacacggtgggagaacacaaccccaaaaggagatttcaccggcg

SEQ ID NO: 315096 - DNA, 396 bp, Homo sapiens
  misc_feature (62)..(62): n is a, c, g, or t
  misc_feature (77)..(77): n is a, c, g, or t
ctctcttccgccgttggtttcgcgcccccccccccgtcaaccaagaaaaaaaaaaaggttgntggtgactcgcgcgncgctgaggggtcaaacacgaaactgtggctacccgggcatcagccccgaggaatgcgcctctcggaagtgctgcttctccaacttcatctttgaagtgccctggtgcttcttcccgaagtctgtggaagactgccattactaagagaggctggttccagaggatgcatctggctcaccgggtgttccgaaaccaaagaagaaacttcgccttatcagcttcatatttcatgaaatcctgggttttcttaaccatcttttcctcattttcaatggtttaacatataatttctttaaataaaacccttaaaatctgctaaa

SEQ ID NO: 315097 - DNA, 505 bp, Homo sapiens
ccaacatctttttcatcaggagctgacaaggcaaaaaacccccttcctctcagaacaatggcatgccaccatgcttttgtagtaacaaacactgaaaagtactcaacttctcctttcctttctcctcaaggaaataaccatcgactgactaataccgccccactccaaaggcacacacatcatgtcacgcatttgagctaaagaccataattcaactgaaagattaggagggaatattggaaaaggatggattagacatggaatctacaacctatcaagaagggaaaagtgagatcatactctctttttgaaccaaaatacaaaaacaaaaacatgtgcagtatatcatagttgagaacttggtctctggtatcatcgcccaaattcaaatggcagactagacctagagctgcacagccttggaaagtctacaagcctcagtcctctcatctgtcaaatgggagtattatagctaggttaaataatgcatgaaaagtgcttcaca

SEQ ID NO: 315098 - DNA, 649 bp, Homo sapiens
tacaacaacccaggtacttaagttttaaaagttttttttaaaacacttgtcaccatattttgaaaaatactaacatttggattactagttataaaagtgtaatttctactgtgtcataatcagccatgcagctggagacttgccctctttgtacagcaaagttgtgaaaaaaagtatttgcactacatttatttaaacattaggaaaaaaagccaacccatgcttttctttgccgagatgtagggctgtattattggctagtgagaagcctgggaacactaggactttgtgtgggctgattgcaggtatcagatccgggattatacaggtactgttggaagtatcttggggattttcctgataagaacagtagtgattgcataaaaaggacaggatgtaaagtgaaatcagtaaaatatcttagtagacagagggtgctgaaattttaacaaatgtgtaaaaagttcttcctatgcattaattttccagatacccttaaaatgtttaaggaatgtaattcaaaatactgtttaaaagagacatgtgaccatcattctcccagcgaatgtgaatcatttagtgtgctactcaaaattaggtgtaaatgtatatgtacactataagaataaaaatcgataccatttcttta

SEQ ID NO: 315099 - DNA, 433 bp, Homo sapiens
ctcttagggtcaatataaatactggctattgttttcattggtggcagcatcaccatcaccttagctacttgttcaacttttgggaacatcttctggtaccgccatctctgactgtctttaaagactgatctgctgatgagattaatgttggctaggctaatgctagaaaactcctcatatgatgaagatgtttaccgatttttcttgttggctatcagtggaatgggttatcagttttccatgtatgttttatttaaaattttctgttagcccaccaaacccagccaccaattttactttaggtaaacttttattttcaagcttttgttggtgttgcaagtgtaaatctgttttataaaatgttctataaatataaccactattccttgtaagctatttaaaataaattttaaagtctttcaagtaaacacca

SEQ ID NO: 315100 - DNA, 283 bp, Homo sapiens
tatactgtgtaccaagaatgtagtaacactttccttttctttttacagggaattgatgttgatgctgaaaattgtgcagtgtgtattgaaaatttcaaagtaaaggatattattagaattctgccatgcaagtatgttctttttacatattgagatgttaaaaattacttgacaagttttaggtgtctgacaaaatagttatttgttttttatgataatgaagatcttgtaatttgtgatcatctcttctttttagaaaagcagcttggattttaaatataat

SEQ ID NO: 315101 - DNA, 3138 bp, Homo sapiens
ttcgtccactccgccaggtgcgcgtgcgcagcggccccgaccccgcctcagtcttccaggcggcggtgggtgtccgcttctctctgctcttcgactgcaccgcactcgcgcgtgaccctgactccccctagtcagctcagcggtgctgccatggcgtggcggcggcgcgaagccagcgtcggggctcgcggcgtgttggctctggcgttgctcgccctggccctgtgcgtgcccggggcccggggccgggctctcgagtggttctcggccgtggtaaacatcgagtacgtggacccgcagaccaacctgacggtgtggagcgtctcggagagtggccgcttcggcgacagctcgcccaaggagggcgcgcatggcctggtgggcgtcccgtgggcgcccggcggagacctcgagggctgcgcgcccgacacgcgcttcttcgtgcccgagcccggcggccgaggggccgcgccctgggtcgccctggtggctcgtgggggctgcaccttcaaggacaaggtgctggtggcggcgcggaggaacgcctcggccgtcgtcctctacaatgaggagcgctacgggaacatcaccttgcccatgtctcacgcgggaacaggaaatatagtggtcattatgattagctatccaaaaggaagagaaattttggagctggtgcaaaaaggaattccagtaacgatgaccataggggttggcacccggcatgtacaggagttcatcagcggtcagtctgtggtgtttgtggccattgccttcatcaccatgatgattatctcgttagcctggctaatattttactatatacagcgtttcctatatactggctctcagattggaagtcagagccatagaaaagaaactaagaaagttattggccagcttctacttcatactgtaaagcatggagaaaagggaattgatgttgatgctgaaaattgtgcagtgtgtattgaaaatttcaaagtaaaggatattattagaattctgccatgcaagcatatttttcatagaatatgcattgacccatggcttttggatcaccgaacatgtccaatgtgtaaacttgatgtcatcaaagccctaggatattggggagagcctggggatgtacaggagatgcctgctccagaatctcctcctggaagggatccagctgcaaatttgagtctagctttaccagatgatgacggaagtgatgagagcagtccaccatcagcctcccctgctgaatctgagccacagtgtgatcccagctttaaaggagatgcaggagaaaatacggcattgctagaagccggcaggagtgactctcggcatggaggacccatctcctagcacacgtgcccactgaagtggcaccaacagaagtttggcttgaactaaaggacattttattttttttactttagcacataatttgtatatttgaaaataatgtatattattttacctattagattctgatttgatatacaaaggactaagatattttcttcttgaagagacttttcgattagtcctcatatatttatctactaaaatagagtgtttaccatgaacagtgtgttgcttcagactattacaaagacaactggggcaggtactctaatataaaggacaggtggtgtttctaaataattggctgctatggttctgtaaaaaccagttaattctatttttcaaggtttttggcaaagcacatcaatgttagactagttgaagtggaattgtataattcaattcgataattgatctcatgggctttccctggaggaaaggttttttttgttgttttttttttaagaacttgaaacttgtaaactgagatgtctgtagcttttttgcccatctgtagtgtatgtgaagatttcaaaacctgagagcactttttctttgtttagaattatgagaaaggcactagatgactttaggatttgcatttttccctttattgcctcatttcttgtgacgccttgttggggagggaaatctgtttattttttcctacaaataaaaagctaagattctatatcgcacatgagcattaagttcttcattgccttgttaaggaaaatgagtaggcagactcagaatctgttatattgatttcagttacaatttaatctttacaattaaaagggcgaaagatgtagaattttagtttttgttgttgactcgaaataaccagttttcttgattagagtttaagcagatttaataccatgaccttgcttaaccgtttcttcttttttacttgcttgctgttcttttgggtcaaaggagcaggctaatgcaaagcttttggagactgctaagtgttaaaaagtgattaaacacacactctgctattttttcacttcttggaggtagaagtcgagtatgaggcagttattttttagagtgtggaattatagtctttccttgctcctagttattctgtatatctttactttgtaggtaaaaataaatgtttatttaaaacaatttttaaaattataaatttatttttatagccatatgtaggatataaagatttatatagattattttctcaagctacttaatgctttaattctagctactcatcatgaaatagtaaacagttttactgaaataaactctacagacagatgcagtatgaggagctattgaagtagaaaatgtatttcgctttgcacactgagttggttttagcagacaacctcaagtaggtttccataacagccattacctttgaaatctaccttctgtagtttattataaataggaaaatacatcctgattctgtagcaagtagattgtttgctctttgtctttaagaaatactaggagggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccggaaggcagagcttgcagtgagccgagatcccgccactgcactccagcctgggcgacagagcgagactccgtctcaaaaaaa

SEQ ID NO: 315102 - DNA, 3113 bp, Homo sapiens
  misc_feature (16)..(16): n is a, c, g, or t
tagaggtggtaccccnggggttaggatattgtcgaccacgccgtcggtccgcttctctctgctcttcgactgcaccgcactcgcgcgtgaccctgactccccctagtcagctcagcggtgctgccatggcgtggcggcggcgcgaagccagcgtcggggctcgcggcgtgttggctctggcgttgctcgccctggccctgtgcgtgcccggggcccggggccgggctctcgagtggttctcggccgtggtaaacatcgagtacgtggacccgcagaccaacctgacggtgtggagcgtctcggagagtggccgcttcggcgacagctcgcccaaggagggcgcgcatggcctggtgggcgtcccgtgggcgcccggcggagacctcgagggctgcgcgcccgacacgcgcttcttcgtgcccgagcccggcggccgaggggccgcgccctgggtcgccctggtggctcgtgggggctgcaccttcaaggacaaggtgctggtggcggcgcggaggaacgcctcggccgtcgtcctctacaatgaggagcgctacgggaacatcaccttgcccatgtctcacgcgggaacaggaaatatagtggtcattatgattagctatccaaaaggaagagaaattttggagctggtgcaaaaaggaattccagtaacgatgaccataggggttggcacccggcatgtacaggagttcatcagcggtcagtctgtggtgtttgtggccattgccttcatcaccatgatgattatctcgttagcctggctaatattttactatatacagcgtttcctatatactggctctcagattggaagtcagagccatagaaaagaaactaagaaagttattggccagcttctacttcatactgtaaagcatggagaaaagggaattgatgttgatgctgaaaattgtgcagtgtgtattgaaaatttcaaagtaaaggatattattagaattctgccatgcaagcatatttttcatagaatatgcattgacccatggcttttggatcaccgaacatgtccaatgtgtaaacttgatgtcatcaaagccctaggatattggggagagcctggggatgtacaggagatgcctgctccagaatctcctcctggaagggatccagctgcaaatttgagtctagctttaccagatgatgacggaagtgatgagagcagtccaccatcagcctcccctgctgaatctgagccacagtgtgatcccagctttaaaggagatgcaggagaaaatacggcattgctagaagccggcaggagtgactctcggcatggaggacccatctcctagcacacgtgcccactgaagtggcaccaacagaagtttggcttgaactaaaggacattttattttttttactttagcacataatttgtatatttgaaaataatgtatattattttacctattagattctgatttgatatacaaaggactaagatattttcttcttgaagagacttttcgattagtcctcatatatttatctactaaaatagagtgtttaccatgaacagtgtgttgcttcagactattacaaagacaactggggcaggtactctaatataaaggacaggtggtgtttctaaataattggctgctatggttctgtaaaaaccagttaattctatttttcaaggtttttggcaaagcacatcaatgttagactagttgaagtggaattgtataattcaattcgataattgatctcatgggctttccctggaggaaaggttttttttgttgttttttttttaagaacttgaaacttgtaaactgagatgtctgtagcttttttgcccatctgtagtgtatgtgaagatttcaaaacctgagagcactttttctttgtttagaattatgagaaaggcactagatgactttaggatttgcatttttccctttattgcctcatttcttgtgacgccttgttggggagggaaatctgtttattttttcctacaaataaaaagctaagattctatatcgcacatgagcattaagttcttcattgccttgttaaggaaaatgagtaggcagactcagaatctgttatattgatttcagttacaatttaatctttacaattaaaagggcgaaagatgtagaattttagtttttgttgttgactcgaaataaccagttttcttgattagagtttaagcagatttaataccatgaccttgcttaaccgtttcttcttttttacttgcttgctgttcttttgggtcaaaggagcaggctaatgcaaagcttttggagactgctaagtgttaaaaagtgattaaacacacactctgctattttttcacttcttggaggtagaagtcgagtatgaggcagttattttttagagtgtggaattatagtctttccttgctcctagttattctgtatatctttactttgtaggtaaaaataaatgtttatttaaaacaatttttaaaattataaatttatttttatagccatatgtaggatataaagatttatatagattattttctcaagctacttaatgctttaattctagctactcatcatgaaatagtaaacagttttactgaaataaactctacagacagatgcagtatgaggagctattgaagtagaaaatgtatttcgctttgcacactgagttggttttagcagacaacctcaagtaggtttccataacagccattacctttgaaatctaccttctgtagtttattataaataggaaaatacatcctgattctgtagcaagtagattgtttgctctttgtctttaagaaatactaggagggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccggaaggcagagcttgcagtgagccgagatcccgccactgcactccagcctgggcgacagagcgagactccgtctcaaaaaaa

SEQ ID NO: 315103 - DNA, 2358 bp, Homo sapiens
ttcgtccactccgccaggtgcgcgtgcgcagcggccccgaccccgcctcagtcttccaggcggcggtgggtgtccgcttctctctgctcttcgactgcaccgcactcgcgcgtgaccctgactccccctagtcagctcagcggtgctgccatggcgtggcggcggcgcgaagccagcgtcggggctcgcggcgtgttggctctggcgttgctcgccctggccctgtgcgtgcccggggcccggggccgggctctcgagtggttctcggccgtggtaaacatcgagtacgtggacccgcagaccaacctgacggtgtggagcgtctcggagagtggccgcttcggcgacagctcgcccaaggagggcgcgcatggcctggtgggcgtcccgtgggcgcccggcggagacctcgagggctgcgcgcccgacacgcgcttcttcgtgcccgagcccggcggccgaggggccgcgccctgggtcgccctggtggctcgtgggggctgcaccttcaaggacaaggtgctggtggcggcgcggaggaacgcctcggccgtcgtcctctacaatgaggagcgctacgggaacatcaccttgcccatgtctcacgcgggaacaggaaatatagtggtcattatgattagctatccaaaaggaagagaaattttggagctggtgcaaaaaggaattccagtaacgatgaccataggggttggcacccggcatgtacaggagttcatcagcggtcagtctgtggtgtttgtggccattgccttcatcaccatgatgattatctcgttagcctggctaatattttactatatacagcgtttcctatatactggctctcagattggaagtcagagccatagaaaagaaactaagaaagttattggccagcttctacttcatactgtaaagcatggagaaaagggaattgatgttgatgctgaaaattgtgcagtgtgtattgaaaatttcaaagtaaaggatattattagaattctgccatgcaagcatatttttcatagaatatgcattgacccatggcttttggatcaccgaacatgtccaatgtgtaaacttgatgtcatcaaagccctaggatattggggagagcctggggatgtacaggagatgcctgctccagaatctcctcctggaagggatccagctgcaaatttgagtctagctttaccagatgatgacggaagtgatgagagcagtccaccatcagcctcccctgctgaatctgagccacagtgtgatcccagctttaaaggagatgcaggagaaaatacggcattgctagaagccggcaggagtgactctcggcatggaggacccatctcctagcacacgtgcccactgaagtggcaccaacagaagtttggcttgaactaaaggacattttattttttttactttagcacataatttgtatatttgaaaataatgtatattattttacctattagattctgatttgatatacaaaggactaagatattttcttcttgaagagacttttcgattagtcctcatatatttatctactaaaatagagtgtttaccatgaacagtgtgttgcttcagactattacaaagacaactggggcaggtactctaatataaaggacaggtggtgtttctaaataattggctgctatggttctgtaaaaaccagttaattctatttttcaaggtttttggcaaagcacatcaatgttagactagttgaagtggaattgtataattcaattcgataattgatctcatgggctttccctggaggaaaggttttttttgttgttttttttttaagaacttgaaacttgtaaactgagatgtctgtagcttttttgcccatctgtagtgtatgtgaagatttcaaaacctgagagcactttttctttgtttagaattatgagaaaggcactagatgactttaggatttgcatttttccctttattgcctcatttcttgtgacgccttgttggggagggaaatctgtttattttttcctacaaataaaaagctaagattctatatcaaaaaaaaaaaaaaaaaaacaaaaaaaacaaattgtttggtgggcgggccttgggccctgtgagaaaaggtttttaaacacaattcggttggggcgcgcggggcccgagagtaggcgataggtcgaacagtgggccataagggtgttcctagggaaaccggggcaaaacacatgcgcctgtgatttcacccagataaaaaaaccccgggggggaccccggggctttttggacaaatccaaagaggggttccaaggggcataccggggttctacacacggggttccagagggccgattttatttccag

SEQ ID NO: 315104 - DNA, 3098 bp, Homo sapiens
  misc_feature (7)..(8): n is a, c, g, or t
  misc_feature (15)..(15): n is a, c, g, or t
gcggccnnctactantaaattcgcggccgctcgactattcctagaagttacatttgaccataatcttgattttcgcttatattatttaagtattcaacatgactttttggaagtaactttttaattggactatgttaaattttttgttttgtgggaaattagatacctttaagtctgggttaccttttgcacatttgtttcctgcaggaaccctcttagtcccttgccagacccaaaggagtgatgaatggaagggggggcctctctgtctccatcatggagccgtagtaaagccatttatctctctcagtgacagcaaagagaagggccgtcagagagccagtggcttcccaaggcaggccttttgagcgtccacttatttctgtcattgtggaaagttgactgttctgtcttgaggactaggaagaggcctttaccttttaggtacttgaatagatgagcatgtggtacccctatcctcagcttcttactttcttgacaatatttaagcataagaagtggttgcttcttcagacaaattaaaatcagtactcttggtgaaacacctcttaaagttacatatggctgttctgcatattaagatttgaatggcttttgttgttagggggcttttttatgaagttggtgcaaaagtaatcgcagttttgccattaaaagttattttcagtatagtcatttgactttgcctttcaaatgaaatgttttctgtatgcttatgtgtattatatttgtgacttttaagaaaaatagtgatttaatttaaatttttcaataactgtattaatattttcctacccaagagccatagaaaagaaactaagaaagttattggccagcttctacttcatactgtaaagcatggagaaaagggaattgatgttgatgctgaaaattgtgcagtgtgtattgaaaatttcaaagtaaaggatattattagaattctgccatgcaagcatatttttcatagaatatgcattgacccatggcttttggatcaccgaacatgtccaatgtgtaaacttgatgtcatcaaagccctaggatattggggagagcctggggatgtacaggagatgcctgctccagaatctcctcctggaagggatccagctgcaaatttgagtctagctttaccagatgatgacggaagtgatgagagcagtccaccatcagcctcccctgctgaatctgagccacagtgtgatcccagctttaaaggagatgcaggagaaaatacggcattgctagaagccggcaggagtgactctcggcatggaggacccatctcctagcacacgtgcccactgaagtggcaccaacagaagtttggcttgaactaaaggacattttattttttttactttagcacataatttgtatatttgaaaataatgtatattattttacctattagattctgatttgatatacaaaggactaagatattttcttcttgaagagacttttcgattagtcctcatatatttatctactaaaatagagtgtttaccatgaacagtgtgttgcttcagactattacaaagacaactggggcaggtactctaatataaaggacaggtggtgtttctaaataattggctgctatggttctgtaaaaaccagttaattctatttttcaaggtttttggcaaagcacatcaatgttagactagttgaagtggaattgtataattcaattcgataattgatctcatgggctttccctggaggaaaggttttttttgttgttttttttttaagaacttgaaacttgtaaactgagatgtctgtagcttttttgcccatctgtagtgtatgtgaagatttcaaaacctgagagcactttttctttgtttagaattatgagaaaggcactagatgactttaggatttgcatttttccctttattgcctcatttcttgtgacgccttgttggggagggaaatctgtttattttttcctacaaataaaaagctaagattctatatcgcacatgagcattaagttcttcattgccttgttaaggaaaatgagtaggcagactcagaatctgttatattgatttcagttacaatttaatctttacaattaaaagggcgaaagatgtagaattttagtttttgttgttgactcgaaataaccagttttcttgattagagtttaagcagatttaataccatgaccttgcttaaccgtttcttcttttttacttgcttgctgttcttttgggtcaaaggagcaggctaatgcaaagcttttggagactgctaagtgttaaaaagtgattaaacacacactctgctattttttcacttcttggaggtagaagtcgagtatgaggcagttattttttagagtgtggaattatagtctttccttgctcctagttattctgtatatctttactttgtaggtaaaaataaatgtttatttaaaacaatttttaaaattataaatttatttttatagccatatgtaggatataaagatttatatagattattttctcaagctacttaatgctttaattctagctactcatcatgaaatagtaaacagttttactgaaataaactctacagacagatgcagtatgaggagctattgaagtagaaaatgtatttcgctttgcacactgagttggttttagcagacaacctcaagtaggtttccataacagccattacctttgaaatctaccttctgtagtttattataaataggaaaatacatcctgattctgtagcaagtagattgtttgctctttgtctttaagaaatactaggagggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccggaaggcagagcttgcagtgagccgagatcccgccactgcactccagcctgggcgacagagcgagactccgtctcaaaaaaa

SEQ ID NO: 315105 - DNA, 3442 bp, Homo sapiens
ttcgtccactccgccaggtgcgcgtgcgcagcggccccgaccccgcctcagtcttccaggcggcggtgggtgtccgcttctctctgctcttcgactgcaccgcactcgcgcgtgaccctgactccccctagtcagctcagcggtgctgccatggcgtggcggcggcgcgaagccagcgtcggggctcgcggcgtgttggctctggcgttgctcgccctggccctgtgcgtgcccggggcccggggccgggctctcgagtggttctcggccgtggtaaacatcgagtacgtggacccgcagaccaacctgacggtgtggagcgtctcggagagtggccgcttcggcgacagctcgcccaaggagggcgcgcatggcctggtgggcgtcccgtgggcgcccggcggagacctcgagggctgcgcgcccgacacgcgcttcttcgtgcccgagcccggcggccgaggggccgcgccctgggtcgccctggtggctcgtgggggctgcaccttcaaggacaaggtgctggtggcggcgcggaggaacgcctcggccgtcgtcctctacaatgaggagcgctacgggaacatcaccttgcccatgtctcacgcgggaacaggaaatatagtggtcattatgattagctatccaaaaggaagagaaattttggagctggtgcaaaaaggaattccagtaacgatgaccataggggttggcacccggcatgtacaggagttcatcagcggtcagtctgtggtgtttgtggccattgccttcatcaccatgatgattatctcgttagcctggctaatattttactatatacagcgtttcctatatactggctctcagattggaagtcagagccatagaaaagaaactaagaaagttattggccagcttctacttcatactgtaaagcatggagaaaagggaattgatgttgatgctgaaaattgtgcagtgtgtattgaaaatttcaaagtaaaggatattattagaattctgccatgcaagcatatttttcatagaatatgcattgacccatggcttttggatcaccgaacatgtccaatgtgtaaacttgatgtcatcaaagccctaggatattggggagagcctggggatgtacaggagatgcctgctccagaatctcctcctggaagggatccagctgcaaatttgagtctagctttaccagatgatgacggaagtgatgagagcagtccaccatcagcctcccctgctgaatctgagccacagtgtgatcccagctttaaaggagatgcaggagaaaatacggcattgctagagctgacttttaaaaagaaggctgtgagctttgcagatgctgctgccgcccagggccccctgcttccagccatggtcaaccccaccatgtttttccacattgctgtcgatggcgagcccttgggctgtgtctccttcgaggtaaggggcctggaaagcaagaagtgactgctcatctaatccataaaactatgttaacagattggagctgtttgcagacaaggttccaaagacagcagaaaatttccatgctctgagcactggagaaaaaggatttggttataagggttcctgctttcacagaattattccagggtttacgtgtcagagtggtgacttcacacgccatacagcattggtggcaagtccatctgcagggagaaatttgatgacaagaacttcatcctgaagcatacgggtcctggcatcttgtccatggcaaatgctggacccagcgtgaacgtttcccagttttttatctgccctgccaagatgccaagacagagtggttggattgcaagcatgtggtctttggcaaggtgaaagatggcatgaatattgtggaggtcatggagcacttggggtccaagaatggcaagatcagcaatcagcaagaagatcaccattgctgactggacaactgcaataaatttgacgggtgtttctcttaaaaaaaaaaaaaatactgtgacagaccaaggtaaattgtttttgataattacagaagtgtgatttcttaatcagcagctgtcaaacatagtgttccttaatttaaaagcttgaacactaaattataaattggagaggttggaataattacggtcatatctctagaaacacaagtctttagtagcaaaaaagaaattagcaagagaagaaaactgttcagtactttgaaaggaaaaagttttcagtgatagtttttttagatgaaaattaacatgataaagaagtgacaggccaggtgtggtggttgacgcttttaacaccaacaatttgggaggccaagatgggaggatctcttgagcccaggaattcaagactagcctaggcaacaaggcaaaactcatctctactaaaaatttaaaaaattagccaggtgtggtggcatctgcctgtagtcccagctgcttgggaagctgaggtgggaggatcgcttgagcccaagaggttgaggctgcagtgagctgtgatcacaccactgtactccagcctgggcaagagtgagaccctgtcaaaaaaaaaaaaaaaaaagaaacaaatattacaagagtttttgctgaaagttttaagttgataagatgcagagaattgggggaatgtataataaatcaggtttcattgttatattatttaccacatgaatcaccttcctcctaaccattataggagccatgtgttcacatgtcatgtggaccagtatttaactgtggaaaccgcgggtggcatggagaaggaggcagtgtccgtgactgtgctgctctccgcagccccctgcctgctgtcctgtttcctcggctcctcggtgtctggactggcgttctgggtttcccagcagaaaactaaagggccagagaggtgtaaaaacacacaccacttggcaggtgatttgaagatattaaagctagaaattggaactagaaaatcaaaagaattcaaggcatcttaacgtgacagttgaactcatttgattatacttaaaaaagtttattgcagttattgactctcaatttttttttttttttttgagtgcagtggtgccattgttgctcactgcagcctcaatcttccaggctcaagaaatcctcccacctcagcttccagagtagctgggactacaggtgcatgccacaccctgataatttttttttccccaatataaacgaggtcttgctatgtcctccagtctggtcttgaactcaagtgatccacccaccttggcctcccaaagtgctgggattacaggcgtgagccaccaaacccagccaccaattttactttaggtaaacttttattttcaagcttttgttggtgttgcaagtgtaaatctgttttataaaatgttctataaatataaccactattccttgtaagctatttaaaataaattttaaagtctttcaagtaaacacca

SEQ ID NO: 315106 - DNA, 3050 bp, Homo sapiens
  misc_feature (3050)..(3050): n is a, c, g, or t
ttcgtccactccgccaggtgcgcgtgcgcagcggccccgaccccgcctcagtcttccaggcggcggtgggtgtccgcttctctctgctcttcgactgcaccgcactcgcgcgtgaccctgactccccctagtcagctcagcggtgctgccatggcgtggcggcggcgcgaagccagcgtcggggctcgcggcgtgttggctctggcgttgctcgccctggccctgtgcgtgcccggggcccggggccgggctctcgagtggttctcggccgtggtaaacatcgagtacgtggacccgcagaccaacctgacggtgtggagcgtctcggagagtggccgcttcggcgacagctcgcccaaggagggcgcgcatggcctggtgggcgtcccgtgggcgcccggcggagacctcgagggctgcgcgcccgacacgcgcttcttcgtgcccgagcccggcggccgaggggccgcgccctgggtcgccctggtggctcgtgggggctgcaccttcaaggacaaggtgctggtggcggcgcggaggaacgcctcggccgtcgtcctctacaatgaggagcgctacgggaacatcaccttgcccatgtctcacgcgggaacaggaaatatagtggtcattatgattagctatccaaaaggaagagaaattttggagctggtgcaaaaaggaattccagtaacgatgaccataggggttggcacccggcatgtacaggagttcatcagcggtcagtctgtggtgtttgtggccattgccttcatcaccatgatgattatctcgttagcctggctaatattttactatatacagcgtttcctatatactggctctcagattggaagtcagagccatagaaaagaaactaagaaagttattggccagcttctacttcatactgtaaagcatggagaaaagggaattgatgttgatgctgaaaattgtgcagtgtgtattgaaaatttcaaagtaaaggatattattagaattctgccatgcaagcatatttttcatagaatatgcattgacccatggcttttggatcaccgaacatgtccaatgtgtaaacttgatgtcatcaaagccctaggatattggggagagcctggggatgtacaggagatgcctgctccagaatctcctcctggaagggatccagctgcaaatttgagtctagctttaccagatgatgacggaagtgatgagagcagtccaccatcagcctcccctgctgaatctgagccacagtgtgatcccagctttaaaggagatgcaggagaaaatacggcattgctagagctgacttttaaaaagaaggctgtgagctttgcagatgctgctgccgcccagggccccctgcttccagccatggtcaaccccaccatgtttttccacattgctgtcgatggcgagcccttgggctgtgtctccttcgaggtaaggggcctggaaagcaagaagtgactgctcatctaatccataaaactatgttaacagattggagctgtttgcagacaaggttccaaagacagcagaaaatttccatgctctgagcactggagaaaaaggatttggttataagggttcctgctttcacagaattattccagggtttacgtgtcagagtggtgacttcacacgccatacagcattggtggcaagtccatctgcagggagaaatttgatgacaagaacttcatcctgaagcatacgggtcctggcatcttgtccatggcaaatgctggacccagcgtgaacgtttcccagttttttatctgccctgccaagatgccaagacagagtggttggattgcaagcatgtggtctttggcaaggtgaaagatggcatgaatattgtggaggtcatggagcacttggggtccaagaatggcaagatcagcaatcagcaagaagatcaccattgctgactggacaactgcaataaatttgacgggtgtttctcttaaaaaaaaaaaaaatactgtgacagaccaaggtaaattgtttttgataattacagaagtgtgatttcttaatcagcagctgtcaaacatagtgttccttaatttaaaagcttgaacactaaattataaattggagaggttggaataattacggtcatatctctagaaacacaagtctttagtagcaaaaaagaaattagcaagagaagaaaactgttcagtactttgaaaggaaaaagttttcagtgatagtttttttagatgaaaattaacatgataaagaagtgacaggccaggtgtggtggttgacgcttttaacaccaacaatttgggaggccaaggtgggaggatcgcttgagcccaagaggttgaggctgcagtgagctgtgatcacaccactgtactccagcctgggcaagagtgagaccctgtcaaaaaaaaaaaaaaaaaagaaacaaatattacaagagtttttgctgaaagttttaagttgataagatgcagagaattgggggaatgtataataaatcaggtttcattgttatattatttaccacatgaatcaccttcctcctaaccattataggagccatgtgttcacatgtcatgtggaccagtatttaactgtggaaaccgcgggtggcatggagaaggaggcagtgtccgtgactgtgctgctctccgcagccccctgcctgctgtcctgtttcctcggctcctcggtgtctggactggcgttctgggtttcccagcagaaaactaaagggccagagaggtgtaaaaacacacaccacttggcaggtgatttgaagatattaaagctagaaattggaactagaaaatcaaaagaattcaaggcatcttaacgtgacagttgaactcatttgattatacttaaaaaagttttcagtgatagtttttttagatgaaaattaacatgataaagaagtgacaggccaggtgtggtggttgacgcttttaacaccaacaatttgggaggccaagatgggaggatctcttgagcccaggaattcaagactagcctaggcaacaaggcaaaacccatcactaagn

SEQ ID NO: 315107 - DNA, 2183 bp, Homo sapiens
agctcggtactccatcaaccctaaatgtattatgaacactgtggtattgcctagagaagtcagtttatatttaggtgaaaaaagaagagtgcccaaatggtcattcacaatgaaatttatttattcaattagagacagtgtctcactctgtcatccaggctggagttgcagtgagccaagatggtgccattgcattccagcctgggcaacaagaacaagactccgtctcaaaaaaaatttttttttctgtttaccatcttgaattatctccaagtgagtaagtgtgtttgcatagttgaagctcggaatatgctgccctcttctgatggagtagcttatgttgctctcttgcagaagccggcaggagtgactctcggcatggaggacccatctcctagcacacgtgcccactgaagtggcaccaacagaagtttggcttgaactaaaggacattttattttttttactttagcacataatttgtatatttgaaaataatgtatattattttacctattagattctgatttgatatacaaaggactaagatattttcttcttgaagagacttttcgattagtcctcatatatttatctactaaaatagagtgtttaccatgaacagtgtgttgcttcagactattacaaagacaactggggcaggtactctaatataaaggacaggtggtgtttctaaataattggctgctatggttctgtaaaaaccagttaattctatttttcaaggtttttggcaaagcacatcaatgttagactagttgaagtggaattgtataattcaattcgataattgatctcatgggctttccctggaggaaaggttttttttgttgttttttttttaagaacttgaaacttgtaaactgagatgtctgtagcttttttgcccatctgtagtgtatgtgaagatttcaaaacctgagagcactttttctttgtttagaattatgagaaaggcactagatgactttaggatttgcatttttccctttattgcctcatttcttgtgacgccttgttggggagggaaatctgtttattttttcctacaaataaaaagctaagattctatatcgcacatgagcattaagttcttcattgccttgttaaggaaaatgagtaggcagactcagaatctgttatattgatttcagttacaatttaatctttacaattaaaagggcgaaagatgtagaattttagtttttgttgttgactcgaaataaccagttttcttgattagagtttaagcagatttaataccatgaccttgcttaaccgtttcttcttttttacttgcttgctgttcttttgggtcaaaggagcaggctaatgcaaagcttttggagactgctaagtgttaaaaagtgattaaacacacactctgctattttttcacttcttggaggtagaagtcgagtatgaggcagttattttttagagtgtggaattatagtctttccttgctcctagttattctgtatatctttactttgtaggtaaaaataaatgtttatttaaaacaatttttaaaattataaatttatttttatagccatatgtaggatataaagatttatatagattattttctcaagctacttaatgctttaattctagctactcatcatgaaatagtaaacagttttactgaaataaactctacagacagatgcagtatgaggagctattgaagtagaaaatgtatttcgctttgcacactgagttggttttagcagacaacctcaagtaggtttccataacagccattacctttgaaatctaccttctgtagtttattataaataggaaaatacatcctgattctgtagcaagtagattgtttgctctttgtctttaagaaatactaggagggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccggaaggcagagcttgcagtgagccgagatcccgccactgcactccagcctgggcgacagagcgagactccgtctcaaaaaaa

SEQ ID NO: 315108 - DNA, 1659 bp, Homo sapiens
ttcgtccactccgccaggtgcgcgtgcgcagcggccccgaccccgcctcagtcttccaggcggcggtgggtgtccgcttctctctgctcttcgactgcaccgcactcgcgcgtgaccctgactccccctagtcagctcagcggtgctgccatggcgtggcggcggcgcgaagccagcgtcggggctcgcggcgtgttggctctggcgttgctcgccctggccctgtgcgtgcccggggcccggggccgggctctcgagtggttctcggccgtggtaaacatcgagtacgtggacccgcagaccaacctgacggtgtggagcgtctcggagagtggccgcttcggcgacagctcgcccaaggagggcgcgcatggcctggtgggcgtcccgtgggcgcccggcggagacctcgagggctgcgcgcccgacacgcgcttcttcgtgcccgagcccggcggccgaggggccgcgccctgggtcgccctggtggctcgtgggggctgcaccttcaaggacaaggtgctggtggcggcgcggaggaacgcctcggccgtcgtcctctacaatgaggagcgctacgggaacatcaccttgcccatgtctcacgcgggaacaggaaatatagtggtcattatgattagctatccaaaaggaagagaaattttggagctggtgcaaaaaggaattccagtaacgatgaccataggggttggcacccggcatgtacaggagttcatcagcggtcagtctgtggtgtttgtggccattgccttcatcaccatgatgattatctcgttagcctggctaatattttactatatacagcgtttcctatatactggctctcagattggaagtcagagccatagaaaagaaactaagaaagttattggccagcttctacttcatactgtaaagcatggagaaaagggaattgatgttgatgctgaaaattgtgcagtgtgtattgaaaatttcaaagtaaaggatattattagaattctgccatgcaagcatatttttcatagaatatgcattgacccatggcttttggatcaccgaacatgtccaatgtgtaaacttgatgtcatcaaagccctaggatattggggagagcctggggatgtacaggagatgcctgctccagaatctcctcctggaagggatccagctgcaaatttgagtctagctttaccagatgatgacggaagtgatgagagcagtccaccatcagcctcccctgctgaatctgagccacagtgtgatcccagctttaaaggagatgcaggagaaaatacggcattgctaggtgagcggtgtgcaaattataaaacaatagaatgtggccaggagtggtggctcacacctgtaatctcagtgctttgggagtttaaggtgggaggattgctcgagtttgagctatcgaagagtaagtaaccagaaatttgagaacagcctgggcagcatggtgagaccccatctctacaaaaacttcacagattagccaggtatggtggcattctcctgtagtcccagctactcagaatgctgaggcaggagagtggcttgtgaccaagagttcaggctgcagtgagctatgatcctgtcactgtactccagcctgagcctgggtgacagagcaagaccctgtctctttaa

SEQ ID NO: 315109 - DNA, 2038 bp, Homo sapiens
  misc_feature (2038)..(2038): n is a, c, g, or t
attctcttgaacctgggaggcggaggttgcggtgagccgagatcgtgccattgcactccagcctgggcaacaagagcaaaactccatctcaaaaagaaaaaagaaagaaagaaatgctaggggaaaatgttttaactagtcattcttcccagtagctaatgaagctgacttttaaaaagaaggctgtgagctttgcagatgctgctgccgcccagggccccctgcttccagccatggtcaaccccaccatgtttttccacattgctgtcgatggcgagcccttgggctgtgtctccttcgaggtaaggggcctggaaagcaagaagtgactgctcatctaatccataaaactatgttaacagattggagctgtttgcagacaaggttccaaagacagcagaaaatttccatgctctgagcactggagaaaaaggatttggttataagggttcctgctttcacagaattattccagggtttacgtgtcagagtggtgacttcacacgccatacagcattggtggcaagtccatctgcagggagaaatttgatgacaagaacttcatcctgaagcatacgggtcctggcatcttgtccatggcaaatgctggacccagcgtgaacgtttcccagttttttatctgccctgccaagatgccaagacagagtggttggattgcaagcatgtggtctttggcaaggtgaaagatggcatgaatattgtggaggtcatggagcacttggggtccaagaatggcaagatcagcaatcagcaagaagatcaccattgctgactggacaactgcaataaatttgacgggtgtttctcttaaaaaaaaaaaaaatactgtgacagaccaaggtaaattgtttttgataattacagaagtgtgatttcttaatcagcagctgtcaaacatagtgttccttaatttaaaagcttgaacactaaattataaattggagaggttggaataattacggtcatatctctagaaacacaagtctttagtagcaaaaaagaaattagcaagagaagaaaactgttcagtactttgaaaggaaaaagttttcagtgatagtttttttagatgaaaattaacatgataaagaagtgacaggccaggtgtggtggttgacgcttttaacaccaacaatttgggaggccaagatgggaggatctcttgagcccaggaattcaagactagcctaggcaacaaggcaaaactcatctctactaaaaatttaaaaaattagccaggtgtggtggcatctgcctgtagtcccagctgcttgggaagctgaggtgggaggatcgcttgagcccaagaggttgaggctgcagtgagctgtgatcacaccactgtactccagcctgggcaagagtgagaccctgtcaaaaaaaaaaaaaaaaaagaaacaaatattacaagagtttttgctgaaagttttaagttgataagatgcagagaattgggggaatgtataataaatcaggtttcattgttatattatttaccacatgaatcaccttcctcctaaccattataggagccatgtgttcacatgtcatgtggaccagtatttaactgtggaaaccgcgggtggcatggagaaggaggcagtgtccgtgactgtgctgctctccgcagccccctgcctgctgtcctgtttcctcggctcctcggtgtctggactggcgttctgggtttcccagcagaaaactaaagggccagagaggtgtaaaaacacacaccacttggcaggtgatttgaagatattaaagctagaaattggaactagaaaatcaaaagaattcaaggcatcttaacgtgacagttgaactcatttgattatacttaaaaaagttttcagtgatagtttttttagatgaaaattaacatgataaagaagtgacaggccaggtgtggtggttgacgcttttaacaccaacaatttgggaggccaagatgggaggatctcttgagcccaggaattcaagactagcctaggcaacaaggcaaaacccatcactaagn

SEQ ID NO: 315110 - DNA, 2013 bp, Homo sapiens
ttcgtccactccgccaggtgcgcgtgcgcagcggccccgaccccgcctcagtcttccaggcggcggtgggtgtccgcttctctctgctcttcgactgcaccgcactcgcgcgtgaccctgactccccctagtcagctcagcggtgctgccatggcgtggcggcggcgcgaagccagcgtcggggctcgcggcgtgttggctctggcgttgctcgccctggccctgtgcgtgcccggggcccggggccgggctctcgagtggttctcggccgtggtaaacatcgagtacgtggacccgcagaccaacctgacggtgtggagcgtctcggagagtggccgcttcggcgacagctcgcccaaggagggcgcgcatggcctggtgggcgtcccgtgggcgcccggcggagacctcgagggctgcgcgcccgacacgcgcttcttcgtgcccgagcccggcggccgaggggccgcgccctgggtcgccctggtggctcgtgggggctgcaccttcaaggacaaggtgctggtggcggcgcggaggaacgcctcggccgtcgtcctctacaatgaggagcgctacgggaacatcaccttgcccatgtctcacgcgggaacaggaaatatagtggtcattatgattagctatccaaaaggaagagaaattttggagctggtgcaaaaaggaattccagtaacgatgaccataggggttggcacccggcatgtacaggagttcatcagcggtcagtctgtggtgtttgtggccattgccttcatcaccatgatgattatctcgttagcctggctaatattttactatatacagcgtttcctatatactggctctcagattggaagtcaggtaatgacggataactctgaattttgctttttaaaagataattcataaatatgccgcatatatattcctagaagttacatttgaccataatcttgattttcgcttatattatttaagtattcaacatgactttttggaagtaactttttaattggactatgttaaattttttgttttgtgggaaattagatacctttaagtctgggttaccttttgcacatttgtttcctgcaggaaccctcttagtcccttgccagacccaaaggagtgatgaatggaagggggggcctctctgtctccatcatggagccgtagtaaagccatttatctctctcagtgacagcaaagagaagggccgtcagagagccagtggcttcccaaggcaggccttttgagcgtccacttatttctgtcattgtggaaagttgactgttctgtcttgaggactaggaagaggcctttaccttttaggtacttgaatagatgagcatgtggtacccctatcctcagcttcttactttcttgacaatatttaagcataagaagtggttgcttcttcagacaaattaaaatcagtactcttggtgaaacacctcttaaagttacatatggctgttctgcatattaagatttgaatggcttttgttgttagggggcttttttatgaagttggtgcaaaagtaatcgcagttttgccattaaaagttattttcagtatagtcatttgactttgcctttcaaatgaaatgttttctgtatgcttatgtgtattatatttgtgacttttaagaaaaatagtgatttaatttaaatttttcaataactgtattaatattttcctacccaagagccatagaaaagaaactaagaaagttattggccagcttctacttcatactgtaaagcatggagaaaagggaattgatgttgatgctgaaaattgtgcagtgtgtattgaaaatttcaaagtaaaggatattattagaattctgccatgcaagtatgttctttttacatattgagatgttaaaaattacttgacaagttttaggtgtctgacaaaatagttatttgttttttatgataatgaagatcttgtaatttgtgatcatctcttctttttagaaaagcagcttggattttaaatataat

SEQ ID NO: 315111 - DNA, 1984 bp, Homo sapiens
  misc_feature (1984)..(1984): n is a, c, g, or t
attctcttgaacctgggaggcggaggttgcggtgagccgagatcgtgccattgcactccagcctgggcaacaagagcaaaactccatctcaaaaagaaaaaagaaagaaagaaatgctaggggaaaatgttttaactagtcattcttcccagtagctaatgaagctgacttttaaaaagaaggctgtgagctttgcagatgctgctgccgcccagggccccctgcttccagccatggtcaaccccaccatgtttttccacattgctgtcgatggcgagcccttgggctgtgtctccttcgaggtaaggggcctggaaagcaagaagtgactgctcatctaatccataaaactatgttaacagattggagctgtttgcagacaaggttccaaagacagcagaaaatttccatgctctgagcactggagagtgtcagagtggtgacttcacacgccatacagcattggtggcaagtccatctgcagggagaaatttgatgacaagaacttcatcctgaagcatacgggtcctggcatcttgtccatggcaaatgctggacccagcgtgaacgtttcccagttttttatctgccctgccaagatgccaagacagagtggttggattgcaagcatgtggtctttggcaaggtgaaagatggcatgaatattgtggaggtcatggagcacttggggtccaagaatggcaagatcagcaatcagcaagaagatcaccattgctgactggacaactgcaataaatttgacgggtgtttctcttaaaaaaaaaaaaaatactgtgacagaccaaggtaaattgtttttgataattacagaagtgtgatttcttaatcagcagctgtcaaacatagtgttccttaatttaaaagcttgaacactaaattataaattggagaggttggaataattacggtcatatctctagaaacacaagtctttagtagcaaaaaagaaattagcaagagaagaaaactgttcagtactttgaaaggaaaaagttttcagtgatagtttttttagatgaaaattaacatgataaagaagtgacaggccaggtgtggtggttgacgcttttaacaccaacaatttgggaggccaagatgggaggatctcttgagcccaggaattcaagactagcctaggcaacaaggcaaaactcatctctactaaaaatttaaaaaattagccaggtgtggtggcatctgcctgtagtcccagctgcttgggaagctgaggtgggaggatcgcttgagcccaagaggttgaggctgcagtgagctgtgatcacaccactgtactccagcctgggcaagagtgagaccctgtcaaaaaaaaaaaaaaaaaagaaacaaatattacaagagtttttgctgaaagttttaagttgataagatgcagagaattgggggaatgtataataaatcaggtttcattgttatattatttaccacatgaatcaccttcctcctaaccattataggagccatgtgttcacatgtcatgtggaccagtatttaactgtggaaaccgcgggtggcatggagaaggaggcagtgtccgtgactgtgctgctctccgcagccccctgcctgctgtcctgtttcctcggctcctcggtgtctggactggcgttctgggtttcccagcagaaaactaaagggccagagaggtgtaaaaacacacaccacttggcaggtgatttgaagatattaaagctagaaattggaactagaaaatcaaaagaattcaaggcatcttaacgtgacagttgaactcatttgattatacttaaaaaagttttcagtgatagtttttttagatgaaaattaacatgataaagaagtgacaggccaggtgtggtggttgacgcttttaacaccaacaatttgggaggccaagatgggaggatctcttgagcccaggaattcaagactagcctaggcaacaaggcaaaacccatcactaagn

SEQ ID NO: 315112 - DNA, 1302 bp, Homo sapiens
tacaacaacccaggtacttaagttttaaaagttttttttaaaacacttgtcaccatattttgaaaaatactaacatttggattactagttataaaagtgtaatttctactgtgtcataatcagccatgcagctggagacttgccctctttgtacagcaaagttgtgaaaaaaagtatttgcactacatttatttaaacattaggaaaaaaagccaacccatgcttttctttgccgagatgtagggctgtattattggctagtgagaagcctgggaacactaggactttgtgtgggctgattgcaggtatcagatccgggattatacaggtactgttggaagtatcttggggattttcctgataagaacagtagtgattgcataaaaaggacaggatgtaaagtgaaatcagtaaaatatcttagtagacagagggtgctgaaattttaacaaatgtgtaaaaagttcttcctatgcattaattttccagatacccttaaaatgtttaaggaatgtaattcaaaatactgtttaaaagagacatgtgaccatcattctcccagcgaatgtgaatcatttagtgtgctactcaaaattaggtgtaaatgtatatgtacactataagaataaaaatcgataccatttctttaaagctttctaaaataaacttaattatttctaatagttacattttaggctctcaaactatttttcttttgaaataactgctttctaccctaagatgttactcattgctgtcttctttttaacaggtgatttgaagatattaaagctagaaattggaactagaaaatcaaaagaattcaaggcatcttaacgtgacagttgaactcatttgattatacttaaaaaagtttattgcagttattgactctcaatttttttttttttttttgagtgcagtggtgccattgttgctcactgcagcctcaatcttccaggctcaagaaatcctcccacctcagcttccagagtagctgggactacaggtgcatgccacaccctgataatttttttttccccaatataaacgaggtcttgctatgtcctccagtctggtcttgaactcaagtgatccacccaccttggcctcccaaagtgctgggattacaggcgtgagccaccaaacccagccaccaattttactttaggtaaacttttattttcaagcttttgttggtgttgcaagtgtaaatctgttttataaaatgttctataaatataaccactattccttgtaagctatttaaaataaattttaaagtctttcaagtaaacacca

SEQ ID NO: 315113 - DNA, 333 bp, Homo sapiens
attgatgtgctttttgccagattcattgtacagaagtacgtaatattgtgtgtgaattacgagccagatgatacataagctttgatcatgttttaagctttgatcatgttttttcttctgttctaattctcaagggagagcctggggatgtacaggagatgcctgctccagaatctcctcctggaagggatccagctgcaaatttgagtctagctttaccagatgatgacggaagtgatgagagcagtccaccatcagcctcccctgctgaatctgagccacagtgtgatcccagctttaaaggagatgcaggagaaaatacggcattgctag

SEQ ID NO: 315114 - DNA, 731 bp, Homo sapiens
aacatggtgaaacctcatctctactaaaaatgcaaaaagtagctgaatgtggtggcgggtgcctgtaatcccagctacccaggaggctgaggcaggagaatcgcttgaacccgggaggctggagttgcagtgagccaagatggtgccattgcattccagcctgggcaacaagaacaagactccgtctcaaaaaaaatttttttttctgtttaccatcttgaattatctccaagtgagtaagtgtgtttgcatagttgaagctcggaatatgctgccctcttctgatggagtagcttatgttgctctcttgcagaagccggcaggagtgactctcggcatggaggacccatctcctagcacacgtgcccactgaagtggcaccaacagaagtttggcttgaactaaaggacattttattttttttactttagcacataatttgtatatttgaaaataatgtatattattttacctattagattctgatttgatatacaaaggactaagatattttcttcttgaagagacttttcgattagtcctcatatatttatctactaaaatagagtgtttaccatgaacagtgtgttgcttcagactattacaaagacaactggggcaggtactctaatataaaggacaggtggtgtttctaaataattggctgctatggttctgtaaaaaccagttaattctatttttcaaggtttttggcaaagcacatcaatgtt

SEQ ID NO: 315115 - DNA, 231 bp, Homo sapiens
agaacttgaaacttgtaaactgagatgtctgtagcttttttgcccatctgtagtgtatgtgaagatttcaaaacctgagagcactttttctttgtttagaattatgagaaaggcactagatgactttaggatttgcatttttccctttattgcctcatttcttgtgacgccttgttggggagggaaatctgtttattttttcctacaaataaaaagctaagattctatatc

SEQ ID NO: 315116 - DNA, 584 bp, Homo sapiens
  misc_feature (7)..(8): n is a, c, g, or t
  misc_feature (15)..(15): n is a, c, g, or t
gcggccnnctactantaaattcgcggccgctcgacggagagcctggggatgtacaggagatgcctgctccagaatctcctcctggaagggatccagctgcaaatttgagtctagctttaccagatgatgacggaagtgatgagagcagtccaccatcagcctcccctgctgaatctgagccacagtgtgatcccagctttaaaggagatgcaggagaaaatacggcattgctaggtgagcggtgtgcaaattataaaacaatagaatgtggccaggagtggtggctcacacctgtaatctcagtgctttgggagtttaaggtgggaggattgctcgagtttgagctatcgaagagtaagtaaccagaaatttgagaacagcctgggcagcatggtgagaccccatctctacaaaaacttcacagattagccaggtatggtggcattctcctgtagtcccagctactcagaatgctgaggcaggagagtggcttgtgaccaagagttcaggctgcagtgagctatgatcctgtcactgtactccagcctgagcctgggtgacagagcaagaccctgtctctttaa

SEQ ID NO: 315117 - DNA, 2051 bp, Homo sapiens
ttcgtccactccgccaggtgcgcgtgcgcagcggccccgaccccgcctcagtcttccaggcggcggtgggtgtccgcttctctctgctcttcgactgcaccgcactcgcgcgtgaccctgactccccctagtcagctcagcggtgctgccatggcgtggcggcggcgcgaagccagcgtcggggctcgcggcgtgttggctctggcgttgctcgccctggccctgtgcgtgcccggggcccggggccgggctctcgagtggttctcggccgtggtaaacatcgagtacgtggacccgcagaccaacctgacggtgtggagcgtctcggagagtggccgcttcggcgacagctcgcccaaggagggcgcgcatggcctggtgggcgtcccgtgggcgcccggcggagacctcgagggctgcgcgcccgacacgcgcttcttcgtgcccgagcccggcggccgaggggccgcgccctgggtcgccctggtggctcgtgggggctgcaccttcaaggacaaggtgctggtggcggcgcggaggaacgcctcggccgtcgtcctctacaatgaggagcgctacgggaacatcaccttgcccatgtctcacgcgggaacaggaaatatagtggtcattatgattagctatccaaaaggaagagaaattttggagctggtgcaaaaaggaattccagtaacgatgaccataggggttggcacccggcatgtacaggagttcatcagcggtcagtctgtggtgtttgtggccattgccttcatcaccatgatgattatctcgttagcctggctaatattttactatatacagcgtttcctatatactggctctcagattggaagtcagagccatagaaaagaaactaagaaagttattggccagcttctacttcatactgtaaagcatggagaaaagggaattgatgttgatgctgaaaattgtgcagtgtgtattgaaaatttcaaagtaaaggatattattagaattctgccatgcaagcatatttttcatagaatatgcattgacccatggcttttggatcaccgaacatgtccaatgtgtaaacttgatgtcatcaaagccctaggatattggggagagcctggggatgtacaggagatgcctgctccagaatctcctcctggaagggatccagctgcaaatttgagtctagctttaccagatgatgacggaagtgatgagagcagtccaccatcagcctcccctgctgaatctgagccacagtgtgatcccagctttaaaggagatgcaggagaaaatacggcattgctagaagccggcaggagtgactctcggcatggaggacccatctcctagcacacgtgcccactgaagtggcaccaacagaagtttggcttgaactaaaggacattttattttttttactttagcacataatttgtatatttgaaaataatgtatattattttacctattagattctgatttgatatacaaaggactaagatattttcttcttgaagagacttttcgattagtcctcatatatttatctactaaaatagagtgtttaccatgaacagtgtgttgcttcagactattacaaagacaactggggcaggtactctaatataaaggacaggtggtgtttctaaataattggctgctatggttctgtaaaaaccagttaattctatttttcaaggtttttggcaaagcacatcaatgttagactagttgaagtggaattgtataattcaattcgataattgatctcatgggctttccctggaggaaaggttttttttgttgttttttttttaagaacttgaaacttgtaaactgagatgtctgtagcttttttgcccatctgtagtgtatgtgaagatttcaaaacctgagagcactttttctttgtttagaattatgagaaaggcactagatgactttaggatttgcatttttccctttattgcctcatttcttgtgacgccttgttggggagggaaatctgtttattttttcctacaaataaaaagctaagattctatatc

SEQ ID NO: 315118 - DNA, 3986 bp, Homo sapiens
ttcgtccactccgccaggtgcgcgtgcgcagcggccccgaccccgcctcagtcttccaggcggcggtgggtgtccgcttctctctgctcttcgactgcaccgcactcgcgcgtgaccctgactccccctagtcagctcagcggtgctgccatggcgtggcggcggcgcgaagccagcgtcggggctcgcggcgtgttggctctggcgttgctcgccctggccctgtgcgtgcccggggcccggggccgggctctcgagtggttctcggccgtggtaaacatcgagtacgtggacccgcagaccaacctgacggtgtggagcgtctcggagagtggccgcttcggcgacagctcgcccaaggagggcgcgcatggcctggtgggcgtcccgtgggcgcccggcggagacctcgagggctgcgcgcccgacacgcgcttcttcgtgcccgagcccggcggccgaggggccgcgccctgggtcgccctggtggctcgtgggggctgcaccttcaaggacaaggtgctggtggcggcgcggaggaacgcctcggccgtcgtcctctacaatgaggagcgctacgggaacatcaccttgcccatgtctcacgcgggaacaggaaatatagtggtcattatgattagctatccaaaaggaagagaaattttggagctggtgcaaaaaggaattccagtaacgatgaccataggggttggcacccggcatgtacaggagttcatcagcggtcagtctgtggtgtttgtggccattgccttcatcaccatgatgattatctcgttagcctggctaatattttactatatacagcgtttcctatatactggctctcagattggaagtcaggtaatgacggataactctgaattttgctttttaaaagataattcataaatatgccgcatatatattcctagaagttacatttgaccataatcttgattttcgcttatattatttaagtattcaacatgactttttggaagtaactttttaattggactatgttaaattttttgttttgtgggaaattagatacctttaagtctgggttaccttttgcacatttgtttcctgcaggaaccctcttagtcccttgccagacccaaaggagtgatgaatggaagggggggcctctctgtctccatcatggagccgtagtaaagccatttatctctctcagtgacagcaaagagaagggccgtcagagagccagtggcttcccaaggcaggccttttgagcgtccacttatttctgtcattgtggaaagttgactgttctgtcttgaggactaggaagaggcctttaccttttaggtacttgaatagatgagcatgtggtacccctatcctcagcttcttactttcttgacaatatttaagcataagaagtggttgcttcttcagacaaattaaaatcagtactcttggtgaaacacctcttaaagttacatatggctgttctgcatattaagatttgaatggcttttgttgttagggggcttttttatgaagttggtgcaaaagtaatcgcagttttgccattaaaagttattttcagtatagtcatttgactttgcctttcaaatgaaatgttttctgtatgcttatgtgtattatatttgtgacttttaagaaaaatagtgatttaatttaaatttttcaataactgtattaatattttcctacccaagagccatagaaaagaaactaagaaagttattggccagcttctacttcatactgtaaagcatggagaaaagggaattgatgttgatgctgaaaattgtgcagtgtgtattgaaaatttcaaagtaaaggatattattagaattctgccatgcaagcatatttttcatagaatatgcattgacccatggcttttggatcaccgaacatgtccaatgtgtaaacttgatgtcatcaaagccctaggatattggggagagcctggggatgtacaggagatgcctgctccagaatctcctcctggaagggatccagctgcaaatttgagtctagctttaccagatgatgacggaagtgatgagagcagtccaccatcagcctcccctgctgaatctgagccacagtgtgatcccagctttaaaggagatgcaggagaaaatacggcattgctagaagccggcaggagtgactctcggcatggaggacccatctcctagcacacgtgcccactgaagtggcaccaacagaagtttggcttgaactaaaggacattttattttttttactttagcacataatttgtatatttgaaaataatgtatattattttacctattagattctgatttgatatacaaaggactaagatattttcttcttgaagagacttttcgattagtcctcatatatttatctactaaaatagagtgtttaccatgaacagtgtgttgcttcagactattacaaagacaactggggcaggtactctaatataaaggacaggtggtgtttctaaataattggctgctatggttctgtaaaaaccagttaattctatttttcaaggtttttggcaaagcacatcaatgttagactagttgaagtggaattgtataattcaattcgataattgatctcatgggctttccctggaggaaaggttttttttgttgttttttttttaagaacttgaaacttgtaaactgagatgtctgtagcttttttgcccatctgtagtgtatgtgaagatttcaaaacctgagagcactttttctttgtttagaattatgagaaaggcactagatgactttaggatttgcatttttccctttattgcctcatttcttgtgacgccttgttggggagggaaatctgtttattttttcctacaaataaaaagctaagattctatatcgcacatgagcattaagttcttcattgccttgttaaggaaaatgagtaggcagactcagaatctgttatattgatttcagttacaatttaatctttacaattaaaagggcgaaagatgtagaattttagtttttgttgttgactcgaaataaccagttttcttgattagagtttaagcagatttaataccatgaccttgcttaaccgtttcttcttttttacttgcttgctgttcttttgggtcaaaggagcaggctaatgcaaagcttttggagactgctaagtgttaaaaagtgattaaacacacactctgctattttttcacttcttggaggtagaagtcgagtatgaggcagttattttttagagtgtggaattatagtctttccttgctcctagttattctgtatatctttactttgtaggtaaaaataaatgtttatttaaaacaatttttaaaattataaatttatttttatagccatatgtaggatataaagatttatatagattattttctcaagctacttaatgctttaattctagctactcatcatgaaatagtaaacagttttactgaaataaactctacagacagatgcagtatgaggagctattgaagtagaaaatgtatttcgctttgcacactgagttggttttagcagacaacctcaagtaggtttccataacagccattacctttgaaatctaccttctgtagtttattataaataggaaaatacatcctgattctgtagcaagtagattgtttgctctttgtctttaagaaatactaggagggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccggaaggcagagcttgcagtgagccgagatcccgccactgcactccagcctgggcgacagagcgagactccgtctcaaaaaaa

SEQ ID NO: 315119 - DNA, 3185 bp, Homo sapiens
  misc_feature (3185)..(3185): n is a, c, g, or t
ttcgtccactccgccaggtgcgcgtgcgcagcggccccgaccccgcctcagtcttccaggcggcggtgggtgtccgcttctctctgctcttcgactgcaccgcactcgcgcgtgaccctgactccccctagtcagctcagcggtgctgccatggcgtggcggcggcgcgaagccagcgtcggggctcgcggcgtgttggctctggcgttgctcgccctggccctgtgcgtgcccggggcccggggccgggctctcgagtggttctcggccgtggtaaacatcgagtacgtggacccgcagaccaacctgacggtgtggagcgtctcggagagtggccgcttcggcgacagctcgcccaaggagggcgcgcatggcctggtgggcgtcccgtgggcgcccggcggagacctcgagggctgcgcgcccgacacgcgcttcttcgtgcccgagcccggcggccgaggggccgcgccctgggtcgccctggtggctcgtgggggctgcaccttcaaggacaaggtgctggtggcggcgcggaggaacgcctcggccgtcgtcctctacaatgaggagcgctacgggaacatcaccttgcccatgtctcacgcgggaacaggaaatatagtggtcattatgattagctatccaaaaggaagagaaattttggagctggtgcaaaaaggaattccagtaacgatgaccataggggttggcacccggcatgtacaggagttcatcagcggtcagtctgtggtgtttgtggccattgccttcatcaccatgatgattatctcgttagcctggctaatattttactatatacagcgtttcctatatactggctctcagattggaagtcagagccatagaaaagaaactaagaaagttattggccagcttctacttcatactgtaaagcatggagaaaagggaattgatgttgatgctgaaaattgtgcagtgtgtattgaaaatttcaaagtaaaggatattattagaattctgccatgcaagcatatttttcatagaatatgcattgacccatggcttttggatcaccgaacatgtccaatgtgtaaacttgatgtcatcaaagccctaggatattggggagagcctggggatgtacaggagatgcctgctccagaatctcctcctggaagggatccagctgcaaatttgagtctagctttaccagatgatgacggaagtgatgagagcagtccaccatcagcctcccctgctgaatctgagccacagtgtgatcccagctttaaaggagatgcaggagaaaatacggcattgctagagctgacttttaaaaagaaggctgtgagctttgcagatgctgctgccgcccagggccccctgcttccagccatggtcaaccccaccatgtttttccacattgctgtcgatggcgagcccttgggctgtgtctccttcgaggtaaggggcctggaaagcaagaagtgactgctcatctaatccataaaactatgttaacagattggagctgtttgcagacaaggttccaaagacagcagaaaatttccatgctctgagcactggagaaaaaggatttggttataagggttcctgctttcacagaattattccagggtttacgtgtcagagtggtgacttcacacgccatacagcattggtggcaagtccatctgcagggagaaatttgatgacaagaacttcatcctgaagcatacgggtcctggcatcttgtccatggcaaatgctggacccagcgtgaacgtttcccagttttttatctgccctgccaagatgccaagacagagtggttggattgcaagcatgtggtctttggcaaggtgaaagatggcatgaatattgtggaggtcatggagcacttggggtccaagaatggcaagatcagcaatcagcaagaagatcaccattgctgactggacaactgcaataaatttgacgggtgtttctcttaaaaaaaaaaaaaatactgtgacagaccaaggtaaattgtttttgataattacagaagtgtgatttcttaatcagcagctgtcaaacatagtgttccttaatttaaaagcttgaacactaaattataaattggagaggttggaataattacggtcatatctctagaaacacaagtctttagtagcaaaaaagaaattagcaagagaagaaaactgttcagtactttgaaaggaaaaagttttcagtgatagtttttttagatgaaaattaacatgataaagaagtgacaggccaggtgtggtggttgacgcttttaacaccaacaatttgggaggccaagatgggaggatctcttgagcccaggaattcaagactagcctaggcaacaaggcaaaactcatctctactaaaaatttaaaaaattagccaggtgtggtggcatctgcctgtagtcccagctgcttgggaagctgaggtgggaggatcgcttgagcccaagaggttgaggctgcagtgagctgtgatcacaccactgtactccagcctgggcaagagtgagaccctgtcaaaaaaaaaaaaaaaaaagaaacaaatattacaagagtttttgctgaaagttttaagttgataagatgcagagaattgggggaatgtataataaatcaggtttcattgttatattatttaccacatgaatcaccttcctcctaaccattataggagccatgtgttcacatgtcatgtggaccagtatttaactgtggaaaccgcgggtggcatggagaaggaggcagtgtccgtgactgtgctgctctccgcagccccctgcctgctgtcctgtttcctcggctcctcggtgtctggactggcgttctgggtttcccagcagaaaactaaagggccagagaggtgtaaaaacacacaccacttggcaggtgatttgaagatattaaagctagaaattggaactagaaaatcaaaagaattcaaggcatcttaacgtgacagttgaactcatttgattatacttaaaaaagttttcagtgatagtttttttagatgaaaattaacatgataaagaagtgacaggccaggtgtggtggttgacgcttttaacaccaacaatttgggaggccaagatgggaggatctcttgagcccaggaattcaagactagcctaggcaacaaggcaaaacccatcactaagn

SEQ ID NO: 315120 - DNA, 3456 bp, Homo sapiens
ttcgtccactccgccaggtgcgcgtgcgcagcggccccgaccccgcctcagtcttccaggcggcggtgggtgtccgcttctctctgctcttcgactgcaccgcactcgcgcgtgaccctgactccccctagtcagctcagcggtgctgccatggcgtggcggcggcgcgaagccagcgtcggggctcgcggcgtgttggctctggcgttgctcgccctggccctgtgcgtgcccggggcccggggccgggctctcgagtggttctcggccgtggtaaacatcgagtacgtggacccgcagaccaacctgacggtgtggagcgtctcggagagtggccgcttcggcgacagctcgcccaaggagggcgcgcatggcctggtgggcgtcccgtgggcgcccggcggagacctcgagggctgcgcgcccgacacgcgcttcttcgtgcccgagcccggcggccgaggggccgcgccctgggtcgccctggtggctcgtgggggctgcaccttcaaggacaaggtgctggtggcggcgcggaggaacgcctcggccgtcgtcctctacaatgaggagcgctacgggaacatcaccttgcccatgtctcacgcgggaacaggaaatatagtggtcattatgattagctatccaaaaggaagagaaattttggagctggtgcaaaaaggaattccagtaacgatgaccataggggttggcacccggcatgtacaggagttcatcagcggtcagtctgtggtgtttgtggccattgccttcatcaccatgatgattatctcgttagcctggctaatattttactatatacagcgtttcctatatactggctctcagattggaagtcagagccatagaaaagaaactaagaaagttattggccagcttctacttcatactgtaaagcatggagaaaagggaattgatgttgatgctgaaaattgtgcagtgtgtattgaaaatttcaaagtaaaggatattattagaattctgccatgcaagcatatttttcatagaatatgcattgacccatggcttttggatcaccgaacatgtccaatgtgtaaacttgatgtcatcaaagccctaggatattggggagagcctggggatgtacaggagatgcctgctccagaatctcctcctggaagggatccagctgcaaatttgagtctagctttaccagatgatgacggaagtgatgagagcagtccaccatcagcctcccctgctgaatctgagccacagtgtgatcccagctttaaaggagatgcaggagaaaatacggcattgctagagctgacttttaaaaagaaggctgtgagctttgcagatgctgctgccgcccagggccccctgcttccagccatggtcaaccccaccatgtttttccacattgctgtcgatggcgagcccttgggctgtgtctccttcgaggtaaggggcctggaaagcaagaagtgactgctcatctaatccataaaactatgttaacagattggagctgtttgcagacaaggttccaaagacagcagaaaatttccatgctctgagcactggagaaaaaggatttggttataagggttcctgctttcacagaattattccagggtttacgtgtcagagtggtgacttcacacgccatacagcattggtggcaagtccatctgcagggagaaatttgatgacaagaacttcatcctgaagcatacgggtcctggcatcttgtccatggcaaatgctggacccagcgtgaacgtttcccagttttttatctgccctgccaagatgccaagacagagtggttggattgcaagcatgtggtctttggcaaggtgaaagatggcatgaatattgtggaggtcatggagcacttggggtccaagaatggcaagatcagcaatcagcaagaagatcaccattgctgactggacaactgcaataaatttgacgggtgtttctcttaaaaaaaaaaaaaatactgtgacagaccaaggtaaattgtttttgataattacagaagtgtgatttcttaatcagcagctgtcaaacatagtgttccttaatttaaaagcttgaacactaaattataaattggagaggttggaataattacggtcatatctctagaaacacaagtctttagtagcaaaaaagaaattagcaagagaagaaaactgttcagtactttgaaaggaaaaagttttcagtgatagtttttttagatgaaaattaacatgataaagaagtgacaggccaggtgtggtggttgacgcttttaacaccaacaatttgggaggccaagatgggaggatctcttgagcccaggaattcaagactagcctaggcaacaaggcaaaactcatctctactaaaaatttaaaaaattagccaggtgtggtggcatctgcctgtagtcccagctgcttgggaagctgaggtgggaggatcgcttgagcccaagaggttgaggctgcagtgagctgtgatcacaccactgtactccagcctgggcaagagtgagaccctgtcaaaaaaaaaaaaaaaaaagaaacaaatattacaagagtttttgctgaaagttttaagttgataagatgcagagaattgggggaatgtataataaatcaggtttcattgttatattatttaccacatgaatcaccttcctcctaaccattataggagccatgtgttcacatgtcatgtggaccagtatttaactgtggaaaccgcgggtggcatggagaaggaggcagtgtccgtgactgtgctgctctccgcagccccctgcctgctgtcctgtttcctcggctcctcggtgtctggactggcgttctgggtttcccagcagaaaactaaagggccagagaggtgtaaaaacacacaccacttggcaggtaataatttccccgcatgctatctttttagggatcctgaacacacagcctttcccagaagactgctccctccagctactgaggaatgatgacaagaaaaggccgaattgcagtgtctccatcagcagtttgctctccatgggcacacgatgacaaaatatcctgaagcgaaccactagtctgacctcagtagcaggattggaagcttcatgccatgggagctgtcaagaaaggcatcccaaagagaactgaaatttaaaaataataatagaccttcaggaataggtgattgtccccatatactggggatgaaatacccaatgtaaccaaattccccagtaagatcacttagtttggcaatagtcttttcttttgagcatgttgaagtttatttgctcaatgaaggctgaaattataagtcagtatatatgtattactaagtagaacttgaggtaattatatgttttagtcaaaagcagtttctgtgggcttggtataaaccctactttgtgatttgctaaagcacaggatgttgactcaaacc

SEQ ID NO: 315121 - DNA, 2211 bp, Homo sapiens
ttcgtccactccgccaggtgcgcgtgcgcagcggccccgaccccgcctcagtcttccaggcggcggtgggtgtccgcttctctctgctcttcgactgcaccgcactcgcgcgtgaccctgactccccctagtcagctcagcggtgctgccatggcgtggcggcggcgcgaagccagcgtcggggctcgcggcgtgttggctctggcgttgctcgccctggccctgtgcgtgcccggggcccggggccgggctctcgagtggttctcggccgtggtaaacatcgagtacgtggacccgcagaccaacctgacggtgtggagcgtctcggagagtggccgcttcggcgacagctcgcccaaggagggcgcgcatggcctggtgggcgtcccgtgggcgcccggcggagacctcgagggctgcgcgcccgacacgcgcttcttcgtgcccgagcccggcggccgaggggccgcgccctgggtcgccctggtggctcgtgggggctgcaccttcaaggacaaggtgctggtggcggcgcggaggaacgcctcggccgtcgtcctctacaatgaggagcgctacgggaacatcaccttgcccatgtctcacgcgggaacaggaaatatagtggtcattatgattagctatccaaaaggaagagaaattttggagctggtgcaaaaaggaattccagtaacgatgaccataggggttggcacccggcatgtacaggagttcatcagcggtcagtctgtggtgtttgtggccattgccttcatcaccatgatgattatctcgttagcctggctaatattttactatatacagcgtttcctatatactggctctcagattggaagtcaggtaatgacggataactctgaattttgctttttaaaagataattcataaatatgccgcatatatattcctagaagttacatttgaccataatcttgattttcgcttatattatttaagtattcaacatgactttttggaagtaactttttaattggactatgttaaattttttgttttgtgggaaattagatacctttaagtctgggttaccttttgcacatttgtttcctgcaggaaccctcttagtcccttgccagacccaaaggagtgatgaatggaagggggggcctctctgtctccatcatggagccgtagtaaagccatttatctctctcagtgacagcaaagagaagggccgtcagagagccagtggcttcccaaggcaggccttttgagcgtccacttatttctgtcattgtggaaagttgactgttctgtcttgaggactaggaagaggcctttaccttttaggtacttgaatagatgagcatgtggtacccctatcctcagcttcttactttcttgacaatatttaagcataagaagtggttgcttcttcagacaaattaaaatcagtactcttggtgaaacacctcttaaagttacatatggctgttctgcatattaagatttgaatggcttttgttgttagggggcttttttatgaagttggtgcaaaagtaatcgcagttttgccattaaaagttattttcagtatagtcatttgactttgcctttcaaatgaaatgttttctgtatgcttatgtgtattatatttgtgacttttaagaaaaatagtgatttaatttaaatttttcaataactgtattaatattttcctacccaagagccatagaaaagaaactaagaaagttattggccagcttctacttcatactgtaaagcatggagaaaaggtaatattttcatggtttttcttttgttttgtggtttagagtagagaatatgctgtacgtgtttattttaaagaaggatgggcagaaatattttgtcattgagaagggccttctagacctgcattaatatggtagccactagtcgcatatagcaatttgcatttaaatgaatttaatttaaaattgagcccctcactggtgacacttcaagcactttgggagccacagtggctggttgctgccctcctggacagctcttacattcccagcagtgacgaaagtggtactggttagaaccagataactataaagacatacagtcttcacagacccttgatagcttcagttcatttctgttaaatctgagactatgtgtccactcccttggagtcctttagttacagggagaaaatgttggcatttctggaggggg

SEQ ID NO: 315122 - DNA, 230 bp, Homo sapiens
tgctcaaaattcatccctgtgtgacctcaagtaagccacataactttgtgatcctgcagtttcatcatatttaacaggaaaaaacttgacagattttcattctgccacagaatgtcaggtctcccagacaccagaaaatacattgacttaaaaagcctttgatacatctcaaagcagtatccctacgcagtatagttggaagatggtgggcgctgtagagagggatgctt

SEQ ID NO: 315123 - DNA, 3140 bp, Homo sapiens
ctatgtgctgggccctgtgttcactcccagaaatgcaaaggtcagcaattctcatggttaaggacctcacactcatgtaggagagacaggcctattatgatgaactataatgcaataagagccaaacatcctagagaaagtcactttgcttctctgagccaccttttctcaactctaaggtgtgagcagcgttgggtatatttagttatgatggtacttgtagatgctcacatttccagttccaaactcgcccgtactttttatgtgcttcaaaatattggacacatttctgcttaatatatgatttctgtatccacaaaccgctgtttgctatgctgagtcaatttagaagttaatttccaatctagtctcaactgcaatgcatttaaaataggtaaaacaagtaaatgagtttgggacattttgagattaatgttactgcccacttgactgtcaatttcaaatggctcctaatgcaaccaaaattataaccaatgtagcatgtgtaggaaaggtatttttaattatttaaaatcattgtgtatattacagcagtatgaggaatgcctggctaaagaggattttttaaaagatgaagaatggttttgcttgtattatataggcttactgagtttgtgagcagcataaaaacaatcattccttaattcttcattgtggaactgaaatatttctgtaatgcattttttaaaaggagactcctagacacagctgtaatagtgggaatagaaatgtagagcttttctcataacacaaaaccagaaaataattttcagcactttgacttactctatgtaataaggaaaaaaattgtttccacaaagttgaactatgtagtaatatttggtaacatatggcatggccactttatatcacagaatgtgtgtcaagttgcaaagcatacttgggccatagtagacactaagaattaaaactcttaaatcagtgaaacaaaaactaatgggcagcattctctctgtttggaatgggatcagtatacaattaatacaatttaattttacacattccctaagacaccatttttaagttacagtcacatgagtgtttgtataaatttaagtcaatgcttttagcctaggcaaagctaaatacaaggtttttggggttttcttttttcagctttattattgaagtattacaaacttaacatcagataccaatgtgtaaaaagtactattgggtccttaagggctctatcagggagttgaaatttcatacgctttaccaggttacttgtaaaaaatgaacagctgtaagacatttcaaaaccattgcagacacattgttaaaatgcagccatttgataatgaaagcagaaaccttaagttttacctaattattgcactaaatgtaaatgataacataaaattaagtgtgcattttaaacagattctatttcccacttactgcttagcatagaaaaagagctatggttagaggagtgaccagcaagatttatttcagatggaaaaggggtgagaaagtggaagcaccttactgttagagcatgttgcatctatttagtgctactgaacaattcagtagttatttctgaactttgctgcaaagtgctctttagttaaagcacattaagaagggtcactgcttaattgctttgtaaaatgaagcaatggtattttttatccgatatagtgtaatttaaaagttttcctacaaagtgagtttatattgttgcctaaactatgttatgtaagcaaagggtttggaaaggcgggagggagtctagattcggcgagagtgtgcgtttgtgtgtgtgaatgtatgaaaagtttccccattgggttattcttaagatgtgtttattgtaaagttttctacgttttgcccacagtaaatgtacaacttcgcaattgtaggatttaattgattgaattccaaatttatactgtctcttcccttctgcagagacattatgccactgtaaggtgcatgtacagaaaatacctctgaggttgacttgttaaataactgatgaatgttatttcacactgaatctcaaagcagtcatttgttttgcgggttaggggaaagttttgttttttgctggtgttttttgttgtttttaattaggcacactaagagtggctaaatttgggggaattggtggataggaaagaccttgaaaagtgatgtgtagatgaaaacacaaggtatggatgttggttacagagttcagttttaacaagggaaatttggggatttttttttttttacttgcatgttctatgggtagctatcaaagggtgtaacaaattattccagcttttcccaatactaattatattggttttaaaaagtctgcataatcactaggtggcattttcccttcatttgtgaaccaagaggggtaaatgatgctacccatacagtgacttctgagttctttaactttgacagaatctccattgtttcattgaatttctcattgtattatatgtctttccaagtgtgcaaactataatatgtagttaatgaaaaatggaaggctgcagattattttgcatgaataattaattgcccattagggctaaggagactgacatgatttttatcggttctgggtaaatgaaaattttaatggaaaactcattcaccatttactagctttgtgcaatattataaaaggtagaagcaaaacactagcacattgtgctttgcttggcttgtaaggatggctttagtaccattacattaaatggacagtgtgcacagtgtattgtaaatgccaactcttgcaaatttacaatacttaaatatgttcaattaacatcctaaagtattaaaagtacagaggaaaaactaagcaagcatttatagcaataccatgaaatctccagtaatcgttttgactgttgccttttgctctttagtgcagcttttctgcattgtaattgtattgctttgtatttcatgttttttacactcatgacttcagagttaagtacttgtacaccaagtattgcaatcacctttctcttgttgtacatgcaatgtaacaacctacagttttggtgcttttaacaatattcctctttttctttaataaaggatatttatttgaattaaaaaaaaactgattt

SEQ ID NO: 315124 - DNA, 2521 bp, Homo sapiens
gagtttgcggggtggtacagaagcgatagcacgattggatcagttagaagctgattattatgatctgcaacttcagttgtatgaagtacagtttgaaatcttgaagtgtgaagagttactattgacagcgcaactagaaagcatcaaaagacttatatcagaaaataattttcagcactttgacttactctatgtaataaggaaaaaaattgtttccacaaagttgaactatgtagtaatatttggtaacatatggcatggccactttatatcacagaatgtgtgtcaagttgcaaagcatacttgggccatagtagacactaagaattaaaactcttaaatcagtgaaacaaaaactaatgggcagcattctctctgtttggaatgggatcagtatacaattaatacaatttaattttacacattccctaagacaccatttttaagttacagtcacatgagtgtttgtataaatttaagtcaatgcttttagcctaggcaaagctaaatacaaggtttttggggttttcttttttcagctttattattgaagtattacaaacttaacatcagataccaatgtgtaaaaagtactattgggtccttaagggctctatcagggagttgaaatttcatacgctttaccaggttacttgtaaaaaatgaacagctgtaagacatttcaaaaccattgcagacacattgttaaaatgcagccatttgataatgaaagcagaaaccttaagttttacctaattattgcactaaatgtaaatgataacataaaattaagtgtgcattttaaacagattctatttcccacttactgcttagcatagaaaaagagctatggttagaggagtgaccagcaagatttatttcagatggaaaaggggtgagaaagtggaagcaccttactgttagagcatgttgcatctatttagtgctactgaacaattcagtagttatttctgaactttgctgcaaagtgctctttagttaaagcacattaagaagggtcactgcttaattgctttgtaaaatgaagcaatggtattttttatccgatatagtgtaatttaaaagttttcctacaaagtgagtttatattgttgcctaaactatgttatgtaagcaaagggtttggaaaggcgggagggagtctagattcggcgagagtgtgcgtttgtgtgtgtgaatgtatgaaaagtttccccattgggttattcttaagatgtgtttattgtaaagttttctacgttttgcccacagtaaatgtacaacttcgcaattgtaggatttaattgattgaattccaaatttatactgtctcttcccttctgcagagacattatgccactgtaaggtgcatgtacagaaaatacctctgaggttgacttgttaaataactgatgaatgttatttcacactgaatctcaaagcagtcatttgttttgcgggttaggggaaagttttgttttttgctggtgttttttgttgtttttaattaggcacactaagagtggctaaatttgggggaattggtggataggaaagaccttgaaaagtgatgtgtagatgaaaacacaaggtatggatgttggttacagagttcagttttaacaagggaaatttggggatttttttttttttacttgcatgttctatgggtagctatcaaagggtgtaacaaattattccagcttttcccaatactaattatattggttttaaaaagtctgcataatcactaggtggcattttcccttcatttgtgaaccaagaggggtaaatgatgctacccatacagtgacttctgagttctttaactttgacagaatctccattgtttcattgaatttctcattgtattatatgtctttccaagtgtgcaaactataatatgtagttaatgaaaaatggaaggctgcagattattttgcatgaataattaattgcccattagggctaaggagactgacatgatttttatcggttctgggtaaatgaaaattttaatggaaaactcattcaccatttactagctttgtgcaatattataaaaggtagaagcaaaacactagcacattgtgctttgcttggcttgtaaggatggctttagtaccattacattaaatggacagtgtgcacagtgtattgtaaatgccaactcttgcaaatttacaatacttaaatatgttcaattaacatcctaaagtattaaaagtacagaggaaaaactaagcaagcatttatagcaataccatgaaatctccagtaatcgttttgactgttgccttttgctctttagtgcagcttttctgcattgtaattgtattgctttgtatttcatgttttttacactcatgacttcagagttaagtacttgtacaccaagtattgcaatcacctttctcttgttgtacatgcaatgtaacaacctacagttttggtgcttttaacaatattcctctttttctttaataaaggatatttatttgaattaaaaaaaaactgattt

SEQ ID NO: 315125 - DNA, 3087 bp, Homo sapiens
ctatgtgctgggccctgtgttcactcccagaaatgcaaaggtcagcaattctcatggttaaggacctcacactcatgtaggagagacaggcctattatgatgaactataatgcaataagagccaaacatcctagagaaagtcactttgcttctctgagccaccttttctcaactctaaggtgtgagcagcgttgggtatatttagttatgatggtacttgtagatgctcacatttccagttccaaactcgcccgtactttttatgtgcttcaaaatattggacacatttctgcttaatatatgatttctgtatccacaaaccgctgtttgctatgctgagtcaatttagaagttaatttccaatctagtctcaactgcaatgcatttaaaataggtaaaacaagtaaatgagtttgggacattttgagattaatgttactgcccacttgactgtcaatttcaaatggctcctaatgcaaccaaaattataaccaatgtagcatgtgtaggaaaggtatttttaattatttaaaatcattgtgtatattacagcagtatgaggaatgcctggctaaagaggattttttaaaagatgaagaatggttttgcttgtattatataggcttactgagtttgtgagcagcataaaaacaatcattccttaattcttcattgtggaactgaaatatttctgtaatgcattttttaaaaggagactcctagacacagctgtaatagtgggaatagaaatgtagagcttttctcataacacaaaaccagaaaataattttcagcactttgacttactctatgtaataaggaaaaaaattgtttccacaaagttgaactatgtagtaatatttggtaacatatggcatggccactttatatcacagaatgtgtgtcaagttgcaaagcatacttgggccatagtagacactaagaattaaaactcttaaatcagtgaaacaaaaactaatgggcagcattctctctgtttggaatgggatcagtatacaattaatacaatttaattttacacattccctaagacaccatttttaagttacagtcacatgagtgtttgtataaatttaagtcaatgcttttagcctaggcaaagctaaatacaaggtttttggggttttcttttttcagctttattattgaagtattacaaacttaacatcagataccaatgtgtaaaaagtactattgggtccttaagggctctatcagggagttgaaatttcatacgctttaccaggttacttgtaaaaaatgaacagctgtaagacatttcaaaaccattgcagacacattgttaaaatgcagccatttgataatgaaagcagaaaccttaagttttacctaattattgcactaaatgtaaatgataacataaaattaagtgtgcattttaaacagattctatttcccacttactgcttagcatagaaaaagagctatggttagaggagtgaccagcaagatttatttcagatggaaaaggggtgagaaagtggaagcaccttactgttagagcatgttgcatctatttagtgctactgaacaattcagtagttatttctgaactttgctgcaaagtgctctttagttaaagcacattaagaagggtcactgcttaattgctttgtaaaatgaagcaatggtattttttatccgatatagtgtaatttaaaagttttcctacaaagtgagtttatattgttgcctaaactatgttatgtaagcaaagggtttggaaaggcgggagggagtctagattcggcgagagtgtgcgtttgtgtgtgtgaatgtatgagttttgcccacagtaaatgtacaacttcgcaattgtaggatttaattgattgaattccaaatttatactgtctcttcccttctgcagagacattatgccactgtaaggtgcatgtacagaaaatacctctgaggttgacttgttaaataactgatgaatgttatttcacactgaatctcaaagcagtcatttgttttgcgggttaggggaaagttttgttttttgctggtgttttttgttgtttttaattaggcacactaagagtggctaaatttgggggaattggtggataggaaagaccttgaaaagtgatgtgtagatgaaaacacaaggtatggatgttggttacagagttcagttttaacaagggaaatttggggatttttttttttttacttgcatgttctatgggtagctatcaaagggtgtaacaaattattccagcttttcccaatactaattatattggttttaaaaagtctgcataatcactaggtggcattttcccttcatttgtgaaccaagaggggtaaatgatgctacccatacagtgacttctgagttctttaactttgacagaatctccattgtttcattgaatttctcattgtattatatgtctttccaagtgtgcaaactataatatgtagttaatgaaaaatggaaggctgcagattattttgcatgaataattaattgcccattagggctaaggagactgacatgatttttatcggttctgggtaaatgaaaattttaatggaaaactcattcaccatttactagctttgtgcaatattataaaaggtagaagcaaaacactagcacattgtgctttgcttggcttgtaaggatggctttagtaccattacattaaatggacagtgtgcacagtgtattgtaaatgccaactcttgcaaatttacaatacttaaatatgttcaattaacatcctaaagtattaaaagtacagaggaaaaactaagcaagcatttatagcaataccatgaaatctccagtaatcgttttgactgttgccttttgctctttagtgcagcttttctgcattgtaattgtattgctttgtatttcatgttttttacactcatgacttcagagttaagtacttgtacaccaagtattgcaatcacctttctcttgttgtacatgcaatgtaacaacctacagttttggtgcttttaacaatattcctctttttctttaataaaggatatttatttgaattaaaaaaaaactgattt

SEQ ID NO: 315126 - DNA, 1225 bp, Homo sapiens
  misc_feature (1129)..(1129): n is a, c, g, or t
  misc_feature (1141)..(1141): n is a, c, g, or t
  misc_feature (1159)..(1159): n is a, c, g, or t
  misc_feature (1199)..(1199): n is a, c, g, or t
  misc_feature (1207)..(1207): n is a, c, g, or t
  misc_feature (1224)..(1224): n is a, c, g, or t
ctatgtgctgggccctgtgttcactcccagaaatgcaaaggtcagcaattctcatggttaaggacctcacactcatgtaggagagacaggcctattatgatgaactataatgcaataagagccaaacatcctagagaaagtcactttgcttctctgagccaccttttctcaactctaaggtgtgagcagcgttgggtatatttagttatgatggtacttgtagatgctcacatttccagttccaaactcgcccgtactttttatgtgcttcaaaatattggacacatttctgcttaatatatgatttctgtatccacaaaccgctgtttgctatgctgagtcaatttagaagttaatttccaatctagtctcaactgcaatgcatttaaaataggtaaaacaagtaaatgagtttgggacattttgagattaatgttactgcccacttgactgtcaatttcaaatggctcctaatgcaaccaaaattataaccaatgtagcatgtgtaggaaaggtatttttaattatttaaaatcattgtgtatattacagcagtatgaggaatgcctggctaaagaggattttttaaaagatgaagaatggttttgcttgtattatataggcttactgagtttgtgagcagcataaaaacaatcattccttaattcttcattgtggaactgaaatatttctgtaatgcattttttaaaaggagactcctagacacagctgtaatagtgggaatagaaatgtagagcttttctcataacacaaaaccagaaaataattttcagcactttgacttactctatgtaataaggaaaaaaattgtttccacaaagttgaactatgtagtaatatttggtaacatatggcatggccactttatatcacagaatgtgtgtcaagttgcaaagcatacttgggccatagtagacactaagaattaaaactcttaaatcagtgaaacaaaaactaatgggcagcattctctctgtttggaatgggatcagtatacaattaatacaatttaattttacacattccctaagacaccatttttaagttacagtcacatgagtgtttgtataaatttaagtcaatgcttttagccctaaggccaaaagcnttaaataccaangggtttttttgggggggnttttctttttttttcaaaccttttttttttttcgaaagtnttttaccnaaacctttaaccttccng

SEQ ID NO: 315127 - DNA, 350 bp, Homo sapiens
gagtttgcggggtggtacagaagcgatagcacgattggatcagttagaagctgattattatgatctgcaacttcagttgtatgaagtacagtttgaaatcttgaagtgtgaagagttactattgacagcgcaactagaaagcatcaaaagacttatatcagaaaaaagagatgaagtggtatactatgacacttacgaaagcatggaggccatgctggagaaggaagagatggcagcatctgcgtacttacagagagaagagctgcagaaacttcagcagaaagcacgccagctggaagcaagacgtggacgggtttctgccaagaaatcctacctcagaaataaaaagg

SEQ ID NO: 315128 - DNA, 1772 bp, Homo sapiens
attttgacctttttcgcaacgggtttgccgccagaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaatgttaaggaagtcagcacttacattaagaaaatggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgcctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgagaaaaaaaaaaaaaaaaacaaaa

SEQ ID NO: 315129 - DNA, 1726 bp, Homo sapiens
attttgacctttttcgcaacgggtttgccgccagaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactaagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaatgttaaggaagtcagcacttacattaagaaaatggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgcctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgagaaaaaaaaaaaaaaaaacaaaa

SEQ ID NO: 315130 - DNA, 1074 bp, Homo sapiens
attttgacctttttcgcaacgggtttgccgccagaacacaggtgtcgtgaaaactacccctaaaagccaaaatgggaaaggaaaagactcatatcaacattgtcgtcattggacacgtagattcggtgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgagaaaaaaaaaaaaaaaaacaaaa

SEQ ID NO: 315131 - DNA, 1284 bp, Homo sapiens
attttgacctttttcgcaacgggtttgccgccagaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgagaaaaaaaaaaaaaaaaacaaaa

SEQ ID NO: 315132 - DNA, 2690 bp, Homo sapiens
cggacgcgtgggtcgcccacgcgtcgccagaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaatgttaaggaagtcagcacttacattaagaaaatggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgcctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgagaaaaaaaaaaaaaaaaacaaaaaaaaaaaaaaaaaaaaaaaaacaaaaaataaaaaaaaaaaacaaaaaaaaaaacaaaaaaacaaaaaaaaacaaaaaaaacaaaaaaacaaaacaacaaacaccagagcgagggggggggcggaggccgccccagaacgacactcactccggggacggacgcacgacaccgacggcagcccgactgtacgtgagcatggggcggcgccgccagaaaggaaggagacattacagagagacgggacggggacgtgacacaaacaacaaaacaacagagcaatgggcagggagacagaaaccaacgacgacacaggtaccaaacactacatagaaagacacaccacaacacaacagcgtggggggcggaagaaaaacaaaggacgccacaaccacaccacaggaagaaacataggcaaacaaaggaaggacaaaaaacaaaaaaaacagagagcaggactgtagggcaacacaaccagagagaaacaacggaggacagaacgaaaaagccaccagccggcaagccaacaacaataaaaaacaacacacacacagcgggaagggcggaataaaagccagcaaagacccgcaacaacgtgacgatggctaaggagaacgcagaaacaaagaagcccagcaagaggaagaggaaggagggacagcgaagagcaaaaggaaagaagaaagaagaaacagacgacggtaagaacaagagagcgagcagacaagagcagcgagaggagcgagaaggcgagagagaaaagaacagagcgggcgcggagagcggcacgcggagcgagaaagggggagggaggcggaggggagagaaaaaggcagagagaggcgagagaggcgagaagacaagaggcgacgaggaagagagggagataggcagaacaaacaaagccggagaaggagaaacagag

SEQ ID NO: 315133 - DNA, 1768 bp, Homo sapiens
cggacgcgtgggtcgcccacgcgtcgccagaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaatgttaaggaagtcagcacttacattaagaaaatggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgcctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgagaaaaaaaaaaaaaaaaacaaaa

SEQ ID NO: 315134 - DNA, 1528 bp, Homo sapiens
attttgacctttttcgcaacgggtttgccgccagaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgagaaaaaaaaaaaaaaaaacaaaa

SEQ ID NO: 315135 - DNA, 1189 bp, Homo sapiens
cggacgcgtgggtcgcccacgcgtaaaatggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgcctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgagaaaaaaaaaaaaaaaaacaaaa

SEQ ID NO: 315136 - DNA, 2655 bp, Homo sapiens
cggacgcgtgggtcgcccacgcgtcgccagaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaatgttaaggaagtcagcacttacattaagaaaatggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgcctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgagaaaaaaaaaaaaaaaaacaaaaaaaaaacaaaaaaaaaaacaaaaaaacaaaaaaaaacaaaaaaaacaaaaaaacaaaacaacaaacaccagagcgagggggggggcggaggccgccccagaacgacactcactccggggacggacgcacgacaccgacggcagcccgactgtacgtgagcatggggcggcgccgccagaaaggaaggagacattacagagagacgggacggggacgtgacacaaacaacaaaacaacagagcaatgggcagggagacagaaaccaacgacgacacaggtaccaaacactacatagaaagacacaccacaacacaacagcgtggggggcggaagaaaaacaaaggacgccacaaccacaccacaggaagaaacataggcaaacaaaggaaggacaaaaaacaaaaaaaacagagagcaggactgtagggcaacacaaccagagagaaacaacggaggacagaacgaaaaagccaccagccggcaagccaacaacaataaaaaacaacacacacacagcgggaagggcggaataaaagccagcaaagacccgcaacaacgtgacgatggctaaggagaacgcagaaacaaagaagcccagcaagaggaagaggaaggagggacagcgaagagcaaaaggaaagaagaaagaagaaacagacgacggtaagaacaagagagcgagcagacaagagcagcgagaggagcgagaaggcgagagagaaaagaacagagcgggcgcggagagcggcacgcggagcgagaaagggggagggaggcggaggggagagaaaaaggcagagagaggcgagagaggcgagaagacaagaggcgacgaggaagagagggagataggcagaacaaacaaagccggagaaggagaaacagag

SEQ ID NO: 315137 - DNA, 2428 bp, Homo sapiens
cggacgcgtgggtcgcccacgcgtcgccagaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaatgttaaggaagtcagcacttacattaagaaaatggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgcctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgagtggaccactttggttttcttttttgcgtgtggcagttttaagttattagtttttaaaatcagtactttttaatggaaacaacttgaccaaaaatttgtcacagaattttgagacccattaaaaaagttaaatgagaaaaaaaaaaaaaaaaacaaaaaaaaaaaaaaaaaaaaaaaaacaaaaaataaaaaaaaaaaacaaaaaaaaaaacaaaaaaacaaaaaaaaacaaaaaaaacaaaaaaacaaaacaacaaacaccagagcgagggggggggcggaggccgccccagaacgacactcactccggggacggacgcacgacaccgacggcagcccgactgtacgtgagcatggggcggcgccgccagaaaggaaggagacattacagagagacgggacggggacgtgacacaaacaacaaaacaacagagcaatgggcagggagacagaaaccaacgacgacacaggtaccaaacactacatagaaagacacaccacaacacaacagcgtggggggcggaagaaaaacaaaggacgccacaaccacaccacaggaagaaacataggcaaacaaaggaaggacaaaaaacaaaaaaaacagagagcaggactgtagggcaacacaaccagagagaaacaacggaggacagaacgaaaaagccaccagccggcaagccaacaacaataaaaaacaacacacacacagcgggaagggcggaataaaagccagcaaagacccgcaacaacgtgacgatggctaaggagaacgcagaaacaaagaagcccagcaagaggaagaggaaggagggacagcgaagagcaaaaggaaagaagaaagaagaaacagacgacggtaagaacaagagagcgagcagacaagagcagcgagaggagcgagaaggcgagagagaaaagaacagagcgggcgcggagagcggcacgcggagcgagaaagggggagggaggcggaggggagagaaaaaggcagagagaggcgagagaggcgagaagacaagaggcgacgaggaagagagggagataggcagaacaaacaaagccggagaaggagaaacagag

SEQ ID NO: 315138 - DNA, 5557 bp, Homo sapiens
tagcggcacccgaggccacgccccgagatcggaagtgacggagacgtgctagcgcgtcgaaggtagctctatggttttcctcgcgttcttgagtcgggaaatggccgctgtgtggttgcaacggagataaattcccggaaccgcgattcggcgtgtcaggaattcgaatttagagtttaatttctcagagcattctctccaggaagaatttttacagtatctcaaagacttcacttgacttcttgatcctgcataaaaccaaggagaaaagaaatgggtcgctccaattctagatcacattcttcaaggtcaaagtctagatcacagtctagttctcgatcaagatcaagatctcattctagaaagaagcgatacagttctaggtctcgttccagaacatattcaaggtctcgtagtagagatcgtatgtattctagagattatcgtcgcgattacagaaataatagaggaatgagacgaccttatgggtacagaggaaggggtagagggtattatcaaggaggaggaggtagatatcatcgaggtggttatagacctgtctggaatagaaggcactctaggagtcctagacgaggtcgttcacgttccaggagtccaaaaagaagatccgtttcttctcaaagatccagaagcagatctcgccggtcatatagatcttctaggtctccaagatcatcctcttctcgttcttcatccccatatagcaaatctcctgtttctaaaagacgagggtctcaggaaaaacaaaccaaaaaagctgaaggggaaccccaagaagagagtccgttgaaaagtaaatcacaggaggaaccgaaagatacatttgaacatgacccatctgagtctatcgatgaatttaataagtcatcagccacatccggtgatatttggcctggcctttcagcttatgataatagtcctagatcaccccatagtccttcacctattgctacaccacctagtcagagttcatcttgctctgatgctcccatgctcagtacagttcactctgcaaaaaatactccttctcagcattcacattccattcagcatagtcctgaaaggtctgggtctggttctgttggaaatggatctagtcgatacagtccttctcagaatagtccaattcatcacatcccttcacgaagaagtcctgcaaagacaatcgcaccacagaatgctccaagagatgagtctaggggccgttcctcgttttatcctgatggtggagatcaggaaactgcaaagactgggaagttcttaaaaaggttcacagatgaagagtctagagtattcctgcttgataggggtaataccagggataaagaggcttcaaaagagaaaggatcagagaaagggagggcagagggagaatgggaagatcaggaagctctagattacttcagtgataaagagtctggaaaacaaaagtttaatgattcagaaggggatgacacagaggagacagaggattatagacagttcaggaagtcagtcctcgcagatcagggtaaaagttttgctactgcatctcaccggaatactgaggaggaaggactcaagtacaagtccaaagtttcactgaaaggcaatagagaaagtgatggatttagagaagaaaaaaattataaacttaaagagactggatatgtagtggaaaggcctagcactacaaaagataagcacaaagaagaagacaaaaattctgaaagaataacagtaaagaaagaaactcagtcacctgagcaggtaaagtctgaaaagctcaaagacctctttgattacagtccccctctacacaagaatctggatgcacgagaaaagtctaccttcagagaggaaagcccacttaggatcaaaatgatagcgagtgattctcaccgtcctgaagtcaaactcaaaatggcacctgttcctcttgatgattctaacagacctgcttccttgactaaagacaggctgcttgctagtacacttgtccattctgtcaagaaggagcaagaattccgatccatctttgaccacattaagttgccacaggccagcaaaagcacttcagagtcatttattcaacacattgtgtccttggttcatcatgttaaagagcaatacttcaagtcagctgcaatgaccctaaacgagcggttcacttcgtatcagaaagccactgaagaacatagtactcggcaaaagagccctgaaatacacaggagaattgacatctcaccaagtaccctgaggaagcatacccgtttagcaggggaagagagagtttttaaagaagaaaatcaaaagggagataaaaaattaaggtgtgactctgctgaccttcggcatgacattgatcgccgtagaaaagaaagaagtaaagaacggggagattccaagggctccagggaatccagtggatcaagaaagcaggaaaaaactccaaaagattacaaggaatacaaatcttacaaagatgacagtaaacataaaagagagcaagatcattctcgatcttcatcctcttcagcatcaccttcttctcccagttctcgagaagaaaaggagagtaagaaggaaagagaagaagaatttaaaactcaccatgaaatgaaagaatactcaggctttgcaggagttagccgaccacgaggaaccttttttcgaattagaggcagaggaagagccagaggagtttttgctgggacaaatactggtccaaacaactcaaatactacttttcaaaagagaccgaaggaagaggaatgggatccagaatataccccaaagagcaagaagtacttcttgcatgacgacagagatgatggtgtggattattgggccaaaagaggaagaggtcgtggtacttttcaacgtggcagagggcgctttaacttcaaaaaatcaggtagcagtcctaaatggactcatgacaaataccaaggggatgggattgttgaagatgaagaagagaccatggaaaataatgaagaaaagaaggacagacgcaaggaagaaaaggaataataaatatgaagtaagattacaacagagcagaacttgcacccaccattttttttacctgatttttgttttcaaataagaatgtaagcattttacttaaattttactgtttgcaagtagtctatagaaattttgttttaagtcttcaaatatcttgagaaatagtagactgtatgttgaaaattgtactgaaataaagtagaaaattgttacgtaccatatttgtaactatcaacttttaaaacttttaacgtttttgttacatgcattgtaattctgctttgtctataagatatggtcaagtacagctctgtgaaagttctgattctcttccttccctgtttgtcaatgttttattctgaagtaaacgttagctctacatataaatcctggaacagaaattgtttatagagactacactaattattttaactgtatacatctgtttaatttgaacacactacatcgtagggtgactgatttttgaagtataccacagacaaaaagttgttactatggtaaactaagctagtttaacacttgagcaaatgcttaagaaggaattaaaaaaaaaaagctttgccaatagctaaaaagtacaagctattaaaaatcagattgaaaagttttgagaaaatgttatttttactgaaagcaagcagtggcctataaagaacattcttaggagccttttctatttgcgttcaaaactgtgtgttctctttctattcctatttgatagtttgagtcatggtcttagatattagctatttgtgagaggaaactggtttgtaacaatactgcaaatagaaaccccatttctactgaacatcctagttttaaacagaagaaaaactgtaatcctggggttggtatgtaggaggtctatcctgcagaataagttgatacattagtacctgatttcatatcttacatatttatttgagctgaacattagtttgtagtgtaactattagtaaaaatagagaaacacagcatactgttcattaatagtattttaaaaaaattgtttttcaaatgtcaccaataaaagttttggcaggaagcttgttgcggcattgatctaacctttttcccccccatttcagttgcagtttttgtagaatggctttttctttttcctcttaagagttctattcttcaggtagataatttttcaaatgtgaattatcttttgtgtctatattgatagctcttaaaggagtgaaaatctaaaatagtaaatttcaatgttaagtgtctgctttatgggcatatataaaagtagacacatttcatttgttaatttagttgtgtgtgtgtgttaaaaggagctaatgcttattctgttaatgtaaacttttgaagatcttaagtgtattgctctttcatcttaaacactttcgaggatttgcagtgcgtctagcacctagattacagccaggaacattggttaagaactgttggaaacaaaactaaaagcaaactcaacatatgtgatgtttatggccctcagatccttagtattgtgtgattttcccccgttaacatgtctttctaaaattgtctattaaagcagaggaaatacctgccaaaggaagtatgtattgcattaatcagggcataactaatattctcctgttcagaataatacttatttacgtgtgaaagcaacatggatgtgattcccaacacagaattttcatgacccttttattgtatacaaataaataccataacagttacttggttagacatcaaatctgtgtgcatgactatgtgcttatccacttaagacaataggtaaaaggggatctgagaaattatgtaatagggagtgggaataaaactacttaattcctgtgggcaggttatattttaagttcaaatgcattgctttaacctttggttacttttattctgttaaacagaattgaagaaagagtattataccagagtgtagtaggctagggtgattgtaagaactctgtaatagaatgtcattgtggatgttacctttttcagatccaagcatataaaaagcctgtatattttttaaaaacacatcttaactccacgctttacgatattataaaagttgaatggttcctcttggtaaggatatttgcttacaagtgctaggaaataactcactgatacctgcgttaacatactttgttttgcctagagaggggcaataaaaatgaaccaaaggatatttccagaaaggattaagaaagctgtttaagaaggccatgactctttaggtgtgtatgtgtacctttcagcatcctaggaatttttatactaaaagcaaaatgttttttccagttagtcttcttcaaggaattactattgttccttttgtcacaggtaaaatcagtgttgggaattataatttgagaaaaatattacccagtaacattgaatgtagatggctaaacgattcttactcagtgtgatgtataatgatgcaacagggacccttgtaaattgtcatacgccaataaaatgtcacaagtaa

SEQ ID NO: 315139 - DNA, 1083 bp, Homo sapiens
  misc_feature (318)..(318): n is a, c, g, or t
  misc_feature (326)..(329): n is a, c, g, or t
  misc_feature (331)..(331): n is a, c, g, or t
  misc_feature (341)..(341): n is a, c, g, or t
  misc_feature (440)..(440): n is a, c, g, or t
  misc_feature (463)..(463): n is a, c, g, or t
  misc_feature (492)..(492): n is a, c, g, or t
cctcgtttcttcaagtctgttaccgaaattatcgttcccaaggttaaaccaatgcattttgaaccttataaatatcaccctggccccacagtaattaaatagtgtttatgtcccactcccttataacataattttctccagatcccccttttaccctagttgtcttaagtgggataatccacatagtcatgcacacagaatgtggatgtcttctcccaagtaactgttatggttatttcatttgtatcacaataaaaggtcatcaaaattctgtgttgggaatcacatccacgttgctttcacacgctaaataagtantattctgnnnngnagaatattanttatgccctgattaatgcatacatacttcctttggcaggtatttcctctgctttaatagacaattttagaaagacatgttaacgggggaaaatcacacnatactaaggatctgagggccatnaacatcacatatgttgagtttgcttttanttttgtttccaacgttcttaaccaatgttcctggctagggtgattgtaagaactctgtaatagaatgtcattgtggatgttacctttttcagatccaagcatataaaaagcctgtatattttttaaaaacacatcttaactccacgctttacgatattataaaagttgaatggttcctcttggtaaggatatttgcttacaagtgctaggaaataactcactgatacctgcgttaacatactttgttttgcctagagaggggcaataaaaatgaaccaaaggatatttccagaaaggattaagaaagctgtttaagaaggccatgactctttaggtgtgtatgtgtacctttcagcatcctaggaatttttatactaaaagcaaaatgttttttccagttagtcttcttcaaggaattactattgttccttttgtcacaggtaaaatcagtgttgggaattataatttgagaaaaatattacccagtaacattgaatgtagatggctaaacgattcttactcagtgtgatgtataatgatgcaacagggacccttgtaaattgtcatacgccaataaaatgtcacaagtaa

SEQ ID NO: 315140 - DNA, 1149 bp, Homo sapiens
tttgctgttgggtttgccaagatgccagatttttggagtaattattgaatgttaattgatttaaaaatatttttccaatttgggtgataatattcagtgtttttataaatccatttttgttgatatggcagcatatagtcactgatgaaatttaatagttgacccaaacaagctttttagttaactccatattttcctgtttttttgttttctgcaaatgattacttgaagtaatgtcattggttcatattggcaaggtattagagcatccatagattatgttcctttttgttctgaggaagtagtgtattaatgaagtggaattagagactcttgatttaatctattaattgctcttggattagatgtagtattgacagggacctgtgagcaactttcgaaacactctcctgttgaggtacaagaaattgaaagggtaggagttccttgtaacacttgattctcttttgctaggtttcttatttttattttcttttcacctgctacatgcccttctgtcacaaacaaatctctcttaaagtaaagttaactaatcggacagtatttcttctaaatcaacagagcaatacttcaagtcagctgcaatgaccctaaacgagcggttcacttcgtatcagaaagccactgaagaacatagtactcggcaaaagagccctgaaatacacagacacaggtatgtatcctgctgaactggcatataaaaacgttgttttgataggaagacactgttaaaacaagattgtattggaagtttgtttttgtcattgatacaagtattattcctcatttatactttaaataaatatatttcaaagtcttgaaaattctataattcttgattttcagcttagttgaaactggttgttagaacttgaaatattaactcttattactttgcagtatggaattaaatagttatcaattagtttggtttttgggaggggcagtggaggcctagagttaccttcgaatttctagtgaaataaatgtgaaataaatgtttggtgagagagagagaacgaaagcatgagcattgaagtcagatagttgtgttgaaatcctgactttgtctcttcgttgcattgtgatgaacaacttaatctctggacgtaagttttttcatataca

SEQ ID NO: 315141 - DNA, 5410 bp, Homo sapiens
tagcggcacccgaggccacgccccgagatcggaagtgacggagacgtgctagcgcgtcgaaggtagctctatggttttcctcgcgttcttgagtcgggaaatggccgctgtgtggttgcaacggagataaattcccggaaccgcgattcggcgtgtcaggaattcgaatttagagtttaatttctcagagcattctctccaggaagaatttttacagtatctcaaagacttcacttgacttcttgatcctgcataaaaccaaggagaaaagaaatgggtcgctccaattctagatcacattcttcaaggtcaaagtctagatcacagtctagttctcgatcaagatcaagatctcattctagaaagaagcgatacagttctaggtctcgttccagaacatattcaaggtctcgtagtagagatcgtatgtattctagagattatcgtcgcgattacagaaataatagaggaatgagacgaccttatgggtacagaggaaggggtagagggtattatcaaggaggaggaggtagatatcatcgaggtggttatagacctgtctggaatagaaggcactctaggagtcctagacgaggtcgttcacgttccaggagtccaaaaagaagatccgtttcttctcaaagatccagaagcagatctcgccggtcatatagatcttctaggtctccaagatcatcctcttctcgttcttcatccccatatagcaaatctcctgtttctaaaagacgagggtctcaggaaaaacaaaccaaaaaagctgaaggggaaccccaagaagagagtccgttgaaaagtaaatcacaggaggaaccgaaagatacatttgaacatgacccatctgagtctatcgatgaatttaataagtcatcagccacatccggtgatatttggcctggcctttcagcttatgataatagtcctagatcaccccatagtccttcacctattgctacaccacctagtcagagttcatcttgctctgatgctcccatgctcagtacagttcactctgcaaaaaatactccttctcagcattcacattccattcagcatagtcctgaaaggtctgggtctggttctgttggaaatggatctagtcgatacagtccttctcagaatagtccaattcatcacatcccttcacgaagaagtcctgcaaagacaatcgcaccacagaatgctccaagagatgagtctaggggccgttcctcgttttatcctgatggtggagatcaggaaactgcaaagactgggaagttcttaaaaaggttcacagatgaagagtctagagtattcctgcttgataggggtaataccagggataaagaggcttcaaaagagaaaggatcagagaaagggagggcagagggagaatgggaagatcaggaagctctagattacttcagtgataaagagtctggaaaacaaaagtttaatgattcagaaggggatgacacagaggagacagaggattatagacagttcaggaagtcagtcctcgcagatcagggtaaaagttttgctactgcatctcaccggaatactgaggaggaaggactcaagtacaagtccaaagtttcactgaaaggcaatagagaaagtgatggatttagagaagaaaaaaattataaacttaaagagactggatatgtagtggaaaggcctagcactacaaaagataagcacaaagaagaagacaaaaattctgaaagaataacagtaaagaaagaaactcagtcacctgagcaggtaaagtctgaaaagctcaaagacctctttgattacagtccccctctacacaagaatctggatgcacgagaaaagtctaccttcagagaggaaagcccacttaggatcaaaatgatagcgagtgattctcaccgtcctgaagtcaaactcaaaatggcacctgttcctcttgatgattctaacagacctgcttccttgactaaagacaggctgcttgctagtacacttgtccattctgtcaagaaggagcaagaattccgatccatctttgaccacattaagttgccacaggccagcaaaagcacttcagagtcatttattcaacacattgtgtccttggttcatcatgttaaagagcaatacttcaagtcagctgcaatgaccctaaacgagcggttcacttcgtatcagaaagccactgaagaacatagtactcggcaaaagagccctgaaatacacaggagaattgacatctcaccaagtaccctgaggaagcatacccgtttagcaggggaagagagagtttttaaagaagaaaatcaaaagggagataaaaaattaaggtgtgactctgctgaccttcggcatgacattgatcgccgtagaaaagaaagaagtaaagaacggggagattccaagggctccagggaatccagtggatcaagaaagcaggaaaaaactccaaaagattacaaggaatacaaatcttacaaagatgacagtaaacataaaagagagcaagatcattctcgatcttcatcctcttcagcatcaccttcttctcccagttctcgagaagaaaaggagagtaagaaggaaagagaagaagaatttaaaactcaccatgaaatgaaagaatactcaggctttgcaggagttagccgaccacgaggaacctttcatgacgacagagatgatggtgtggattattgggccaaaagaggaagaggtcgtggtacttttcaacgtggcagagggcgctttaacttcaaaaaatcaggtagcagtcctaaatggactcatgacaaataccaaggggatgggattgttgaagatgaagaagagaccatggaaaataatgaagaaaagaaggacagacgcaaggaagaaaaggaataataaatatgaagtaagattacaacagagcagaacttgcacccaccattttttttacctgatttttgttttcaaataagaatgtaagcattttacttaaattttactgtttgcaagtagtctatagaaattttgttttaagtcttcaaatatcttgagaaatagtagactgtatgttgaaaattgtactgaaataaagtagaaaattgttacgtaccatatttgtaactatcaacttttaaaacttttaacgtttttgttacatgcattgtaattctgctttgtctataagatatggtcaagtacagctctgtgaaagttctgattctcttccttccctgtttgtcaatgttttattctgaagtaaacgttagctctacatataaatcctggaacagaaattgtttatagagactacactaattattttaactgtatacatctgtttaatttgaacacactacatcgtagggtgactgatttttgaagtataccacagacaaaaagttgttactatggtaaactaagctagtttaacacttgagcaaatgcttaagaaggaattaaaaaaaaaaagctttgccaatagctaaaaagtacaagctattaaaaatcagattgaaaagttttgagaaaatgttatttttactgaaagcaagcagtggcctataaagaacattcttaggagccttttctatttgcgttcaaaactgtgtgttctctttctattcctatttgatagtttgagtcatggtcttagatattagctatttgtgagaggaaactggtttgtaacaatactgcaaatagaaaccccatttctactgaacatcctagttttaaacagaagaaaaactgtaatcctggggttggtatgtaggaggtctatcctgcagaataagttgatacattagtacctgatttcatatcttacatatttatttgagctgaacattagtttgtagtgtaactattagtaaaaatagagaaacacagcatactgttcattaatagtattttaaaaaaattgtttttcaaatgtcaccaataaaagttttggcaggaagcttgttgcggcattgatctaacctttttcccccccatttcagttgcagtttttgtagaatggctttttctttttcctcttaagagttctattcttcaggtagataatttttcaaatgtgaattatcttttgtgtctatattgatagctcttaaaggagtgaaaatctaaaatagtaaatttcaatgttaagtgtctgctttatgggcatatataaaagtagacacatttcatttgttaatttagttgtgtgtgtgtgttaaaaggagctaatgcttattctgttaatgtaaacttttgaagatcttaagtgtattgctctttcatcttaaacactttcgaggatttgcagtgcgtctagcacctagattacagccaggaacattggttaagaactgttggaaacaaaactaaaagcaaactcaacatatgtgatgtttatggccctcagatccttagtattgtgtgattttcccccgttaacatgtctttctaaaattgtctattaaagcagaggaaatacctgccaaaggaagtatgtattgcattaatcagggcataactaatattctcctgttcagaataatacttatttacgtgtgaaagcaacatggatgtgattcccaacacagaattttcatgacccttttattgtatacaaataaataccataacagttacttggttagacatcaaatctgtgtgcatgactatgtgcttatccacttaagacaataggtaaaaggggatctgagaaattatgtaatagggagtgggaataaaactacttaattcctgtgggcaggttatattttaagttcaaatgcattgctttaacctttggttacttttattctgttaaacagaattgaagaaagagtattataccagagtgtagtaggctagggtgattgtaagaactctgtaatagaatgtcattgtggatgttacctttttcagatccaagcatataaaaagcctgtatattttttaaaaacacatcttaactccacgctttacgatattataaaagttgaatggttcctcttggtaaggatatttgcttacaagtgctaggaaataactcactgatacctgcgttaacatactttgttttgcctagagaggggcaataaaaatgaaccaaaggatatttccagaaaggattaagaaagctgtttaagaaggccatgactctttaggtgtgtatgtgtacctttcagcatcctaggaatttttatactaaaagcaaaatgttttttccagttagtcttcttcaaggaattactattgttccttttgtcacaggtaaaatcagtgttgggaattataatttgagaaaaatattacccagtaacattgaatgtagatggctaaacgattcttactcagtgtgatgtataatgatgcaacagggacccttgtaaattgtcatacgccaataaaatgtcacaagtaa

SEQ ID NO: 315142 - DNA, 5720 bp, Homo sapiens
tagcggcacccgaggccacgccccgagatcggaagtgacggagacgtgctagcgcgtcgaaggtagctctatggttttcctcgcgttcttgagtcgggaaatggccgctgtgtggttgcaacggagataaattcccggaaccgcgattcggcgtgtcaggaattcgaatttagagtttaatttctcagagcattctctccaggaagaatttttacagtatctcaaagacttcacttgacttcttgatcctgcataaaaccaaggagaaaagaaatgggtcgctccaattctagatcacattcttcaaggtcaaagtctagatcacagtctagttctcgatcaagatcaagatctcattctagaaagaagcgatacagttctaggtctcgttccagaacatattcaaggtctcgtagtagagatcgtatgtattctagagattatcgtcgcgattacagaaataatagaggaatgagacgaccttatgggtacagaggaaggggtagagggtattatcaaggaggaggaggtagatatcatcgaggtggttatagacctgtctggaatagaaggcactctaggagtcctagacgaggtcgttcacgttccaggagtccaaaaagaagatccgtttcttctcaaagatccagaagcagatctcgccggtcatatagatcttctaggtctccaagatcatcctcttctcgttcttcatccccatatagcaaatctcctgtttctaaaagacgagggtctcaggaaaaacaaaccaaaaaagctgaaggggaaccccaagaagagagtccgttgaaaagtaaatcacaggaggaaccgaaagatacatttgaacatgacccatctgagtctatcgatgaatttaataagtcatcagccacatccggtgatatttggcctggcctttcagcttatgataatagtcctagatcaccccatagtccttcacctattgctacaccacctagtcagagttcatcttgctctgatgctcccatgctcagtacagttcactctgcaaaaaatactccttctcagcattcacattccattcagcatagtcctgaaaggtctgggtctggttctgttggaaatggatctagtcgatacagtccttctcagaatagtccaattcatcacatcccttcacgaagaagtcctgcaaagacaatcgcaccacagaatgctccaagagatgagtctaggggccgttcctcgttttatcctgatggtggagatcaggaaactgcaaagactgggaagttcttaaaaaggttcacagatgaagagtctagagtattcctgcttgataggggtaataccagggataaagaggcttcaaaagagaaaggatcagagaaagggagggcagagggagaatgggaagatcaggaagctctagattacttcagtgataaagagtctggaaaacaaaagtttaatgattcagaaggggatgacacagaggagacagaggattatagacagttcaggaagtcagtcctcgcagatcagggtaaaagttttgctactgcatctcaccggaatactgaggaggaaggactcaagtacaagtccaaagtttcactgaaaggcaatagagaaagtgatggatttagagaagaaaaaaattataaacttaaagagactggatatgtagtggaaaggcctagcactacaaaagataagcacaaagaagaagacaaaaattctgaaagaataacagtaaagaaagaaactcagtcacctgagcaggtaaagtctgaaaagctcaaagacctctttgattacagtccccctctacacaagaatctggatgcacgagaaaagtctaccttcagagaggaaagcccacttaggatcaaaatgatagcgagtgattctcaccgtcctgaagtcaaactcaaaatggcacctgttcctcttgatgattctaacagacctgcttccttgactaaagacaggctgcttgctagtacacttgtccattctgtcaagaaggagcaagaattccgatccatctttgaccacattaagttgccacaggccagcaaaagcacttcagagtcatttattcaacacattgtgtccttggttcatcatgttaaagagcaatacttcaagtcagctgcaatgaccctaaacgagcggttcacttcgtatcagaaagccactgaagaacatagtactcggcaaaagagccctgaaatacacaggagaattgacatctcaccaagtaccctgaggaagcatacccgtttagcaggggaagagagagtttttaaagaagaaaatcaaaagggagataaaaaattaaggtgtgactctgctgaccttcggcatgacattgatcgccgtagaaaagaaagaagtaaagaacggggagattccaagggctccagggaatccagtggatcaagaaagcaggaaaaaactccaaaagattacaaggaatacaaatcttacaaagatgacagcaaaaatgtatttgtcttttacacggcttatggtggatgaggacaaaaactttggaatagcaagctaacactgaaaaaaaaaatgacaaattaatgtgtcctattatccaggctacatcaggaggttggacttcaatgcagtgcatttctagaaacagtttgttaaacataaaagagagcaagatcattctcgatcttcatcctcttcagcatcaccttcttctcccagttctcgagaagaaaaggagagtaagaaggaaagagaagaagaatttaaaactcaccatgaaatgaaagaatactcaggctttgcaggagttagccgaccacgaggaaccttttttcgaattagaggcagaggaagagccagaggagtttttgctgggacaaatactggtccaaacaactcaaatactacttttcaaaagagaccgaaggaagaggaatgggatccagaatataccccaaagagcaagaagtacttcttgcatgacgacagagatgatggtgtggattattgggccaaaagaggaagaggtcgtggtacttttcaacgtggcagagggcgctttaacttcaaaaaatcaggtagcagtcctaaatggactcatgacaaataccaaggggatgggattgttgaagatgaagaagagaccatggaaaataatgaagaaaagaaggacagacgcaaggaagaaaaggaataataaatatgaagtaagattacaacagagcagaacttgcacccaccattttttttacctgatttttgttttcaaataagaatgtaagcattttacttaaattttactgtttgcaagtagtctatagaaattttgttttaagtcttcaaatatcttgagaaatagtagactgtatgttgaaaattgtactgaaataaagtagaaaattgttacgtaccatatttgtaactatcaacttttaaaacttttaacgtttttgttacatgcattgtaattctgctttgtctataagatatggtcaagtacagctctgtgaaagttctgattctcttccttccctgtttgtcaatgttttattctgaagtaaacgttagctctacatataaatcctggaacagaaattgtttatagagactacactaattattttaactgtatacatctgtttaatttgaacacactacatcgtagggtgactgatttttgaagtataccacagacaaaaagttgttactatggtaaactaagctagtttaacacttgagcaaatgcttaagaaggaattaaaaaaaaaaagctttgccaatagctaaaaagtacaagctattaaaaatcagattgaaaagttttgagaaaatgttatttttactgaaagcaagcagtggcctataaagaacattcttaggagccttttctatttgcgttcaaaactgtgtgttctctttctattcctatttgatagtttgagtcatggtcttagatattagctatttgtgagaggaaactggtttgtaacaatactgcaaatagaaaccccatttctactgaacatcctagttttaaacagaagaaaaactgtaatcctggggttggtatgtaggaggtctatcctgcagaataagttgatacattagtacctgatttcatatcttacatatttatttgagctgaacattagtttgtagtgtaactattagtaaaaatagagaaacacagcatactgttcattaatagtattttaaaaaaattgtttttcaaatgtcaccaataaaagttttggcaggaagcttgttgcggcattgatctaacctttttcccccccatttcagttgcagtttttgtagaatggctttttctttttcctcttaagagttctattcttcaggtagataatttttcaaatgtgaattatcttttgtgtctatattgatagctcttaaaggagtgaaaatctaaaatagtaaatttcaatgttaagtgtctgctttatgggcatatataaaagtagacacatttcatttgttaatttagttgtgtgtgtgtgttaaaaggagctaatgcttattctgttaatgtaaacttttgaagatcttaagtgtattgctctttcatcttaaacactttcgaggatttgcagtgcgtctagcacctagattacagccaggaacattggttaagaactgttggaaacaaaactaaaagcaaactcaacatatgtgatgtttatggccctcagatccttagtattgtgtgattttcccccgttaacatgtctttctaaaattgtctattaaagcagaggaaatacctgccaaaggaagtatgtattgcattaatcagggcataactaatattctcctgttcagaataatacttatttacgtgtgaaagcaacatggatgtgattcccaacacagaattttcatgacccttttattgtatacaaataaataccataacagttacttggttagacatcaaatctgtgtgcatgactatgtgcttatccacttaagacaataggtaaaaggggatctgagaaattatgtaatagggagtgggaataaaactacttaattcctgtgggcaggttatattttaagttcaaatgcattgctttaacctttggttacttttattctgttaaacagaattgaagaaagagtattataccagagtgtagtaggctagggtgattgtaagaactctgtaatagaatgtcattgtggatgttacctttttcagatccaagcatataaaaagcctgtatattttttaaaaacacatcttaactccacgctttacgatattataaaagttgaatggttcctcttggtaaggatatttgcttacaagtgctaggaaataactcactgatacctgcgttaacatactttgttttgcctagagaggggcaataaaaatgaaccaaaggatatttccagaaaggattaagaaagctgtttaagaaggccatgactctttaggtgtgtatgtgtacctttcagcatcctaggaatttttatactaaaagcaaaatgttttttccagttagtcttcttcaaggaattactattgttccttttgtcacaggtaaaatcagtgttgggaattataatttgagaaaaatattacccagtaacattgaatgtagatggctaaacgattcttactcagtgtgatgtataatgatgcaacagggacccttgtaaattgtcatacgccaataaaatgtcacaagtaa

SEQ ID NO: 315143 - DNA, 5038 bp, Homo sapiens
tagcggcacccgaggccacgccccgagatcggaagtgacggagacgtgctagcgcgtcgaaggtagctctatggttttcctcgcgttcttgagtcgggaaatggccgctgtgtggttgcaacggagataaattcccggaaccgcgattcggcgtgtcaggaattcgaatttagagtttaatttctcagagcattctctccaggaagaatttttacagtatctcaaagacttcacttgacttcttgatcctgcataaaaccaaggagaaaagaaatgggtcgctccaattctagatcacattcttcaaggtcaaagtctagatcacagtctagttctcgatcaagatcaagatctcattctagaaagaagcgatacagttctaggtctcgttccagaacatattcaaggtctcgtagtagagatcgtatgtattctagagattatcgtcgcgattacagaaataatagaggaatgagacgaccttatgggtacagaggaaggggtagagggtattatcaaggaggaggaggtagatatcatcgaggtggttatagacctgtctggaatagaaggcactctaggagtcctagacgaggtcgttcacgttccaggagtccaaaaagaagatccgtttcttctcaaagatccagaagcagatctcgccggtcatatagatcttctaggtctccaagatcatcctcttctcgttcttcatccccatatagcaaatctcctgtttctaaaagacgagggtctcaggaaaaacaaaccaaaaaagctgaaggggaaccccaagaagagagtccgttgaaaagtaaatcacaggaggaaccgaaagatacatttgaacatgacccatctgagtctatcgatgaatttaataagtcatcagccacatccggtgatatttggcctggcctttcagcttatgataatagtcctagatcaccccatagtccttcacctattgctacaccacctagtcagagttcatcttgctctgatgctcccatgctcagtacagttcactctgcaaaaaatactccttctcagcattcacattccattcagcatagtcctgaaaggtctgggtctggttctgttggaaatggatctagtcgatacagtccttctcagaatagtccaattcatcacatcccttcacgaagaagtcctgcaaagacaatcgcaccacagaatgctccaagagatgagtctaggggccgttcctcgttttatcctgatggtggagatcaggaaactgcaaagactgggaagttcttaaaaagtccccctctacacaagaatctggatgcacgagaaaagtctaccttcagagaggaaagcccacttaggatcaaaatgatagcgagtgattctcaccgtcctgaagtcaaactcaaaatggcacctgttcctcttgatgattctaacagacctgcttccttgactaaagacaggctgcttgctagtacacttgtccattctgtcaagaaggagcaagaattccgatccatctttgaccacattaagttgccacaggccagcaaaagcacttcagagtcatttattcaacacattgtgtccttggttcatcatgttaaagagcaatacttcaagtcagctgcaatgaccctaaacgagcggttcacttcgtatcagaaagccactgaagaacatagtactcggcaaaagagccctgaaatacacaggagaattgacatctcaccaagtaccctgaggaagcatacccgtttagcaggggaagagagagtttttaaagaagaaaatcaaaagggagataaaaaattaaggtgtgactctgctgaccttcggcatgacattgatcgccgtagaaaagaaagaagtaaagaacggggagattccaagggctccagggaatccagtggatcaagaaagcaggaaaaaactccaaaagattacaaggaatacaaatcttacaaagatgacagtaaacataaaagagagcaagatcattctcgatcttcatcctcttcagcatcaccttcttctcccagttctcgagaagaaaaggagagtaagaaggaaagagaagaagaatttaaaactcaccatgaaatgaaagaatactcaggctttgcaggagttagccgaccacgaggaaccttttttcgaattagaggcagaggaagagccagaggagtttttgctgggacaaatactggtccaaacaactcaaatactacttttcaaaagagaccgaaggaagaggaatgggatccagaatataccccaaagagcaagaagtacttcttgcatgacgacagagatgatggtgtggattattgggccaaaagaggaagaggtcgtggtacttttcaacgtggcagagggcgctttaacttcaaaaaatcaggtagcagtcctaaatggactcatgacaaataccaaggggatgggattgttgaagatgaagaagagaccatggaaaataatgaagaaaagaaggacagacgcaaggaagaaaaggaataataaatatgaagtaagattacaacagagcagaacttgcacccaccattttttttacctgatttttgttttcaaataagaatgtaagcattttacttaaattttactgtttgcaagtagtctatagaaattttgttttaagtcttcaaatatcttgagaaatagtagactgtatgttgaaaattgtactgaaataaagtagaaaattgttacgtaccatatttgtaactatcaacttttaaaacttttaacgtttttgttacatgcattgtaattctgctttgtctataagatatggtcaagtacagctctgtgaaagttctgattctcttccttccctgtttgtcaatgttttattctgaagtaaacgttagctctacatataaatcctggaacagaaattgtttatagagactacactaattattttaactgtatacatctgtttaatttgaacacactacatcgtagggtgactgatttttgaagtataccacagacaaaaagttgttactatggtaaactaagctagtttaacacttgagcaaatgcttaagaaggaattaaaaaaaaaaagctttgccaatagctaaaaagtacaagctattaaaaatcagattgaaaagttttgagaaaatgttatttttactgaaagcaagcagtggcctataaagaacattcttaggagccttttctatttgcgttcaaaactgtgtgttctctttctattcctatttgatagtttgagtcatggtcttagatattagctatttgtgagaggaaactggtttgtaacaatactgcaaatagaaaccccatttctactgaacatcctagttttaaacagaagaaaaactgtaatcctggggttggtatgtaggaggtctatcctgcagaataagttgatacattagtacctgatttcatatcttacatatttatttgagctgaacattagtttgtagtgtaactattagtaaaaatagagaaacacagcatactgttcattaatagtattttaaaaaaattgtttttcaaatgtcaccaataaaagttttggcaggaagcttgttgcggcattgatctaacctttttcccccccatttcagttgcagtttttgtagaatggctttttctttttcctcttaagagttctattcttcaggtagataatttttcaaatgtgaattatcttttgtgtctatattgatagctcttaaaggagtgaaaatctaaaatagtaaatttcaatgttaagtgtctgctttatgggcatatataaaagtagacacatttcatttgttaatttagttgtgtgtgtgtgttaaaaggagctaatgcttattctgttaatgtaaacttttgaagatcttaagtgtattgctctttcatcttaaacactttcgaggatttgcagtgcgtctagcacctagattacagccaggaacattggttaagaactgttggaaacaaaactaaaagcaaactcaacatatgtgatgtttatggccctcagatccttagtattgtgtgattttcccccgttaacatgtctttctaaaattgtctattaaagcagaggaaatacctgccaaaggaagtatgtattgcattaatcagggcataactaatattctcctgttcagaataatacttatttacgtgtgaaagcaacatggatgtgattcccaacacagaattttcatgacccttttattgtatacaaataaataccataacagttacttggttagacatcaaatctgtgtgcatgactatgtgcttatccacttaagacaataggtaaaaggggatctgagaaattatgtaatagggagtgggaataaaactacttaattcctgtgggcaggttatattttaagttcaaatgcattgctttaacctttggttacttttattctgttaaacagaattgaagaaagagtattataccagagtgtagtaggctagggtgattgtaagaactctgtaatagaatgtcattgtggatgttacctttttcagatccaagcatataaaaagcctgtatattttttaaaaacacatcttaactccacgctttacgatattataaaagttgaatggttcctcttggtaaggatatttgcttacaagtgctaggaaataactcactgatacctgcgttaacatactttgttttgcctagagaggggcaataaaaatgaaccaaaggatatttccagaaaggattaagaaagctgtttaagaaggccatgactctttaggtgtgtatgtgtacctttcagcatcctaggaatttttatactaaaagcaaaatgttttttccagttagtcttcttcaaggaattactattgttccttttgtcacaggtaaaatcagtgttgggaattataatttgagaaaaatattacccagtaacattgaatgtagatggctaaacgattcttactcagtgtgatgtataatgatgcaacagggacccttgtaaattgtcatacgccaataaaatgtcacaagtaa

SEQ ID NO: 315144 - DNA, 5135 bp, Homo sapiens
ccgggcttcagtgtccagagtatcagtgacttgagaaatttaccaagggaatggatgaccttgggagcagtgaggaaggggtagagggtattatcaaggaggaggaggtagatatcatcgaggtggttatagacctgtctggaatagaaggcactctaggagtcctagacgaggtcgttcacgttccaggagtccaaaaagaagatccgtttcttctcaaagatccagaagcagatctcgccggtcatatagatcttctaggtctccaagatcatcctcttctcgttcttcatccccatatagcaaatctcctgtttctaaaagacgagggtctcaggaaaaacaaaccaaaaaagctgaaggggaaccccaagaagagagtccgttgaaaagtaaatcacaggaggaaccgaaagatacatttgaacatgacccatctgagtctatcgatgaatttaataagtcatcagccacatccggtgatatttggcctggcctttcagcttatgataatagtcctagatcaccccatagtccttcacctattgctacaccacctagtcagagttcatcttgctctgatgctcccatgctcagtacagttcactctgcaaaaaatactccttctcagcattcacattccattcagcatagtcctgaaaggtctgggtctggttctgttggaaatggatctagtcgatacagtccttctcagaatagtccaattcatcacatcccttcacgaagaagtcctgcaaagacaatcgcaccacagaatgctccaagagatgagtctaggggccgttcctcgttttatcctgatggtggagatcaggaaactgcaaagactgggaagttcttaaaaaggttcacagatgaagagtctagagtattcctgcttgataggggtaataccagggataaagaggcttcaaaagagaaaggatcagagaaagggagggcagagggagaatgggaagatcaggaagctctagattacttcagtgataaagagtctggaaaacaaaagtttaatgattcagaaggggatgacacagaggagacagaggattatagacagttcaggaagtcagtcctcgcagatcagggtaaaagttttgctactgcatctcaccggaatactgaggaggaaggactcaagtacaagtccaaagtttcactgaaaggcaatagagaaagtgatggatttagagaagaaaaaaattataaacttaaagagactggatatgtagtggaaaggcctagcactacaaaagataagcacaaagaagaagacaaaaattctgaaagaataacagtaaagaaagaaactcagtcacctgagcaggtaaagtctgaaaagctcaaagacctctttgattacagtccccctctacacaagaatctggatgcacgagaaaagtctaccttcagagaggaaagcccacttaggatcaaaatgatagcgagtgattctcaccgtcctgaagtcaaactcaaaatggcacctgttcctcttgatgattctaacagacctgcttccttgactaaagacaggctgcttgctagtacacttgtccattctgtcaagaaggagcaagaattccgatccatctttgaccacattaagttgccacaggccagcaaaagcacttcagagtcatttattcaacacattgtgtccttggttcatcatgttaaagagcaatacttcaagtcagctgcaatgaccctaaacgagcggttcacttcgtatcagaaagccactgaagaacatagtactcggcaaaagagccctgaaatacacaggagaattgacatctcaccaagtaccctgaggaagcatacccgtttagcaggggaagagagagtttttaaagaagaaaatcaaaagggagataaaaaattaaggtgtgactctgctgaccttcggcatgacattgatcgccgtagaaaagaaagaagtaaagaacggggagattccaagggctccagggaatccagtggatcaagaaagcaggaaaaaactccaaaagattacaaggaatacaaatcttacaaagatgacagtaaacataaaagagagcaagatcattctcgatcttcatcctcttcagcatcaccttcttctcccagttctcgagaagaaaaggagagtaagaaggaaagagaagaagaatttaaaactcaccatgaaatgaaagaatactcaggctttgcaggagttagccgaccacgaggaaccttttttcgaattagaggcagaggaagagccagaggagtttttgctgggacaaatactggtccaaacaactcaaatactacttttcaaaagagaccgaaggaagaggaatgggatccagaatataccccaaagagcaagaagtacttcttgcatgacgacagagatgatggtgtggattattgggccaaaagaggaagaggtcgtggtacttttcaacgtggcagagggcgctttaacttcaaaaaatcaggtagcagtcctaaatggactcatgacaaataccaaggggatgggattgttgaagatgaagaagagaccatggaaaataatgaagaaaagaaggacagacgcaaggaagaaaaggaataataaatatgaagtaagattacaacagagcagaacttgcacccaccattttttttacctgatttttgttttcaaataagaatgtaagcattttacttaaattttactgtttgcaagtagtctatagaaattttgttttaagtcttcaaatatcttgagaaatagtagactgtatgttgaaaattgtactgaaataaagtagaaaattgttacgtaccatatttgtaactatcaacttttaaaacttttaacgtttttgttacatgcattgtaattctgctttgtctataagatatggtcaagtacagctctgtgaaagttctgattctcttccttccctgtttgtcaatgttttattctgaagtaaacgttagctctacatataaatcctggaacagaaattgtttatagagactacactaattattttaactgtatacatctgtttaatttgaacacactacatcgtagggtgactgatttttgaagtataccacagacaaaaagttgttactatggtaaactaagctagtttaacacttgagcaaatgcttaagaaggaattaaaaaaaaaaagctttgccaatagctaaaaagtacaagctattaaaaatcagattgaaaagttttgagaaaatgttatttttactgaaagcaagcagtggcctataaagaacattcttaggagccttttctatttgcgttcaaaactgtgtgttctctttctattcctatttgatagtttgagtcatggtcttagatattagctatttgtgagaggaaactggtttgtaacaatactgcaaatagaaaccccatttctactgaacatcctagttttaaacagaagaaaaactgtaatcctggggttggtatgtaggaggtctatcctgcagaataagttgatacattagtacctgatttcatatcttacatatttatttgagctgaacattagtttgtagtgtaactattagtaaaaatagagaaacacagcatactgttcattaatagtattttaaaaaaattgtttttcaaatgtcaccaataaaagttttggcaggaagcttgttgcggcattgatctaacctttttcccccccatttcagttgcagtttttgtagaatggctttttctttttcctcttaagagttctattcttcaggtagataatttttcaaatgtgaattatcttttgtgtctatattgatagctcttaaaggagtgaaaatctaaaatagtaaatttcaatgttaagtgtctgctttatgggcatatataaaagtagacacatttcatttgttaatttagttgtgtgtgtgtgttaaaaggagctaatgcttattctgttaatgtaaacttttgaagatcttaagtgtattgctctttcatcttaaacactttcgaggatttgcagtgcgtctagcacctagattacagccaggaacattggttaagaactgttggaaacaaaactaaaagcaaactcaacatatgtgatgtttatggccctcagatccttagtattgtgtgattttcccccgttaacatgtctttctaaaattgtctattaaagcagaggaaatacctgccaaaggaagtatgtattgcattaatcagggcataactaatattctcctgttcagaataatacttatttacgtgtgaaagcaacatggatgtgattcccaacacagaattttcatgacccttttattgtatacaaataaataccataacagttacttggttagacatcaaatctgtgtgcatgactatgtgcttatccacttaagacaataggtaaaaggggatctgagaaattatgtaatagggagtgggaataaaactacttaattcctgtgggcaggttatattttaagttcaaatgcattgctttaacctttggttacttttattctgttaaacagaattgaagaaagagtattataccagagtgtagtaggctagggtgattgtaagaactctgtaatagaatgtcattgtggatgttacctttttcagatccaagcatataaaaagcctgtatattttttaaaaacacatcttaactccacgctttacgatattataaaagttgaatggttcctcttggtaaggatatttgcttacaagtgctaggaaataactcactgatacctgcgttaacatactttgttttgcctagagaggggcaataaaaatgaaccaaaggatatttccagaaaggattaagaaagctgtttaagaaggccatgactctttaggtgtgtatgtgtacctttcagcatcctaggaatttttatactaaaagcaaaatgttttttccagttagtcttcttcaaggaattactattgttccttttgtcacaggtaaaatcagtgttgggaattataatttgagaaaaatattacccagtaacattgaatgtagatggctaaacgattcttactcagtgtgatgtataatgatgcaacagggacccttgtaaattgtcatacgccaataaaatgtcacaagtaa

SEQ ID NO: 315145 - DNA, 5706 bp, Homo sapiens
tagcggcacccgaggccacgccccgagatcggaagtgacggagacgtgctagcgcgtcgaaggtagctctatggttttcctcgcgttcttgagtcgggaaatggccgctgtgtggttgcaacggagataaattcccggaaccgcgattcggcgtgtcaggaattcgaatttagagtttaatttctcagagcattctctccaggaagaatttttacagtatctcaaagacttcacttgacttcttgatcctgcataaaaccaaggagaaaagaaatgggtcgctccaattctagatcacattcttcaaggtcaaagtctagatcacagtctagttctcgatcaagatcaagatctcattctagaaagaagcgatacagttctaggtctcgttccagaacatattcaaggtctcgtagtagagatcgtatgtattctagagattatcgtcgcgattacagaaataatagaggaatgagacgaccttatgggtacagaggaaggggtagagggtattatcaaggaggaggaggtagatatcatcgaggtggttatagacctgtctggaatagaaggcactctaggagtcctagacgaggtcgttcacgttccaggagtccaaaaagaagatccgtttcttctcaaagatccagaagcagatctcgccggtcatatagatcttctaggtctccaagatcatcctcttctcgttcttcatccccatatagcaaatctcctgtttctaaaagacgagggtctcaggaaaaacaaaccaaaaaagctgaaggggaaccccaagaagagagtccgttgaaaagtaaatcacaggaggaaccgaaagatacatttgaacatgacccatctgagtctatcgatgaatttaataagtcatcagccacatccggtgatatttggcctggcctttcagcttatgataatagtcctagatcaccccatagtccttcacctattgctacaccacctagtcagagttcatcttgctctgatgctcccatgctcagtacagttcactctgcaaaaaatactccttctcagcattcacattccattcagcatagtcctgaaaggtctgggtctggttctgttggaaatggatctagtcgatacagtccttctcagaatagtccaattcatcacatcccttcacgaagaagtcctgcaaagacaatcgcaccacagaatgctccaagagatgagtctaggggccgttcctcgttttatcctgatggtggagatcaggaaactgcaaagactgggaagttcttaaaaaggttcacagatgaagagtctagagtattcctgcttgataggggtaataccagggataaagaggcttcaaaagagaaaggatcagagaaagggagggcagagggagaatgggaagatcaggaagctctagattacttcagtgataaagagtctggaaaacaaaagtttaatgattcagaaggggatgacacagaggagacagaggattatagacagttcaggaagtcagtcctcgcagatcagggtaaaagttttgctactgcatctcaccggaatactgaggaggaaggactcaagtacaagtccaaagtttcactgaaaggcaatagagaaagtgatggatttagagaagaaaaaaattataaacttaaagagactggatatgtagtggaaaggcctagcactacaaaagataagcacaaagaagaagacaaaaattctgaaagaataacagtaaagaaagaaactcagtcacctgagcaggtaaagtctgaaaagctcaaagacctctttgattacagtccccctctacacaagaatctggatgcacgagaaaagtctaccttcagagaggaaagcccacttaggatcaaaatgatagcgagtgattctcaccgtcctgaagtcaaactcaaaatggcacctgttcctcttgatgattctaacagacctgcttccttgactaaagacaggctgcttgctagtacacttgtccattctgtcaagaaggagcaagaattccgatccatctttgaccacattaagttgccacaggccagcaaaagcacttcagagtcatttattcaacacattgtgtccttggttcatcatgttaaagagcaatacttcaagtcagctgcaatgaccctaaacgagcggttcacttcgtatcagaaagccactgaagaacatagtactcggcaaaagagccctgaaatacacaggagaattgacatctcaccaagtaccctgaggaagcatacccgtttagcaggggaagagagagtttttaaagaagaaaatcaaaagggagataaaaaattaaggtgtgactctgctgaccttcggcatgacattgatcgccgtagaaaagaaagaagtaaagaacggggagattccaagggctccagggaatccagtggatcaagaaagcaggaaaaaactccaaaagattacaaggaatacaaatcttacaaagatgacagtaaacataaaagagagcaagatcattctcgatcttcatcctcttcagcatcaccttcttctcccagttctcgagaagaaaaggagagtaagaaggaaagagaagaagaatttaaaactcaccatgaaatgaaagaatactcaggctttgcaggagttagccgaccacgaggaaccttttttcgaattagaggcagaggaagagccagaggagtttttgctgggacaaatactggtccaaacaactcaaatactacttttcaaaagagaccgaaggaagaggaatgggatccagaatataccccaaagagcaagaagtacttcttgcatgacgacagagatgatggtgtggattattgggccaaaagaggaagaggtcgtggtacttttcaacgtggcagagggcgctttaacttcaaaaaatcaggtagcagtcctaaatggactcatgacaaataccaaggggatgggattgttgaagatgaagaagagaccatggaaaataatgaagaaaagaaggacagacgcaaggaagaaaaggtataaaatttcaacttgtgattctgacagattttttttgatataggtttggtgggtgaattatttcatttttaggaacaattattaatatggttccttttcactctccgcatcttttgttaatctttaattttttctctctcttttaggaataataaatatgaagtaagattacaacagagcagaacttgcacccaccattttttttacctgatttttgttttcaaataagaatgtaagcattttacttaaattttactgtttgcaagtagtctatagaaattttgttttaagtcttcaaatatcttgagaaatagtagactgtatgttgaaaattgtactgaaataaagtagaaaattgttacgtaccatatttgtaactatcaacttttaaaacttttaacgtttttgttacatgcattgtaattctgctttgtctataagatatggtcaagtacagctctgtgaaagttctgattctcttccttccctgtttgtcaatgttttattctgaagtaaacgttagctctacatataaatcctggaacagaaattgtttatagagactacactaattattttaactgtatacatctgtttaatttgaacacactacatcgtagggtgactgatttttgaagtataccacagacaaaaagttgttactatggtaaactaagctagtttaacacttgagcaaatgcttaagaaggaattaaaaaaaaaaagctttgccaatagctaaaaagtacaagctattaaaaatcagattgaaaagttttgagaaaatgttatttttactgaaagcaagcagtggcctataaagaacattcttaggagccttttctatttgcgttcaaaactgtgtgttctctttctattcctatttgatagtttgagtcatggtcttagatattagctatttgtgagaggaaactggtttgtaacaatactgcaaatagaaaccccatttctactgaacatcctagttttaaacagaagaaaaactgtaatcctggggttggtatgtaggaggtctatcctgcagaataagttgatacattagtacctgatttcatatcttacatatttatttgagctgaacattagtttgtagtgtaactattagtaaaaatagagaaacacagcatactgttcattaatagtattttaaaaaaattgtttttcaaatgtcaccaataaaagttttggcaggaagcttgttgcggcattgatctaacctttttcccccccatttcagttgcagtttttgtagaatggctttttctttttcctcttaagagttctattcttcaggtagataatttttcaaatgtgaattatcttttgtgtctatattgatagctcttaaaggagtgaaaatctaaaatagtaaatttcaatgttaagtgtctgctttatgggcatatataaaagtagacacatttcatttgttaatttagttgtgtgtgtgtgttaaaaggagctaatgcttattctgttaatgtaaacttttgaagatcttaagtgtattgctctttcatcttaaacactttcgaggatttgcagtgcgtctagcacctagattacagccaggaacattggttaagaactgttggaaacaaaactaaaagcaaactcaacatatgtgatgtttatggccctcagatccttagtattgtgtgattttcccccgttaacatgtctttctaaaattgtctattaaagcagaggaaatacctgccaaaggaagtatgtattgcattaatcagggcataactaatattctcctgttcagaataatacttatttacgtgtgaaagcaacatggatgtgattcccaacacagaattttcatgacccttttattgtatacaaataaataccataacagttacttggttagacatcaaatctgtgtgcatgactatgtgcttatccacttaagacaataggtaaaaggggatctgagaaattatgtaatagggagtgggaataaaactacttaattcctgtgggcaggttatattttaagttcaaatgcattgctttaacctttggttacttttattctgttaaacagaattgaagaaagagtattataccagagtgtagtaggctagggtgattgtaagaactctgtaatagaatgtcattgtggatgttacctttttcagatccaagcatataaaaagcctgtatattttttaaaaacacatcttaactccacgctttacgatattataaaagttgaatggttcctcttggtaaggatatttgcttacaagtgctaggaaataactcactgatacctgcgttaacatactttgttttgcctagagaggggcaataaaaatgaaccaaaggatatttccagaaaggattaagaaagctgtttaagaaggccatgactctttaggtgtgtatgtgtacctttcagcatcctaggaatttttatactaaaagcaaaatgttttttccagttagtcttcttcaaggaattactattgttccttttgtcacaggtaaaatcagtgttgggaattataatttgagaaaaatattacccagtaacattgaatgtagatggctaaacgattcttactcagtgtgatgtataatgatgcaacagggacccttgtaaattgtcatacgccaataaaatgtcacaagtaa

SEQ ID NO: 315146 - DNA, 4925 bp, Homo sapiens
  misc_feature (318)..(318): n is a, c, g, or t
  misc_feature (326)..(329): n is a, c, g, or t
  misc_feature (331)..(331): n is a, c, g, or t
  misc_feature (341)..(341): n is a, c, g, or t
  misc_feature (440)..(440): n is a, c, g, or t
  misc_feature (463)..(463): n is a, c, g, or t
  misc_feature (492)..(492): n is a, c, g, or t
  misc_feature (954)..(954): n is a, c, g, or t
  misc_feature (991)..(991): n is a, c, g, or t
  misc_feature (1035)..(1035): n is a, c, g, or t
  misc_feature (1163)..(1163): n is a, c, g, or t
  misc_feature (1165)..(1165): n is a, c, g, or t
  misc_feature (1170)..(1170): n is a, c, g, or t
  misc_feature (1172)..(1172): n is a, c, g, or t
  misc_feature (1179)..(1179): n is a, c, g, or t
  misc_feature (1181)..(1181): n is a, c, g, or t
  misc_feature (1183)..(1183): n is a, c, g, or t
  misc_feature (1202)..(1202): n is a, c, g, or t
cctcgtttcttcaagtctgttaccgaaattatcgttcccaaggttaaaccaatgcattttgaaccttataaatatcaccctggccccacagtaattaaatagtgtttatgtcccactcccttataacataattttctccagatcccccttttaccctagttgtcttaagtgggataatccacatagtcatgcacacagaatgtggatgtcttctcccaagtaactgttatggttatttcatttgtatcacaataaaaggtcatcaaaattctgtgttgggaatcacatccacgttgctttcacacgctaaataagtantattctgnnnngnagaatattanttatgccctgattaatgcatacatacttcctttggcaggtatttcctctgctttaatagacaattttagaaagacatgttaacgggggaaaatcacacnatactaaggatctgagggccatnaacatcacatatgttgagtttgcttttanttttgtttccaacgttcttaaccaatgttcctggctgtaatctaggtgctagacgcactgcaaatcctcgaaagtgctttatagatgaaagagcatacacttaagatcttcaaagtttacattaacagcataagcaccttagctcccttttaacacacacacacacttaaatagtaaatttcaatgttaagtgtctgctttatgggcatatatacaaagtagacacatttcatttgttaatttagttgtgtgtgtgtgttaaaaggagctaatgcttattctgttaatgtaaacttttgaagatcttaagtgtattgctctttcatcttaaacactttcgaggatttgcagtgcgtctagcacctagattacagccaggaacattggttaagaactgttggaaacaaaactaaaagcaaactcaacatatgtgatgtttatggccctcagatccttagtatngtgtgattttcccccgttaacatgtctttctaaaatngtctattaaagcagaggaaatacctgccaaaggaagtatgtatngcattaatcagggcataactaatattctcctgttcagaataatacttatttacgtgtgaaagcaacatggatgtgattcccaacacagaattttcatgacccttttattgtatacaaataaataccanancagtnanttggttngncntcaaaaaaaaaaaaaaaanaaaaaaaaaaaaataccttcagagaggaaagcccacttaggatcaaaatgatagcgagtgattctcaccgtcctgaagtcaaactcaaaatggcacctgttcctcttgatgattctaacagacctgcttccttgactaaagacaggctgcttgctagtacacttgtccattctgtcaagaaggagcaagaattccgatccatctttgaccacattaagttgccacaggccagcaaaagcacttcagagtcatttattcaacacattgtgtccttggttcatcatgttaaagagcaatacttcaagtcagctgcaatgaccctaaacgagcggttcacttcgtatcagaaagccactgaagaacatagtactcggcaaaagagccctgaaatacacaggagaattgacatctcaccaagtaccctgaggaagcatacccgtttagcaggggaagagagagtttttaaagaagaaaatcaaaagggagataaaaaattaaggtgtgactctgctgaccttcggcatgacattgatcgccgtagaaaagaaagaagtaaagaacggggagattccaagggctccagggaatccagtggatcaagaaagcaggaaaaaactccaaaagattacaaggaatacaaatcttacaaagatgacagtaaacataaaagagagcaagatcattctcgatcttcatcctcttcagcatcaccttcttctcccagttctcgagaagaaaaggagagtaagaaggaaagagaagaagaatttaaaactcaccatgaaatgaaagaatactcaggctttgcaggagttagccgaccacgaggaaccttttttcgaattagaggcagaggaagagccagaggagtttttgctgggacaaatactggtccaaacaactcaaatactacttttcaaaagagaccgaaggaagaggaatgggatccagaatataccccaaagagcaagaagtacttcttgcatgacgacagagatgatggtgtggattattgggccaaaagaggaagaggtcgtggtacttttcaacgtggcagagggcgctttaacttcaaaaaatcaggtagcagtcctaaatggactcatgacaaataccaaggggatgggattgttgaagatgaagaagagaccatggaaaataatgaagaaaagaaggacagacgcaaggaagaaaaggaataataaatatgaagtaagattacaacagagcagaacttgcacccaccattttttttacctgatttttgttttcaaataagaatgtaagcattttacttaaattttactgtttgcaagtagtctatagaaattttgttttaagtcttcaaatatcttgagaaatagtagactgtatgttgaaaattgtactgaaataaagtagaaaattgttacgtaccatatttgtaactatcaacttttaaaacttttaacgtttttgttacatgcattgtaattctgctttgtctataagatatggtcaagtacagctctgtgaaagttctgattctcttccttccctgtttgtcaatgttttattctgaagtaaacgttagctctacatataaatcctggaacagaaattgtttatagagactacactaattattttaactgtatacatctgtttaatttgaacacactacatcgtagggtgactgatttttgaagtataccacagacaaaaagttgttactatggtaaactaagctagtttaacacttgagcaaatgcttaagaaggaattaaaaaaaaaaagctttgccaatagctaaaaagtacaagctattaaaaatcagattgaaaagttttgagaaaatgttatttttactgaaagcaagcagtggcctataaagaacattcttaggagccttttctatttgcgttcaaaactgtgtgttctctttctattcctatttgatagtttgagtcatggtcttagatattagctatttgtgagaggaaactggtttgtaacaatactgcaaatagaaaccccatttctactgaacatcctagttttaaacagaagaaaaactgtaatcctggggttggtatgtaggaggtctatcctgcagaataagttgatacattagtacctgatttcatatcttacatatttatttgagctgaacattagtttgtagtgtaactattagtaaaaatagagaaacacagcatactgttcattaatagtattttaaaaaaattgtttttcaaatgtcaccaataaaagttttggcaggaagcttgttgcggcattgatctaacctttttcccccccatttcagttgcagtttttgtagaatggctttttctttttcctcttaagagttctattcttcaggtagataatttttcaaatgtgaattatcttttgtgtctatattgatagctcttaaaggagtgaaaatctaaaatagtaaatttcaatgttaagtgtctgctttatgggcatatataaaagtagacacatttcatttgttaatttagttgtgtgtgtgtgttaaaaggagctaatgcttattctgttaatgtaaacttttgaagatcttaagtgtattgctctttcatcttaaacactttcgaggatttgcagtgcgtctagcacctagattacagccaggaacattggttaagaactgttggaaacaaaactaaaagcaaactcaacatatgtgatgtttatggccctcagatccttagtattgtgtgattttcccccgttaacatgtctttctaaaattgtctattaaagcagaggaaatacctgccaaaggaagtatgtattgcattaatcagggcataactaatattctcctgttcagaataatacttatttacgtgtgaaagcaacatggatgtgattcccaacacagaattttcatgacccttttattgtatacaaataaataccataacagttacttggttagacatcaaatctgtgtgcatgactatgtgcttatccacttaagacaataggtaaaaggggatctgagaaattatgtaatagggagtgggaataaaactacttaattcctgtgggcaggttatattttaagttcaaatgcattgctttaacctttggttacttttattctgttaaacagaattgaagaaagagtattataccagagtgtagtaggctagggtgattgtaagaactctgtaatagaatgtcattgtggatgttacctttttcagatccaagcatataaaaagcctgtatattttttaaaaacacatcttaactccacgctttacgatattataaaagttgaatggttcctcttggtaaggatatttgcttacaagtgctaggaaataactcactgatacctgcgttaacatactttgttttgcctagagaggggcaataaaaatgaaccaaaggatatttccagaaaggattaagaaagctgtttaagaaggccatgactctttaggtgtgtatgtgtacctttcagcatcctaggaatttttatactaaaagcaaaatgttttttccagttagtcttcttcaaggaattactattgttccttttgtcacaggtaaaatcagtgttgggaattataatttgagaaaaatattacccagtaacattgaatgtagatggctaaacgattcttactcagtgtgatgtataatgatgcaacagggacccttgtaaattgtcatacgccaataaaatgtcacaagtaa

SEQ ID NO: 315147 - DNA, 4014 bp, Homo sapiens
tttgctgttgggtttgccaagatgccagatttttggagtaattattgaatgttaattgatttaaaaatatttttccaatttgggtgataatattcagtgtttttataaatccatttttgttgatatggcagcatatagtcactgatgaaatttaatagttgacccaaacaagctttttagttaactccatattttcctgtttttttgttttctgcaaatgattacttgaagtaatgtcattggttcatattggcaaggtattagagcatccatagattatgttcctttttgttctgaggaagtagtgtattaatgaagtggaattagagactcttgatttaatctattaattgctcttggattagatgtagtattgacagggacctgtgagcaactttcgaaacactctcctgttgaggtacaagaaattgaaagggtaggagttccttgtaacacttgattctcttttgctaggtttcttatttttattttcttttcacctgctacatgcccttctgtcacaaacaaatctctcttaaagtaaagttaactaatcggacagtatttcttctaaatcaacagagcaatacttcaagtcagctgcaatgaccctaaacgagcggttcacttcgtatcagaaagccactgaagaacatagtactcggcaaaagagccctgaaatacacaggagaattgacatctcaccaagtaccctgaggaagcatacccgtttagcaggggaagagagagtttttaaagaagaaaatcaaaagggagataaaaaattaaggtgtgactctgctgaccttcggcatgacattgatcgccgtagaaaagaaagaagtaaagaacggggagattccaagggctccagggaatccagtggatcaagaaagcaggaaaaaactccaaaagattacaaggaatacaaatcttacaaagatgacagtaaacataaaagagagcaagatcattctcgatcttcatcctcttcagcatcaccttcttctcccagttctcgagaagaaaaggagagtaagaaggaaagagaagaagaatttaaaactcaccatgaaatgaaagaatactcaggctttgcaggagttagccgaccacgaggaaccttttttcgaattagaggcagaggaagagccagaggagtttttgctgggacaaatactggtccaaacaactcaaatactacttttcaaaagagaccgaaggaagaggaatgggatccagaatataccccaaagagcaagaagtacttcttgcatgacgacagagatgatggtgtggattattgggccaaaagaggaagaggtcgtggtacttttcaacgtggcagagggcgctttaacttcaaaaaatcaggtagcagtcctaaatggactcatgacaaataccaaggggatgggattgttgaagatgaagaagagaccatggaaaataatgaagaaaagaaggacagacgcaaggaagaaaaggaataataaatatgaagtaagattacaacagagcagaacttgcacccaccattttttttacctgatttttgttttcaaataagaatgtaagcattttacttaaattttactgtttgcaagtagtctatagaaattttgttttaagtcttcaaatatcttgagaaatagtagactgtatgttgaaaattgtactgaaataaagtagaaaattgttacgtaccatatttgtaactatcaacttttaaaacttttaacgtttttgttacatgcattgtaattctgctttgtctataagatatggtcaagtacagctctgtgaaagttctgattctcttccttccctgtttgtcaatgttttattctgaagtaaacgttagctctacatataaatcctggaacagaaattgtttatagagactacactaattattttaactgtatacatctgtttaatttgaacacactacatcgtagggtgactgatttttgaagtataccacagacaaaaagttgttactatggtaaactaagctagtttaacacttgagcaaatgcttaagaaggaattaaaaaaaaaaagctttgccaatagctaaaaagtacaagctattaaaaatcagattgaaaagttttgagaaaatgttatttttactgaaagcaagcagtggcctataaagaacattcttaggagccttttctatttgcgttcaaaactgtgtgttctctttctattcctatttgatagtttgagtcatggtcttagatattagctatttgtgagaggaaactggtttgtaacaatactgcaaatagaaaccccatttctactgaacatcctagttttaaacagaagaaaaactgtaatcctggggttggtatgtaggaggtctatcctgcagaataagttgatacattagtacctgatttcatatcttacatatttatttgagctgaacattagtttgtagtgtaactattagtaaaaatagagaaacacagcatactgttcattaatagtattttaaaaaaattgtttttcaaatgtcaccaataaaagttttggcaggaagcttgttgcggcattgatctaacctttttcccccccatttcagttgcagtttttgtagaatggctttttctttttcctcttaagagttctattcttcaggtagataatttttcaaatgtgaattatcttttgtgtctatattgatagctcttaaaggagtgaaaatctaaaatagtaaatttcaatgttaagtgtctgctttatgggcatatataaaagtagacacatttcatttgttaatttagttgtgtgtgtgtgttaaaaggagctaatgcttattctgttaatgtaaacttttgaagatcttaagtgtattgctctttcatcttaaacactttcgaggatttgcagtgcgtctagcacctagattacagccaggaacattggttaagaactgttggaaacaaaactaaaagcaaactcaacatatgtgatgtttatggccctcagatccttagtattgtgtgattttcccccgttaacatgtctttctaaaattgtctattaaagcagaggaaatacctgccaaaggaagtatgtattgcattaatcagggcataactaatattctcctgttcagaataatacttatttacgtgtgaaagcaacatggatgtgattcccaacacagaattttcatgacccttttattgtatacaaataaataccataacagttacttggttagacatcaaatctgtgtgcatgactatgtgcttatccacttaagacaataggtaaaaggggatctgagaaattatgtaatagggagtgggaataaaactacttaattcctgtgggcaggttatattttaagttcaaatgcattgctttaacctttggttacttttattctgttaaacagaattgaagaaagagtattataccagagtgtagtaggctagggtgattgtaagaactctgtaatagaatgtcattgtggatgttacctttttcagatccaagcatataaaaagcctgtatattttttaaaaacacatcttaactccacgctttacgatattataaaagttgaatggttcctcttggtaaggatatttgcttacaagtgctaggaaataactcactgatacctgcgttaacatactttgttttgcctagagaggggcaataaaaatgaaccaaaggatatttccagaaaggattaagaaagctgtttaagaaggccatgactctttaggtgtgtatgtgtacctttcagcatcctaggaatttttatactaaaagcaaaatgttttttccagttagtcttcttcaaggaattactattgttccttttgtcacaggtaaaatcagtgttgggaattataatttgagaaaaatattacccagtaacattgaatgtagatggctaaacgattcttactcagtgtgatgtataatgatgcaacagggacccttgtaaattgtcatacgccaataaaatgtcacaagtaa

SEQ ID NO: 315148 - DNA, 5406 bp, Homo sapiens
tagcggcacccgaggccacgccccgagatcggaagtgacggagacgtgctagcgcgtcgaaggtagctctatggttttcctcgcgttcttgagtcgggaaatggccgctgtgtggttgcaacggagataaattcccggaaccgcgattcggcgtgtcaggaattcgaatttagagtttaatttctcagagcattctctccaggaagaatttttacagtatctcaaagacttcacttgacttcttgatcctgcataaaaccaaggagaaaagaaatgggtcgctccaattctagatcacattcttcaaggtcaaagtctagatcacagtctagttctcgatcaagatcaagatctcattctagaaagaagcgatacagttctaggtctcgttccagaacatattcaaggtctcgtagtagagatcgtatgtattctagagattatcgtcgcgattacagaaataatagaggaatgagacgaccttatgggtacagaggaaggggtagagggtattatcaaggaggaggaggtagatatcatcgaggtggttatagacctgtctggaatagaaggcactctaggagtcctagacgaggtcgttcacgttccaggagtccaaaaagaagatccgtttcttctcaaagatccagaagcagatctcgccggtcatatagatcttctaggtctccaagatcatcctcttctcgttcttcatccccatatagcaaatctcctgtttctaaaagacgagggtctcaggaaaaacaaaccaaaaaagctgaaggggaaccccaagaagagagtccgttgaaaagtaaatcacaggaggaaccgaaagatacatttgaacatgacccatctgagtctatcgatgaatttaataagtcatcagccacatccggtgatatttggcctggcctttcagcttatgataatagtcctagatcaccccatagtccttcacctattgctacaccacctagtcagagttcatcttgctctgatgctcccatgctcagtacagttcactctgcaaaaaatactccttctcagcattcacattccattcagcatagtcctgaaaggtctgggtctggttctgttggaaatggatctagtcgatacagtccttctcagaatagtccaattcatcacatcccttcacgaagaagtcctgcaaagacaatcgcaccacagaatgctccaagagatgagtctaggggccgttcctcgttttatcctgatggtggagatcaggaaactgcaaagactgggaagttcttaaaaaggttcacagatgaagagtctagagtattcctgcttgataggggtaataccagggataaagaggcttcaaaagagaaaggatcagagaaagggagggcagagggagaatgggaagatcaggaagctctagattacttcagtgataaagagtctggaaaacaaaagtttaatgattcagaaggggatgacacagaggagacagaggattatagacagttcaggaagtcagtcctcgcagatcagggtaaaagttttgctactgcatctcaccggaatactgaggaggaaggactcaagtacaagtccaaagtttcactgaaaggcaatagagaaagtgatggatttagagaagaaaaaaattataaacttaaagagactggatatgtagtggaaaggcctagcactacaaaagataagcacaaagaagaagacaaaaattctgaaagaataacagtaaagaaagaaactcagtcacctgagcaggtaaagtctgaaaagctcaaagacctctttgattacagtccccctctacacaagaatctggatgcacgagaaaagtctaccttcagagaggaaagcccacttaggatcaaaatgatagcgagtgattctcaccgtcctgaagtcaaactcaaaatggcacctgttcctcttgatgattctaacagacctgcttccttgactaaagacaggctgcttgctagtacacttgtccattctgtcaagaaggagcaagaattccgatccatctttgaccacattaagttgccacaggccagcaaaagcacttcagagtcatttattcaacacattgtgtccttggttcatcatgttaaagagcaatacttcaagtcagctgcaatgaccctaaacgagcggttcacttcgtatcagaaagccactgaagaacatagtactcggcaaaagagccctgaaatacacaggagaattgacatctcaccaagtaccctgaggaagcatacccgtttagcaggggaagagagagtttttaaagaagaaaatcaaaagggagataaaaaattaaggtgtgactctgctgaccttcggcatgacattgatcgccgtagaaaagaaagaagtaaagaacggggagattccaagggctccagggaatccagtggatcaagaaagcaggaaaaaactccaaaagattacaaggaatacaaatcttacaaagatgacagtaaacataaaagagagcaagatcattctcgatcttcatcctcttcagcatcaccttcttctcccagttctcgagaagaaaaggagagtaagaaggaaagagaagaagaatttaaaactcaccatgaaatgaaagaatactcaggctttgcaggagttagccgaccacgaggaacctttcatgacgacagagatgatggtgtggattattgggccaaaagaggaagaggtcgtggtacttttcaacgtggcagagggcgctttaacttcaaaaaatcaggtagcagtcctaaatggactcatgacaaataccaaggggatgggattgttgaagatgaagaagagaccatggaaaataatgaagaaaagaaggacagacgcaaggaagaaaaggaataataaatatgaagtaagattacaacagagcagaacttgcacccaccattttttttacctgatttttgttttcaaataagaatgtaagcattttacttaaattttactgtttgcaagtagtctatagaaattttgttttaagtcttcaaatatcttgagaaatagtagactgtatgttgaaaattgtactgaaataaagtagaaaattgttacgtaccatatttgtaactatcaacttttaaaacttttaacgtttttgttacatgcattgtaattctgctttgtctataagatatggtcaagtacagctctgtgaaagttctgattctcttccttccctgtttgtcaatgttttattctgaagtaaacgttagctctacatataaatcctggaacagaaattgtttatagagactacactaattattttaactgtatacatctgtttaatttgaacacactacatcgtagggtgactgatttttgaagtataccacagacaaaaagttgttactatggtaaactaagctagtttaacacttgagcaaatgcttaagaaggaattaaaaaaaaaaagctttgccaatagctaaaaagtacaagctattaaaaatcagattgaaaagttttgagaaaatgttatttttactgaaagcaagcagtggcctataaagaacattcttaggagccttttctatttgcgttcaaaactgtgtgttctctttctattcctatttgatagtttgagtcatggtcttagatattagctatttgtgagaggaaactggtttgtaacaatactgcaaatagaaaccccatttctactgaacatcctagttttaaacagaagaaaaactgtaatcctggggttggtatgtaggaggtctatcctgcagaataagttgatacattagtacctgatttcatatcttacatatttatttgagctgaacattagtttgtagtgtaactattagtaaaaatagagaaacacagcatactgttcattaatagtattttaaaaaaattgtttttcaaatgtcaccaataaaagttttggcaggaagcttgttgcggcattgatctaacctttttcccccccatttcagttgcagtttttgtagaatggctttttctttttcctcttaagagttctattcttcaggtagataatttttcaaatgtgaattatcttttgtgtctatattgatagctcttaaaggagtgaaaatctaaaatagtaaatttcaatgttaagtgtctgctttatgggcatatataaaagtagacacatttcatttgttaatttagttgtgtgtgtgtgttaaaaggagctaatgcttattctgttaatgtaaacttttgaagatcttaagtgtattgctctttcatcttaaacactttcgaggatttgcagtgcgtctagcacctagattacagccaggaacattggttaagaactgttggaaacaaaactaaaagcaaactcaacatatgtgatgtttatggccctcagatccttagtattgtgtgattttcccccgttaacatgtctttctaaaattgtctattaaagcagaggaaatacctgccaaaggaagtatgtattgcattaatcagggcataactaatattctcctgttcagaataatacttatttacgtgtgaaagcaacatggatgtgattcccaacacagaattttcatgacccttttattgtatacaaataaataccataacagttacttggttagacatcaaatctgtgtgcatgactatgtgcttatccacttaagacaataggtaaaaggggatctgagaaattatgtaatagggagtgggaataaaactacttaattcctgtgggcaggttatattttaagttcaaatgcattgctttaacctttggttacttttattctgttaaacagaattgaagaaagagtattataccagagtgtagtaggctagggtgattgtaagaactctgtaatagaatgtcattgtggatgttacctttttcagatccaagcatataaaaagcctgtatattttttaaaaacacatcttaactccacgctttacgatattataaaagttgaatggttcctcttggtaaggatatttgcttacaagtgctaggaaataactcactgatacctgcgttaacatactttgttttgcctagagaggggcaataaaaatgaaccaaaggatatttccagaaaggattaagaaagctgtttaagaaggccatgactctttaggtgtgtatgtgtacctttcagcatcctaggaatttttatactaaaagcaaaatgttttttccagttagtcttcttcaaggaattactattgttccttttgtcacaggtaaaatcagtgttggcgcgataacatcacgtatcttatcccctacacgcaccttgaatacaaccaaatctcagttttacttttcacttaatatctgtgatgatacagccaaaaaaattttttttattaagtttggcgatacttacg

SEQ ID NO: 315149 - DNA, 6873 bp, Homo sapiens
tagcggcacccgaggccacgccccgagatcggaagtgacggagacgtgctagcgcgtcgaaggtagctctatggttttcctcgcgttcttgagtcgggaaatggccgctgtgtggttgcaacggagataaattcccggaaccgcgattcggcgtgtcaggaattcgaatttagagtttaatttctcagagcattctctccaggaagaatttttacagtatctcaaagacttcacttgacttcttgatcctgcataaaaccaaggagaaaagaaatgggtcgctccaattctagatcacattcttcaaggtcaaagtctagatcacagtctagttctcgatcaagatcaagatctcattctagaaagaagcgatacagttctaggtctcgttccagaacatattcaaggtctcgtagtagagatcgtatgtattctagagattatcgtcgcgattacagaaataatagaggaatgagacgaccttatgggtacagaggaaggggtagagggtattatcaaggaggaggaggtagatatcatcgaggtggttatagacctgtctggaatagaaggcactctaggagtcctagacgaggtcgttcacgttccaggagtccaaaaagaagatccgtttcttctcaaagatccagaagcagatctcgccggtcatatagatcttctaggtctccaagatcatcctcttctcgttcttcatccccatatagcaaatctcctgtttctaaaagacgagggtctcaggaaaaacaaaccaaaaaagctgaaggggaaccccaagaagagagtccgttgaaaagtaaatcacaggaggaaccgaaagatacatttgaacatgacccatctgagtctatcgatgaatttaataagtcatcagccacatccggtgatatttggcctggcctttcagcttatgataatagtcctagatcaccccatagtccttcacctattgctacaccacctagtcagagttcatcttgctctgatgctcccatgctcagtacagttcactctgcaaaaaatactccttctcagcattcacattccattcagcatagtcctgaaaggtctgggtctggttctgttggaaatggatctagtcgatacagtccttctcagaatagtccaattcatcacatcccttcacgaagaagtcctgcaaagacaatcgcaccacagaatgctccaagagatgagtctaggggccgttcctcgttttatcctgatggtggagatcaggaaactgcaaagactgggaagttcttaaaaaggttcacagatgaagagtctagagtattcctgcttgataggggtaataccagggataaagaggcttcaaaagagaaaggatcagagaaagggagggcagagggagaatgggaagatcaggaagctctagattacttcagtgataaagagtctggaaaacaaaagtttaatgattcagaaggggatgacacagaggagacagaggattatagacagttcaggaagtcagtcctcgcagatcagggtaaaagttttgctactgcatctcaccggaatactgaggaggaaggactcaagtacaagtccaaagtttcactgaaaggcaatagagaaagtgatggatttagagaagaaaaaaattataaacttaaagagactggatatgtagtggaaaggcctagcactacaaaagataagcacaaagaagaagacaaaaattctgaaagaataacagtaaagaaagaaactcagtcacctgagcaggtaaagtctgaaaagctcaaagacctctttgattacagtccccctctacacaagaatctggatgcacgagaaaagtctaccttcagagaggaaagcccacttaggatcaaaatgatagcgagtgattctcaccgtcctgaagtcaaactcaaaatggcacctgttcctcttgatgattctaacagacctgcttccttgactaaagacaggctgcttgctagtacacttgtccattctgtcaagaaggagcaagaattccgatccatctttgaccacattaagttgccacaggccagcaaaagcacttcagagtcatttattcaacacattgtgtccttggttcatcatgttaaagagcaatacttcaagtcagctgcaatgaccctaaacgagcggttcacttcgtatcagaaagccactgaagaacatagtactcggcaaaagagccctgaaatacacaggagaattgacatctcaccaagtaccctgaggaagcatacccgtttagcaggggaagagagagtttttaaagaagaaaatcaaaagggagataaaaaattaaggtgtgactctgctgaccttcggcatgacattgatcgccgtagaaaagaaagaagtaaagaacggggagattccaagggctccagggaatccagtggatcaagaaagcaggaaaaaactccaaaagattacaaggaatacaaatcttacaaagatgacagtaaacataaaagagagcaagatcattctcgatcttcatcctcttcagcatcaccttcttctcccagttctcgagaagaaaaggagagtaagaaggaaagagaagaagaatttaaaactcaccatgaaatgaaagaatactcaggctttgcaggagttagccgaccacgaggaacctttcatgacgacagagatgatggtgtggattattgggccaaaagaggaagaggtcgtggtacttttcaacgtggcagagggcgctttaacttcaaaaaatcaggtagcagtcctaaatggactcatgacaaataccaaggggatgggattgttgaagatgaagaagagaccatggaaaataatgaagaaaagaaggacagacgcaaggaagaaaaggaataataaatatgaagtaagattacaacagagcagaacttgcacccaccattttttttacctgatttttgttttcaaataagaatgtaagcattttacttaaattttactgtttgcaagtagtctatagaaattttgttttaagtcttcaaatatcttgagaaatagtagactgtatgttgaaaattgtactgaaataaagtagaaaattgttacgtaccatatttgtaactatcaacttttaaaacttttaacgtttttgttacatgcattgtaattctgctttgtctataagatatggtcaagtacagctctgtgaaagttctgattctcttccttccctgtttgtcaatgttttattctgaagtaaacgttagctctacatataaatcctggaacagaaattgtttatagagactacactaattattttaactgtatacatctgtttaatttgaacacactacatcgtagggtgactgatttttgaagtataccacagacaaaaagttgttactatggtaaactaagctagtttaacacttgagcaaatgcttaagaaggaattaaaaaaaaaaagctttgccaatagctaaaaagtacaagctattaaaaatcagattgaaaagttttgagaaaatgttatttttactgaaagcaagcagtggcctataaagaacattcttaggagccttttctatttgcgttcaaaactgtgtgttctctttctattcctatttgatagtttgagtcatggtcttagatattagctatttgtgagaggaaactggtttgtaacaatactgcaaatagaaaccccatttctactgaacatcctagttttaaacagaagaaaaactgtaatcctggggttggtatgtaggaggtctatcctgcagaataagttgatacattagtacctgatttcatatcttacatatttatttgagctgaacattagtttgtagtgtaactattagtaaaaatagagaaacacagcatactgttcattaatagtattttaaaaaaattgtttttcaaatgtcaccaataaaagttttggcaggaagcttgttgcggcattgatctaacctttttcccccccatttcagttgcagtttttgtagaatggctttttctttttcctcttaagagttctattcttcaggtagataatttttcaaatgtgaattatcttttgtgtctatattgatagctcttaaaggagtgaaaatctaaaatagtaaatttcaatgttaagtgtctgctttatgggcatatataaaagtagacacatttcatttgttaatttagttgtgtgtgtgtgttaaaaggagctaatgcttattctgttaatgtaaacttttgaagatcttaagtgtattgctctttcatcttaaacactttcgaggatttgcagtgcgtctagcacctagattacagccaggaacattggttaagaactgttggaaacaaaactaaaagcaaactcaacatatgtgatgtttatggccctcagatccttagtattgtgtgattttcccccgttaacatgtctttctaaaattgtctattaaagcagaggaaatacctgccaaaggaagtatgtattgcattaatcagggcataactaatattctcctgttcagaataatacttatttacgtgtgaaagcaacatggatgtgattcccaacacagaattttcatgacccttttattgtatacaaataaataccataacagttacttggttagacatcaaatctgtgtgcatgactatgtgcttatccacttaagacaataggtaaaaggggatctgagaaattatgtaatagggagtgggaataaaactacttaattcctgtgggcaggttatattttaagttcaaatgcattgctttaacctttggttacttttattctgttaaacagaattgaagaaagagtattataccagagtgtagtaggctagggtgattgtaagaactctgtaatagaatgtcattgtgtgtatgtgtacctttcagcatcctaggaatttttatactaaaagcaaaatgttttttccagttagtcttcttcaaggaattactattgttccttttgtcacaggtaaaatcagtgttgggaattataatttgagaaaaatattacccagtaacattgaatgtagatggctaaacgattcttactcagtgtgatgtataatgatgcaacagggacccttgtaaattgtcatacgccaataaaatgtcacaagtaataactgctgttgtttgtttacctgtgtctatttcacacatcttatttctgtggcctattttagaatatcagcgcatctgttaggaagattactggtgtggtaaggcttgataaatgctttataaactccctcaaacctttctttactgtttttttgttttgtcttgtttttgtttttgtttttgtttttgttttttcccttgtctcccctgggaaaatgggaaattttacagttggtaaatctaagccaaaattattttgaaataaaggaattctggatgtccagtttagtcctcgttttcttacgttaatctgggaccttatcacccataatatggtgattacttctctttctaaaaacatagtagctagtaaataagtaaaaagaattgtcttttcattcactttaagtaagatgtggtataattcttaccatgtgccatcctgtcagttttaacaaagcattttcacagaaatttgtgtactaagacaaactgacacattttgactcatacaaatggcaaattagtccttaaaaattctgtgagagaaataactctgtgtgtacatacatatgcatgtaaagtgttgtgtaagatcattggtagcttaattatactggataattgtaatgttatatacaaatttcttatataaaagtatgctgcattattaacatttgtttaacttttcttatttttctttttctgggtttcaactggaatcccattggtggggatgtaccttaagtttccttgtggaataatagactttcacatccagaaagagaagttcagaggcctttctcaatttacagagttgaagaggaaaggcaaatggaggaataaacttcattgtcattgggattaatttggctagactcaatctcttgagccctaaaatgagaaagtaatatccattacatgtttagagttctcaaatagttgatactattattaaatgtttcaaattttattggggtagatactaaaaattagtacactgtcctaatgaagtttaaatgaacaagttttacatttcttaggattcaggaatatatggaatctagttgtatttaattgacttgagagccacagagattgtgttgatttatgagctggactcctattgttttagaaacatgcagtaatgattaacttgtgtcaatgatggtaatgagaccaaacttgtacatttaattaagggtaccagttctttttatgttactagactataccttggcctttaaaaatgaatctcactgattaaagagaacaggcattattaggatagcattccaccacaactagaaacattcaaataatgtgtcttaattgtaatctgtatataggaaaatttttcctatggatatttttggtgttttaccacagtgaactgatttgtagcacttatgaagtgcagaaggtaatattcttgaaaatagaaaaaggttgggtgagcaggctttaatgcctttcccccaagaatatacatcgaatttttcttaatcttttggggttggccagcttccagatttcattaataatgagctctgcctttaataaaagtacatgatcatagctacactgtatgtttaggtggtgtgaaatgatttataatcacagcttgaactgtgtttgcttggtactgtcatagtgattacaaatttcatggaatgcgaagagcaacaataaataaaaaataccactcaccctccagaatagtg

SEQ ID NO: 315150 - DNA, 3346 bp, Homo sapiens
  misc_feature (325)..(325): n is a, c, g, or t
cggggcgcgcaaaatttcgaaaattctgagggcgctctcctttgtggagaactcccctcgcggtttaaatagaagacctcccctgagttatttagccccctctctgagaactcctccccactcttgtgggagatttttgttctccaaaaaaaacacgcctcctgggtgtgtctccccccccgggcgcgcgcttttttatataactctggtgtgagagaaaaatccccaacacccaccctgtttgtgctctcttggcccccgggtgttctctctctgggaacacccgtctttggcgccacatgtgttcgccttgatcacctcctgnggtgcccgcgcgcggcgcccacacccgaagtgggtctcttcaaacagagtcttcttcggaggtcccagggcgcgcgccgcagcaaagcttttttttgttcttctttgtttgtttgcttcgtgttggccccatatccacaccatcatctctgtcgtcatgcaagaagtacttcttgtgggacaaatactggtccaaacaactcaaatactacttttcaaaagagaccgaaggaagaggaatgggatccagaatataccccaaagagcaagaagtacttcttgcatgacgacagagatgatggtgtggattattgggccaaaagaggaagaggtcgtggtacttttcaacgtggcagagggcgctttaacttcaaaaaatcaggtagcagtcctaaatggactcatgacaaataccaaggggatgggattgttgaagatgaagaagagaccatggaaaataatgaagaaaagaaggacagacgcaaggaagaaaaggaataataaatatgaagtaagattacaacagagcagaacttgcacccaccattttttttacctgatttttgttttcaaataagaatgtaagcattttacttaaattttactgtttgcaagtagtctatagaaattttgttttaagtcttcaaatatcttgagaaatagtagactgtatgttgaaaattgtactgaaataaagtagaaaattgttacgtaccatatttgtaactatcaacttttaaaacttttaacgtttttgttacatgcattgtaattctgctttgtctataagatatggtcaagtacagctctgtgaaagttctgattctcttccttccctgtttgtcaatgttttattctgaagtaaacgttagctctacatataaatcctggaacagaaattgtttatagagactacactaattattttaactgtatacatctgtttaatttgaacacactacatcgtagggtgactgatttttgaagtataccacagacaaaaagttgttactatggtaaactaagctagtttaacacttgagcaaatgcttaagaaggaattaaaaaaaaaaagctttgccaatagctaaaaagtacaagctattaaaaatcagattgaaaagttttgagaaaatgttatttttactgaaagcaagcagtggcctataaagaacattcttaggagccttttctatttgcgttcaaaactgtgtgttctctttctattcctatttgatagtttgagtcatggtcttagatattagctatttgtgagaggaaactggtttgtaacaatactgcaaatagaaaccccatttctactgaacatcctagttttaaacagaagaaaaactgtaatcctggggttggtatgtaggaggtctatcctgcagaataagttgatacattagtacctgatttcatatcttacatatttatttgagctgaacattagtttgtagtgtaactattagtaaaaatagagaaacacagcatactgttcattaatagtattttaaaaaaattgtttttcaaatgtcaccaataaaagttttggcaggaagcttgttgcggcattgatctaacctttttcccccccatttcagttgcagtttttgtagaatggctttttctttttcctcttaagagttctattcttcaggtagataatttttcaaatgtgaattatcttttgtgtctatattgatagctcttaaaggagtgaaaatctaaaatagtaaatttcaatgttaagtgtctgctttatgggcatatataaaagtagacacatttcatttgttaatttagttgtgtgtgtgtgttaaaaggagctaatgcttattctgttaatgtaaacttttgaagatcttaagtgtattgctctttcatcttaaacactttcgaggatttgcagtgcgtctagcacctagattacagccaggaacattggttaagaactgttggaaacaaaactaaaagcaaactcaacatatgtgatgtttatggccctcagatccttagtattgtgtgattttcccccgttaacatgtctttctaaaattgtctattaaagcagaggaaatacctgccaaaggaagtatgtattgcattaatcagggcataactaatattctcctgttcagaataatacttatttacgtgtgaaagcaacatggatgtgattcccaacacagaattttcatgacccttttattgtatacaaataaataccataacagttacttggttagacatcaaatctgtgtgcatgactatgtgcttatccacttaagacaataggtaaaaggggatctgagaaattatgtaatagggagtgggaataaaactacttaattcctgtgggcaggttatattttaagttcaaatgcattgctttaacctttggttacttttattctgttaaacagaattgaagaaagagtattataccagagtgtagtaggctagggtgattgtaagaactctgtaatagaatgtcattgtggatgttacctttttcagatccaagcatataaaaagcctgtatattttttaaaaacacatcttaactccacgctttacgatattataaaagttgaatggttcctcttggtaaggatatttgcttacaagtgctaggaaataactcactgatacctgcgttaacatactttgttttgcctagagaggggcaataaaaatgaaccaaaggatatttccagaaaggattaagaaagctgtttaagaaggccatgactctttaggtgtgtatgtgtacctttcagcatcctaggaatttttatactaaaagcaaaatgttttttccagttagtcttcttcaaggaattactattgttccttttgtcacaggtaaaatcagtgttgggaattataatttgagaaaaatattacccagtaacattgaatgtagatggctaaacgattcttactcagtgtgatgtataatgatgcaacagggacccttgtaaattgtcatacgccaataaaatgtcacaagtaa

SEQ ID NO: 315151 - DNA, 2805 bp, Homo sapiens
  misc_feature (63)..(63): n is a, c, g, or t
  misc_feature (65)..(65): n is a, c, g, or t
atcggacgaatgttgagactgcggagaatccagggaacagaatcaggccttgcatggaacacngncatgacgacagagatgatggtgtggattattgggccaaaagaggaagaggtcgtggtacttttcaacgtggcagagggcgctttaacttcaaaaaatcaggtagcagtcctaaatggactcatgacaaataccaaggggatgggattgttgaagatgaagaagagaccatggaaaataatgaagaaaagaaggacagacgcaaggaagaaaaggaataataaatatgaagtaagattacaacagagcagaacttgcacccaccattttttttacctgatttttgttttcaaataagaatgtaagcattttacttaaattttactgtttgcaagtagtctatagaaattttgttttaagtcttcaaatatcttgagaaatagtagactgtatgttgaaaattgtactgaaataaagtagaaaattgttacgtaccatatttgtaactatcaacttttaaaacttttaacgtttttgttacatgcattgtaattctgctttgtctataagatatggtcaagtacagctctgtgaaagttctgattctcttccttccctgtttgtcaatgttttattctgaagtaaacgttagctctacatataaatcctggaacagaaattgtttatagagactacactaattattttaactgtatacatctgtttaatttgaacacactacatcgtagggtgactgatttttgaagtataccacagacaaaaagttgttactatggtaaactaagctagtttaacacttgagcaaatgcttaagaaggaattaaaaaaaaaaagctttgccaatagctaaaaagtacaagctattaaaaatcagattgaaaagttttgagaaaatgttatttttactgaaagcaagcagtggcctataaagaacattcttaggagccttttctatttgcgttcaaaactgtgtgttctctttctattcctatttgatagtttgagtcatggtcttagatattagctatttgtgagaggaaactggtttgtaacaatactgcaaatagaaaccccatttctactgaacatcctagttttaaacagaagaaaaactgtaatcctggggttggtatgtaggaggtctatcctgcagaataagttgatacattagtacctgatttcatatcttacatatttatttgagctgaacattagtttgtagtgtaactattagtaaaaatagagaaacacagcatactgttcattaatagtattttaaaaaaattgtttttcaaatgtcaccaataaaagttttggcaggaagcttgttgcggcattgatctaacctttttcccccccatttcagttgcagtttttgtagaatggctttttctttttcctcttaagagttctattcttcaggtagataatttttcaaatgtgaattatcttttgtgtctatattgatagctcttaaaggagtgaaaatctaaaatagtaaatttcaatgttaagtgtctgctttatgggcatatataaaagtagacacatttcatttgttaatttagttgtgtgtgtgtgttaaaaggagctaatgcttattctgttaatgtaaacttttgaagatcttaagtgtattgctctttcatcttaaacactttcgaggatttgcagtgcgtctagcacctagattacagccaggaacattggttaagaactgttggaaacaaaactaaaagcaaactcaacatatgtgatgtttatggccctcagatccttagtattgtgtgattttcccccgttaacatgtctttctaaaattgtctattaaagcagaggaaatacctgccaaaggaagtatgtattgcattaatcagggcataactaatattctcctgttcagaataatacttatttacgtgtgaaagcaacatggatgtgattcccaacacagaattttcatgacccttttattgtatacaaataaataccataacagttacttggttagacatcaaatctgtgtgcatgactatgtgcttatccacttaagacaataggtaaaaggggatctgagaaattatgtaatagggagtgggaataaaactacttaattcctgtgggcaggttatattttaagttcaaatgcattgctttaacctttggttacttttattctgttaaacagaattgaagaaagagtattataccagagtgtagtaggctagggtgattgtaagaactctgtaatagaatgtcattgtggatgttacctttttcagatccaagcatataaaaagcctgtatattttttaaaaacacatcttaactccacgctttacgatattataaaagttgaatggttcctcttggtaaggatatttgcttacaagtgctaggaaataactcactgatacctgcgttaacatactttgttttgcctagagaggggcaataaaaatgaaccaaaggatatttccagaaaggattaagaaagctgtttaagaaggccatgactctttaggtgtgtatgtgtacctttcagcatcctaggaatttttatactaaaagcaaaatgttttttccagttagtcttcttcaaggaattactattgttccttttgtcacaggtaaaatcagtgttgggaattataatttgagaaaaatattacccagtaacattgaatgtagatggctaaacgattcttactcagtgtgatgtataatgatgcaacagggacccttgtaaattgtcatacgccaataaaatgtcacaagtaa

SEQ ID NO: 315152 - DNA, 2798 bp, Homo sapiens
  misc_feature (38)..(38): n is a, c, g, or t
  misc_feature (40)..(40): n is a, c, g, or t
  misc_feature (42)..(42): n is a, c, g, or t
ttagttacgcggatcgcccgggcggctgggaggggttntntnctcacatgtaccacgccatgacgacagagatgatggtgtggattattgggccaaaagaggaagaggtcgtggtacttttcaacgtggcagagggcgctttaacttcaaaaaatcaggtagcagtcctaaatggactcatgacaaataccaaggggatgggattgttgaagatgaagaagagaccatggaaaataatgaagaaaagaaggacagacgcaaggaagaaaaggaataataaatatgaagtaagattacaacagagcagaacttgcacccaccattttttttacctgatttttgttttcaaataagaatgtaagcattttacttaaattttactgtttgcaagtagtctatagaaattttgttttaagtcttcaaatatcttgagaaatagtagactgtatgttgaaaattgtactgaaataaagtagaaaattgttacgtaccatatttgtaactatcaacttttaaaacttttaacgtttttgttacatgcattgtaattctgctttgtctataagatatggtcaagtacagctctgtgaaagttctgattctcttccttccctgtttgtcaatgttttattctgaagtaaacgttagctctacatataaatcctggaacagaaattgtttatagagactacactaattattttaactgtatacatctgtttaatttgaacacactacatcgtagggtgactgatttttgaagtataccacagacaaaaagttgttactatggtaaactaagctagtttaacacttgagcaaatgcttaagaaggaattaaaaaaaaaaagctttgccaatagctaaaaagtacaagctattaaaaatcagattgaaaagttttgagaaaatgttatttttactgaaagcaagcagtggcctataaagaacattcttaggagccttttctatttgcgttcaaaactgtgtgttctctttctattcctatttgatagtttgagtcatggtcttagatattagctatttgtgagaggaaactggtttgtaacaatactgcaaatagaaaccccatttctactgaacatcctagttttaaacagaagaaaaactgtaatcctggggttggtatgtaggaggtctatcctgcagaataagttgatacattagtacctgatttcatatcttacatatttatttgagctgaacattagtttgtagtgtaactattagtaaaaatagagaaacacagcatactgttcattaatagtattttaaaaaaattgtttttcaaatgtcaccaataaaagttttggcaggaagcttgttgcggcattgatctaacctttttcccccccatttcagttgcagtttttgtagaatggctttttctttttcctcttaagagttctattcttcaggtagataatttttcaaatgtgaattatcttttgtgtctatattgatagctcttaaaggagtgaaaatctaaaatagtaaatttcaatgttaagtgtctgctttatgggcatatataaaagtagacacatttcatttgttaatttagttgtgtgtgtgtgttaaaaggagctaatgcttattctgttaatgtaaacttttgaagatcttaagtgtattgctctttcatcttaaacactttcgaggatttgcagtgcgtctagcacctagattacagccaggaacattggttaagaactgttggaaacaaaactaaaagcaaactcaacatatgtgatgtttatggccctcagatccttagtattgtgtgattttcccccgttaacatgtctttctaaaattgtctattaaagcagaggaaatacctgccaaaggaagtatgtattgcattaatcagggcataactaatattctcctgttcagaataatacttatttacgtgtgaaagcaacatggatgtgattcccaacacagaattttcatgacccttttattgtatacaaataaataccataacagttacttggttagacatcaaatctgtgtgcatgactatgtgcttatccacttaagacaataggtaaaaggggatctgagaaattatgtaatagggagtgggaataaaactacttaattcctgtgggcaggttatattttaagttcaaatgcattgctttaacctttggttacttttattctgttaaacagaattgaagaaagagtattataccagagtgtagtaggctagggtgattgtaagaactctgtaatagaatgtcattgtggatgttacctttttcagatccaagcatataaaaagcctgtatattttttaaaaacacatcttaactccacgctttacgatattataaaagttgaatggttcctcttggtaaggatatttgcttacaagtgctaggaaataactcactgatacctgcgttaacatactttgttttgcctagagaggggcaataaaaatgaaccaaaggatatttccagaaaggattaagaaagctgtttaagaaggccatgactctttaggtgtgtatgtgtacctttcagcatcctaggaatttttatactaaaagcaaaatgttttttccagttagtcttcttcaaggaattactattgttccttttgtcacaggtaaaatcagtgttgggaattataatttgagaaaaatattacccagtaacattgaatgtagatggctaaacgattcttactcagtgtgatgtataatgatgcaacagggacccttgtaaattgtcatacgccaataaaatgtcacaagtaa

SEQ ID NO: 315153 - DNA, 3240 bp, Homo sapiens
  misc_feature (325)..(325): n is a, c, g, or t
cggggcgcgcaaaatttcgaaaattctgagggcgctctcctttgtggagaactcccctcgcggtttaaatagaagacctcccctgagttatttagccccctctctgagaactcctccccactcttgtgggagatttttgttctccaaaaaaaacacgcctcctgggtgtgtctccccccccgggcgcgcgcttttttatataactctggtgtgagagaaaaatccccaacacccaccctgtttgtgctctcttggcccccgggtgttctctctctgggaacacccgtctttggcgccacatgtgttcgccttgatcacctcctgnggtgcccgcgcgcggcgcccacacccgaagtgggtctcttcaaacagagtcttcttcggaggtcccagggcgcgcgccgcagcaaagcttttttttgttcttctttgtttgtttgcttcgtgttggccccatatccacaccatcatctctgtcgtcatgcaagaagtacttcttgcatgacgacagagatgatggtgtggattattgggccaaaagaggaagaggtcgtggtacttttcaacgtggcagagggcgctttaacttcaaaaaatcaggtagcagtcctaaatggactcatgacaaataccaaggggatgggattgttgaagatgaagaagagaccatggaaaataatgaagaaaagaaggacagacgcaaggaagaaaaggaataataaatatgaagtaagattacaacagagcagaacttgcacccaccattttttttacctgatttttgttttcaaataagaatgtaagcattttacttaaattttactgtttgcaagtagtctatagaaattttgttttaagtcttcaaatatcttgagaaatagtagactgtatgttgaaaattgtactgaaataaagtagaaaattgttacgtaccatatttgtaactatcaacttttaaaacttttaacgtttttgttacatgcattgtaattctgctttgtctataagatatggtcaagtacagctctgtgaaagttctgattctcttccttccctgtttgtcaatgttttattctgaagtaaacgttagctctacatataaatcctggaacagaaattgtttatagagactacactaattattttaactgtatacatctgtttaatttgaacacactacatcgtagggtgactgatttttgaagtataccacagacaaaaagttgttactatggtaaactaagctagtttaacacttgagcaaatgcttaagaaggaattaaaaaaaaaaagctttgccaatagctaaaaagtacaagctattaaaaatcagattgaaaagttttgagaaaatgttatttttactgaaagcaagcagtggcctataaagaacattcttaggagccttttctatttgcgttcaaaactgtgtgttctctttctattcctatttgatagtttgagtcatggtcttagatattagctatttgtgagaggaaactggtttgtaacaatactgcaaatagaaaccccatttctactgaacatcctagttttaaacagaagaaaaactgtaatcctggggttggtatgtaggaggtctatcctgcagaataagttgatacattagtacctgatttcatatcttacatatttatttgagctgaacattagtttgtagtgtaactattagtaaaaatagagaaacacagcatactgttcattaatagtattttaaaaaaattgtttttcaaatgtcaccaataaaagttttggcaggaagcttgttgcggcattgatctaacctttttcccccccatttcagttgcagtttttgtagaatggctttttctttttcctcttaagagttctattcttcaggtagataatttttcaaatgtgaattatcttttgtgtctatattgatagctcttaaaggagtgaaaatctaaaatagtaaatttcaatgttaagtgtctgctttatgggcatatataaaagtagacacatttcatttgttaatttagttgtgtgtgtgtgttaaaaggagctaatgcttattctgttaatgtaaacttttgaagatcttaagtgtattgctctttcatcttaaacactttcgaggatttgcagtgcgtctagcacctagattacagccaggaacattggttaagaactgttggaaacaaaactaaaagcaaactcaacatatgtgatgtttatggccctcagatccttagtattgtgtgattttcccccgttaacatgtctttctaaaattgtctattaaagcagaggaaatacctgccaaaggaagtatgtattgcattaatcagggcataactaatattctcctgttcagaataatacttatttacgtgtgaaagcaacatggatgtgattcccaacacagaattttcatgacccttttattgtatacaaataaataccataacagttacttggttagacatcaaatctgtgtgcatgactatgtgcttatccacttaagacaataggtaaaaggggatctgagaaattatgtaatagggagtgggaataaaactacttaattcctgtgggcaggttatattttaagttcaaatgcattgctttaacctttggttacttttattctgttaaacagaattgaagaaagagtattataccagagtgtagtaggctagggtgattgtaagaactctgtaatagaatgtcattgtggatgttacctttttcagatccaagcatataaaaagcctgtatattttttaaaaacacatcttaactccacgctttacgatattataaaagttgaatggttcctcttggtaaggatatttgcttacaagtgctaggaaataactcactgatacctgcgttaacatactttgttttgcctagagaggggcaataaaaatgaaccaaaggatatttccagaaaggattaagaaagctgtttaagaaggccatgactctttaggtgtgtatgtgtacctttcagcatcctaggaatttttatactaaaagcaaaatgttttttccagttagtcttcttcaaggaattactattgttccttttgtcacaggtaaaatcagtgttgggaattataatttgagaaaaatattacccagtaacattgaatgtagatggctaaacgattcttactcagtgtgatgtataatgatgcaacagggacccttgtaaattgtcatacgccaataaaatgtcacaagtaa

SEQ ID NO: 315154 - DNA, 3951 bp, Homo sapiens
tagcggcacccgaggccacgccccgagatcggaagtgacggagacgtgctagcgcgtcgaaggtagctctatggttttcctcgcgttcttgagtcgggaaatggccgctgtgtggttgcaacggagataaattcccggaaccgcgattcggcgtgtcaggaattcgaatttagagtttaatttctcagagcattctctccaggaagaatttttacagtatctcaaagacttcacttgacttcttgatcctgcataaaaccaaggagaaaagaaatgggtcgctccaattctagatcacattcttcaaggtcaaagtctagatcacagtctagttctcgatcaagatcaagatctcattctagaaagaagcgatacagttctaggtctcgttccagaacatattcaaggtctcgtagtagagatcgtatgtattctagagattatcgtcgcgattacagaaataatagaggaatgagacgaccttatgggtacagaggaaggggtagagggtattatcaaggaggaggaggtagatatcatcgaggtggttatagacctgtctggaatagaaggcactctaggagtcctagacgaggtcgttcacgttccaggagtccaaaaagaagatccgtttcttctcaaagatccagaagcagatctcgccggtcatatagatcttctaggtctccaagatcatcctcttctcgttcttcatccccatatagcaaatctcctgtttctaaaagacgagggtctcaggaaaaacaaaccaaaaaagctgaaggggaaccccaagaagagagtccgttgaaaagtaaatcacaggaggaaccgaaagatacatttgaacatgacccatctgagtctatcgatgaatttaataagtcatcagccacatccggtgatatttggcctggcctttcagcttatgataatagtcctagatcaccccatagtccttcacctattgctacaccacctagtcagagttcatcttgctctgatgctcccatgctcagtacagttcactctgcaaaaaatactccttctcagcattcacattccattcagcatagtcctgaaaggtctgggtctggttctgttggaaatggatctagtcgatacagtccttctcagaatagtccaattcatcacatcccttcacgaagaagtcctgcaaagacaatcgcaccacagaatgctccaagagatgagtctaggggccgttcctcgttttatcctgatggtggagatcaggaaactgcaaagactgggaagttcttaaaaaggttcacagatgaagagtctagagtattcctgcttgataggggtaataccagggataaagaggcttcaaaagagaaaggatcagagaaagggagggcagagggagaatgggaagatcaggaagctctagattacttcagtgataaagagtctggaaaacaaaagtttaatgattcagaaggggatgacacagaggagacagaggattatagacagttcaggaagtcagtcctcgcagatcagggtaaaagttttgctactgcatctcaccggaatactgaggaggaaggactcaagtacaagtccaaagtttcactgaaaggcaatagagaaagtgatggatttagagaagaaaaaaattataaacttaaagagactggatatgtagtggaaaggcctagcactacaaaagataagcacaaagaagaagacaaaaattctgaaagaataacagtaaagaaagaaactcagtcacctgagcaggtaaagtctgaaaagctcaaagacctctttgattacagtccccctctacacaagaatctggatgcacgagaaaagtctaccttcagagaggaaagcccacttaggatcaaaatgatagcgagtgattctcaccgtcctgaagtcaaactcaaaatggcacctgttcctcttgatgattctaacagacctgcttccttgactaaagacaggctgcttgctagtacacttgtccattctgtcaagaaggagcaagaattccgatccatctttgaccacattaagttgccacaggccagcaaaagcacttcagagtcatttattcaacacattgtgtccttggttcatcatgttaaagagcaatacttcaagtcagctgcaatgaccctaaacgagcggttcacttcgtatcagaaagccactgaagaacatagtactcggcaaaagagccctgaaatacacaggagaattgacatctcaccaagtaccctgaggaagcatacccgtttagcaggggaagagagagtttttaaagaagaaaatcaaaagggagataaaaaattaaggtgtgactctgctgaccttcggcatgacattgatcgccgtagaaaagaaagaagtaaagaacggggagattccaagggctccagggaatccagtggatcaagaaagcaggaaaaaactccaaaagattacaaggaatacaaatcttacaaagatgacagtaaacataaaagagagcaagatcattctcgatcttcatcctcttcagcatcaccttcttctcccagttctcgagaagaaaaggagagtaagaaggaaagagaagaagaatttaaaactcaccatgaaatgaaagaatactcaggctttgcaggagttagccgaccacgaggaacctttcatgacgacagagatgatggtgtggattattgggccaaaagaggaagaggtcgtggtacttttcaacgtggcagagggcgctttaacttcaaaaaatcaggtagcagtcctaaatggactcatgacaaataccaaggggatgggattgttgaagatgaagaagagaccatggaaaataatgaagaaaagaaggacagacgcaaggaagaaaaggaataataaatatgaagtaagattacaacagagcagaacttgcacccaccattttttttacctgatttttgttttcaaataagaatgtaagcattttacttaaattttactgtttgcaagtagtctatagaaattttgttttaagtcttcaaatatcttgagaaatagtagactgtatgttgaaaattgtactgaaataaagtagaaaattgttacgtaccatatttgtaactatcaacttttaaaacttttaacgtttttgttacatgcattgtaattctgctttgtctataagatatggtcaagtacagctctgtgaaagttctgattctcttccttccctgtttgtcaatgttttattctgaagtaaacgttagctctacatataaatcctggaacagaaattgtttatagagactacactaattattttaactgtatacatctgtttaatttgaacacactacatcgtagggtgactgatttttgaagtataccacagacaaaaagttgttactatggtaaactaagctagtttaacacttgagcaaatgcttaagaaggaattaaaaaaaaaaagctttgccaatagctaaaaagtacaagctattaaaaatcagattgaaaagttttgagaaaatgttatttttactgaaagcaagcagtggcctataaagaacattcttaggagccttttctatttgcgttcaaaactgtgtgttctctttctattcctatttgatagtttgagtcatggtcttagatattagctatttgtgagaggaaactggtttgtaacaatactgcaaatagaaaccccatttctactgaacatcctagttttaaacagaagaaaaactgtaatcctggggttggtatgtaggaggtctatcctgcagaataagttgatacattagtacctgatttcatatcttacatatttatttgagctgaacattagtttgtagtgtaactattagtaaaaatagagaaacacagcatactgttcattaatagtattttaaaaaaattgtttttcaaatgtcaccaataaaagttttggcagga

SEQ ID NO: 315155 - DNA, 1822 bp, Homo sapiens
aactaggatgttcagtagaaatggggtttctatttgcagtatgttacaaaccagtttcctctcacaaatagctaatatctaagaccatgactcaaactatgcaaatagaaaccccatttctactgaacatcctagttttaaacagaagaaaaactgtaatcctggggttggtatgtaggaggtctatcctgcagaataagttgatacattagtacctgatttcatatcttacatatttatttgagctgaacattagtttgtagtgtaactattagtaaaaatagagaaacacagcatactgttcattaatagtattttaaaaaaattgtttttcaaatgtcaccaataaaagttttggcaggaagcttgttgcggcattgatctaacctttttcccccccatttcagttgcagtttttgtagaatggctttttctttttcctcttaagagttctattcttcaggtagataatttttcaaatgtgaattatcttttgtgtctatattgatagctcttaaaggagtgaaaatctaaaatagtaaatttcaatgttaagtgtctgctttatgggcatatataaaagtagacacatttcatttgttaatttagttgtgtgtgtgtgttaaaaggagctaatgcttattctgttaatgtaaacttttgaagatcttaagtgtattgctctttcatcttaaacactttcgaggatttgcagtgcgtctagcacctagattacagccaggaacattggttaagaactgttggaaacaaaactaaaagcaaactcaacatatgtgatgtttatggccctcagatccttagtattgtgtgattttcccccgttaacatgtctttctaaaattgtctattaaagcagaggaaatacctgccaaaggaagtatgtattgcattaatcagggcataactaatattctcctgttcagaataatacttatttacgtgtgaaagcaacatggatgtgattcccaacacagaattttcatgacccttttattgtatacaaataaataccataacagttacttggttagacatcaaatctgtgtgcatgactatgtgcttatccacttaagacaataggtaaaaggggatctgagaaattatgtaatagggagtgggaataaaactacttaattcctgtgggcaggttatattttaagttcaaatgcattgctttaacctttggttacttttattctgttaaacagaattgaagaaagagtattataccagagtgtagtaggctagggtgattgtaagaactctgtaatagaatgtcattgtggatgttacctttttcagatccaagcatataaaaagcctgtatattttttaaaaacacatcttaactccacgctttacgatattataaaagttgaatggttcctcttggtaaggatatttgcttacaagtgctaggaaataactcactgatacctgcgttaacatactttgttttgcctagagaggggcaataaaaatgaaccaaaggatatttccagaaaggattaagaaagctgtttaagaaggccatgactctttaggtgtgtatgtgtacctttcagcatcctaggaatttttatactaaaagcaaaatgttttttccagttagtcttcttcaaggaattactattgttccttttgtcacaggtaaaatcagtgttgggaattataatttgagaaaaatattacccagtaacattgaatgtagatggctaaacgattcttactcagtgtgatgtataatgatgcaacagggacccttgtaaattgtcatacgccaataaaatgtcacaagtaa
